United States Patent 8,541,208 (PROCESS FOR THE PRODUCTION OF FINE CHEMICALS) - sequence listing, part 13

SEQ ID NO: 65494 - DNA, 984 bp, Silicibacter sp. TM1040
  CDS (1)..(984)
atggccaatgtgctggtcacaggaggggcgggctacattggctcgcacgcatgtaaagctctgaaacaggcaggctatacgccagtcacatatgacaatctggtcacgggctggcaggatgcggtgaagttcggccccttcgaacaaggcgatctgaccgaccggggccgccttgatgaggtgtttgcacaatataaacctgtggccgtgatgcattttgcagccctgagccaggtgggcgaggcgatgtccgagccgggacggtattgggcgaacaatgttggcggctcgctctgcctgattgaggcagccgtggcggcagggtgtctggatttcgtcttttcgtccacctgcgcgacatatggcgagcacgacaatgtggttctggacgagaatactccgcagcagcctttaaatgcctatggtgcgtccaagcgggcggtcgaggatatcttgaaagacttcgaagccgcgcatggcctgcgcagcgtgatctttcggtatttcaatgtcgcgggcgcagatcctgaggccgaggtgggagagttccaccagcctgaaacccatttggtgccactgatgattcaggcgatcaaaggcgagcgggcggcgcttactgtgtttgggaccgactatgacaccccagatggcacctgcattcgcgactatgtccatgtctgcgatttggtggatgctcatatccttggcctgaaatggcttgaggatggcaaaggcagccgcgtgttcaaccttggcaccggcaccgggttttccgtcaaggaagtgctgtcgcattctcatgccgtaacgaataccgaagtgccgcatgtcatcggcccgcgccgtgcgggcgactgtaccaagctggtgtccggctcggtgcgcgccggagaggaactgggctgggagccgaagcgctccaccatggaccagatgatctctgacgcatggcgctggcaccaaagcggccactacgagcgctga

SEQ ID NO: 65495 - protein, 327 aa, Silicibacter sp. TM1040
MANVLVTGGAGYIGSHACKALKQAGYTPVTYDNLVTGWQDAVKFGPFEQGDLTDRGRLDEVFAQYKPVAVMHFAALSQVGEAMSEPGRYWANNVGGSLCLIEAAVAAGCLDFVFSSTCATYGEHDNVVLDENTPQQPLNAYGASKRAVEDILKDFEAAHGLRSVIFRYFNVAGADPEAEVGEFHQPETHLVPLMIQAIKGERAALTVFGTDYDTPDGTCIRDYVHVCDLVDAHILGLKWLEDGKGSRVFNLGTGTGFSVKEVLSHSHAVTNTEVPHVIGPRRAGDCTKLVSGSVRAGEELGWEPKRSTMDQMISDAWRWHQSGHYER

SEQ ID NO: 65496 - DNA, 939 bp, Azotobacter vinelandii
  CDS (1)..(939)
atgtctgatctgcccgttctggtgaccggtggcgccggcttcatcggttcgcatctggtcgatgcgttgctcgccaggggctactccgtgcgtgtgctggacaacctgtccagcggcaagccggacaatctgccgcttggccattcccgactcgagctgatcgaggggaatgtcgccgatgctgtccgggtacgcgaagtcatggccggttgcggagctgtggtccacctggccgccgtggcttcggtgcaggcctcggtgatcgacccggtgggcactcaccgcagcaatttcatcggtaccctgaacgtctgcgaagcgatgcgcgagcagggcctccggcgcgtgctgttcgcctccagcgcggctgtctacggcaacaatggagaaggcgaggtgatcgacgaggacacgccgaaagcaccgctcactccttatgcggcggacaagctggccagcgagcactacctcgacttctatcgccgccagcatgggctggagccggcgatcttccgtttcttcaacatctacggaccgcgacaggacccttcgtcaccctattcgggggtgatcagcatcttcaccgagcgcgccgcgaaaggtctgcccatcaccctgttcggcgatggcgagcagactcgcgatttcgtctatatcgccgatctcatcgggattctgctgcaggctctggaggcgccgcagattctgccgggtgcggtgaacgtcggcttgaatcgcagcctcagcctgaaccggctgctcgaggagatttcggcattgttcggtggcttgccggaggtgcgccgggaggctgcgcggccaggcgacattcgccattcgcaagcgagcgaccggcgcctgcgggaacgctatcgattgcccgagccgacgccgatggctgccggcctggccagtttgctgggatcggctcggtcctga

SEQ ID NO: 65497 - protein, 312 aa, Azotobacter vinelandii
MSDLPVLVTGGAGFIGSHLVDALLARGYSVRVLDNLSSGKPDNLPLGHSRLELIEGNVADAVRVREVMAGCGAVVHLAAVASVQASVIDPVGTHRSNFIGTLNVCEAMREQGLRRVLFASSAAVYGNNGEGEVIDEDTPKAPLTPYAADKLASEHYLDFYRRQHGLEPAIFRFFNIYGPRQDPSSPYSGVISIFTERAAKGLPITLFGDGEQTRDFVYIADLIGILLQALEAPQILPGAVNVGLNRSLSLNRLLEEISALFGGLPEVRREAARPGDIRHSQASDRRLRERYRLPEPTPMAAGLASLLGSARS

SEQ ID NO: 65498 - DNA, 1011 bp, Anabaena variabilis ATCC 29413
  CDS (1)..(1011)
atgaatcaaaaagttttagttaccggtggtgctggctacattggttctcatgtggtgcgtcagctaggtgaagcaggttacgatgttgttgtgtatgacaactgttctactggtttaccccaagccgtactacatggtgagctaattatcggcgatttaaaaaattccgaatgtctttcccaagtatttcatcaacatcaatttgcggcagttttacacttcgcggctagtctgagcgtaccagaatctgttgcccgtcccctggactactacgctaacaacacacgcaacaccctcaatttacttcgctgttgtcacgaaactggtgttaaccaaattatcttttccagcacagccgcagtttatggacaaccggaaactgccgttgtcaccgaatctacaccaactgaaccgattaatccctatggacgctcaaaactttcttgtgaatggttgattcgtgaccacgccaaggcttctgatctacgctatgtcattctacgttactttaatgttgctggagccgagcctggtgggcgattgggacagatgtcaaaagacgcatcccatttaattcgtgtcacttgtgatgctgcacttaaacgcagactgggagtaaaaatttttggtacagattttcccacaccagacggaacggcaattagagactacattcatgtagaagacctcgcaacagcacatttagacgctttagcttatttagagcaaggtaatgccagccaaatccttaactgtggttatggacagggctatagtgttcgtcaagttatcgagcgggttaaggcaatttctggcgtagattttccggtgatagaagcggaacgtcgttctggtgatccggtttgtgtgacagcttgtagtgataaaatccgtcacgtactaggatggcaacctaagtatgatgatatgaatcagataattcatagtaccctcacctgggaaataagtaaacaagaattgttcctcaattcattagctggagttgcataa

SEQ ID NO: 65499 - protein, 336 aa, Anabaena variabilis ATCC 29413
MNQKVLVTGGAGYIGSHVVRQLGEAGYDVVVYDNCSTGLPQAVLHGELIIGDLKNSECLSQVFHQHQFAAVLHFAASLSVPESVARPLDYYANNTRNTLNLLRCCHETGVNQIIFSSTAAVYGQPETAVVTESTPTEPINPYGRSKLSCEWLIRDHAKASDLRYVILRYFNVAGAEPGGRLGQMSKDASHLIRVTCDAALKRRLGVKIFGTDFPTPDGTAIRDYIHVEDLATAHLDALAYLEQGNASQILNCGYGQGYSVRQVIERVKAISGVDFPVIEAERRSGDPVCVTACSDKIRHVLGWQPKYDDMNQIIHSTLTWEISKQELFLNSLAGVA

SEQ ID NO: 65500 - DNA, 2166 bp, Kineococcus radiotolerans SRS30216
  CDS (1)..(2166)
atgctcggcggcggtgacgaacaccgcctccccccgggcgaggtcctgcgcgccggtggcggagaccagccgcaccgacccctccagcgccagcaccgcccgcgggaccgcccgctcccagcgggtctcctccccgggcacgacggtcagctccgtcagggcgaagtcgtcgacgtcgccgggggcgaatacccgctggtgctcggagaggacgcggggggcgagcagcggcggcggcaggacccggaagtcgaggacgtcgagcagctcggcgacgtcgacgtgcttgggggtcaggcccccgcgcaggacgttgtcggagctggccatgagctccacccccgtgcccgccaggtaggcgtggacgttgccggcgggcaggtacagcgcctcccccggggcgaggcgcacctggttcagcagcgtcgacaccaggacgcccgggtcccccgggtggtgcccggacagctccacgacgcagcgcgcggaggggtcctcggaggcggtgcacgcctgggccaccgcctcgaccagcgggcccaccgcccccgcctcggccgtcagcagcagccgggtcgccccccgcagggcctcgccctcgtcgggcccggcgaggacgtccagcagcgcggcgaagaggtcccgggagcccggcggcagcgccggcagctccaggccggcgagcaggtcccgcgcggcggcgggggcgcggaacccggccatcgccgcgaacggctccagggcgaggaggagctcgggcttgtgctcggtgtccttgtagaggcggtgcgcggcgtcgcggggggtcccggcggcctcctcctcggcgtagcggcgcgcggcggtctcccggtcggggtgggcctgcagcgacagcggcgccgcggccgagaggaccttcagcaggaaccccagccgggccccgccccccgcgtccgcccccccgtcgcccaggaactcctccggggccgcggcgatccgctcgtccagacccaccccctcggcgtcggagggggcccccgggtgcgccccgatccacagctcggcctggggcccgccgtccggctcgacgcccagcagctcggggatggcgctggtcgaaccccacgcgtagggctgaacggtgttggtcagtctcagcacacgggtgaggctacggccggggcggcggcgggggcggtgcggctggctacagtcgcccccatgagcgttctcgtgacgggcggtgccggctacatcggatcccacgtggtgcggctgctgcagcagcgcggggagcgcgtcgtcgtcgtcgacgacctctccaacggccgcgcgcagcgcgtcggcgacgccccggtggtgcaggtcgacctcggcaccgacgcggccgcgggcgccctggcgagcgcgttcgccgagcacgacgtggacgccgtcatccacttcgcggcccgcaagcaggtcggggagtccgtcgcgaagcccgcccgctactgggcgcagaacgtcggcggcacggcgaacctgctgcaggcgatggaggacgccggggtcggcaagctcgtgttctcctcctccgcggccacctacggcgccccggcgacggccctggtgcgcgaggacggccccgcggagccgatcaacccctacgggcagacgaagctcgtcggggagtggatgagccgcgccgccggggtcgcctggggcctgcgcgcggcgaacctgcgctacttcaacgtcgccggcgccggctggagcgacctcggcgacgcggcggtgatgaacctcatccccatcgtcttccgcgccctggacgaggggcgcgcgccggtggtgttcggcgacgactacccgaccccggacggctcctgcatccgcgactacgtccacgtcctggacctcgcccgggcccacctcgccgcgctggaccacctcgccgccgacgagcgccccttcgacacgttcaacgtcggctccggctccggctcctccgtcttcgaggtgctgcgggtggtccgcgaggtcaccggcgtcgacgtgcagcccgacgtccgcgagcgccgcgcgggcgacccgccgcagctggtggccgacgtgtcgcgcatcaacgacaccctgggctggtccacgacgaaggacctcaccgacatcgtcgccagcgcctgggaggcgtggcgcgcctga

SEQ ID NO: 65501 - protein, 721 aa, Kineococcus radiotolerans SRS30216
MLGGGDEHRLPPGEVLRAGGGDQPHRPLQRQHRPRDRPLPAGLLPGHDGQLRQGEVVDVAGGEYPLVLGEDAGGEQRRRQDPEVEDVEQLGDVDVLGGQAPAQDVVGAGHELHPRARQVGVDVAGGQVQRLPRGEAHLVQQRRHQDARVPRVVPGQLHDAARGGVLGGGARLGHRLDQRAHRPRLGRQQQPGRPPQGLALVGPGEDVQQRGEEVPGARRQRRQLQAGEQVPRGGGGAEPGHRRERLQGEEELGLVLGVLVEAVRGVAGGPGGLLLGVAARGGLPVGVGLQRQRRRGREDLQQEPQPGPAPRVRPPVAQELLRGRGDPLVQTHPLGVGGGPRVRPDPQLGLGPAVRLDAQQLGDGAGRTPRVGLNGVGQSQHTGEATAGAAAGAVRLATVAPMSVLVTGGAGYIGSHVVRLLQQRGERVVVVDDLSNGRAQRVGDAPVVQVDLGTDAAAGALASAFAEHDVDAVIHFAARKQVGESVAKPARYWAQNVGGTANLLQAMEDAGVGKLVFSSSAATYGAPATALVREDGPAEPINPYGQTKLVGEWMSRAAGVAWGLRAANLRYFNVAGAGWSDLGDAAVMNLIPIVFRALDEGRAPVVFGDDYPTPDGSCIRDYVHVLDLARAHLAALDHLAADERPFDTFNVGSGSGSSVFEVLRVVREVTGVDVQPDVRERRAGDPPQLVADVSRINDTLGWSTTKDLTDIVASAWEAWRA

SEQ ID NO: 65502 - DNA, 1110 bp, Polaromonas sp. JS666
  CDS (1)..(1110)
atgaccgcatacgaacaactccagattcgcctgaagagcgagccccgtgcctggctcgtcactggggttgccggctttattggcagcaatctgctggaagctctgctcaagctgggccagcgcgtggtcggactggacaactttgccaccggctaccagcgcaacctggacgaagtgcaaacgctggtctctcctgagcagtgggccaatttccacttcattgagggcgacatccgtaacctgcccgattgccagcgtgccatgtcttggccccctctccccacggaagacggtaggggtgagggctctcccgtcgactacgtccttcaccaggcagccctgggcagcgtgccccggtcactggccgatcccatcaccaccaacgccgccaacatcacgggtttcctgaacatgctggtggccgcacgcgacgccggggtcaaaagctttacctacgccgccagcagcagcacctacggggatcacccggctctgcccaaggtagagcacaccatcggcaaaccgctcagcccctatgcggtgaccaaatatgtgaacgagctgtatgccgaggtatttgcccgctgctacggctttaacaccataggtttgcgctacttcaatgtgtttggtgcacggcaaaatcccagtggggcctatgccgctgtgatcccgaaatggaccgcagcgatgatgaaaggggaagacgtgttcatcaacggcgatggtgaaaccagccgggacttctgctacgtggccaacgcggtgcaagccaacctgttggcggcgaccgtgagtgatctccctctccccctggaagagggcgggggtgagggctctcctaccaaccaggtgtacaacgtggccgtgggtgatcgcactacgctgaacaccctgtttggcctgatacgtgacaacttgattgcacgtggcgtgcctgtcagtaccgagcccaagtatcgggatttccgtgcgggcgacgtgcgtaacagcctggccgacatcggcaaggcccatcggatgctgggttacgcccctacccatcgcatagaccagggattgcagttggcgattccttggtatgtccagaactgcaaggtttcatcatga

SEQ ID NO: 65503 - protein, 369 aa, Polaromonas sp. JS666
MTAYEQLQIRLKSEPRAWLVTGVAGFIGSNLLEALLKLGQRVVGLDNFATGYQRNLDEVQTLVSPEQWANFHFIEGDIRNLPDCQRAMSWPPLPTEDGRGEGSPVDYVLHQAALGSVPRSLADPITTNAANITGFLNMLVAARDAGVKSFTYAASSSTYGDHPALPKVEHTIGKPLSPYAVTKYVNELYAEVFARCYGFNTIGLRYFNVFGARQNPSGAYAAVIPKWTAAMMKGEDVFINGDGETSRDFCYVANAVQANLLAATVSDLPLPLEEGGGEGSPTNQVYNVAVGDRTTLNTLFGLIRDNLIARGVPVSTEPKYRDFRAGDVRNSLADIGKAHRMLGYAPTHRIDQGLQLAIPWYVQNCKVSS

SEQ ID NO: 65504 - DNA, 1008 bp, Polaromonas sp. JS666
  CDS (1)..(1008)
atgaaaatcgtagtgaccggcgccgccggcttcatcggcagcaacctcgtgaagggactcaacgaccgcggcatcgacgacatcatcgccgtcgacgacctgacccacggcgacaagtttcgcaacctggcagacctgcagattgccgactacatcgatgccgacgacttttatgacctgtttgccgaaggcgcttttggccaggtagaagcggtgttccacgaaggcgcctgcagcgacaccatggagcttgacggcaagtacatgatggacaacaactacacgctgtcctgcgagctgtttcatgcctgccaggagcagggcacacgcctgctgtatgcctcgtcggccgccacctatggcggctccgataccttcagcgagtcacccgagttcgagcgcccgctcaacgtctatggctactccaagctgctgtttgaccagcggatgcggcgtgagctcggtgcccggtttgaaaacgccgccacgcaggtggccggcttccggtactttaacgtctacggcccgcgcgagcagcacaagggccgcatggccagcgtcgcctttcaccagttcaaccagttccaggcagaaggcaaggtcaagctgtttggagactacggcggttaccaggccggcggacagatgcgcgactttgtgttcatcgatgacgtggtggcagtcaatctctggtttctggatcacccggagaagtccggcattttcaacctgggtaccggaagggcgcagcccttcaacgatgtggccctggccgtcgtcaacaccctgcgccagagccaaaacgctgcagccatgagcctcgaagacgcggtgcgcggcgggctgattgactacatcaccttcccccccgcgctggtgggcaagtaccagagctatacccaggccgacttgcaagccctgcgcgcggccggctgccagcatgcctttgccgatgtgcagaccggtgtggcggcttacatgcagtggctggcgagtgcaaagatctag

SEQ ID NO: 65505 - protein, 335 aa, Polaromonas sp. JS666
MKIVVTGAAGFIGSNLVKGLNDRGIDDIIAVDDLTHGDKFRNLADLQIADYIDADDFYDLFAEGAFGQVEAVFHEGACSDTMELDGKYMMDNNYTLSCELFHACQEQGTRLLYASSAATYGGSDTFSESPEFERPLNVYGYSKLLFDQRMRRELGARFENAATQVAGFRYFNVYGPREQHKGRMASVAFHQFNQFQAEGKVKLFGDYGGYQAGGQMRDFVFIDDVVAVNLWFLDHPEKSGIFNLGTGRAQPFNDVALAVVNTLRQSQNAAAMSLEDAVRGGLIDYITFPPALVGKYQSYTQADLQALRAAGCQHAFADVQTGVAAYMQWLASAKI

SEQ ID NO: 65506 - DNA, 987 bp, Campylobacter lari RM2100
  CDS (1)..(987): transl_table=11
atgaaaattttaatcaccggtggcgcaggatacataggctctcatactttaaaacaatttttagaaaccaatcatgaaatttgtgtattagataatctttcaaaaggtagcaaaaaaagtttagatgaactttctaaaatcagaccttttaagttttttgagcaagatttaagcgattatgctgggattaaaaaacttttcaaagaagaaaaatttgatgcgattgtgcattttgcagctagcattgaagttcctgaaagtatggaaaatcctttaaaatactatatgaacaataccgcaaacacaagtaatctaatccaaacttgtttagaaacaggtgtgaaaaaattcattttttcttcaaccgcagctacttatggagaaccacaaactcctattgtagatgaacaaagtccattagcaccgattaatccttatggacaaagcaaactaatgagtgaaaaagtcttgcaagatgctaatatggctaatcctgaatttaaatactgcattttaagatactttaatgtagcaggtgcttgcatgagctatcctataggacaacgctatccaaaagctactttacttatcaaggtagctgctgaagtagctacaggaaaaagagaaaaactttatatttttggcgatgattataataccaaagatggtacttgtattagagattttatccatgttgatgatatttcaagtgcgcatttggctgctttagaatacttagaaaacaatgaaagcaatattttcaatgtaggctatgggcatggttttagcgtaaaagaagttattgaaactatgaaaaaagtaagtggagtagatttcacagtagaacttgcaccaaaaagagctggggatccttctgtgcttatttcaaatgcggataaaatcaaaaccctaaccaactggaaaccaaaatatgataatttggaattaatctgcaaaagtgcttatgagtgggaaaaacagtgttaa

SEQ ID NO: 65507 - protein, 328 aa, Campylobacter lari RM2100
MKILITGGAGYIGSHTLKQFLETNHEICVLDNLSKGSKKSLDELSKIRPFKFFEQDLSDYAGIKKLFKEEKFDAIVHFAASIEVPESMENPLKYYMNNTANTSNLIQTCLETGVKKFIFSSTAATYGEPQTPIVDEQSPLAPINPYGQSKLMSEKVLQDANMANPEFKYCILRYFNVAGACMSYPIGQRYPKATLLIKVAAEVATGKREKLYIFGDDYNTKDGTCIRDFIHVDDISSAHLAALEYLENNESNIFNVGYGHGFSVKEVIETMKKVSGVDFTVELAPKRAGDPSVLISNADKIKTLTNWKPKYDNLELICKSAYEWEKQC

SEQ ID NO: 65508 - DNA, 954 bp, Campylobacter lari RM2100
  CDS (1)..(954): transl_table=11
atgaaaattgtgataacaggtggagcaggttttataggctctgcgcttgctttggaacttcaagataaacatgaagttttgattgtagataaaatgcgatcaagtgctacttttgaaaatggaaatttagaaagctttggtcattttaaaaatattttagattttgaaggtgagctttatgtgggtgatattaatgatgaaaaaactttaaaagttataaaagattttaaacccgatgtgatctttcataaggctgcaatttcagatacaactgtttatgatcaaaacaaagttttaaagactaatttaaacacttttaaagattttctagaacttgctttggagcttaatgcaaaattaatctatgcaagctcagcttcagtttatggagatgctccaagcccacaaaccgtaaatttaagtgaagcccctaaaaacccttacgcattttcaaaactaatgatggataaattagcaaaaaaatactttgataaaatgcatatagttgggcttagatattttaatgtatatggcaagggagaattttttaaaaatagcaccgcttctatgattttgcaatttggacatcaaattttagcgggtaaaaatccgcgtttgtttgaaggaagcgatcaaatttatcgtgattttgtatatattaaagatgttgtgagtgcaaatttgcaagctttagaagcaaaaagtggaatttataatgtagctacaggcaaagcaagaacttttcaggatatagttgatattttacaaaaagaattaaacactaattatccttgtgagtatattcctaatccttataaaaatgcttatcaattttatactcaagcaaaattagatgagagtttttcatataaagctcaatttagtcttgaagagggaataaaagattatttagatgagattaaaaggctttatgaaaaggaagtaaatgcttga

SEQ ID NO: 65509 - protein, 317 aa, Campylobacter lari RM2100
MKIVITGGAGFIGSALALELQDKHEVLIVDKMRSSATFENGNLESFGHFKNILDFEGELYVGDINDEKTLKVIKDFKPDVIFHKAAISDTTVYDQNKVLKTNLNTFKDFLELALELNAKLIYASSASVYGDAPSPQTVNLSEAPKNPYAFSKLMMDKLAKKYFDKMHIVGLRYFNVYGKGEFFKNSTASMILQFGHQILAGKNPRLFEGSDQIYRDFVYIKDVVSANLQALEAKSGIYNVATGKARTFQDIVDILQKELNTNYPCEYIPNPYKNAYQFYTQAKLDESFSYKAQFSLEEGIKDYLDEIKRLYEKEVNA

SEQ ID NO: 65510 - DNA, 993 bp, Helicobacter pylori
  CDS (1)..(993): transl_table=11
atgcgttatattgatgatggattagaaaatcaaacgattttaatcaccggtggggctggctttgatggcagtaatctggccttttattttcaagagaaccaccctaaagctaaagtaatcattttagataagtttcgcagtaacacgcttttcagtaataaccgccccagttctttagggcattttaagaatttaatcggttttaagggtgaggtgattgcagctgatattaataaccccttagatttaaggcgtttagaaaaattgcattttgattatttattccaccaagcggctgtttctgatacgaccatgctggatcaagaattagtgatgaaaaccaattatcaggcttttttaaaccttttagaaatcgctcgatcaaaaaaggctaaagtgatttacgcttcttcagcgggtgtttatggcaacaccaaagcccccaatgtggtaggctcaaacgaaagccctgaaaacgtttatggcttttcccagctttgcatggacgaatttgtccgattccattcaaacgacaatattcaagtgggcttaaggtattttaatgtctatgggcctagggaattttataaagaaaaaaccgcttccatggttttgcagctcgctttaagtgcaatggcgtttaaggaagtcaagctttttgaatttggcgaacaattaagggattttgtctatattgaagatgtgatccaagcgaatgtgaaagcgatgaaggctcaaaaaagcggggtttataatgtgggttattcgcaagccagaagttataatgaaatcgttggcattttaaaagagcatttaggggattttaaagtgagctatatcaaaaacccttacgcttttttccaaaagcacacccaagcgcacattgagcctgctattttggatttggattacacccctttatacgatttggaaagcggtattaaagattatttgccccatatccatgcgatttttaaagaacagcacgcatga

SEQ ID NO: 65511 - protein, 330 aa, Helicobacter pylori
MRYIDDGLENQTILITGGAGFDGSNLAFYFQENHPKAKVIILDKFRSNTLFSNNRPSSLGHFKNLIGFKGEVIAADINNPLDLRRLEKLHFDYLFHQAAVSDTTMLDQELVMKTNYQAFLNLLEIARSKKAKVIYASSAGVYGNTKAPNVVGSNESPENVYGFSQLCMDEFVRFHSNDNIQVGLRYFNVYGPREFYKEKTASMVLQLALSAMAFKEVKLFEFGEQLRDFVYIEDVIQANVKAMKAQKSGVYNVGYSQARSYNEIVGILKEHLGDFKVSYIKNPYAFFQKHTQAHIEPAILDLDYTPLYDLESGIKDYLPHIHAIFKEQHA

SEQ ID NO: 65512 - DNA, 1035 bp, Helicobacter pylori
  CDS (1)..(1035): n means a or g or c or t/u
atggcattattattcacaggggcgtgcgggtatataggctcgcataccgcaagggcgtttttagaaaaaaccaaagaaaacatcattattatagatgacttaagcaccggctttttagagcatatcaaagcgttagagcgttactaccctaatagggttgcgtttattcaagcgaatttgaatgaaacgcaaaaattagacacctttttaaataagcaacagctaaaagatcccattgaagctgtcttgcattttggggctaaaatctcagtagaagaatccacgcgcttgcctttagaatantacaccaacaacacgctcaacactttagagcttgtcaaactttgcttaaaacatgcaatcaagcgttttattttttctttctacggccgtggtttatggcgagtctgttcaagcttgagtgaagaaagccccttaaaccccattaatccttatggagcgtctaaaatgatgagcgaaaggattttgttagacatttctaaagtagcggattttaattgcgttatcttgcgctatttcaatgtggctggggcatgcatgcacaatgattataccaccccctacactttggggcagcgcacgcttaacgccacgcatttgatcaaaatcgcatgcgaatgcgcggtgggtaaaaggaaaaaaatggggatttttggcactaactaccccactagagatggcacttgcattagggattatatccatgtanatgatttggctaacgcgcatttagcgagctatcacactcttttagaaaaaaataagagcgagatctataatgttggctacaatcaaggccatagcgtgaaagaagtgatagaaaaggttaaagaaatctcaaataaggattttttagtggaaattttagacaaacgacagggcgatccagcaagccttattgctaataattctaaaatcttacaaaatacccctttcaaacccctttataacaacttagacaccattatcaaaagcgctctagattgggaagaacaccttttgaaatttcaataa

SEQ ID NO: 65513 - protein, 344 aa, Helicobacter pylori
  misc_feature (101)..(101): Xaa can be any amino acid
  misc_feature (244)..(244): Xaa can be Asn or Asp or His or Tyr
MALLFTGACGYIGSHTARAFLEKTKENIIIIDDLSTGFLEHIKALERYYPNRVAFIQANLNETQKLDTFLNKQQLKDPIEAVLHFGAKISVEESTRLPLEXYTNNTLNTLELVKLCLKHAIKRFIFSFYGRGLWRVCSSLSEESPLNPINPYGASKMMSERILLDISKVADFNCVILRYFNVAGACMHNDYTTPYTLGQRTLNATHLIKIACECAVGKRKKMGIFGTNYPTRDGTCIRDYIHVXDLANAHLASYHTLLEKNKSEIYNVGYNQGHSVKEVIEKVKEISNKDFLVEILDKRQGDPASLIANNSKILQNTPFKPLYNNLDTIIKSALDWEEHLLKFQ

SEQ ID NO: 65514 - DNA, 1128 bp, Arabidopsis thaliana
  CDS (1)..(1128)
atggggaagattgttttggtcatgacacttacagcaatgtgcattctcttgctcaaccaatccccaaccttcaataccccaagcgtgttttctcgaagtgaaccaggagttacacatgttctagtcactggtggtgcagggtatatcgggtcacatgcagctttacgccttctaaaagattcataccgtgtcaccattgtggacaatctatctcgagggaacctcggtgcagtcaagatcttgcaacaactgtttccggaacctggaaagcttcaattcatttatgctgatcttggagatgcaaatgctgttaacaaaatattttctgaaaacgcatttgacgctgtgatgcattttgctgctgttgcttattattatcacaatatcacatcgaacacattggtagttttagagacaatggctgctcatggtgtgaagactttgatatattcaagcacatgtgctacttatggagagcctgagaaaatgccaataacagaggaaactccacaggttccaatcaatccatatggaaaggctaaaaagatggcagaagatatcatcttggatttctccaagaattctattatggcagttatgatcctaagatatttcaatgtgattgggtctgatcctgagggtagactaggtgaagctccaagacctgaactcagtgagcatggacggatctctggtgcttgctttgatgctgcacgaggcatcattcccgggctgcagattaaaggaacagactacaagactgttgatgggacttgtgtacgtgattacattgatgtcaccgacttggttgatgctcatgttaaagctcttgaaaaggcgaaaccccgcaaagttggtatcttcaatgttggtaccgggaaaggtagctcggtgaaggagtttgtggaagcgtgcaaaaaggcgaccggcgttgatataaaagtcgattacttggaaagacgggcaggagattacgcagaggtttacagcgatccaagaaaaatcaaagaagagctgaattggacagctaagcacaccaatcttcaagaaagtttaaagatggcatggagatggcaaaagcttcatcgcagtggctatggatcttcttccttggtttctgcatactga

SEQ ID NO: 65515 - protein, 375 aa, Arabidopsis thaliana
MGKIVLVMTLTAMCILLLNQSPTFNTPSVFSRSEPGVTHVLVTGGAGYIGSHAALRLLKDSYRVTIVDNLSRGNLGAVKILQQLFPEPGKLQFIYADLGDANAVNKIFSENAFDAVMHFAAVAYYYHNITSNTLVVLETMAAHGVKTLIYSSTCATYGEPEKMPITEETPQVPINPYGKAKKMAEDIILDFSKNSIMAVMILRYFNVIGSDPEGRLGEAPRPELSEHGRISGACFDAARGIIPGLQIKGTDYKTVDGTCVRDYIDVTDLVDAHVKALEKAKPRKVGIFNVGTGKGSSVKEFVEACKKATGVDIKVDYLERRAGDYAEVYSDPRKIKEELNWTAKHTNLQESLKMAWRWQKLHRSGYGSSSLVSAY

SEQ ID NO: 65516 - DNA, 1005 bp, Vibrio vulnificus
  CDS (1)..(1005): transl_table=11
atgaaatacttagtaactggtgctgctggttttattggcagtgcgacggcagagaaacttaatgctgcagggcatgaagttgtgggcatcgataatctaaatgattactacgatgtgaatttaaaacatgcgcggcttgctcgtattgaaaatccactgttcaaatttgtaagcgtagatatttcagatcgtggagcgatggagcagttgtttgccaccgagaagtttgatcgtgtgatccacttggctgcccaagctggtgtacgttattcactagaaaacccacatgcttatgcggattcaaatttggttggacatctcaatattcttgagggctgtcgtcaaaacaaagtaagccatctagtatatgcatcttcgagctctgtatatggactaaatgcaaaagtgcccttttcaacttcggatagtgttgaccatccggtgtcgctttatgctccaaccaagaagtctaacgaacttatggctcatagctattcccatctttacgacattccaacaacggggttacgcttttttacggtgtatggctcttgggggcgtccggacatggccccatttattttcactaagaaaattcttgatggtgatgcaattgatatcaacaacaatggtgatatgtggagagacttcacccatgtagatgatattgttgaaggtgtagttcgcattgctgatgtcatcccaacccgaaatgaatcttggactgttgaagcagggacaccagcaacgagctctgcgccatactcggtttataacattggtcatggttctcctatcaatctgatggattttgtgaaagcaattgaaaatgaacttggtattgaagcgaagaaaaacttccgcgaaatgcagcctggggatgtttatcaaacttatgctgatacagaagatttgtttaccgctactggttacaaaccaagagtaacagttaaagaaggcgttgcagagtttgtttcttggtataaagaattctataacaagtaa

SEQ ID NO: 65517 - protein, 334 aa, Vibrio vulnificus
MKYLVTGAAGFIGSATAEKLNAAGHEVVGIDNLNDYYDVNLKHARLARIENPLFKFVSVDISDRGAMEQLFATEKFDRVIHLAAQAGVRYSLENPHAYADSNLVGHLNILEGCRQNKVSHLVYASSSSVYGLNAKVPFSTSDSVDHPVSLYAPTKKSNELMAHSYSHLYDIPTTGLRFFTVYGSWGRPDMAPFIFTKKILDGDAIDINNNGDMWRDFTHVDDIVEGVVRIADVIPTRNESWTVEAGTPATSSAPYSVYNIGHGSPINLMDFVKAIENELGIEAKKNFREMQPGDVYQTYADTEDLFTATGYKPRVTVKEGVAEFVSWYKEFYNK

SEQ ID NO: 65518 - DNA, 987 bp, Campylobacter jejuni
  CDS (1)..(987): transl_table=11
atgaaaattcttattagcggtggtgcaggttatataggttctcatactttaagacaatttttaaaaacagatcatgaaatttgtgttttagataatctttctaagggttctaaaatcgcaatagaagatttgcaaaaaataagaacttttaaattttttgaacaagatttaagtgattttcaaggcgtaaaagcattgtttgagagagaaaaatttgacgctattgtgcattttgcagcgagcattgaagtttttgaaagtatgcaaaaccctttaaagtattatatgaataacactgttaatacgacaaatctcatcgaaacttgtttgcaaactggagtgaataaatttatattttcttcaacggcagccacttatggcgaaccacaaactcccgttgtgagcgaaacaagtcctttagcacctattaatccttatgggcgtagtaagcttatgagcgaagaggttttgcgtgatgcaagtatggcaaatcctgaatttaagcattgtattttaagatattttaatgttgcaggtgcttgcatggattatactttaggacaacgctatccaaaagcgactttgcttataaaagttgcagctgaatgtgccgcagaaaaacgtaataaacttttcatatttggcgatgattatgatacaaaagatggcacttgcataagagattttatccatgtggatgatatttcaagtgcgcatttatcggctttggattatttaaaagagaatgaaagcaatgtttttaatgtaggttatggacatggttttagcgtaaaagaagtgattgaagcgatgaaaaaagttagcggagtggattttaaagtagaacttgccccacgccgtgcgggtgatcctagtgtattgatttctgatgcaagtaaaatcagaaatcttacttcttggcagcctaaatatgatgatttagggcttatttgtaaatctgcttttgattgggaaaaacagtgctaa

SEQ ID NO: 65519 - protein, 328 aa, Campylobacter jejuni
MKILISGGAGYIGSHTLRQFLKTDHEICVLDNLSKGSKIAIEDLQKIRTFKFFEQDLSDFQGVKALFEREKFDAIVHFAASIEVFESMQNPLKYYMNNTVNTTNLIETCLQTGVNKFIFSSTAATYGEPQTPVVSETSPLAPINPYGRSKLMSEEVLRDASMANPEFKHCILRYFNVAGACMDYTLGQRYPKATLLIKVAAECAAEKRNKLFIFGDDYDTKDGTCIRDFIHVDDISSAHLSALDYLKENESNVFNVGYGHGFSVKEVIEAMKKVSGVDFKVELAPRRAGDPSVLISDASKIRNLTSWQPKYDDLGLICKSAFDWEKQC

SEQ ID NO: 65520 - DNA, 1005 bp, Vibrio cholerae
  CDS (1)..(1005): transl_table=11
atgaaatatctagttacaggtgctgctggctttattggtagcgccaccgtaaaaaaattaacagaacaaggccatcatgtggttggcattgataacattaacgactattacgatgttaatctaaaacattccagactggcgcgtattgagcacccgctgtttcattttcttaaagtagatattgctgatcgtgctgccatggcgcagcttttcgaacaagaaaaatttgagcgcgtgattcaccttgccgcgcaggcaggggtacgttattcactcgaaaaccctcatgcgtacgccgattcaaacctagtcggtcatttgaatattcttgaaggttgccgacaaaataaagtgggccatttagtctacgcttcgtccagctcagtgtatggcttaaatgcgaaagtgccctttgcgacttctgactcggtcgatcacccagtttcgttgtatgcggccactaaaaaatctaatgagctaatggcgcacagttattcgcacctttatgatattccgaccacgggtttgcgcttttttactgtgtatggttcttgggggcgtcctgatatggctccatttatctttaccaagaagattttagcgggcgaagccatagatattaataaccatggtgatatgtggcgtgattttacccatgttgacgatattgtggagggcgtagtacgcattgcagatgtgctaccaactcgtaatgcagcttggacggtagaatctggcactccagcgaccagctcagccccttacgcgatttataatatcggccatggctcgccaattaatttaatggaatttgtcaaagcgattgaagaacaactgggcattgaagccaataaaaacttccgatgtatgcagcctggggatgtttatcaaacttacgctgatacggcagacttatttgctgctacaggctataagccgaaagttggagtaagagagggagtgtcggagtttatcgcttggtatagagatttttataatcaataa

SEQ ID NO: 65521 - protein, 334 aa, Vibrio cholerae
MKYLVTGAAGFIGSATVKKLTEQGHHVVGIDNINDYYDVNLKHSRLARIEHPLFHFLKVDIADRAAMAQLFEQEKFERVIHLAAQAGVRYSLENPHAYADSNLVGHLNILEGCRQNKVGHLVYASSSSVYGLNAKVPFATSDSVDHPVSLYAATKKSNELMAHSYSHLYDIPTTGLRFFTVYGSWGRPDMAPFIFTKKILAGEAIDINNHGDMWRDFTHVDDIVEGVVRIADVLPTRNAAWTVESGTPATSSAPYAIYNIGHGSPINLMEFVKAIEEQLGIEANKNFRCMQPGDVYQTYADTADLFAATGYKPKVGVREGVSEFIAWYRDFYNQ

SEQ ID NO: 65522 - DNA, 993 bp, Lactococcus lactis
  CDS (1)..(993): transl_table=11
atggaggttcttatgacggttttagttcttggtggagcaggatacgtgggaagtcacgcggtagatatgcttcttaaacgtggttacgatgtggcagtggtggataatttagtgacaggccaccgtgaatctgttccagcaaatgtacgcttttacgagggtgatgtgcgtgatcatgctttcttagctagtgtttttgaaaaagaaaatattgaaggaatcatgcatttttgtgcttactctttagtgggtgagtcaatgcaaaaacctttaatgtattttaataataatgttggtggtgctcaagtaattctagaaacgatggaagaattcggagtaaaacatattgttttctcaagtacagcagctacatttggaattccagaaaaaagtccaatttcagaaaaaacacctcaaaaaccaattaatccttatggtgaaagcaaattaatcatggaaaaaatgatgaaatggcaatcgcaagcaactgatatgacttatgtcgctttacgttatttcaatgttgcaggggctaaggatgatggttcaattggtgaagctcataaaaatgaaacacatttgattccaattattttgcaaacagcacttggccaaagggaattcattactatttatggtgatgactatcacactcctgatggaacttgtattcgtgattatattgatatggaagatttgattgaagcacacatcaaagcactagagtatcttaaagcgggcggtcagtctgaccaatttaatctcggttcaagtaaaggctattcaaatcttgaagtacttgaaacagcacgaaaagtaacaggtaaagaaattccaagccaaatgggtgaacgccgtgcaggagacccagatgaactagttgctgattcaacaaaagctggtgaaattttgggttggaaagcacaaaatgatttagagcacattattacgaacgcttggaaatggcaccaaagtcatccaaaaggttactag

SEQ ID NO: 65523 - protein, 330 aa, Lactococcus lactis
MEVLMTVLVLGGAGYVGSHAVDMLLKRGYDVAVVDNLVTGHRESVPANVRFYEGDVRDHAFLASVFEKENIEGIMHFCAYSLVGESMQKPLMYFNNNVGGAQVILETMEEFGVKHIVFSSTAATFGIPEKSPISEKTPQKPINPYGESKLIMEKMMKWQSQATDMTYVALRYFNVAGAKDDGSIGEAHKNETHLIPIILQTALGQREFITIYGDDYHTPDGTCIRDYIDMEDLIEAHIKALEYLKAGGQSDQFNLGSSKGYSNLEVLETARKVTGKEIPSQMGERRAGDPDELVADSTKAGEILGWKAQNDLEHIITNAWKWHQSHPKGY

SEQ ID NO: 65524 - DNA, 1026 bp, Shigella sonnei
  CDS (1)..(1026): transl_table=11
atgtctcgctatgaagagattacacagcagttaattttttcaccgaaaacttggttaattactggtgtcgctggctttataggatcaaatcttttagaaaagttacttaaattaaaccaggttgttattgggttagataacttttccacgggacatcaatataatcttgatgaagttaaaacattagtttccactgaacagtggagtcgattttgctttatagaaggtgatattcgagatctcactacctgtgagcaagttatgaaaggtgttgatcatgtcttacatcaggctgcgctaggttctgtacctcgttcaattgttgatcctataacaaccaatgcaactaatattactggatttttgaatatcttacatgcggctaaaaatgcacaagtacaaagttttacttatgctgcatcaagctcaacttatggagatcatcccgcactaccaaaagtagaggaaaacattggtaatccactttctccttatgcagttactaaatatgttaacgagatttatgctcaggtatatgctcgaacatatggtgttaaaactattggattacgttattttaatgtatttggtcgtcgtcaagatcctaatggagcttatgctgcagtaattccaaaatggacagcagcaatgcttaaaggtgatgacgtatatattaatggcgatggtgaaacgagtcgtgatttttgttatatagataatgttatacaaatgaatatattatctgcattagcgaaggacagtgctaaagataatatatataatgttgcagttggtgatagaacaacgttaaatgaattatctggttacatttatgatgagcttaatttaattcaccatatcgataaattgagcattaagtatagagagtttagatctggagatgttaggcattctcaggctgatgttactaaggctatagatttactaaagtatagaccaaatataaaaatcagagagggattacgactttcaatgccgtggtatgtgagatttttaaaaggctaa

SEQ ID NO: 65525 - protein, 341 aa, Shigella sonnei
MSRYEEITQQLIFSPKTWLITGVAGFIGSNLLEKLLKLNQVVIGLDNFSTGHQYNLDEVKTLVSTEQWSRFCFIEGDIRDLTTCEQVMKGVDHVLHQAALGSVPRSIVDPITTNATNITGFLNILHAAKNAQVQSFTYAASSSTYGDHPALPKVEENIGNPLSPYAVTKYVNEIYAQVYARTYGVKTIGLRYFNVFGRRQDPNGAYAAVIPKWTAAMLKGDDVYINGDGETSRDFCYIDNVIQMNILSALAKDSAKDNIYNVAVGDRTTLNELSGYIYDELNLIHHIDKLSIKYREFRSGDVRHSQADVTKAIDLLKYRPNIKIREGLRLSMPWYVRFLKG

SEQ ID NO: 65526 - DNA, 1005 bp, Vibrio cholerae O139
  CDS (1)..(1005): transl_table=11
atgaaatatctagttacaggtgccgctggctttattggtagcgccaccgtaaaaaaattaacagaacaaggccatcatgtggttggcattgataacattaacgactattacgatgttaatctaaaacatgccagactggcgcgtattgagcacccgctgtttcattttcttaaagtagatattgctgatcgcgctgccatggcgcagcttttcgaacaagaaaaatttgagcgcgtgattcaccttgccgcgcaggcaggggtacgttattcactcgaaaaccctcatgcgtacgccgattcaaacctagtcggtcatttgaatattcttgaaggttgccgacaaaataaagttggccatttagtctacgcttcgtccagctcagtgtatggcttaaatgcgaaagtgccctttgcgacttctgactcggtcgatcacccagtttcgttgtatgcggccactaaaaaatctaatgagctaatggcacacagttattcgcacctttatgatattccgaccacgggtttgcggttttttaccgtgtatggttcttgggggcgtcctgatatggctccatttatctttaccaagaagattttagcgggcgaagccatagatattaataaccatggtgatatgtggcgtgattttacccatgttgatgatattgtggagggcgtagtacgcattgcagatgtgctaccaactcgtaatgcagcttggacggtagaatctggcacgccagcgaccagctcagccccttacgcgatttataatatcggccatggctcgccaattaatttaatggaatttgttaaagcgattgaagagcaactgggcattgaagccaataaaaacttccgaagtatgcagcctggcgatgtttatcaaacttacgctgatacggcagacttatttgctgctacaggctataagccgaaagttggagtaagagacggagtatcggagtttatcgcttggtatagagatttttataatcaataa

SEQ ID NO: 65527 - protein, 334 aa, Vibrio cholerae O139
MKYLVTGAAGFIGSATVKKLTEQGHHVVGIDNINDYYDVNLKHARLARIEHPLFHFLKVDIADRAAMAQLFEQEKFERVIHLAAQAGVRYSLENPHAYADSNLVGHLNILEGCRQNKVGHLVYASSSSVYGLNAKVPFATSDSVDHPVSLYAATKKSNELMAHSYSHLYDIPTTGLRFFTVYGSWGRPDMAPFIFTKKILAGEAIDINNHGDMWRDFTHVDDIVEGVVRIADVLPTRNAAWTVESGTPATSSAPYAIYNIGHGSPINLMEFVKAIEEQLGIEANKNFRSMQPGDVYQTYADTADLFAATGYKPKVGVRDGVSEFIAWYRDFYNQ

SEQ ID NO: 65528 - DNA, 975 bp, Campylobacter jejuni
  CDS (1)..(975)
atgaaaaatattttagttgtaggtggtgcaggatatataggctcacataccttaaaacatttgctggacaatgattataattgtattgtcatggataatctcatttatggacacaagcaagctattgataaaagagctaaatttattcatgcagatttactagacaccttttctttagctagcgtttttaaaaaagaaaaaatagatgctctagtgcattttgcagcttttgcttatgtgggagaaagtgttgtaaatcctgcaaaatattatcaaaataatgtagtaggaactataaatcttttaaatgcaatgcttgaaaataatgttaaggatatagtattttcaagcacttgtgcaacttatggagaaccacaatatactccaattgatgaaaaacatcctcaaaatcctattaacgcttatggaaggactaagcttatgatagagcaagtttttgctgattatgaaaaagcttatggtttaaggtatatttctttaagatattttaatgctgcaggtgcaagtaaagatggacttatcggagaaagtcatgaacctgaaactcatttaattcctttagttttaaaagctataaaaggagaaattcctgctataaatatttttggaaatgactatgacaccgaagatggaacttgtataagagattatattcatgtagaagatttagcgttagctcatcgtttagccttggaaaatttacataaatttagcggttgtataaatcttggtacaggaataggtacaagtgtaaaagaaatcatcagcgcagctgaagttgtaagtggcaaaaagtgccctataaattacgcaccaagaagagaaggggatcctgcaagattatatgcagataataaaaaagcaaaagaaatcttatcttgggaagcaaaatacactgatattaaagatataatcaaaagtgcttggatttgggaaaataatagaaagtattaa

SEQ ID NO: 65529 - protein, 324 aa, Campylobacter jejuni
MKNILVVGGAGYIGSHTLKHLLDNDYNCIVMDNLIYGHKQAIDKRAKFIHADLLDTFSLASVFKKEKIDALVHFAAFAYVGESVVNPAKYYQNNVVGTINLLNAMLENNVKDIVFSSTCATYGEPQYTPIDEKHPQNPINAYGRTKLMIEQVFADYEKAYGLRYISLRYFNAAGASKDGLIGESHEPETHLIPLVLKAIKGEIPAINIFGNDYDTEDGTCIRDYIHVEDLALAHRLALENLHKFSGCINLGTGIGTSVKEIISAAEVVSGKKCPINYAPRREGDPARLYADNKKAKEILSWEAKYTDIKDIIKSAWIWENNRKY

SEQ ID NO: 65530 - DNA, 1002 bp, Streptococcus thermophilus
  CDS (1)..(1002): transl_table=11
atggcaattttagtattaggtggagctggttatatcggttctcacatggttgatcgcttagttgaaaaaggtcaagaaaaagtagtagtagtagatagtttggtaaccggtcaccgtgctgccgtacatccagatgctattttctatcaaggcgatctctctgatcaagattttatgagaaaggtcttcaaagaaaatcctgatgttgatgccgttattcactttgcggcctattcattggttggtgaatcaatggaaaaaccactcaaatattttgataacaatacagctggaatggttaaattgcttgaagttatgaacgaatgcggtgttaaatacattgtcttctcatcaacagcagcaacttacggaattccagaagaaattccaattcttgaaacaacaccacaaaatcctatcaacccatatggtgaaagtaagttgatgatggaaaccattatgaagtggtctgataaagcttatggtattaaatatgtgccacttcgttacttcaacgttgctggtgcaaaacctgatggatctatcggtgaagaccatggtccagaaactcaccttcttccaattatccttcaagtagctcaaggtgttcgtgaaaaaatcatgatctttggggatgactacaatactccagacgggactaacgttcgtgactatgtgcatccattcgacttggcggacgctcacctccttgctgttgaatatcttcgtaaaggtaatgaatctacagcctttaacttaggttcatcaacaggtttttcaaaccttcaaattcttgaagcagctcgtaaggtaactggtaaagagattccagctgaaaaagttgatcgtcgtcctggtgatcctgatatattgattgcttcatctgaaaaagcacgtacagttcttggatggaaaccacaatttgataacatcgaaaaaatcatcgcaagtgcttgggcatggcattctagccatccaaaagggtacgatgatcgaggataa

SEQ ID NO: 65531 - protein, 333 aa, Streptococcus thermophilus
MAILVLGGAGYIGSHMVDRLVEKGQEKVVVVDSLVTGHRAAVHPDAIFYQGDLSDQDFMRKVFKENPDVDAVIHFAAYSLVGESMEKPLKYFDNNTAGMVKLLEVMNECGVKYIVFSSTAATYGIPEEIPILETTPQNPINPYGESKLMMETIMKWSDKAYGIKYVPLRYFNVAGAKPDGSIGEDHGPETHLLPIILQVAQGVREKIMIFGDDYNTPDGTNVRDYVHPFDLADAHLLAVEYLRKGNESTAFNLGSSTGFSNLQILEAARKVTGKEIPAEKVDRRPGDPDILIASSEKARTVLGWKPQFDNIEKIIASAWAWHSSHPKGYDDRG

SEQ ID NO: 65532 - DNA, 1002 bp, Streptococcus thermophilus
  CDS (1)..(1002): transl_table=11
atggcaattttagtattaggtggagctggttatatcggttctcacatggttgatcgcttagttgaaaaaggtcaagaaaaagtagtagtagtagatagtttggtaacaggtcaccgtgctgccgtacatccagatgctattttctatcaaggcgatctttctgatcaggattttatgagaaaggtcttcaaagaaaaccctgatgttgatgctgttattcactttgcggcctattctttggttggtgaatcaatggaaaaaccactcaaatattttgataacaacacagctggaatggttaaattgcttgaggttatgaacgaatgcggtgttaaatacattgtcttctcatcaacagcagcaacttacggaattccagaagaaattccaattcttgaaacaacaccacaaaatcctatcaacccatatggtgaaagtaagttgatgatggaaaccattatgaggtggtcagaccaagcttacggcatcaagtatgtccctcttcgttacttcaacgttgctggtgccaaacctgatggttcgattggtgaggaccacggtccagaaactcaccttctaccgattattcttcaagtagctcaaggtgttcgtgaaaaaatcatgatctttggggatgactacaatactccagacgggactaacgttcgtgactatgtgcatccattcgacttggcggacgctcacctccttgctgttgaatatcttcgtgaaggtaatgaatctacagcctttaacttaggttcatcaacaggtttctcaaaccttcaaattcttgaagcagctcgtaaggtaactggtaaagagattccatctgaaaaagctgatcgtcgtcctggtgatcctgatatattgattgcttcatctgaaaaagcacgtacagttcttggatggaaaccacaatttgataacatcgaaaaaatcatcgcaagtgcttgggcatggcattctagccatccaaaagggtacgatgatcgaggataa

SEQ ID NO: 65533 - protein, 333 aa, Streptococcus thermophilus
MAILVLGGAGYIGSHMVDRLVEKGQEKVVVVDSLVTGHRAAVHPDAIFYQGDLSDQDFMRKVFKENPDVDAVIHFAAYSLVGESMEKPLKYFDNNTAGMVKLLEVMNECGVKYIVFSSTAATYGIPEEIPILETTPQNPINPYGESKLMMETIMRWSDQAYGIKYVPLRYFNVAGAKPDGSIGEDHGPETHLLPIILQVAQGVREKIMIFGDDYNTPDGTNVRDYVHPFDLADAHLLAVEYLREGNESTAFNLGSSTGFSNLQILEAARKVTGKEIPSEKADRRPGDPDILIASSEKARTVLGWKPQFDNIEKIIASAWAWHSSHPKGYDDRG

SEQ ID NO: 65534 - DNA, 951 bp, Escherichia coli
  CDS (1)..(951): transl_table=11
atggatgctagaaaaaatggagtcctgattacaggcggtgctgggtttataggtaaagcattgatcaccgaaatggtcgaaaggcagatcccactagtgtcgttcgatatttcggataaaccagactcgttgcctgagctaagtgaatattttaactggtataaatttagctacctcgaatcttctcagcgtataaaagaactgcatgagatagttagccgccacaatattaagacagttattcatttggcaacaactatgtttccacatgaatcgaaaaaaaatatcgataaagattgtctggaaaatgtttatgcgaatgtctgttttttcaaaaacctatatgaaaatggttgtgagaaaattatatttgcatcatcgggtggcactgtttacggaaaatccgatacaccattttctgaagatgatgcacttttaccagagatcagttatggcttaagcaaagttatgactgagacatacttacgatttattgctaaagaactcaatggtaaatccatatcattgcggatctcaaatccttatggagaagggcagagaatagatggtaagcaaggtgtaataccaatatttttaaataaaatctcaaatgatattccaattgatattattggttcaattgagagtaaaagagattatatttatataagtgatcttgtacaagccttcatgtgttcattagaatatgaaggacatgaagatatttttaacataggttctggagaatctattacgttaaaaaaacttattgaaactatcgaatttaaattgaataaaaaggcagtaatcggttttcaagatcctatccataccaatgctaacggaattattttagatattaagcgagctatggctgagttaggatggcgtccgacggttgtactcgatgatggcattgataaattaataaaatcaattaggtgtaagtaa

SEQ ID NO: 65535 - protein, 316 aa, Escherichia coli
MDARKNGVLITGGAGFIGKALITEMVERQIPLVSFDISDKPDSLPELSEYFNWYKFSYLESSQRIKELHEIVSRHNIKTVIHLATTMFPHESKKNIDKDCLENVYANVCFFKNLYENGCEKIIFASSGGTVYGKSDTPFSEDDALLPEISYGLSKVMTETYLRFIAKELNGKSISLRISNPYGEGQRIDGKQGVIPIFLNKISNDIPIDIIGSIESKRDYIYISDLVQAFMCSLEYEGHEDIFNIGSGESITLKKLIETIEFKLNKKAVIGFQDPIHTNANGIILDIKRAMAELGWRPTVVLDDGIDKLIKSIRCK

SEQ ID NO: 65536 - DNA, 984 bp, Listeria monocytogenes
  CDS (1)..(984): transl_table=11
atgggtattgctgtacttggtggcgctggctatatcggttcacatgcagtaaatgagttaattactcgcggatatgaagtagtagttattgataatttaagaacagggcatagggaatccattcataaaaaggcaaaattttatgaaggagatattcgtgataaagcatttttaagttcagtttttgaaaaagaaaaagtagatggtgtgattcattttgctgctagttcacttgtaggagaatcgatggaagtaccgctggattatttaaataataatgtctatggtacgcaaatcgttttagaagtgatggaggaatttgatgtgaagcatatcgtcttttcttccagtgcggctacatacggtgaaccagaacgcgtaccgattacggaagatatgccaacaaatccggaaagtacttacggcgaaacgaagctaatcatggaaaaaatgatgaaatggtgcgataaagcgtatgatatgaaatatgttgcactccggtattttaatgttgctggcgccaaagcggatggttcaattggggaagatcacaaaccagaatcacacttagtcccaattattttacaagttgcgcttggtcaacgagaaaaattagcgatttacggtgacgactacaatacgcctgatggtacttgtattcgtgattatgtacaagtagaagatttaattgacgcgcatattaaagcgctagaatacttgaaaaatggcggggaaagtaatattttcaaccttggtagcagtaacggtttttcagtgaaagaaatgcttgaagcagctcgtactgtaacaggtaaagaaattccagctgaagttgtaccacgccgtgcaggagatccaggaacgttaattgcttcaagtgataaagcgcgtgaaattcttggttgggagccaacttatacagacgtaaaagatattatcgccactgcttggaaatggcacgtatctcatccaaatggctattaa

SEQ ID NO: 65537 - protein, 327 aa, Listeria monocytogenes
MGIAVLGGAGYIGSHAVNELITRGYEVVVIDNLRTGHRESIHKKAKFYEGDIRDKAFLSSVFEKEKVDGVIHFAASSLVGESMEVPLDYLNNNVYGTQIVLEVMEEFDVKHIVFSSSAATYGEPERVPITEDMPTNPESTYGETKLIMEKMMKWCDKAYDMKYVALRYFNVAGAKADGSIGEDHKPESHLVPIILQVALGQREKLAIYGDDYNTPDGTCIRDYVQVEDLIDAHIKALEYLKNGGESNIFNLGSSNGFSVKEMLEAARTVTGKEIPAEVVPRRAGDPGTLIASSDKAREILGWEPTYTDVKDIIATAWKWHVSHPNGY

SEQ ID NO: 65538 - DNA, 1005 bp, Klebsiella pneumoniae
  CDS (1)..(1005): transl_table=11
atgaagtttttgatcactggtgccgcaggttttatcggcttccatatcgcgcagcgcctgctgaatgaagggcatgatgttgtcggaatcgacaacatgaacgactattatgacgtcagcctgaaacaggcccgtctggatcgcctggcatctccggcattccatttccagcagctggatctggccgaccgtgaaggtatggcaaagctgttcgccacagagcaatttaatcgtgtgatccacctggccgcccaggccggcgtgcgctactcgctggaaaacccgtatgcctacgcagacgctaacctgatggggtacctgaacattctggaaggctgccgtcataccaaggtgaaacacctggtgtacgcctcctccagctcggtttacggccttaaccgtaaaatgccgttctccaccgaagattccgtcgatcatccggtctccctgtatgccgccaccaagaaagccaatgagctgatggcgcatacctattcccatctgtacggcatcccgaccaccgggctgcgcttctttacggtttatggtccgtggggtcgcccggatatggcgctgttcaagttcacgaaagcgatgctggaaggaaaaagtatcgacgtttacaactacggcaaaatgaagcgcgacttcacctacatcgacgacatcgtcgaggcggtggttcgggtgcaggatgtgatcccgcaggccaatgccaactggaccgttgagagcggttccccggccaccagttccgcgccgtatcgggtatataacattggcaacagctcaccagtggaactgatggactacatcaccgccctggaagaagcgctggggatggaagcgcagaagaatatgatgccgatccagctgggagatgtgctggacaccagcgcagacccccaaccgctgtatgacctggtgggtttcaagccgcaaacgtcagtgaaggaaggcgtgaagaacttcgtggagtggtacaaggattactatcagatctag

SEQ ID NO: 65539 - protein, 334 aa, Klebsiella pneumoniae
MKFLITGAAGFIGFHIAQRLLNEGHDVVGIDNMNDYYDVSLKQARLDRLASPAFHFQQLDLADREGMAKLFATEQFNRVIHLAAQAGVRYSLENPYAYADANLMGYLNILEGCRHTKVKHLVYASSSSVYGLNRKMPFSTEDSVDHPVSLYAATKKANELMAHTYSHLYGIPTTGLRFFTVYGPWGRPDMALFKFTKAMLEGKSIDVYNYGKMKRDFTYIDDIVEAVVRVQDVIPQANANWTVESGSPATSSAPYRVYNIGNSSPVELMDYITALEEALGMEAQKNMMPIQLGDVLDTSADPQPLYDLVGFKPQTSVKEGVKNFVEWYKDYYQI

SEQ ID NO: 65540 - DNA, 1044 bp, Brachydanio rerio
  CDS (1)..(1044)
atgagctgcagtgaccggcggactgtgctcgtcactggaggagctggattcattgggtctcatctgatctgcgctctggctggccggtttcctcactggaggatcatcaacgttgataatcttcagtattgctccaacctgaagaacctgcgttcagtccaggccagcagctcttacagcttcattccgggcgatgtgtgtgatcctctgttcatcaagcatctgttttccactgaacacatcgatgtggtcttccactgcgctgctgaaactcatgtagagaactcgtttgtgtgtccgtcgcgcttcatgcgtgtgaatgtggacggcactgcggtgctggtgcgggcgtcgctggaggccagtgtgcagcgcttcatctacatcagcactgatgaggtgtacggtgacagcgtagaccagccctttgatgagctgagtcctaaaagacccacaaacccctactccagatccaaagctgcagccgagagcatcgtcaccagctactggctcaaacacaagtttccagccgtgatcacgaggagcagtaatgtgtacgggccgcggcagcatcatgagaaggtcattcccagattcctctcgctcctgcagcagcagcagaagtgcactatccagggctccggcctgcagtcaagacacttcctgtatgtctctgacgtcaccgacgccttcctgacggtgatggagaagggcattctgggagaaatctacaacatcgggaccggctttgagattcccatcattcagctggccagagaactggtccaaatgacagtgaagagcgtctctgctgaatctctggacgactggctggagtttgtggaagatcgtcctgtgacagagctgcgataccccatgaactctgtgaagctgcacagactcggctggagacccaaagtggcctggacagagggaatcagacgcaccgttcagtggtacgaggagaacccaaactactggccgataatcagcgagaatcagacgaatctggagtcatgtgatcagacgcctcatccagtctga

SEQ ID NO: 65541 - protein, 347 aa, Brachydanio rerio
MSCSDRRTVLVTGGAGFIGSHLICALAGRFPHWRIINVDNLQYCSNLKNLRSVQASSSYSFIPGDVCDPLFIKHLFSTEHIDVVFHCAAETHVENSFVCPSRFMRVNVDGTAVLVRASLEASVQRFIYISTDEVYGDSVDQPFDELSPKRPTNPYSRSKAAAESIVTSYWLKHKFPAVITRSSNVYGPRQHHEKVIPRFLSLLQQQQKCTIQGSGLQSRHFLYVSDVTDAFLTVMEKGILGEIYNIGTGFEIPIIQLARELVQMTVKSVSAESLDDWLEFVEDRPVTELRYPMNSVKLHRLGWRPKVAWTEGIRRTVQWYEENPNYWPIISENQTNLESCDQTPHPV

SEQ ID NO: 65542 - DNA, 987 bp, Campylobacter jejuni
  CDS (1)..(987): transl_table=11
atgaaaattcttattagcggtggtgcaggttatataggttctcatactttaagacaatttttaaaaacagatcatgaaatttgtgttttagataatctttctaagggttctaaaatcgcaatagaagatttgcaaaaaataagagcttttaaattttttgaacaagatttaagtgattttcaaggcgtaaaagcattgtttgagagagaaaaatttgacgctattgtacattttgcagcgagcattgaagtttttgaaagtatgcaaaatcctttaaaatattatatgaacaacactgttaatacaacaaatctcatcgaaacttgtttgcaaactggagtgaataaatttatattttcttcaacggcggccacttatggcgaaccacaaactcccgttgtgagcgaaacaagtcctttagcacctattaatccttatgggcgtagtaagcttatgagtgaagaagttttgcgtgatgcaagtatggcaaatcctgaatttaagcattgtattttaagatattttaatgttgcaggtgcttgtatggattatactttaggacaacgctatccaaaagcgactttgcttataaaagttgcagctgaatgtgccgcaggaaaacgtgataaacttttcatatttggcgatgattatgatacaaaagatggtacttgcataagagattttatccatgtagatgatatttcaagtgcacatttagcggctttggattatttaaaagagaatgaaagcaatgtttttaatgtaggttatggacatggttttagcgtaaaagaagtgattgaagcgatgaaaaaagttagcggagtggattttaaagtagaacttgccccacgccgtgcgggtgatcctagtgtattgatttctgatgcaagtaaaatcagaaatcttacttcttggcagcctaaatatgatgatttagagcttatttgtaaatctgcttttgattgggaaaaacagtgttaa

SEQ ID NO: 65543 - protein, 328 aa, Campylobacter jejuni
MKILISGGAGYIGSHTLRQFLKTDHEICVLDNLSKGSKIAIEDLQKIRAFKFFEQDLSDFQGVKALFEREKFDAIVHFAASIEVFESMQNPLKYYMNNTVNTTNLIETCLQTGVNKFIFSSTAATYGEPQTPVVSETSPLAPINPYGRSKLMSEEVLRDASMANPEFKHCILRYFNVAGACMDYTLGQRYPKATLLIKVAAECAAGKRDKLFIFGDDYDTKDGTCIRDFIHVDDISSAHLAALDYLKENESNVFNVGYGHGFSVKEVIEAMKKVSGVDFKVELAPRRAGDPSVLISDASKIRNLTSWQPKYDDLELICKSAFDWEKQC

SEQ ID NO: 65544 - DNA, 1029 bp, Shigella dysenteriae
  CDS (1)..(1029): transl_table=11
atgaaatataaaaaaatagaagacgctttgtcttctaaatctgaaacatggttgattacaggtgttgcgggatttatcggttctaacctattagaggccttactaaaacttaatcaaaaagtagttggcttagataattttgcaactggacatcaagcaaaccttgatgaggttaaagagtctgtttcagctgaacaatggtctgcttttacctttgtggaaggagacatatgtgagccagagacgtgtgtggaggttgttaaaggagttgatcatgtcctacatcaggctgcattaggttctgtgcctcgttcaattaaagatccaattactacaaataataccaatatatcgggtttcattaatatgttggttgccgccaaagatgccaatgtcagaagtttcacttacgctgcaagtagctcaacgtatggtgatcatcctgcattacctaaaattgaagaaaatataggtaatccgctatctccatacgcagtgacaaagtatgtaaatgaattatatgcgcaagtatttgcaagaacctacggattcaaatcaattggattaagatactttaatgtatttggaaaacgccaggatcctaatggggcatatgctgctgtgataccgaagtggactgctgcaatgatcaatgatgaaccgctgtatatcaatggtgatggcgaaacaagtagagacttttgttttattgagaatgtcgtgcaaatgaatattcttgctgcacagtctgatgcgtctgcaagagatcaggtttataacgttgcagttggtgaccgtactacgcttaaacaattattcactgtattaaagaatgcacttaatgaaaatggtgtttcgtataacaaagaacctgaatataaagattttcgtgcaggtgatgttcgccattcgcaagctgatatcactaaagccaaaactagacttggatacgagccacagttcagtatatcggagggcatcctcaaagcgatgccgtggtatgtaaactctctgggcaacaaaaaataa

SEQ ID NO: 65545 - protein, 342 aa, Shigella dysenteriae
MKYKKIEDALSSKSETWLITGVAGFIGSNLLEALLKLNQKVVGLDNFATGHQANLDEVKESVSAEQWSAFTFVEGDICEPETCVEVVKGVDHVLHQAALGSVPRSIKDPITTNNTNISGFINMLVAAKDANVRSFTYAASSSTYGDHPALPKIEENIGNPLSPYAVTKYVNELYAQVFARTYGFKSIGLRYFNVFGKRQDPNGAYAAVIPKWTAAMINDEPLYINGDGETSRDFCFIENVVQMNILAAQSDASARDQVYNVAVGDRTTLKQLFTVLKNALNENGVSYNKEPEYKDFRAGDVRHSQADITKAKTRLGYEPQFSISEGILKAMPWYVNSLGNKK

SEQ ID NO: 65546 - DNA, 1011 bp, Klebsiella terrigena
  CDS (1)..(1011): transl_table=11
atgaacatgaagtttttagtcactggagccgcaggatttatcggtttccacacctgcaagcgccttcttgaggcgggtcatcaggttgttggtatcgacaacatgaatgattactacgacgtcaatcttaagcaggcgcgtctggatttactgcaatcctcccttttcagtttccataaagtcgatcttgccgatcgccagggcatcgcagaactgttcgcagaagagaagtttaaccgcgtgatccatctggccgctcaggctggcgttcggtactcgctggaaaatcctcatgcctatgctgactccaacctgatcggctatctgaacattctggaaggttgccgacacaataaggtcgaacacctgctgtatgcatcgtccagttccgtctatggtttgaaccgtaaaatgccgttctcaaccgacgactcggtcgaccatccggtttcactctatgccgccaccaagaaagccaatgagctgatggcgcatacctactcccacctttacggcataccgactaccgggctgcggttcttcaccgtatacggcccgtggggccgccctgacatggcgttgttcaaattcaccaaagccatgctggaaggtaagagtattgacgtgtacaactacggcaagatgaagcgtgatttcacctacgttgacgatattgtggaagctattgtgcgcgttcaggatgttatcccgcagtcgaacgcggagtggaccgtcgagaatggctctccggcagacagctcggccccatatcgggtttacaatatcggcaacagctccccggttgaactgatggattacatcaccgccctggaagaagcactgggaatggtcgctgagaaaaacatgatgcctatccaaccgggcgacgtgcttgaaaccagtgcggataccaaaccgctgtacgatcttgttggcttcaagccgcagaccaccgtcaaagaaggcgtgcagaattttgtcgactggtacaaggcctactataaggcataa

SEQ ID NO: 65547 - protein, 336 aa, Klebsiella terrigena
MNMKFLVTGAAGFIGFHTCKRLLEAGHQVVGIDNMNDYYDVNLKQARLDLLQSSLFSFHKVDLADRQGIAELFAEEKFNRVIHLAAQAGVRYSLENPHAYADSNLIGYLNILEGCRHNKVEHLLYASSSSVYGLNRKMPFSTDDSVDHPVSLYAATKKANELMAHTYSHLYGIPTTGLRFFTVYGPWGRPDMALFKFTKAMLEGKSIDVYNYGKMKRDFTYVDDIVEAIVRVQDVIPQSNAEWTVENGSPADSSAPYRVYNIGNSSPVELMDYITALEEALGMVAEKNMMPIQPGDVLETSADTKPLYDLVGFKPQTTVKEGVQNFVDWYKAYYKA

SEQ ID NO: 65548 - DNA, 987 bp, Rhizobium sp
  CDS (1)..(987): transl_table=11
ctgatggacacgccccgcatcctggtaaccggcggcgccggctatatcggcagccataccgcaaaacttcttcgtctggagggcctcgagccggttacctatgacaatctaacgaccggcaaccgctcgtcggtgcgctgggggccgttcatcgagggcgatatcctcgactcggctcatctcatcgaggtcatcgagcactatgcgccggacgcggtaatccatttcgccgcgtctgcctatgtcggcgaatccgtcgccgacccggcaaagtactaccacaacaatgtctgcggaaccttgtcgctactcgatgcgtgccggcggacggggcttgggaaggtgatcttctcgtcgagctgcgccacctatggcgtaccggccgcgctgccgatcgacgaggcgacgcggcaggaaccgatcaatccctatggcaggacgaagctgatcgccgaacgcatgctgtccgactacgcggcggctttcggcctctcctatgtggcgctgcgctatttcaacgcctgcggagccgacccggaaggcgacctcggcgaatggcacgaccccgagacgcatctcattccgcgcgcgctgatggcggccgccggccggatcggcaagctcgaggtcttcggcgacgactacgatacggctgacggcacctgcgtgcgtgactacattcatgtcgcggacctcgcgcaggcgcatgtgctggcctaccggcttcttgcagagggcggcgcgaacctcgccctcaacctcgggtccggccgcggcttctcggtccgggaggtgctcagcgccgtcggtgcggtcaccggccgggatgtgccggtggcgatccgcccccgccgggccggcgacccgccggtcctctatgccgatgcgaggcttgcccgcgaggtgctgggcttctcgccgctctattccgatctcgagaccatcgtgcgtaccgctgcccccttcttcggactggaggcccgctga

SEQ ID NO: 65549 - protein, 328 aa, Rhizobium sp
MMDTPRILVTGGAGYIGSHTAKLLRLEGLEPVTYDNLTTGNRSSVRWGPFIEGDILDSAHLIEVIEHYAPDAVIHFAASAYVGESVADPAKYYHNNVCGTLSLLDACRRTGLGKVIFSSSCATYGVPAALPIDEATRQEPINPYGRTKLIAERMLSDYAAAFGLSYVALRYFNACGADPEGDLGEWHDPETHLIPRALMAAAGRIGKLEVFGDDYDTADGTCVRDYIHVADLAQAHVLAYRLLAEGGANLALNLGSGRGFSVREVLSAVGAVTGRDVPVAIRPRRAGDPPVLYADARLAREVLGFSPLYSDLETIVRTAAPFFGLEAR

SEQ ID NO: 65550 - DNA, 981 bp, Rhizobium sp
  CDS (1)..(981): transl_table=11
gtgcagaacaacaacatcctcgtcgtcggcggtgccggctatatcggctcccatacctgcctccgcctggccgaaaagggctataacccgatcgtctacgacaatctttccaacggccacgaggaattcgtccgctggggcgtgctggagaagggcgacatccgcgaccggcggcgcctcgacgaggtgctggcccgccacaaaccgcgggcagtcctgcattttgcggcgatgatcgaagtcggcgaatcggtcaaggatccggttgccttctacgacaacaacgtcatcgggacgctgaccttgttgtcggcgacgctcgccgccggcatcgaggctttcgtcttctcctcgacctgcgccacctatggcttgcccgacagcgtaccgatggacgaaacgcacaagcaggctccgatcaacccctatggccggaccaagtgggtttgcgagcaggcgctcaaggactacggcctctacaagggcctgcgctccgtcatcctgcgctacttcaacgccgccggcgccgatcttgagggccgcatcggcgaatggcacgagccggagacgcatgcgatcccgctggcgatcgacgcggcgcttggccggcgcgacggcttcaaggtcttcggaacggactatgagacgcgcgacggcacctgcgtgcgcgactatatccatgtcctcgacctcgccgatgcgcatgtgcgcgccgtcgactacctgctcgagggcggcgacagcgtcgaactcaacctcggcaccggcaccggcacgacggtgaaggagttgctcacggccatcgaaaaggtctccaggcggccattcaatgtcagttatgtcgggcgccgcgacggcgactcgacgacgctcgtcgccaacaacgacaaggcccgacaagtcctcggctgggagcctcagtacgatctcgcggcaatcaccgagtcggcctggaactggcattcgcgccggaacggctga

SEQ ID NO: 65551 - protein, 326 aa, Rhizobium sp
MQNNNILVVGGAGYIGSHTCLRLAEKGYNPIVYDNLSNGHEEFVRWGVLEKGDIRDRRRLDEVLARHKPRAVLHFAAMIEVGESVKDPVAFYDNNVIGTLTLLSATLAAGIEAFVFSSTCATYGLPDSVPMDETHKQAPINPYGRTKWVCEQALKDYGLYKGLRSVILRYFNAAGADLEGRIGEWHEPETHAIPLAIDAALGRRDGFKVFGTDYETRDGTCVRDYIHVLDLADAHVRAVDYLLEGGDSVELNLGTGTGTTVKELLTAIEKVSRRPFNVSYVGRRDGDSTTLVANNDKARQVLGWEPQYDLAAITESAWNWHSRRNG

SEQ ID NO: 65552 - DNA, 993 bp, Streptococcus agalactiae
  CDS (1)..(993): transl_table=11
atggcagttctgattttaggtggcgccggctacattggctcgcatatggttgatcagttaatcacacaaggaaaagagaaagttattgttgttgataacttggtaacaggtcatcgtcaagcggtgcattcagatgcgattttttatgaaggagatttatccgataaaacgtttatgcgtcaagtttttagggaaaatcctgatgtagatgctgttatccattttgcggcattttcactagttgctgagtcaatggaaaatcctttaaaatattttgataataacactgctggaatgataaaacttttagaagtaatgaatgaatgtgatatcaaaaatattgtcttttcatcaacagctgcaacatatggtattccagaacaagttcctattttagaaacagctcctcaaaatcctattaatccttatggcgaaagtaagcttatgatggaaacaattatgaaatgggctgatcaagcctacggtattaagtttgtcgctctacgttacttcaacgttgctggagataaaccggatggctcaattggggaagatcataaaccagaaacacatttgttaccaatcattcttcaagttgctcaaggagtacgtgacaaaataatgattttggaagatgattcccatactccagatggaactaatgttcgagattatgtgcatccatttgattggccagatgctcatatattagcagtgatttaccttcgccaagggaatgaatcaaacgtgtttaatctcggatcttcgacaggtttttctaccttcagatgtaaggcagctcgtcgtattactggaaagaaaattcctgctcaaaaggcagctcgtcgtccaggagatccagatacgcttattgcttcctcagagaaagctcgtcaaatccttgggtgggagcctaaatttgataatattgataaaattatttcatcggcatgggcatggcattctagtcatccaaatggctacgaagattaa

SEQ ID NO: 65553 - protein, 330 aa, Streptococcus agalactiae
MAVLILGGAGYIGSHMVDQLITQGKEKVIVVDNLVTGHRQAVHSDAIFYEGDLSDKTFMRQVFRENPDVDAVIHFAAFSLVAESMENPLKYFDNNTAGMIKLLEVMNECDIKNIVFSSTAATYGIPEQVPILETAPQNPINPYGESKLMMETIMKWADQAYGIKFVALRYFNVAGDKPDGSIGEDHKPETHLLPIILQVAQGVRDKIMILEDDSHTPDGTNVRDYVHPFDWPDAHILAVIYLRQGNESNVFNLGSSTGFSTFRCKAARRITGKKIPAQKAARRPGDPDTLIASSEKARQILGWEPKFDNIDKIISSAWAWHSSHPNGYED

SEQ ID NO: 65554 - DNA, 963 bp, Melittangium lichenicola
  CDS (1)..(963): transl_table=11
atgaaggtgctcgtcacgggagccgcgggctttatcggataccacgtttgtgagcggctgctcgcgcgcggggacaccgtcattggcgtggacaacctggacacgtcgggggacgtgaccttgaaggccacacggctgtcccggcttcgggcggcccccaatttcggtttccaccggatggacatccgcgacgcgaaggcctgccgggagctgttcgacggggcgcggccggagcgggtggtgcacctggcggcgagggtgggggtgcggacgctggactccgagtcacccgaatacgcggagacgaacgtcacgggcttcctccaggtgctggagctgtgccgccgctcacgggtggagcacctggtgttcgcctcgtccagctcggtgtacggcgcgggctcggacatgcccttctcggaggactcggcggcggatcggcccctgagcctctacgcggccaccaagcgcgccaacgagatgatggcgcacgcctacagccaccagtacgccatgcccatcacgggactgcggctgttctccgtgtatggcccctggggccggccggacatggcccccatgatgttcctgcgcgcgatgttggagggccgctcgctggaactgcatggcgagggcaaggcccagcgggacttcacctacatcgacgacgtggtggaggcgctggtgcgggtgctggacgcggcccccacgggcctgccgctctatcgcgtgctgaacgtgggccggggcacgccggtgtcgatgtcacggctggtggatctgctcgaggagcacttgggcaccacggcctgggtggagatgcggtcctcgcgctccgaggagatggacgccacgtgcgcggacgtgacggcgctggagcgcgagacgggctttcgtccctcggtgacgctggagcagggactcgcccggctcgtggcctggtaccgcggacgcgagggctga

SEQ ID NO: 65555 - protein, 320 aa, Melittangium lichenicola
MKVLVTGAAGFIGYHVCERLLARGDTVIGVDNLDTSGDVTLKATRLSRLRAAPNFGFHRMDIRDAKACRELFDGARPERVVHLAARVGVRTLDSESPEYAETNVTGFLQVLELCRRSRVEHLVFASSSSVYGAGSDMPFSEDSAADRPLSLYAATKRANEMMAHAYSHQYAMPITGLRLFSVYGPWGRPDMAPMMFLRAMLEGRSLELHGEGKAQRDFTYIDDVVEALVRVLDAAPTGLPLYRVLNVGRGTPVSMSRLVDLLEEHLGTTAWVEMRSSRSEEMDATCADVTALERETGFRPSVTLEQGLARLVAWYRGREG

SEQ ID NO: 65556 - DNA, 1038 bp, Plesiomonas shigelloides
  CDS (1)..(1038): transl_table=11
atggatatttatatgtctcgctatgaagagattacacagcagttaattttttcaccgaaaacttggttaattactggtgtcgctggctttataggatcaaatcttttagaaaagttacttaaattaaaccaggttgttattgggttagataacttttccacgggacatcaatataatcttgatgaagttaaaacattagtttccactgaacagtggagtcgattttgctttatagaaggtgatattcgagatctcactacctgtgagcaagttatgaaaggtgttgatcatgtcttacatcaggctgcgctaggttctgtacctcgttcaattgttgatcctataacaaccaatgcaactaatattactggatttttgaatatcttacatgcggctaaaaatgcacaagtacaaagttttacttatgctgcatcaagctcaacttatggagatcatcccgcactaccaaaagtagaggaaaacattggtaatccactttctccttatgcagttactaaatatgttaacgagatttatgctcaggtatatgctcgaacatatggttttaaaactattggattacgttattttaatgtatttggtcgtcgtcaagatcctaatggagcttatgctgcagtaattccaaaatggacagcagcaatgcttaaaggtgatgacgtatatattaatggcgatggtgaaacgagtcgtgatttttgttatatagataatgttatacaaatgaatatattatctgcattagcgaaggacagtgctaaagataatatatataatgttgcagttggtgatagaacaacgttaaatgaattatctggttacatttatgatgagcttaatttaattcaccatatcgataaattgagcattaagtatagagagtttagatctggagatgttaggcattctcaggctgatgttactaaggctatagatttactaaagtatagaccaaatataaaaatcagagagggattacgactttcaatgccgtggtatgtgagatttttaaaaggctaa

SEQ ID NO: 65557 - protein, 345 aa, Plesiomonas shigelloides
MDIYMSRYEEITQQLIFSPKTWLITGVAGFIGSNLLEKLLKLNQVVIGLDNFSTGHQYNLDEVKTLVSTEQWSRFCFIEGDIRDLTTCEQVMKGVDHVLHQAALGSVPRSIVDPITTNATNITGFLNILHAAKNAQVQSFTYAASSSTYGDHPALPKVEENIGNPLSPYAVTKYVNEIYAQVYARTYGFKTIGLRYFNVFGRRQDPNGAYAAVIPKWTAAMLKGDDVYINGDGETSRDFCYIDNVIQMNILSALAKDSAKDNIYNVAVGDRTTLNELSGYIYDELNLIHHIDKLSIKYREFRSGDVRHSQADVTKAIDLLKYRPNIKIREGLRLSMPWYVRFLKG

SEQ ID NO: 65558 - DNA, 954 bp, Campylobacter jejuni
  CDS (1)..(954): transl_table=11
atgaaaatagcaatcacaggtggcgcaggatttataggttcgcaactagctttaaatttgcaagaaaaacatgaaattttaatcatcgataaaatgcgtagtagtgcgacttttgaaaatggaaatttgcaaagttttgggcattttaaaaatttacttgaatttgatggagaactttttgcaggcgatattaatgatgaaaaagttttaaaaaagattgaagattttaagccagagattatttttcatcaagcagcaatttcagacactacggtttttgatcaaactaaggttttacaaaccaatttaaatacttttaaagattttatagaacttagcatagatcttaatgcaaagcttatttatgcaagttcagcttcagtttatggcgatgcaaaaagtccgcaaactgtaggtaaagatgaagaaccaaaaaatccttatgctttttcaaaattgatgatggataagttagcgaaaaaatactacgataaagctcatttggtaggacttagatattttaatgtttatggaaaaggcgaattttataaaaacaaaactgcttctatggttttacaatttggccatcaaattttagcaggaaaaaatccacgcttgtttgaaggaagtgatcaaatttatagagattttacttatattaaagatgttattaatgccaatttaatcgcccttgattcaaaatgcggggtttataatgtaggcagtggtaaagcaagaacctttcaagatatagttgatattttacaaaaagagttaaagactgatttgccttgcgaatatatcccaaatccttatgtaaaatcttatcaattccacactgaagcaaaactagatcaaacttgggattatcagccaaaatttagccttgaagagggtataaaagattatttaggcgagataaaaagactttttgaaaaggaagtcaatgcttga

SEQ ID NO: 65559 - protein, 317 aa, Campylobacter jejuni
MKIAITGGAGFIGSQLALNLQEKHEILIIDKMRSSATFENGNLQSFGHFKNLLEFDGELFAGDINDEKVLKKIEDFKPEIIFHQAAISDTTVFDQTKVLQTNLNTFKDFIELSIDLNAKLIYASSASVYGDAKSPQTVGKDEEPKNPYAFSKLMMDKLAKKYYDKAHLVGLRYFNVYGKGEFYKNKTASMVLQFGHQILAGKNPRLFEGSDQIYRDFTYIKDVINANLIALDSKCGVYNVGSGKARTFQDIVDILQKELKTDLPCEYIPNPYVKSYQFHTEAKLDQTWDYQPKFSLEEGIKDYLGEIKRLFEKEVNA

SEQ ID NO: 65560 - DNA, 987 bp, Campylobacter jejuni
  CDS (1)..(987): transl_table=11
atgaaaattcttattagcggtggtgcaggttatataggttctcatactttaagacaatttttaaaaacagatcatgaaatttgtgttttagataatctttccaagggttctaaaatcgcaatagaagatttgcaaaaaataagagcttttaaattttttgaacaagatttaagtgattttcaaggtgtaaaagcattgtttgagagagaaaaatttgacgctattgtgcattttgcagcgagtattgaagtttttgaaagtatgcaaaaccctttaaaatactatataaacaacactgttaatacaacaaatctcatcgaaacttgtatgcaaactggagtaaataaatttatattttcttcaacggcagccacttatggcgaaccacaaactcccgttgtgagcgaaacaagtcctttagcacctattaatccttatgggcgtagtaagcttatgagcgaagaggttttgcgtgatgcaagtatggcaaatcctgaatttaagcattgtattttaagatattttaatgttgcaggtgcttgtatggattatactttaggacaacgctatccaaaagcgactttgcttataaaagttgcagctgaatgtgccgcaggaaaacgtgataaacttttcatatttggcgatgattatgatacaaaagatggtacttgtataagagattttatccatgtagatgatatttcaagtgcgcatttagcggctttggattatttacaagagaatgaaagcaatgtttttaatgtaggttatggacatggttttagcgtaaaagaagtgattgaagcaatgaaaaaagttagcggagtggattttaaagtagaacttgccccacgccgtgcgggtgatcctagtgtgttgatttctgatgcaagtaaaatcagaaatcttacttcttggcagcctaaatatgatgatttagagcttatttgtaaatctgcttttgattgggaaaaacagtgctaa

SEQ ID NO: 65561 - protein, 328 aa, Campylobacter jejuni
MKILISGGAGYIGSHTLRQFLKTDHEICVLDNLSKGSKIAIEDLQKIRAFKFFEQDLSDFQGVKALFEREKFDAIVHFAASIEVFESMQNPLKYYINNTVNTTNLIETCMQTGVNKFIFSSTAATYGEPQTPVVSETSPLAPINPYGRSKLMSEEVLRDASMANPEFKHCILRYFNVAGACMDYTLGQRYPKATLLIKVAAECAAGKRDKLFIFGDDYDTKDGTCIRDFIHVDDISSAHLAALDYLQENESNVFNVGYGHGFSVKEVIEAMKKVSGVDFKVELAPRRAGDPSVLISDASKIRNLTSWQPKYDDLELICKSAFDWEKQC

SEQ ID NO: 65562 - DNA, 984 bp, Methylobacillus sp
  CDS (1)..(984): transl_table=11
atgaaagttttggtggtaggtggtgccgggtacatcggttcgcacatggtgaaaatgctgttgggcgaaggccatgatgtcatcacgtttgataatctgtcgtcaggctatcgtgatgcagtggtcggcggtacctttgtgcaggcggacctggctgacaaggcggcgctggatgaggtgtttgtgaaacacacgcccgatgctgtcatgcattttgcctcctatattcaggttggcgagtcggtgcggcacccggacaagtattacctcaataactttaccaataccatgaatctgctggatgccatggtgaagcatggggtgaattactttattttctcatccactgcggctgtcttcggcgagccggaatatgtgccgatcgacgaagcgcatgccaaaaacccgctgaatccctatggccgttccaagctgatggtggagcaggcgttgggcgattatgagcgcgcctatggcatcaagtcggtttgcttgcgctacttcaatgcggcaggggctgatcctgaaggccagctcggtgagcgtcacgagcctgagacgcatctgattccgctggtattacaggcaatctccggccgtcgtgacaacattacggtatttggtcgcgattacgatacgccagacggtacctgcatccgcgattacattcatattgtcgacttgtgcagcgcgcactcgctggccttgcgcaaattgatggaaaccaacatcagccgccgttataacctgggtaatggtgctggcttctctgtgcaggaagtgattgccgcggcgcaaaaagtgacgggcaagccgatcaaggtggctgaaggcgagcgccgtgagggtgatccagccaggctggtggcggatgcctcacttgcgcgcagtgagctggggtggaaaccggtgtatgccgatctggacaccatcatccagcacgcctggcagtgggaatccaaaacagttggcaagcctgtttga

SEQ ID NO: 65563 - protein, 327 aa, Methylobacillus sp
MKVLVVGGAGYIGSHMVKMLLGEGHDVITFDNLSSGYRDAVVGGTFVQADLADKAALDEVFVKHTPDAVMHFASYIQVGESVRHPDKYYLNNFTNTMNLLDAMVKHGVNYFIFSSTAAVFGEPEYVPIDEAHAKNPLNPYGRSKLMVEQALGDYERAYGIKSVCLRYFNAAGADPEGQLGERHEPETHLIPLVLQAISGRRDNITVFGRDYDTPDGTCIRDYIHIVDLCSAHSLALRKLMETNISRRYNLGNGAGFSVQEVIAAAQKVTGKPIKVAEGERREGDPARLVADASLARSELGWKPVYADLDTIIQHAWQWESKTVGKPV

SEQ ID NO: 65564 - DNA, 1050 bp, Escherichia coli
  CDS (1)..(1050): transl_table=11
atgtgtcagagaggatgcctaatgaaatataaaaaaatagaagacgctttgtcttctaaatctgaaacatggttgattacaggtgttgcgggatttatcggttctaacctattagaggccttactaaaacttaatcaaaaagtagttggcttagataattttgcaactggacatcaagcaaaccttgatgaggttaaagagtctgtttcagctgaacaatggtctgcttttacctttgtggaaggagacatatgtgagccagagacgtgtgtggaggttgttaaaggagttgatcatgtcctacatcaggctgcattaggttctgtgcctcgttcaattaaagatccaattactacaaataataccaatatatcgggtttcattaatatgttggttgccgccaaagatgccaatgtcagaagtttcacttacgctgcaagtagctcaacgtatggtgatcatcctgcattacctaaaattgaagaaaatataggtaatccgctatctccatacgcagtgacaaagtatgtaaatgaattatatgcgcaagtatttgcaagaacctacggattcaaatcaattggattaagatactttaatgtatttggaaaacgccaggatcctaatggggcatatgctgctgtgataccgaagtggactgctgcaatgatcaatgatgaaccgctgtatatcaatggtgatggcgaaacaagtagagacttttgttttattgagaatgtcgtgcaaatgaatattcttgctgcacagtctgatgcgtctgcaagagatcaggtttataacgttgcagttggtgaccgtactacgcttaaacaattattcactgtattaaagaatgcacttaatgaaaatggtgtttcgtataacaaagaacctgaatataaagattttcgtgcaggtgatgttcgccattcgcaagctgatatcactaaagccaaaactagacttggatacgagccacagttcagtatatcggagggcatcctcaaagcgatgccgtggtatgtaaactctctgggcaacaaaaaataa

SEQ ID NO: 65565 - protein, 349 aa, Escherichia coli
MCQRGCLMKYKKIEDALSSKSETWLITGVAGFIGSNLLEALLKLNQKVVGLDNFATGHQANLDEVKESVSAEQWSAFTFVEGDICEPETCVEVVKGVDHVLHQAALGSVPRSIKDPITTNNTNISGFINMLVAAKDANVRSFTYAASSSTYGDHPALPKIEENIGNPLSPYAVTKYVNELYAQVFARTYGFKSIGLRYFNVFGKRQDPNGAYAAVIPKWTAAMINDEPLYINGDGETSRDFCFIENVVQMNILAAQSDASARDQVYNVAVGDRTTLKQLFTVLKNALNENGVSYNKEPEYKDFRAGDVRHSQADITKAKTRLGYEPQFSISEGILKAMPWYVNSLGNKK

SEQ ID NO: 65566 - DNA, 1158 bp, Giardia lamblia
  CDS (1)..(1158)
atgcagaaccactcgttcctcggaaagaccgtcctgataactggcggatgtggcttcatagggtctcattttgtggaggcctgccacgttctcggcatgaccgtctacgtactagataacctctcatcaggaaaaaatgtgtttaaaaccacgtctgactgcagctcgtctttggtgtacaccatcggagatatcagggacaaagcaattttctcccgcctccctcagaagatagactttgtcattcacctcgctgcagccgtatcagttgcagagtcggttactaatccccagaagtacatgttgacaaacgtggagggaagtaggaatgttttccaatatgccgtcgatgccaaagcatccgctgttctgtctgcgtccacggctgcatactacggagattgtgggaaaagcgctatcactgaggccttcccatatggagggatctctccatacgcagaatctaaaatggaaatggagagacttggggccgagttccagaagacctcgcgctgcagattcatcttctgccgattcttcaatgtgtatgggccgcgtcaggacccatcgtcgccctacactggagtgatgtccatctttatggacaggtgtgcagcaaggaagccgataaccatcttcggaactggggagcagacccgtgactttgtgttcatcaaagacctcattgtcgccgccataaacctgcttggtcagctagacaagttccctattggagcggacgctgtccaacagaacgaccccgaggaggtccaacgcagtgcatatactggcgaaggcgtatacccgactgttttcaatataggctctgggatatcgatatcggtcaacgagctcgcagagttggcaaagattgtgagcgggagacacgaggtggagattgtgcacggggagcctcgcagtggggatatcctccattccctctctgactgtacccgtatccgcaatgccacaggatggtcagctagcacgaccctgcgcgttggcatgtctgaaacatggggatgggcagcgggtgagatctcctatctgtctggggacctcgtcagagtgttggaaaatgagcttaagatcgatggagtctcggtggccaaaagcctctgtggaaaggatgcggatgtcaaggggattggtctatag

SEQ ID NO: 65567 - protein, 385 aa, Giardia lamblia
MQNHSFLGKTVLITGGCGFIGSHFVEACHVLGMTVYVLDNLSSGKNVFKTTSDCSSSLVYTIGDIRDKAIFSRLPQKIDFVIHLAAAVSVAESVTNPQKYMLTNVEGSRNVFQYAVDAKASAVLSASTAAYYGDCGKSAITEAFPYGGISPYAESKMEMERLGAEFQKTSRCRFIFCRFFNVYGPRQDPSSPYTGVMSIFMDRCAARKPITIFGTGEQTRDFVFIKDLIVAAINLLGQLDKFPIGADAVQQNDPEEVQRSAYTGEGVYPTVFNIGSGISISVNELAELAKIVSGRHEVEIVHGEPRSGDILHSLSDCTRIRNATGWSASTTLRVGMSETWGWAAGEISYLSGDLVRVLENELKIDGVSVAKSLCGKDADVKGIGL

SEQ ID NO: 65568 - DNA, 1260 bp, Arabidopsis thaliana
  CDS (1)..(1260)
atgtttagttttggccgagcaagaagccaagggaggcaaaacagatctatgtctcttggaggactggattatgcagaccccaagaagaaaaacaattacttgggaaagattcttttgacagcttctcttacagccttgtgcattttcatgctcaagcaatctccaacattcaatactcctagcgtgttttctcgacatgagccaggggttacacatgttttggtcactggtggtgctgggtatattggttcacatgcagctctaaggcttctaaaggaatcatatcgagtgaccattgtggacaatctatcacggggcaatctcgctgcagtcaggattttgcaagaactatttccggaacctggaaggcttcaatttatttatgctgatcttggagatgccaaagctgtcaacaagatattcacagagaatgcctttgacgctgtgatgcatttcgctgctggtgcatatgttggggaaagcacacaattccctcttaagtattatcacaatattacatcgaacactttggtagtattagagacaatggctgctcatggagtaaagactttgatatattcaagcacttgtgcaacgtatggggagcctgatattatgccaattacagaggaaactcctcaggtgccaatcaacccatatggtaaggccaagaagatggcagaagatatcattttggatttctcgaaaaactcagatatggcagttatgatcctaagatatttcaatgtgattgggtccgatccagagggcagattgggtgaagccccaagacctgagctgcgagagcatggacgcatctccggtgcttgttttgatgcagcacgtggcatcatgcctggcctacagatcaaaggaacagactacaaaaccgctgatggaacttgcgtacgggattacattgatgtcactgatttggttgatgctcatgttaaagctcttcaaaaggcaaaaccacgcaaagttggaatctacaatgttggcaccgggaaaggtagctcggtgaaagagtttgttgaggcgtgcaagaaagcaactggtgttgagatcaagatcgactatttgcctagacgtgcaggtgattacgctgaggtttacagtgatccaagcaagattaggaaggaacttaactggacagctaagcacactaatctcaaagagagtcttgagactgcatggagatggcagaagctgcaccgtaatggctatggcttaacaacctcatcggtctcggtttactga

SEQ ID NO: 65569 - protein, 419 aa, Arabidopsis thaliana
MFSFGRARSQGRQNRSMSLGGLDYADPKKKNNYLGKILLTASLTALCIFMLKQSPTFNTPSVFSRHEPGVTHVLVTGGAGYIGSHAALRLLKESYRVTIVDNLSRGNLAAVRILQELFPEPGRLQFIYADLGDAKAVNKIFTENAFDAVMHFAAGAYVGESTQFPLKYYHNITSNTLVVLETMAAHGVKTLIYSSTCATYGEPDIMPITEETPQVPINPYGKAKKMAEDIILDFSKNSDMAVMILRYFNVIGSDPEGRLGEAPRPELREHGRISGACFDAARGIMPGLQIKGTDYKTADGTCVRDYIDVTDLVDAHVKALQKAKPRKVGIYNVGTGKGSSVKEFVEACKKATGVEIKIDYLPRRAGDYAEVYSDPSKIRKELNWTAKHTNLKESLETAWRWQKLHRNGYGLTTSSVSVY

SEQ ID NO: 65570 - DNA, 1026 bp, Pseudomonas aeruginosa
  CDS (1)..(1026): transl_table=11
atgaacgcttacgctaaggctttaagtaggctagagactactactagtagttggctggtcactggggttgccggttttattggatcgaatcttctggagttacttctgaaatttaatcagaaggttgtggggttggatgatttttctaccgggcatatgtataaccttgatgaagtgagggggcttgttggcgaggagagatggaggaacttcaagcttatacagggggatatcagagacattggtgattgcaggcgtgcagtcgagggcgtcgattatgttcttcatcaggccgccttgggttccgttcctcgctcaattgcagatccgattactacaaactcggtaaatatctcaggatttctgaatatcctcgtggcgtccaaagaggcgggggttaagagccttacctatgcagctagtagttcaacctatggtgaccacccaggattgcctaaggtagaggaagttatagggaaaccactgtcgccctatgcagtaaccaagtacgtcaatgagctttatgctgatgtcttttcgcgctgctatggcttcaacttgattggtttgagatattttaatgtttttggaaaacggcaggatcctaatggggcctatgctgcagtgattccaaaatggatttcagctatgataaagggtgagcccgtatatattaatggggatggtgaaactagtcgggatttttgcttcattaataatgtgataaaagcgaatctgctggctgctttttgtgaaaccgaagaggcaaaaaatcaggtttataatgttgcttatggtggtcgcacaacattgggtcagctttttgactcgctaaaagttgagctttcccggaacggtattaactatgagcaaggacctatttatagggagtttcgtgcgggggatgtacgtcactctcaagcggaaatcaaaaaggctcaagcctatctaggctataatcccgaatatgatatccaggctggtattgctgaggctatgccttggtatatatcttttgtaaagtag

SEQ ID NO: 65571 - protein, 341 aa, Pseudomonas aeruginosa
MNAYAKALSRLETTTSSWLVTGVAGFIGSNLLELLLKFNQKVVGLDDFSTGHMYNLDEVRGLVGEERWRNFKLIQGDIRDIGDCRRAVEGVDYVLHQAALGSVPRSIADPITTNSVNISGFLNILVASKEAGVKSLTYAASSSTYGDHPGLPKVEEVIGKPLSPYAVTKYVNELYADVFSRCYGFNLIGLRYFNVFGKRQDPNGAYAAVIPKWISAMIKGEPVYINGDGETSRDFCFINNVIKANLLAAFCETEEAKNQVYNVAYGGRTTLGQLFDSLKVELSRNGINYEQGPIYREFRAGDVRHSQAEIKKAQAYLGYNPEYDIQAGIAEAMPWYISFVK

SEQ ID NO: 65572 - DNA, 1020 bp, Escherichia coli
  CDS (1)..(1020): transl_table=11
atgaatatattagttacaggtggagcaggctatattggctcgcatactagtttatgtcttctgaataaaggttacaatgttgtaatcattgacaacttaattaattcatcttgcgagagcattcgaaggattgaattaatagctaaaaaaaaagttactttctatgagttgaacatcaacaatgaaaaagaagttaatcaaattctaaaaaaacacaaatttgattgtataatgcattttgccggtgcaaagtctgttgctgaatctttaataaaacccattttttattatgataataatgtttcagggacgttgcaattaattaattgcgctataaaaaacgatgtggctaattttatttttagctcttctgcaacggtttatggtgaaagcaaaataatgcctgtaacagaagattgccatataggaggaacattaaatccatatggtacatcaaagtatatatcagaattgatgattagagatattgcaaaaaaatatagcgatactaattttttgtgtctgagatattttaacccaacaggtgctcacgagtcgggaatgatcggtgaaagtcccgctgatataccaagcaatttagttccttatatattacaagttgctatgggtaaactagaaaaacttatggtgtttgggggggattaccctacaaaggatggaaccggtgttcgtgattatatacacgtaatggatttagcggaagggcatgtggctgctttatcttaccttttccgtgataataacactaattatcatgtttttaatttaggtactggtaaaggatattctgttttagagctggtttctacctttgaaaaaatatctggggttagaattccatatgaaattgtttcgagaagagatggggatattgctgaaagttggtcatcaccagaaaaagcaaataagtatctcaattggaaagctaaaagggaattggaaacaatgcttgaggatgcctggcgctggcaaatgaaaaacccaaatggttatatttaa

SEQ ID NO: 65573 - protein, 339 aa, Escherichia coli
MNILVTGGAGYIGSHTSLCLLNKGYNVVIIDNLINSSCESIRRIELIAKKKVTFYELNINNEKEVNQILKKHKFDCIMHFAGAKSVAESLIKPIFYYDNNVSGTLQLINCAIKNDVANFIFSSSATVYGESKIMPVTEDCHIGGTLNPYGTSKYISELMIRDIAKKYSDTNFLCLRYFNPTGAHESGMIGESPADIPSNLVPYILQVAMGKLEKLMVFGGDYPTKDGTGVRDYIHVMDLAEGHVAALSYLFRDNNTNYHVFNLGTGKGYSVLELVSTFEKISGVRIPYEIVSRRDGDIAESWSSPEKANKYLNWKAKRELETMLEDAWRWQMKNPNGYI

SEQ ID NO: 65574 - DNA, 1011 bp, Streptococcus thermophilus
  CDS (1)..(1011): transl_table=11
atggcaattttagtattaggtggagctggttatatcggttctcacatggttgatcgcttagttgaaaaaggtcaagaaaaagtagtagtagtagatagtttggtaacaggtcaccgtgctgccgttcatccagatgctattttttatcaaggcgatctttctgatcaggattttatgagaaaggtcttcaaagaaaaccctgatgttgatgctgttattcactttgcggcctattctttggttggtgaatcaatggaaaaaccactcaaatattttgataacaacacagctggaatgattaaattgcttgaggttatgaacgaatgcggtgttaaatacattgtcttctcatcaacagcagcaacttacggaattccagaagaaattccaattcttgaaacaacaccacaaaatcctatcaacccatatggtgaaagtaagttgatgatggaaaccattatgaagtggtcagaccaagcttacggcatcaagtatgtccctcttcgttactttaatgtggcgggtgccaaacctgatggttcgattggtgaggaccacgatccagaaactcaccttctaccgattattcttcaagtagctcaaggtgttcgtgaaaaaatcatgatctttggggatgactacaatactccagacgggactaacgttcgtgactatgtgcatccattcgacttggcggacgctcacctccttactgttgaatatcttcgtaaaggtaatgaatctacagccttagacttaggttcatcaacaggtttctcaaaccttcaaattcttgaagcagcttgtaaggtaactggtaaagagattccagctgaaaaagctgatcgtcttcgtggtgatcctgatatattgattgcttcatctgaaaaagcacgtacagtttttggatggaaaccacaatttgataacatcgacaatatcatcgctagtgcttgggcatggcattctaaccatcctaaagggtacgatgatcgaggattattaaaataa

SEQ ID NO: 65575 - protein, 336 aa, Streptococcus thermophilus
MAILVLGGAGYIGSHMVDRLVEKGQEKVVVVDSLVTGHRAAVHPDAIFYQGDLSDQDFMRKVFKENPDVDAVIHFAAYSLVGESMEKPLKYFDNNTAGMIKLLEVMNECGVKYIVFSSTAATYGIPEEIPILETTPQNPINPYGESKLMMETIMKWSDQAYGIKYVPLRYFNVAGAKPDGSIGEDHDPETHLLPIILQVAQGVREKIMIFGDDYNTPDGTNVRDYVHPFDLADAHLLTVEYLRKGNESTALDLGSSTGFSNLQILEAACKVTGKEIPAEKADRLRGDPDILIASSEKARTVFGWKPQFDNIDNIIASAWAWHSNHPKGYDDRGLLK

SEQ ID NO: 65576 - DNA, 1002 bp, Streptococcus salivarius
  CDS (1)..(1002): transl_table=11
atggcaattttagtattaggtggagctggttatatcggttctcacatggttgatcgcttagttgaaaaaggtcaagaaaaagtagtagtagtagatagtttggtaaccggtcaccgtgctgccgtacatccagatgctattttctaccaaggcgatctctctgatcaagattttatgagaaaggtcttcaaagaaaatcctgatgttgatgccgttattcactttgcggcctattcattggttggtgaatcaatggaaaaaccactcaaatattttgataacaatacagctggaatggttaaattgcttgaagttatgaacgaatgcggtgttaaatacattgtcttctcatcaacagcagcaacttacggtatcccagaagaaattccaattcttgaaacaacaccacaaaatcctatcaacccatatggtgagagcaagcttatgatggaaaccattatgaagtggtcagaccaagcttacggcatcaagtatgtccctcttcgttactttaatgtggcgggtgccaaacctgatggttctatcggagaggatcacggtcctgaaacccacctcttgccaattattctccaagtagctcaaggtgttcgtgaaaaaatcatgatttttggtgatgactacaacactcctgatggaacaaatgttcgtgactatgttcacccatttgacttggctgatgctcacctccttgctgttgaatatcttcgtaaaggtaatgaatctacagcctttaacttaggttcatcaacaggtttctcaaaccttcaaattcttgaagccgctcgtaaggtaactggtaaagaaattccagctgaaaaagctgatcgtcgtcctggtgatcctgatacattgattgcttcatctgaaaaagcacgtacagttcttggatggaaaccacaatttgataacatcgaaaaaatcatcgcaagtgcttgggcatggcattctagccatccaaaagggtacgatgatcgaggataa

SEQ ID NO: 65577 - protein, 333 aa, Streptococcus salivarius
MAILVLGGAGYIGSHMVDRLVEKGQEKVVVVDSLVTGHRAAVHPDAIFYQGDLSDQDFMRKVFKENPDVDAVIHFAAYSLVGESMEKPLKYFDNNTAGMVKLLEVMNECGVKYIVFSSTAATYGIPEEIPILETTPQNPINPYGESKLMMETIMKWSDQAYGIKYVPLRYFNVAGAKPDGSIGEDHGPETHLLPIILQVAQGVREKIMIFGDDYNTPDGTNVRDYVHPFDLADAHLLAVEYLRKGNESTAFNLGSSTGFSNLQILEAARKVTGKEIPAEKADRRPGDPDTLIASSEKARTVLGWKPQFDNIEKIIASAWAWHSSHPKGYDDRG

SEQ ID NO: 65578 - DNA, 1005 bp, Pasteurella piscicida
  CDS (1)..(1005): transl_table=11
atgaaatatttagtgaccggtgctgcgggctttattggaagtgcagtaactgagcgtttatgcgctttaggccatcaggttgttggtgttgataaccttaatgactattacgatgtgtctttaaaacaagcgcgtctgcagcgtgccgctaatccattgtttactttcattgaattggatcttgcggatcgtgaaggtgtggctcagttatttgcagatcagcaatttgataaagtgatccatttggcggcgcaagcaggagttcgttattctattgataatcctctggcttacgccgatagtaacttggtggggcatttaacgattctagaaggttgtcgccatcacaaggttaaacatttggtttatgcctcttctagttcggtatatggcttaaatcacaagacgccttttaatacctcagacagtgttgatcacccaatttcgctttatgctgcgaccaaaaaatccaatgaattaatggcgcatacctattctcatctttacggtgttccaacgacgggtctacgcttctttaccgtatatggtccatggggccgtccagatatggcactatttaagttcactaatgccattatggaagggaaagaaattgatgtgtataaccacggagatatgcgtcgagactttacctatatcgatgatattgtcgaaggggttatgcgtattcaagatgtgattcctgaaccaaatccagattggacagtagagacaggctctccagcgaccagttcagcaccttatcgagtgtataacattggccatggtagtcctgtaaaactgatggattacatcgaagcgcttgaagaggcgctaggcatcgaagcgaagaaaaactttatggatatgcagccgggtgatgtttacatgacttatgctgatacagaagatttatttaacgcaacaggctacaaacctgaagtgaaagtaaaagagggcgtaaaagcctttgtggattggtatcgagcttactatcagaagtaa

SEQ ID NO: 65579 - protein, 334 aa, Pasteurella piscicida
MKYLVTGAAGFIGSAVTERLCALGHQVVGVDNLNDYYDVSLKQARLQRAANPLFTFIELDLADREGVAQLFADQQFDKVIHLAAQAGVRYSIDNPLAYADSNLVGHLTILEGCRHHKVKHLVYASSSSVYGLNHKTPFNTSDSVDHPISLYAATKKSNELMAHTYSHLYGVPTTGLRFFTVYGPWGRPDMALFKFTNAIMEGKEIDVYNHGDMRRDFTYIDDIVEGVMRIQDVIPEPNPDWTVETGSPATSSAPYRVYNIGHGSPVKLMDYIEALEEALGIEAKKNFMDMQPGDVYMTYADTEDLFNATGYKPEVKVKEGVKAFVDWYRAYYQK

SEQ ID NO: 65580 - DNA, 1029 bp, Streptomyces viridochromogenes
  CDS (1)..(1029): transl_table=11
atggcgcactgtctggtgaccggcggagccggcttcatcggctcgcatgtggcggaggctctgctcagccgcgggcaccgggtatcggtcctcgacgacctcagcggcggcaccgccgagcgtgtccccgagggcgcgcacctgttcaccgggtcggtgaccgatgtggagctggtcgacaggctcttcgccgagcagcgattcgaccacgtcttccacttcgcggcgttcgcggcggaggcgatcagtcactcggtgaagagcctcaactacggcaccaacgtgatgggcagcgtgaacctcatcaacgcggcgctgcgaaccggcgtctcgttcttctgtttcgcgtcctccgtcgcggtgtacgggcacggcgagaccccgatgcgggagtcgtcgatcccggtaccggccgacagttacggcaacgcgaaactcacggtcgagcgcgagctggaaacgacgatgcggacccagggcctgcccttcaccgcattccgtatgcacaacgtgtacggcgaatggcagaacatgcgcgacccctatcgcaatgcggtcgccattttcttcaaccagatcctgcgcggtgagccgatctcggtctacggcgacggcggtcaggtgcgggcgttcagctacgtcaaggacatcgtggacgtcatcgtgcgcgcccccgagacggagaaggcctggggccgggccttcaacgtcggctcgtcccgcaccaacaccgtgctggagctggcccaggccgtgcgtgcggcggccggtgtccccagccaccccatcgcgcacctgcccgcccgggacgaggtgatggtcgcctacaccgccaccgaggaggcccgcgaggtcttcggcgactgggcggacaccccgctggcggacgggctcgcccggaccgccgcgtgggccgcctccgtcggccccgccgaactgcgctcctccttcgagatcgagatcggcggagagcgcgtcccggagtgggcgcagtgtgtggccgaccggctgagcggcgccgaccggtga

SEQ ID NO: 65581 - protein, 342 aa, Streptomyces viridochromogenes
MAHCLVTGGAGFIGSHVAEALLSRGHRVSVLDDLSGGTAERVPEGAHLFTGSVTDVELVDRLFAEQRFDHVFHFAAFAAEAISHSVKSLNYGTNVMGSVNLINAALRTGVSFFCFASSVAVYGHGETPMRESSIPVPADSYGNAKLTVERELETTMRTQGLPFTAFRMHNVYGEWQNMRDPYRNAVAIFFNQILRGEPISVYGDGGQVRAFSYVKDIVDVIVRAPETEKAWGRAFNVGSSRTNTVLELAQAVRAAAGVPSHPIAHLPARDEVMVAYTATEEAREVFGDWADTPLADGLARTAAWAASVGPAELRSSFEIEIGGERVPEWAQCVADRLSGADR

SEQ ID NO: 65582 - DNA, 1041 bp, Citrobacter freundii
  CDS (1)..(1041): transl_table=11
atgacagcctatgatgaattagaaatacaactcgttcttgaaccaaaacgttggcttattactggcgtagcaggttttatcggctctggattattagaagaactactctatttaaatcaaacagtaattgggttggataacttttcaactggctatcaacataatttagaggatgtccgtgccgctgtcagtgaagaacaatggtcgcggtttacctttgttcatggggatatccggtcgtttgccgattgtcaggctgtttgtgagaatgtcgattacgttttacatcaggccgctctgggaagcgtaccacgttccttgcaggatcctatcacgacaaatagcgctaacattgatggttttttaaatatgttgacggcggcgagagatgcacatgtatctggtttcacctatgccgcaagcagtagtacttatggtgaccatcccgatttacctaaaattgaggaccggatcggccggccattaagcccgtatgcggttacaaaatacgtcaatgaattgtacgccgaggtgtttgctcgcagctatgattttaacgctattggcctgcgctactttaatgtatttggccgccgccaaaaccctaacggagcatactctgcagtcattcctcgctggatactatcgcttcttaaagatgaaccaatttatatcaatggcgatggttcaacaagccgggatttttgctatatagaaaatgtgattcaggccaatttattatcagcaacgactaatgatttagcctcaaaaaataaaatctataatgtggctgttggagacagaacttcgctaaatgagctttattatctcatccgcggtgggttgaatttatggcgggacgaacaaattagtgctgaaccaatttataaagattttcgtgacggtgacgttaagcatagtcaggcagatattaccagaataaaaacatttctttcatatgagcctgagtttgatatcaaagaaggacttaagcagactctaaaatggtatatcgataaaaagactgctttgtattcctga

SEQ ID NO: 65583 - protein, 346 aa, Citrobacter freundii
MTAYDELEIQLVLEPKRWLITGVAGFIGSGLLEELLYLNQTVIGLDNFSTGYQHNLEDVRAAVSEEQWSRFTFVHGDIRSFADCQAVCENVDYVLHQAALGSVPRSLQDPITTNSANIDGFLNMLTAARDAHVSGFTYAASSSTYGDHPDLPKIEDRIGRPLSPYAVTKYVNELYAEVFARSYDFNAIGLRYFNVFGRRQNPNGAYSAVIPRWILSLLKDEPIYINGDGSTSRDFCYIENVIQANLLSATTNDLASKNKIYNVAVGDRTSLNELYYLIRGGLNLWRDEQISAEPIYKDFRDGDVKHSQADITRIKTFLSYEPEFDIKEGLKQTLKWYIDKKTALYS

SEQ ID NO: 65584 - DNA, 1062 bp, Arabidopsis thaliana
  CDS (1)..(1062)
atgggttcttctgtggaacagaacattttggtgactggtggtgctggattcattggaacacatactgttgttcagcttttgaatcagggttttaaggttacgatcattgataatcttgataactctgtcgttgaagctgttcatagggttagggaacttgttggtcctgatctctctaccaagcttgaattcaatctgggtgatctaagaaacaaaggagatattgagaaactcttttccaatcagagaaacagatttgatgctgtgattcactttgctggtcttaaagctgtgggagaaagtgttggaaaccctcgtcgttactttgataataacttagttggaactatcaatctatatgagaccatggcaaaatacaactgcaaaatgatggtgttttcgtcgtctgcaacagtttatggtcaacctgaaatagtcccatgtgtggaagactttgagttacaggctatgaatccttatggtcgtactaagctgtttcttgaagagatagctagagacattcacgctgcggaaccagaatggaagataattcttctgaggtacttcaatccggttggagctcacgagagtggaagaattggagaagatccaaagggcataccgaataatctcatgccttatatccaacaagtggcggttggaagattacctgaactcaatgtatttggacatgattatcctaccatggatggtagcgcggttagagactacatccatgtaatggatttagcagatggccatgtggctgcgttaaacaaattgttttcagactcaaagattggctgtactgcttataatcttggcactggtcaaggaacttctgtcttagaaatggtttcttcttttgaaaaagcttctggcaagaaaatacctatcaagctatgtccaagaagagctggagatgcaacagctgtttatgcttcaactcagaaagctgagaaggaacttggctggaaggcaaaatatggagttgatgagatgtgcagagatcaatggaactgggcaaataagaatccatggggtttccagaagaagccttga

SEQ ID NO: 65585 - protein, 353 aa, Arabidopsis thaliana
MGSSVEQNILVTGGAGFIGTHTVVQLLNQGFKVTIIDNLDNSVVEAVHRVRELVGPDLSTKLEFNLGDLRNKGDIEKLFSNQRNRFDAVIHFAGLKAVGESVGNPRRYFDNNLVGTINLYETMAKYNCKMMVFSSSATVYGQPEIVPCVEDFELQAMNPYGRTKLFLEEIARDIHAAEPEWKIILLRYFNPVGAHESGRIGEDPKGIPNNLMPYIQQVAVGRLPELNVFGHDYPTMDGSAVRDYIHVMDLADGHVAALNKLFSDSKIGCTAYNLGTGQGTSVLEMVSSFEKASGKKIPIKLCPRRAGDATAVYASTQKAEKELGWKAKYGVDEMCRDQWNWANKNPWGFQKKP

SEQ ID NO: 65586 - DNA, 852 bp, Corynebacterium equii
  CDS (1)..(852): transl_table=11
gtgagacttctggttaccggcggcgcaggatacgtcggcagcgtgtgcaccaccgtgctgctcgagcgtggccacgaggtggtcgtcgtcgacgacctctcgaccggaaacgccgacgccgtgccggcaggtgccgagttcatcgagggtgacatcgccgctgttgccggatccgtgctcggatccggcaacagcacaccccgtttcgacggtgtgttgcatttcgccgcacagtcgctggtcggcgagtccgtcgagcgtccggagcagtactggcagggcaacgtcgtgacgacgctcgcgctgctcgaggccatgcggctgtcgggcacaccccgcctggtgttctcgtccaccgcggccacctacggcgagccggaacgcacacccatcaccgaggacgcaccgacccgtcccaccaacccgtacggcgccacgaagctcgcgatcgaccacgcgatcacgtcgtacgcgaacgcgcactcgctcgccgccaccagcctgcgctacttcaacgtcgccggagcctacaggggcgcgggtgagaaccgagtcgtggaaacacatctcattcccctcgtgctccaggtcgcgttgggtcaacgcgagaagatctccgtcttcggcaccgactggcccaccaaggacggcaccgcggtgcgcgactacatccacgtcctcgacctggccgacgcccacctgctggccctcgagtcgtcggtccccggacaccaccgcatctacaacctcggtagcggcgccggatttcactgtccgcgaagtcatttcggcctgcgagcgggtgaccggcctgcccatcgccgccgaggacgccccccgacgcgcgggtga

SEQ ID NO: 65587 - protein, 283 aa, Corynebacterium equii
MRLLVTGGAGYVGSVCTTVLLERGHEVVVVDDLSTGNADAVPAGAEFIEGDIAAVAGSVLGSGNSTPRFDGVLHFAAQSLVGESVERPEQYWQGNVVTTLALLEAMRLSGTPRLVFSSTAATYGEPERTPITEDAPTRPTNPYGATKLAIDHAITSYANAHSLAATSLRYFNVAGAYRGAGENRVVETHLIPLVLQVALGQREKISVFGTDWPTKDGTAVRDYIHVLDLADAHLLALESSVPGHHRIYNLGSGAGFHCPRSHFGLRAGDRPAHRRRGRPPTRG

SEQ ID NO: 65588 - DNA, 993 bp, Campylobacter jejuni
  CDS (1)..(993): transl_table=11
atgatgatgaaaattcttattagcggtggtgcaggttatataggttctcatactttaagacaatttttaaaaacagatcatgaaatttgtgttttagataatctttctaagggttctaaaatcgcaatagaagatttgcaaaaaataagaacttttaaattttttgaacaagatttaagtgattttcaaggcgtaaaagcattgtttgagagagaaaaatttgacgctattgtgcattttgcagcgagcattgaagtttttgaaagtatgcaaaaccctttaaagtattatatgaataacactgttaatacgacaaatctcatcgaaacttgtttgcaaactggagtgaataaatttatattttcttcaacggcagccacttatggcgaaccacaaactcccgttgtgagcgaaacaagtcctttagcacctattaatccttatgggcgtagtaagcttatgagcgaagaggttttgcgtgatgcaagtatggcaaatcctgaatttaagcattgtattttaagatattttaatgttgcaggtgcttgcatggattatactttaggacaacgctatccaaaagcgactttgcttataaaagttgcagctgaatgtgccgcagaaaaacgtaataaacttttcatatttggcgatgattatgatacaaaagatggcacttgcataagagattttatccatgtggatgatatttcaagtgcgcatttatcggctttggattatttaaaagagaatgaaagcaatgtttttaatgtaggttatggacatggttttagcgtaaaagaagtgattgaagcgatgaaaaaagttagcggagtggattttaaagtagaacttgccccacgccgtgcgggtgatcctagtgtattgatttctgatgcaagtaaaatcagaaatcttacttcttggcagcctaaatatgatgatttagggcttatttgtaaatctgcttttgattgggaaaaacagtgctaa

SEQ ID NO: 65589 - protein, 330 aa, Campylobacter jejuni
MMMKILISGGAGYIGSHTLRQFLKTDHEICVLDNLSKGSKIAIEDLQKIRTFKFFEQDLSDFQGVKALFEREKFDAIVHFAASIEVFESMQNPLKYYMNNTVNTTNLIETCLQTGVNKFIFSSTAATYGEPQTPVVSETSPLAPINPYGRSKLMSEEVLRDASMANPEFKHCILRYFNVAGACMDYTLGQRYPKATLLIKVAAECAAEKRNKLFIFGDDYDTKDGTCIRDFIHVDDISSAHLSALDYLKENESNVFNVGYGHGFSVKEVIEAMKKVSGVDFKVELAPRRAGDPSVLISDASKIRNLTSWQPKYDDLGLICKSAFDWEKQC

SEQ ID NO: 65590 - DNA, 1014 bp, Bradyrhizobium japonicum
  CDS (1)..(1014): transl_table=11
atgaccgtgctcgtgaccggcggtgccggctatatcggaagtcacatggttcatgcgctggtcgatgccggcgagagcgtcgtcgtgatcgacaacctttccaccggcttctccgcgttcctgcccgaaggcgtgccgctgttcattggcgacgccggcgacgagaacctcgtcgaaggcgtgatcgcccagcacggcatcgacagcatcatccatttcgcgggctccgtcgtggtaccggactcgatgcgcgatccgctcggctactaccgcaacaacaccatgacgacgggcagcctgctcaacgcggcggtgaagggcggcgtcagccgcttcatcttctcctcgaccgcggccgtctacggcaacccggaccgggtgccggtgccggagatcgcaccgacccgtccgctgtcgccctacggctcgtcgaagctgatgaccgagatcatgctgcacgacgtcgcatccgctcatggcatgagctacgtcgtgctgcgctacttcaacgtcgccggcgccgacccgaagggccgcgtcggccttgccaccaccggcgccacccatctgctcaagatcgcggtcgaggccgcaaccggccagcgcgccaagatcgacgtgttcggcaccgactatccgacccaggacggcagctgcatcagggacttcatccatgtcagcgacctcgtcgaggcgcatcgcgcggcgctgtcctatctgcgcgccggcgggcaatcggtgacgctgaattgcggttatggccgcggctattccgtgctcgaaaccatcgaggcggtgcgccgggtctcgatgcgcaacttcgcggtcgcctacgccgcgcgccggcccggcgacatcatgaccatggtggccgacacgacaaggatccgctcgctgctcgactggacgccgcgcttcgacgatctcgagaccatcgcgagccacgcactggcctgggaggagaagctgttccgggagcgcgcgggctccgcgcgacaggcggaatcggcctaa

SEQ ID NO: 65591 - protein, 337 aa, Bradyrhizobium japonicum
MTVLVTGGAGYIGSHMVHALVDAGESVVVIDNLSTGFSAFLPEGVPLFIGDAGDENLVEGVIAQHGIDSIIHFAGSVVVPDSMRDPLGYYRNNTMTTGSLLNAAVKGGVSRFIFSSTAAVYGNPDRVPVPEIAPTRPLSPYGSSKLMTEIMLHDVASAHGMSYVVLRYFNVAGADPKGRVGLATTGATHLLKIAVEAATGQRAKIDVFGTDYPTQDGSCIRDFIHVSDLVEAHRAALSYLRAGGQSVTLNCGYGRGYSVLETIEAVRRVSMRNFAVAYAARRPGDIMTMVADTTRIRSLLDWTPRFDDLETIASHALAWEEKLFRERAGSARQAESA

SEQ ID NO: 65592 - DNA, 990 bp, Rhodococcus erythropolis
  CDS (1)..(990): transl_table=11
atgaaactcctggtcaccggcggcgccggttacgtcggcagtgtgtgcagcactgtgttgctcgagcgtggacacgaggttgtcgtcatcgacgacctctccaccggaaatgccgacgcggtgcctgccggtgccgagttcatcgaaggagacgtgggagcgcttgctgccgacgtcctcggcagtgcgggttcaccggttttcgacggtgtgcttcacttcgcagcgcagtcgctggtgggcgaatcggtgcttcaccctgaaaagtactggcgcggaaacgtcgtcacgaccatcgagttgctcgaggctatccgtgtctccggtactccccgcctcgtgttctcgtccaccgccgctacgtacggcgaaccggagcagtcacccatcgtggagaccgctccgacccgccccaccaatccgtacggcgcgaccaagctcgcgatcgatcatgcgatcacctcgtactcgatcgcccacggcctcggtgcgacgagcttgcgctacttcaacgtcgcaggtgcgtacaagtccgccggcgagaaccgggtgatcgaaacccacctgattccactcgtcctgcaggtcgcgctcgaacagcgggacaagatctcggtcttcggaaccgactggcccacgccggacggaaccgcggtacgcgactacatccacgtgctggacctcgccgaagcacatctactggcgctcgaatcctcggttcccggcgagcaccgcatctacaacctcggaagcggtgccggcttcagcgtgcgcgaggtgatcgccgcctgtgcgcgggtcaccggcctgccgatcaacgtcgaggacgcgtcacgacggctgggtgatccggcagtactgatcgcatcgagcgacaaggcgattgccgagctgggttggacgcccacgcgtaccgatctcgacgtcatcgtcgccgacgcatggcagttcctccaggatctgggcgaccgctcacacgctgctcgctag

SEQ ID NO: 65593 - protein, 329 aa, Rhodococcus erythropolis
MKLLVTGGAGYVGSVCSTVLLERGHEVVVIDDLSTGNADAVPAGAEFIEGDVGALAADVLGSAGSPVFDGVLHFAAQSLVGESVLHPEKYWRGNVVTTIELLEAIRVSGTPRLVFSSTAATYGEPEQSPIVETAPTRPTNPYGATKLAIDHAITSYSIAHGLGATSLRYFNVAGAYKSAGENRVIETHLIPLVLQVALEQRDKISVFGTDWPTPDGTAVRDYIHVLDLAEAHLLALESSVPGEHRIYNLGSGAGFSVREVIAACARVTGLPINVEDASRRLGDPAVLIASSDKAIAELGWTPTRTDLDVIVADAWQFLQDLGDRSHAAR

SEQ ID NO: 65594 - DNA, 990 bp, Staphylococcus carnosus
  CDS (1)..(990): transl_table=11
atgtcagttttagtgttaggtggagcagggtacatcggcagtcatgctgctgatcaattgatagaacaaggatatgatgtagcagttgtagataatcttggaacaggtcatcgtcaagctgtcccggaaacagcacgtttttatgaaggggatattagagataaagcatttttaaatcacgtttttgaacaagaaaatgtcgaaggtgtttttcatttttgtgcatattctttagtaggagaatctgttgagaagccattagaatattttaataacaatgtctatggcatgcaagtattattagaagtgatgaaagcacatgatgttaatgaaataattttttcttctacagcagcagtatacggagaacctgaaattattccaattcaagaagatgcaccaaaagctccaacgaacccatatggtgaaagtaaacttatgatggaaaaaatgatgcattggtgtcataacgcatacggtgtgaattatgctgcattacgttattttaatgttgcaggtgcaaaagaggatggaagtatcggtgaagaccataacccagaaacgcacttaattccaatcgtattgcaagctgcattaggacagcgtgatgctatcactattttcggtacagattatgatacagaagacggttcatgtgttcgcgattatttacatgttacagatttgattgcggcacatattttagcgtatcaatatttaaaagacggtggagaaagcggcgcgtttaatctaggaagcagccaaggatattctgtcattgaaattgtagaagctgcacgtaaagcaacaggaattgatatcaaagcagaaattggtgaaagacgtgctggggatccaagtaaattggtagcatctagtgataaagcacaacgtgtacttggttggaaacctaaacatgatgatattcatgaaattattgaaacagcatggaactggcatcaatcacatccaaacggatattcaaattaa

SEQ ID NO: 65595 - protein, 329 aa, Staphylococcus carnosus
MSVLVLGGAGYIGSHAADQLIEQGYDVAVVDNLGTGHRQAVPETARFYEGDIRDKAFLNHVFEQENVEGVFHFCAYSLVGESVEKPLEYFNNNVYGMQVLLEVMKAHDVNEIIFSSTAAVYGEPEIIPIQEDAPKAPTNPYGESKLMMEKMMHWCHNAYGVNYAALRYFNVAGAKEDGSIGEDHNPETHLIPIVLQAALGQRDAITIFGTDYDTEDGSCVRDYLHVTDLIAAHILAYQYLKDGGESGAFNLGSSQGYSVIEIVEAARKATGIDIKAEIGERRAGDPSKLVASSDKAQRVLGWKPKHDDIHEIIETAWNWHQSHPNGYSN

SEQ ID NO: 65596 - DNA, 1038 bp, Plesiomonas shigelloides
  CDS (1)..(1038): transl_table=11
atggatatttatatgtctcgctatgaagagattacacagcagttaattttttcaccgaaaacttggttaattactggtgtcgctggctttataggatcaaatcttttagaaaagttacttaaattaaaccaggttgttattgggttagataacttttccacgggacatcaatataatcttgatgaagttaaaacattagtttccactgaacagtggagtcgattttgctttatagaaggtgatattcgagatctcactacctgtgagcaagttatgaaaggtgttgatcatgtcttacatcaggctgcgctaggttctgtacctcgttcaattgttgatcctataacaaccaatgcaactaatattactggatttttgaatatcttacatgcggctaaaaatgcacaagtacaaagttttacttatgctgcatcaagctcaacttatggagatcatcccgcactaccaaaagtagaggaaaacattggtaatccactttctccttatgcagttactaaatatgttaacgagatttatgctcaggtatatgctcgaacatatggttttaaaactattggattacgttattttaatgtatttggtcgtcgtcaagatcctaatggagcttatgctgcagtaattccaaaatggacagcagcaatgcttaaaggtgatgacgtatatattaatggcgatggtgaaacgagtcgtgatttttgttatatagataatgttatacaaatgaatatattatctgcattagcgaaggacagtgctaaagataatatatataatgttgcagttggtgatagaacaacattaaatgaattatctggttacatttatgatgagcttaatttaattcaccatatcgataaattgagcattaagtatagagagtttagatctggagatgttaggcattctcaggctgatgttactaaggctatagatttactacagtatagaccaaatataaaaatcagagagggattacgactttcaatgccgtggtatgtgagatttttaaaaggctaa

SEQ ID NO: 65597 - protein, 345 aa, Plesiomonas shigelloides
MDIYMSRYEEITQQLIFSPKTWLITGVAGFIGSNLLEKLLKLNQVVIGLDNFSTGHQYNLDEVKTLVSTEQWSRFCFIEGDIRDLTTCEQVMKGVDHVLHQAALGSVPRSIVDPITTNATNITGFLNILHAAKNAQVQSFTYAASSSTYGDHPALPKVEENIGNPLSPYAVTKYVNEIYAQVYARTYGFKTIGLRYFNVFGRRQDPNGAYAAVIPKWTAAMLKGDDVYINGDGETSRDFCYIDNVIQMNILSALAKDSAKDNIYNVAVGDRTTLNELSGYIYDELNLIHHIDKLSIKYREFRSGDVRHSQADVTKAIDLLQYRPNIKIREGLRLSMPWYVRFLKG

SEQ ID NO: 65598 - DNA, 1005 bp, Staphylococcus aureus
  CDS (1)..(1005): transl_table=11
atgaaaatattaatcacaggtacagcaggttttattgggtcacatcttgcgaaaaaactaattaaacaaggtcattacgttataggtgtagatagcataaatgattattattcagtttctttgaaagaggatagattaaaatcaatagggaaagagaatttcacttttaataaagtgaaattagaaaattatgacgatttatctaaagtatttgtagatgaacaaccagaagtagtagttaatttagctgctcaagcaggtgttagatacagtattgagaatccaaggacgtatattgattctaatattgtcggttttatgaacattttagaatgcagtaggcattttaatattcaaaatttaatttatgcttcatctagttctgtttatggtgcaaatacttctaaaccatttagcacttcggataatattgatcatccgttaagtttatatgcagcaactaaaaaatcaaatgagctaatggcacatacgtatagtcatttatacaatttacctacaacaggattgagatttttcacagtatatggtccatgggggagaccagatatggcgctatttaaatttacaaaagcaatcgtaaatgatcaagctatagacgtctataatcacggaaatatgatgagagactttacttacgtggatgatattgttgaagcaattagtaggcttgttaagaaaccagcgtcccctaataaagaatggtcaggggccgaccctgaccctggttcctcatatgcaccatataaagtctacaatattgggaacaacagtccagttagattgatggaatttgtagaggctatagagaataaattaggcaaagaagctaggaaaaactacatggatttacaaccaggagatgtacctgaaacttatgcaaatgtagatgacttgtttagagatattgatttcaaaccagaaactacaattcaagatggtgtaaataaatttgttgattggtacttagaatattataaaaaatga

SEQ ID NO: 65599 - protein, 334 aa, Staphylococcus aureus
MKILITGTAGFIGSHLAKKLIKQGHYVIGVDSINDYYSVSLKEDRLKSIGKENFTFNKVKLENYDDLSKVFVDEQPEVVVNLAAQAGVRYSIENPRTYIDSNIVGFMNILECSRHFNIQNLIYASSSSVYGANTSKPFSTSDNIDHPLSLYAATKKSNELMAHTYSHLYNLPTTGLRFFTVYGPWGRPDMALFKFTKAIVNDQAIDVYNHGNMMRDFTYVDDIVEAISRLVKKPASPNKEWSGADPDPGSSYAPYKVYNIGNNSPVRLMEFVEAIENKLGKEARKNYMDLQPGDVPETYANVDDLFRDIDFKPETTIQDGVNKFVDWYLEYYKK

SEQ ID NO: 65600 - DNA, 1047 bp, Azospirillum brasilense
  CDS (1)..(1047): transl_table=11
atgacggatcaaacggcggcctctccccgtgtcctggtgaccggcggggcagggtacatcggcagccatgtccttcacgccctgaccgacgccggcattcccgcggtgacgatcgacgatctgtcggccggccggcgcgaggccatccccgccgccgtgcccctggtcgagggggacatcgggtcggcggaactgctggaccgggtgatgcgcgaccaccgggtggacgcggtgatgcatttcgccggctccatcgtcgtcccggaatcggtcgtgaagccgctcgactactaccggaacaacaccgccaacagcctgacgctgctcggcgcctgcctgcgggcggggatcgacaaggtggtcttctcctccaccgccgcggtctacggcgcgccggaaagcgtgccgatccgcgaggacgcgccgaccgtcccgatcaacccctacggcgcctccaagctgatgacggagcagatgctgcgcgacgccggagcggcccatgggctgcgcagcgtcatcctgcgctacttcaacgtcgccggcgccgatccggcgggccgcaccggacaggcgacgccggtcgcgacccacctcatcaaggtggcctgccaggcgctgctcggccgccggccgccgctggcgatcttcggcaccgactacgacacgccggacggcacctgcatccgcgactacatccatgtcagcgatctcgccgacgcgcatgtgctggcgctgctccatctgcggcgcggtggcgggagcctgctgatgaactgcggctacgggcgcggcgcctccgtccgcgaggtggtgcgcacgctggaagaggtcagcggcgagcaagtgcccgccaccttcgccgaccgccggcccggagatccgccccaactcgtcgccggggccgaccgcatccgggagcagctcggctgggtgccgaagcacgaccggctggacgggatcgtgcgcagcgcgctgtcctgggaacgctcgctggagcagtccgtggggcaggccggggcaccgggagggtccgcctcccggtcatga

SEQ ID NO: 65601 - protein, 348 aa, Azospirillum brasilense
MTDQTAASPRVLVTGGAGYIGSHVLHALTDAGIPAVTIDDLSAGRREAIPAAVPLVEGDIGSAELLDRVMRDHRVDAVMHFAGSIVVPESVVKPLDYYRNNTANSLTLLGACLRAGIDKVVFSSTAAVYGAPESVPIREDAPTVPINPYGASKLMTEQMLRDAGAAHGLRSVILRYFNVAGADPAGRTGQATPVATHLIKVACQALLGRRPPLAIFGTDYDTPDGTCIRDYIHVSDLADAHVLALLHLRRGGGSLLMNCGYGRGASVREVVRTLEEVSGEQVPATFADRRPGDPPQLVAGADRIREQLGWVPKHDRLDGIVRSALSWERSLEQSVGQAGAPGGSASRS

SEQ ID NO: 65602 - DNA, 984 bp, Rhizobium leguminosarum
  CDS (1)..(984): transl_table=11
atggcaggtgaaacggttcttgtcgtcggcggcgccggctatatcggctcgcatacgtgcctcgacctggcgaacaagggctataggcctgtcgtcttcgacaatttttcgaacggtcatcgcgagtttgtcagatgggggccggccgaagagggcgatattcgcgaccgcgcccggctggatgaggtgctggccaagcacaagccggcggcgatcctgcatttcgccgcgctgatcgaagtcggcgaatcggtcaaggatccggtttccttctacgagaacaatgtgatcggcacgttgacgctgctttcggcggcacaagcggccggcatcaacgccttcgtcttctcctcgacctgcgccacttacggcctgccgcagagcgtgccgctcgacgagacccatcggcaggtgccgatcaatccctacgggcgaacgaaatatatcgtcgaacaggcgcttgccgattacgaccagtacgggagcctgcgctcggtggtgctgcgctatttcaatgcggccggcgccgattttgagggccggatcggcgaatggcaccagccggaaacgcatgcgatacccctggcgatcgacgcggcactcggccgccgccaaggcttcaaggtgttcggcagcgattacgagacacgcgacggcacctgtgtgcgcgactatatccatgtgctggatctcgccgatgcgcatgtgcgcgccgtcgaatatctgctgaagggcggcgattccgttgcgctcaacctcggcaccggcaccggcacgacggtgaaggaattgctcggcgcgatcgaagaagtgtcgaaccggcctttcccggtcgaatatatcggccggcgcgaaggcgattcgcacacgctggtggccaataacgacaaggcgcgcgacgtgctcggctgggtgccgcagtatgatctgtctgagatcatccgctccgcctgggattggcatgcaaaatccaaccagcattga

SEQ ID NO: 65603 - protein, 327 aa, Rhizobium leguminosarum
MAGETVLVVGGAGYIGSHTCLDLANKGYRPVVFDNFSNGHREFVRWGPAEEGDIRDRARLDEVLAKHKPAAILHFAALIEVGESVKDPVSFYENNVIGTLTLLSAAQAAGINAFVFSSTCATYGLPQSVPLDETHRQVPINPYGRTKYIVEQALADYDQYGSLRSVVLRYFNAAGADFEGRIGEWHQPETHAIPLAIDAALGRRQGFKVFGSDYETRDGTCVRDYIHVLDLADAHVRAVEYLLKGGDSVALNLGTGTGTTVKELLGAIEEVSNRPFPVEYIGRREGDSHTLVANNDKARDVLGWVPQYDLSEIIRSAWDWHAKSNQH

SEQ ID NO: 65604 - DNA, 987 bp, Rhizobium meliloti
  CDS (1)..(987): transl_table=11
gtgcagaacaacaacattctcgtggtcggcggcgccggctatatcggctcgcatacctgccttcagcttgcggcaaagggttaccaacccgtcgtttacgacaacctctccaacggccacgaggaattcgtcaagtggggcgttctcgaaaagggcgatatccgtgacaggcagcgtcttgacgaggttcttgcgcggcacaagccgcgggcgatcctgcacttcgcggcgatgatcgaggtgggcgagtcggtcaaggacccggccgccttctatgacaacaacgtcatcggcacgctgaccctcttgtctgcggcgcttgccgcgggcatcgacgccttcgtcttctcatcgacgtgcgcgacctacggactgcccgacagcgtaccgatggatgagagccataagcaggccccgatcaatccctatggccgcaccaagtggatctgcgagcaggcgctgaaggactacggtctctacaagggcctgcgctcggtaatcctgcgctacttcaatgccgcgggtgccgacttcgagggccgcatcggcgaatggcatgagccggaaacccatgcgatcccgctcgcgatcgatgcggcacttgggcggcgcgaaggcttcaaggtcttcgggacagactacgacacgcgcgacggaacgtgcgtgcgggactatatccacgtcctcgatctggcggatgcccatgtgcgcgcggtcgactatctcctcgagggcggcgagagcgttgcgctcaatctcgggaccggcaccggtaccacggtgaaggagttgctggacgcgatcgagaaagtggccaagcgaccgttcaacatcggctacgccgagcggcgcgaaggcgactcgaccacgcttgtcgccaacaatgacaaggcgcgtcaggttctaggctgggagccgcaatacgatctcgcagcgattaccgaatcggcatggaactggcactcgcgcagaaatcagggcggctga

SEQ ID NO: 65605 - protein, 328 aa, Rhizobium meliloti
MQNNNILVVGGAGYIGSHTCLQLAAKGYQPVVYDNLSNGHEEFVKWGVLEKGDIRDRQRLDEVLARHKPRAILHFAAMIEVGESVKDPAAFYDNNVIGTLTLLSAALAAGIDAFVFSSTCATYGLPDSVPMDESHKQAPINPYGRTKWICEQALKDYGLYKGLRSVILRYFNAAGADFEGRIGEWHEPETHAIPLAIDAALGRREGFKVFGTDYDTRDGTCVRDYIHVLDLADAHVRAVDYLLEGGESVALNLGTGTGTTVKELLDAIEKVAKRPFNIGYAERREGDSTTLVANNDKARQVLGWEPQYDLAAITESAWNWHSRRNQGG

SEQ ID NO: 65606 - DNA, 2070 bp, Pachysolen tannophilus
  CDS (1)..(2070)
atgtcttacattttggttactggtggtgctgggtatatcggttcgcataccgttgtggaattggtaaataatggttacaacgttgttgttgttgataacttagttaattcttcttatgatgttattgtaagaattgaggtgttgactaggaaacaaattcctttcttcaagattgatttgaatgatcatgatgcgttggatcaagtttttaaactgtatcctatccaagctgttttgcactttgctgctttgaaagcagttggtgaatctactaaattcccattaaattattatagtaataatgttgggggtgcaattagtttgctaaaagttatggaagaaaacaatgttaaaaacattgttttcagttcttctgcaacggtttatggggatgctacaaggtttgaaaatatgattccaatccctgaacattgtccaacgggacctacaaacccatatggtgaaaccaagattaccattgaaaacattatcagggacgtttatgctaatgataagtcatggaaatgtgcaatcttaaggtatttcaatccaattggtgctcatccttctggtttaataggagaagatcctttaggtatacctaataatttgctccctttcttagctcaagtcgctattggtagaagggaaaaattaagtgtctttggaagtgattataattccaaagatggtactcctataagagactacattcacgtgatcgatttagcaaaaggtcacattgctgctttaaattatcttttcaaccataaagataatggtctttgtagagaatggaatcttggaacaggtaatggttctacagtctttgaagttttcaatgccttttgtgaggcagttggtaaaaaattgccatttgaagttgttggtagaagagatggtgatgtcttaaatttaactgcaaatccaaagagagcaaatacagaattaaaatggaaagctcaattatcgattaatgatgcttgtaaagatttatggaattggactacgaaaaatccatttggtttccaaataaacaattattcatggactaaatttgattctgaatcgttgacaaattatgatagattaaatactgtaaggacttttaacggtaaatttgaagtttcaatttcaaatcatggtgctacaattgttgcagctaaattaaacggaattaaattaaatttgggttttgataatttgaaaggctatttaagagaagataatccattctttggggctactattggtagagttgctaacagaatttctaaaggtgatttactcattaatggaacccattaccaagttggtttaaatgagctgcatcgtacatcacttcatggtggtacttatggttataacaagaggactttcttgggtccaattgttaagacaaacgagaaggaaaaggaaactaccatggaatttgtcttgattgatttagatggtactgaaggatatccaggtgatgtcgagactaaagtcatctatacagttagagataccggtgtaggaggtgagcttggtattgaatatgaggctaagttattagaagaaagtggtcgtgattccacagcagttagcttaaccaatcattcttattggaatattggtaatcaaccttcaattgagggaactcacattaaattagtttcaaataaacatttggagagtaatcctctggattcaactccaactggtaaaattgttacttcaactgatttggattcccaaaattctgccaaattaggtccagatggtcctgtatttgactattgttttgtcacaaaacaacaggataagttggatacaagaaatgacgagctacgtgttgttgcaactgcaacacacccaaagacgagaattgcattcactactttgaccacagaacctgcattccaattctacactggtgacggtgtcgatgttgctggagttttcaccaagagaagtggattctgtcttgaagctagcagatacatctataacccaaaatggtttattcctttgaataaaggggaagtttacggttcatataccatttacaggttcgagaatttttaa

SEQ ID NO: 65607 - protein, 689 aa, Pachysolen tannophilus
MSYILVTGGAGYIGSHTVVELVNNGYNVVVVDNLVNSSYDVIVRIEVLTRKQIPFFKIDLNDHDALDQVFKLYPIQAVLHFAALKAVGESTKFPLNYYSNNVGGAISLLKVMEENNVKNIVFSSSATVYGDATRFENMIPIPEHCPTGPTNPYGETKITIENIIRDVYANDKSWKCAILRYFNPIGAHPSGLIGEDPLGIPNNLLPFLAQVAIGRREKLSVFGSDYNSKDGTPIRDYIHVIDLAKGHIAALNYLFNHKDNGLCREWNLGTGNGSTVFEVFNAFCEAVGKKLPFEVVGRRDGDVLNLTANPKRANTELKWKAQLSINDACKDLWNWTTKNPFGFQINNYSWTKFDSESLTNYDRLNTVRTFNGKFEVSISNHGATIVAAKLNGIKLNLGFDNLKGYLREDNPFFGATIGRVANRISKGDLLINGTHYQVGLNELHRTSLHGGTYGYNKRTFLGPIVKTNEKEKETTMEFVLIDLDGTEGYPGDVETKVIYTVRDTGVGGELGIEYEAKLLEESGRDSTAVSLTNHSYWNIGNQPSIEGTHIKLVSNKHLESNPLDSTPTGKIVTSTDLDSQNSAKLGPDGPVFDYCFVTKQQDKLDTRNDELRVVATATHPKTRIAFTTLTTEPAFQFYTGDGVDVAGVFTKRSGFCLEASRYIYNPKWFIPLNKGEVYGSYTIYRFENF

SEQ ID NO: 65608 - DNA, 1056 bp, Arabidopsis thaliana
  CDS (1)..(1056)
atgggttcttctgtggagcagaacattcttgttactggtggtgctggctttatcgggacgcatactgttgttcaacttctcaaagatggttttaaggtttcgatcatcgataattttgataactctgttatcgaagctgttgatagagttagggagcttgttggtcctgatctctccaagaagctcgacttcaatctgggtgatctaagaaacaaaggggacattgagaaactattctccaagcagagatttgatgctgtgattcattttgcgggtcttaaagctgtgggtgagagtgttgaaaaccctcgccgctactttgacaataacttggttggaacaatcaatctatatgagaccatggcaaagtacaactgcaaaatgatggtgttttcatcttctgccactgtttatggacaacctgaaaagattccatgcatggaagactttgaattaaaggctatgaatccttatggtcgtactaagctctttcttgaagaaatagctagagatattcaaaaggcagaaccggaatggagaattattctgctgaggtacttcaatcctgtaggagcacatgagagtggcagtattggtgaggatccaaaaggcatccccaataacctcatgccttacatccaacaagtggccgttggacgtttaccggaactcaatgtctatggacatgactatcccaccgaggatggtagtgcggtaagagactacatccatgtgatggatttagcagatggccatatcgctgcgctcaggaagctatttgctgatccaaagattggttgtactgcttacaatctagggactggtcaaggaacgtctgtgttagaaatggttgcagcttttgaaaaagcttccggcaagaaaatcccgattaagctctgtccgagaaggtcaggagatgcaacagcagtttatgcttcaacagagaaggctgagaaagaacttggctggaaggcaaaatatggagtggatgagatgtgcagagatcagtggaaatgggcaaacaataatccatggggttaccagaataagctttga

SEQ ID NO: 65609 - protein, 351 aa, Arabidopsis thaliana
MGSSVEQNILVTGGAGFIGTHTVVQLLKDGFKVSIIDNFDNSVIEAVDRVRELVGPDLSKKLDFNLGDLRNKGDIEKLFSKQRFDAVIHFAGLKAVGESVENPRRYFDNNLVGTINLYETMAKYNCKMMVFSSSATVYGQPEKIPCMEDFELKAMNPYGRTKLFLEEIARDIQKAEPEWRIILLRYFNPVGAHESGSIGEDPKGIPNNLMPYIQQVAVGRLPELNVYGHDYPTEDGSAVRDYIHVMDLADGHIAALRKLFADPKIGCTAYNLGTGQGTSVLEMVAAFEKASGKKIPIKLCPRRSGDATAVYASTEKAEKELGWKAKYGVDEMCRDQWKWANNNPWGYQNKL

SEQ ID NO: 65610 - DNA, 1053 bp, Pisum sativum
  CDS (1)..(1053)
atggtggcttcgtcgcaaaagatactcgtaaccggcagtgccggtttcatcggcactcacacggtggttcagcttctaaataacggcttcaacgtttccatcattgataatttcgataattctgttatggaagcagtggagcgcgtccgtgaagttgttggttctaacctctctcagaatctcgaattcactctgggagatctcaggaataaagatgatttggagaaactcttctcaaaatctaaatttgatgctgtgattcactttgctggactaaaagcagttggtgagagtgttgaaaatcctcgtcgttatttcgataataatcttgttggaactatcaatctctatgaagttatggctaagcataattgtaaaaagatggttttctcgtcatctgcaactgtttatggccaacctgaaaagataccctgcgtggaggatttcaagttacaagccatgaacccttatggacggaccaagctcttccttgaagaaattgcacgagatattcagaaagctgagccagaatggagaatcgttttactgcggtacttcaatccagtcggggcacatgaaagtggtaaacttggtgaagatcccagaggcatcccaaataatctcatgccttatatacagcaagtagccgttggaagattacctgagctcaatgtatatggtcatgattatcctacaagggatggctctgcgatacgggactatatccatgtgatggacttagcagatggtcacattgctgccctgagaaagcttttcacatcagaaaacattggttgtactgcttataatttgggaactggtcgtggttcatctgtgcttgaaatggttgctgcatttgagaaagcttctggcaagaaaattgcattgaaattgtgtccaagaaggccaggagatgctacagaggtttatgcatccacagcgaaagctgagaaagaacttggttggaaggccaaatatggtgtagaggaaatgtgcagggaccagtggaattgggcaaagaacaacccgtggggttactcaggaaagccttga

SEQ ID NO: 65611 - protein, 350 aa, Pisum sativum
MVASSQKILVTGSAGFIGTHTVVQLLNNGFNVSIIDNFDNSVMEAVERVREVVGSNLSQNLEFTLGDLRNKDDLEKLFSKSKFDAVIHFAGLKAVGESVENPRRYFDNNLVGTINLYEVMAKHNCKKMVFSSSATVYGQPEKIPCVEDFKLQAMNPYGRTKLFLEEIARDIQKAEPEWRIVLLRYFNPVGAHESGKLGEDPRGIPNNLMPYIQQVAVGRLPELNVYGHDYPTRDGSAIRDYIHVMDLADGHIAALRKLFTSENIGCTAYNLGTGRGSSVLEMVAAFEKASGKKIALKLCPRRPGDATEVYASTAKAEKELGWKAKYGVEEMCRDQWNWAKNNPWGYSGKP

SEQ ID NO: 65612 - DNA, 987 bp, Corynebacterium diphtheriae
  CDS (1)..(987)
atgaaactcctcgttaccggtggtgccggatacgtaggaagtgtctgttccactgttctgctcgaacagggacacgaagtaacaattgtcgataatcttacaaccggcaatcgcgatgctgttccactaggagctacttttgtcgagggtgatatcaaagacgttgccgataacgttttatcatctgattcttttgacgcggttcttcacttcgcggctcgttcgcttgtcggcgaatcagttgaaaagccagatgaatattggcagcacaacatggtgaccacactcgcgcttcttgatgccatgaagcgtaataacgtgcgaaacatcgtcttttcttcgacagctgctacatacggcgaacccgaaacagtcccgattactgaagacgctcctacccacccaacgaatccatacggcgcaaccaagctgtctatcgactacgcgatcacgtcatatgcacatgcatatgggtttgcggcgacgagtctgcggtacttcaacgtagctggcgcatatggtttggtgggtgaaaatcgagaaatagaaacccatctcattccgctcgttttacaagtagcactgggacaccgtgacaagattttcatgtttggtgacgactggccaactgaagatggaacccccatccgcgattacattcatattcgtgatcttgcagatgcccatattttggcacttcaaagtaacgtcgaaggtagccaccggatctttaatctcggatccggtgaaggatattcggtcaaacaggtcattgatacctgcagagaagttaccggtcatctcatccccgctgaggtagctcctcgacgggctggtgatcctgcagtgctcattgcatcatcggctaaggcacaatccgaactgggttggaaaccacaacggactgatctgcacacgattgtctctgatgcctgggcttttacctctcagctcggagacaaagcccatagcgcttctcgcggataa

SEQ ID NO: 65613 - protein, 328 aa, Corynebacterium diphtheriae
MKLLVTGGAGYVGSVCSTVLLEQGHEVTIVDNLTTGNRDAVPLGATFVEGDIKDVADNVLSSDSFDAVLHFAARSLVGESVEKPDEYWQHNMVTTLALLDAMKRNNVRNIVFSSTAATYGEPETVPITEDAPTHPTNPYGATKLSIDYAITSYAHAYGFAATSLRYFNVAGAYGLVGENREIETHLIPLVLQVALGHRDKIFMFGDDWPTEDGTPIRDYIHIRDLADAHILALQSNVEGSHRIFNLGSGEGYSVKQVIDTCREVTGHLIPAEVAPRRAGDPAVLIASSAKAQSELGWKPQRTDLHTIVSDAWAFTSQLGDKAHSASRG

SEQ ID NO: 65614 - DNA, 990 bp, Corynebacterium glutamicum
  CDS (1)..(990): transl_table=11
atgaagcttctggttaccggtggcgctggctatgttggcagcgttgctgccgctgttcttctagaacatgggcacgatgtcacaatcattgacaatttcagtaccggcaaccgtgaagcagtccctgctgacgctcgcctgatagaaggtgacgtcaacgatgtcgttgaggaagtcctttctgaaggcggattcgagggtgtcgtccacttcgctgctcgctcattggtaggcgaatcagtggaaaagcccaatgaatactggcacgacaatgtggtcacggcgctcaccttgctcgatgcaatgcgtgcccatggggtgaacaaccttgtgttctcctccactgctgctacctacggtgaaccagacgttgttcccatcaccgaggacatgcccacccagcccaccaatgcttatggcgcaacgaagctgtccatcgactacgcaattacgtcctacgctgctgcctttggtctggctgcaaccagcttgcgctacttcaacgttgctggcgcatacggaaacatcggtgaaaatcgtgaagttgaaactcacctcattccactagtgctgcaggtagcaaccggtcaccgcgagaaaaccttcatgttcggcgatgactggccaactcccgatggaaccgcggtccgcgattacatccacattcttgatcttgccaaagcacacgtgttggctttggaatccaacgaagccggtaagcaccgcattttcaaccttggttccggagatggctacagcgtgaaacaggttgtggagatgtgccgtgaagtaaccggacatcccatcccggcagaggtcgcacccaggcgtgcaggagatccagcaacactaattgcatcttctgagaaggcaaagcaagaactgggttggacccctgagcacactgatctgcgcaccatcgttgaggacgcttgggcgtttacatccgcactgggcgatcgttcccatgctgcaaagaagaaagcttaa

SEQ ID NO: 65615 - protein, 329 aa, Corynebacterium glutamicum
MKLLVTGGAGYVGSVAAAVLLEHGHDVTIIDNFSTGNREAVPADARLIEGDVNDVVEEVLSEGGFEGVVHFAARSLVGESVEKPNEYWHDNVVTALTLLDAMRAHGVNNLVFSSTAATYGEPDVVPITEDMPTQPTNAYGATKLSIDYAITSYAAAFGLAATSLRYFNVAGAYGNIGENREVETHLIPLVLQVATGHREKTFMFGDDWPTPDGTAVRDYIHILDLAKAHVLALESNEAGKHRIFNLGSGDGYSVKQVVEMCREVTGHPIPAEVAPRRAGDPATLIASSEKAKQELGWTPEHTDLRTIVEDAWAFTSALGDRSHAAKKKA

SEQ ID NO: 65616 - DNA, 996 bp, Lactobacillus casei
  CDS (1)..(996): transl_table=11
atgacaattgcagttttaggcggcgctggttacatcggttcacatacggtaaaacaattactcgctgccggcgaggatgttgtggttttggataacttgattactgggcatcgtaaggcggttgatccacgcgcccgtttttatcaaggcgacatccgcgactatcattttctgagccaagtgttcagccaggaaaagattgacgggattgtccattttgcggcgttctcaattgtgccggaatccatgaaagatccgttgaagtattttgataacaacactggcggcatgatcaccttgcttgaagccatgaatcaattcggcatcaagaaaattgtcttctcatctacggcagcaacttatggcgaacctaagcaggtcccaattaaagaaactgatccgcaagtaccgaccaacccttacggtgaaagcaagttggccatggaaaagatcatgcattgggctgatgtggcttatgggctgaagttcgtggctttgcgttacttcaatgttgcgggtgcgatgccagacggttccatcggtgaagaccatcatccagaaacgcatattgtgccaattatcttgcaggttgcagcaggtacgcgaactggtttgcaaatttatggtgacgactatccaactaaggatggtaccaatgtgcgtgactatgttcatgtggtcgatcttgctgatgcccacattttggccttgaagtatctggatgccggcaataagtcatccgcgttcaacattggttctgcgcatggtttctccaaccttgaaattctaaatgcagcgcgtaaggtgactggccaagagattccagccacgatgggcccgcggcgtgccggtgatccaagcactttgattgctagctcagaaaaggctcgtgacattttaggctggaagccaaactatgacgatattgacaagattatcgaaaccgcatggaactggcacgaaaatcacccagaaggatttggtgaccggaattga

SEQ ID NO: 65617 - protein, 331 aa, Lactobacillus casei
MTIAVLGGAGYIGSHTVKQLLAAGEDVVVLDNLITGHRKAVDPRARFYQGDIRDYHFLSQVFSQEKIDGIVHFAAFSIVPESMKDPLKYFDNNTGGMITLLEAMNQFGIKKIVFSSTAATYGEPKQVPIKETDPQVPTNPYGESKLAMEKIMHWADVAYGLKFVALRYFNVAGAMPDGSIGEDHHPETHIVPIILQVAAGTRTGLQIYGDDYPTKDGTNVRDYVHVVDLADAHILALKYLDAGNKSSAFNIGSAHGFSNLEILNAARKVTGQEIPATMGPRRAGDPSTLIASSEKARDILGWKPNYDDIDKIIETAWNWHENHPEGFGDRN

SEQ ID NO: 65618 - DNA, 993 bp, Lactobacillus helveticus
  CDS (1)..(993): transl_table=11
atgaaagttttagttatcggtggtgcgggctatatcggctcacatgctgttcgtgaattagttaaggaaggcaacgacgtacttgtcttagatgctttatataccggtcacagaaaagctgttgatcctaaggcaaagttttatcaaggtgatatcgaagataccttcttagtatcaaagattttgcgcgacgaaaagattgacgctgtaatgcactttgcagcttactcacttgttccagaatcagttaaaaagcctcttaagtattacgacaataacgttactggcatgatctcattattacaagctatgaatgatgccaacgttaagtacttagtcttctcaagttctgccgcaacttacggtattcctaagaagttgccaatcactgaagacaccccacttaaccctatcaacccatacggtgaaaccaagatgatgatggaaaagatcatggcttgggcagataaggctgacggcattaaatacactgctcttcgttacttcaatgttgctggtgcttcaagcgacggttcaatcggtgaagaccatgctccagaaactcacttgattccaaatattttaaagagtgctatttctggtgacggcaagttcactatcttcggcgatgattacgacactaaagacggtactaatgtccgtgactacgttcaagtagaagacttgatcgatgctcacattttggcattgaagcacatgatgaagaccaataagtcagatgtcttcaacttgggtactgcacatggttactcaaaccttgaaattttggaaagcgctaagaaggttaccggtatcgacattccttatactatgggaccacgtcgtggtggcgatcctgactcacttgttgctgactcaactaaggcaagaactgttttaggctggaagccaaagcatgaaaacgttgatgatgtaattgcaactgcttggaagtggcacaagagtcacccaaagggctacgaagataagtaa

SEQ ID NO: 65619 - protein, 330 aa, Lactobacillus helveticus
MKVLVIGGAGYIGSHAVRELVKEGNDVLVLDALYTGHRKAVDPKAKFYQGDIEDTFLVSKILRDEKIDAVMHFAAYSLVPESVKKPLKYYDNNVTGMISLLQAMNDANVKYLVFSSSAATYGIPKKLPITEDTPLNPINPYGETKMMMEKIMAWADKADGIKYTALRYFNVAGASSDGSIGEDHAPETHLIPNILKSAISGDGKFTIFGDDYDTKDGTNVRDYVQVEDLIDAHILALKHMMKTNKSDVFNLGTAHGYSNLEILESAKKVTGIDIPYTMGPRRGGDPDSLVADSTKARTVLGWKPKHENVDDVIATAWKWHKSHPKGYEDK

SEQ ID NO: 65620 - DNA, 918 bp, Methanococcus jannaschii
  CDS (1)..(918): transl_table=11
atgatattagttactggaggagcaggttttattggtagtcatatagtggataaactaatcgaaaacaactacgatgtaattatcttagataatttaacaacaggaaataaaaataacataaatccaaaggcagagtttgtaaatgcagatattagagataaagacttagatgaaaaaattaattttaaagatgttgaagttgttatacatcaagcagctcaaataaacgttagaaattctgttgaaaatccagtatatgatggagacatcaatgttttaggaactataaatatcttagagatgatgagaaaatacgatatagataaaattgtattcgcatcttctggtggagcagtttatggagaaccaaattatttgccagtagatgaaaatcatccaataaacccattatctccttatgggttaagtaaatacgtgggagaggaatatattaagctatacaaccgtttatatggaattgaatatgcaattttgagatattcaaatgtctatggagagaggcaagacccaaaaggagaggctggagttataagcatatttatagataaaatgttaaaaaaccaaagcccaattatttttggagatggaaatcaaacaagggattttgtctatgttggagatgtagctaaagctaatttaatggctttaaattggaagaatgagatagtaaatattgggactggaaaagagacatcagtaaatgaattatttgatataataaagcatgagattgggtttagaggagaagcaatatatgataaaccaagagagggagaggtctatagaatttatctggatataaaaaaggcagaatctttaggttggaagccagagattgatttaaaagagggaataaagagagtcgttaattggatgaaaaataataataggacatag

SEQ ID NO: 65621 - protein, 305 aa, Methanococcus jannaschii
MILVTGGAGFIGSHIVDKLIENNYDVIILDNLTTGNKNNINPKAEFVNADIRDKDLDEKINFKDVEVVIHQAAQINVRNSVENPVYDGDINVLGTINILEMMRKYDIDKIVFASSGGAVYGEPNYLPVDENHPINPLSPYGLSKYVGEEYIKLYNRLYGIEYAILRYSNVYGERQDPKGEAGVISIFIDKMLKNQSPIIFGDGNQTRDFVYVGDVAKANLMALNWKNEIVNIGTGKETSVNELFDIIKHEIGFRGEAIYDKPREGEVYRIYLDIKKAESLGWKPEIDLKEGIKRVVNWMKNNNRT

SEQ ID NO: 65622 - DNA, 1023 bp, Mycoplasma genitalium
  CDS (1)..(1023): transl_table=4
atgattggagcaaagactagggttgcaatagttggcgggattggttacataggtagttgttttgctagttttatcaaagaacaaaatgataagctaattgttactgttattgataacaacaaaaataaccatgtaattaaactcttaaaaaagattggaattgaattctattttgctgatttactagatagacataagctaactgaagtaattgcagcaattcaacctgatgtggtatttcactttgctgctaaaacaagtgtaagtgaatcagtacataatccattgaagtactttgattgcaatgtaattggtactttaaacctaattagtgcaattagtaacttacagaagccaattaaattatttttcgcttctagtgctgcagtgtatggtcaaacaactaatagttacattagtgaagagattgtaataactgaaacacaagcaaccaatccttatggattgagtaagtttttagatgaattaatcttaaatgcagttgccaaaaatagtcaactacaagttgtttgcttacgcttttttaatgtggcaggtgcaattctgccatttggtaattttaatggtaataccacgcttttaattcctaacttagtaaaagcctttttaaaacaaactcccttttttttatatggcaatgattatgcaactaaggatggtagttgcataagagattacatccatgtttatgatatatgtaatgctcatttcttattatgaaagtggttaaatgatcatcgccaaattaaatttgaaacctttaacttggggagtgggataggaacttctaatttagaagttattgatattgctaaaaaagtgttttatcctagtagattaaatttagaaattagaccaaaaagaagctgagatccagcaattttagtagcaaatgttgctaaagcaaaacaaacctttcaattcaaaataacgcgtaatttgaaagatatgataagtgatgagcgtaatttttatgagaatttttataatgacgcttattaa

SEQ ID NO: 65623 - protein, 340 aa, Mycoplasma genitalium
MIGAKTRVAIVGGIGYIGSCFASFIKEQNDKLIVTVIDNNKNNHVIKLLKKIGIEFYFADLLDRHKLTEVIAAIQPDVVFHFAAKTSVSESVHNPLKYFDCNVIGTLNLISAISNLQKPIKLFFASSAAVYGQTTNSYISEEIVITETQATNPYGLSKFLDELILNAVAKNSQLQVVCLRFFNVAGAILPFGNFNGNTTLLIPNLVKAFLKQTPFFLYGNDYATKDGSCIRDYIHVYDICNAHFLLWKWLNDHRQIKFETFNLGSGIGTSNLEVIDIAKKVFYPSRLNLEIRPKRSWDPAILVANVAKAKQTFQFKITRNLKDMISDERNFYENFYNDAY

SEQ ID NO: 65624 - DNA, 1017 bp, Mycoplasma pneumoniae
  CDS (1)..(1017): transl_table=4
atgagtgaaaccaagagtaaagtactcgttttaggcggtttaggttacattgggagctgttttattgaccagcttctaaaacagtaccctgatgtaactgttagtgtaattgacattaaccacactagtctggcgctacaactgttaccaagacaggtcaacgttcactttgttaacttacttgaccgtgcacagttaacagatacgattgctcaaattaaccctgatgtcgtgtttcactttgcggcaaaaacaagcgtaaaggaatcgaccgaacaaccacttacatattttgaccataacctagtcggtacgctcaacttactccacgctttaaaagaactacaaaaaccgatccagctgttcttctcctccactgctgcagtctttggtagtgctagtacacttccaattccagaaaacttagttttagaggaaacactcgcttccaatccgtatggcattagtaagtttttaagtgaaatagtactgcaaacacttacccgtagcccccattttcaagtaatagcgttgcgctactttaacgtagcgggtgctagtaatccctttggtaacttcaataaaaacacgaccttactgattcctaacctgattaaagcctttatggaaaagcgcaccttctttctgtatggtgatgactatgacactaaagatgggagctgtatccgtgattacatccatgtagtagacttgtgtgatgcccatttgttggcgtgaaagtggttgcaagccaatcctaaagtgcgctttgaaagctttaacttaggtagtggtcagggcttttccaattgggaggtcattaatactgctcaagcaatctttgcgcctgaacaattacagctcaaaattgaatcacgaagggctggtgatccacctgttttagtggttgattgcacgaaggcaaaacgcttactcaacttccaaccaacccgctcattacacaaaatgctgagcgatgaaacaattttttatcgggatttttataataggctttaa

SEQ ID NO: 65625 - protein, 338 aa, Mycoplasma pneumoniae
MSETKSKVLVLGGLGYIGSCFIDQLLKQYPDVTVSVIDINHTSLALQLLPRQVNVHFVNLLDRAQLTDTIAQINPDVVFHFAAKTSVKESTEQPLTYFDHNLVGTLNLLHALKELQKPIQLFFSSTAAVFGSASTLPIPENLVLEETLASNPYGISKFLSEIVLQTLTRSPHFQVIALRYFNVAGASNPFGNFNKNTTLLIPNLIKAFMEKRTFFLYGDDYDTKDGSCIRDYIHVVDLCDAHLLAWKWLQANPKVRFESFNLGSGQGFSNWEVINTAQAIFAPEQLQLKIESRRAGDPPVLVVDCTKAKRLLNFQPTRSLHKMLSDETIFYRDFYNRL

SEQ ID NO: 65626 - DNA, 1017 bp, Pasteurella haemolytica
  CDS (1)..(1017): transl_table=11
atggcaattttagttacaggtggtgcaggctacatcggttcacatacattagttgaattattaaacgaaaatcgtgaaatcgtggtgttagataatctttctaattcctctgaagtatcacttgagcgtgtgaagcagatcaccggcaagagcgtaaaattctatcaaggcgatattttagatcgtgatattttacgcaaaatttttgcggaaaatcagattgaatcggtaattcactttgccggtttaaaagctgtaggcgaaacgtcagagaaccgctacgttactatcaaaaacaatgtaaccggctcgattgtattggtagaagagatgctaaaagccaatgtgaataccattgtgtttagttcatcggcgaccgtttatggtgatccgcagattatcccgattgtggaatcttgccctgtcggtggcacaaccaacccttacggtacgtccaaatatatggttgaacgcattcttgaagataccgttaaagccttcccacaattaagtgcggtagtattgcgttacttcaaccgggtaggggctcacgaaagcggtttaatcggtgaagatccaaacggtatcccaaataacttaatgccgtttatcagccaagtggctgtgggcaaattacctcaattatcggtgtttggtggcgattataatactcacgatggcacaggtgtgcgtgattatatccacgtggtagatttagcacttggtcacttaaaagccttagacaagcaccaaaatgatgccggtttccacgtttacaatttaggcacaggaacaggttattcggtgctagatatggtaaaagcctttgaagccgcaaatggcattactattccatacaaagtggtagatcgccgcccgggcgatattgccgtttgctactccgctccacaaaaagcgttagagcaactgggttgggaaaccgagcgtgggctagaacaaatgatgaaagacacttggaattggcaaaaaaataacccgaatggttataaaggctaa

SEQ ID NO: 65627 - protein, 338 aa, Pasteurella haemolytica
MAILVTGGAGYIGSHTLVELLNENREIVVLDNLSNSSEVSLERVKQITGKSVKFYQGDILDRDILRKIFAENQIESVIHFAGLKAVGETSENRYVTIKNNVTGSIVLVEEMLKANVNTIVFSSSATVYGDPQIIPIVESCPVGGTTNPYGTSKYMVERILEDTVKAFPQLSAVVLRYFNRVGAHESGLIGEDPNGIPNNLMPFISQVAVGKLPQLSVFGGDYNTHDGTGVRDYIHVVDLALGHLKALDKHQNDAGFHVYNLGTGTGYSVLDMVKAFEAANGITIPYKVVDRRPGDIAVCYSAPQKALEQLGWETERGLEQMMKDTWNWQKNNPNGYKG

SEQ ID NO: 65628 - DNA, 1017 bp, Pasteurella multocida
  CDS (1)..(1017): transl_table=11
atggcgattctcgtaactggtggtgcaggctatattggctcgcacaccgtcgttgaactacttaatgcaaataaagatgttgttgttttagataatctttgtaattcctctccgaaatccctcgagcgtgttgctcaaatcaccggcaaacaagtcaaattctatcaaggtgatattttagataccgcacttttacaaaaaatcttcgctgaaaatcaaattcaatctgtgatacattttgctggcttaaaagcggttggcgaaagtgtgcaaaaacccgctgaatactatatgaataacgtcacaggctcattggtcttaatacaagaaatgaaaaaagcaggcgtttggaattttgtgtttagctcttctgcgacggtgtacggtgatcctgaaattattccgatcactgaaagttgtaaagtaggcggaacaacaaatccttatggcacctcaaaatttatggtggagcaaattttaaaagatatcgccaaagcgacaccggaatttagcattacgatcttgcgttattttaaccctgttggtgcacatgaaagtggcttaattggggaagatccaaatggcattccaaataatttattgccttatattagccaagtggcaatcggtaagttgccacaactttcggtatttggtagtgattatgagactcacgatggtactggggtacgtgattatattcatgtggtcgatcttgctattggtcaccttaaagcacttgaccgtcacgaaggcgatgctggcttgcatatttataatttagggactggtagcggttattctgtattagatatggtcaaggcgtttgagaaagtaaacgacatcaaaatcccttataaacttgttgatcgccgtccaggtgatattgctacctgttattcagatcctagccttgccaaaacagaactaaactggacagcagcgcgtggtcttgaacaaatgatgaaagacacttggcactggcaaaaaaagaatcctaaaggctatcgagattaa

SEQ ID NO: 65629 - protein, 338 aa, Pasteurella multocida
MAILVTGGAGYIGSHTVVELLNANKDVVVLDNLCNSSPKSLERVAQITGKQVKFYQGDILDTALLQKIFAENQIQSVIHFAGLKAVGESVQKPAEYYMNNVTGSLVLIQEMKKAGVWNFVFSSSATVYGDPEIIPITESCKVGGTTNPYGTSKFMVEQILKDIAKATPEFSITILRYFNPVGAHESGLIGEDPNGIPNNLLPYISQVAIGKLPQLSVFGSDYETHDGTGVRDYIHVVDLAIGHLKALDRHEGDAGLHIYNLGTGSGYSVLDMVKAFEKVNDIKIPYKLVDRRPGDIATCYSDPSLAKTELNWTAARGLEQMMKDTWHWQKKNPKGYRD

SEQ ID NO: 65630 - DNA, 1002 bp, Streptococcus mutans
  CDS (1)..(1002)
atggctattttagttttaggtggagctggttatattggttcacacatggttgaccgtcttattgaaaaaggtgaggaagaggttgttgtcgttgatagtttggtgacgggtcaccgtgcagcagtacacccagctgctaagttttatcaaggtgatttagcagatcgagagtttatgagtatggtttttagagaaaatcctgatgtggatgccgttattcactttgcagcttattctttggttgcagagtccatgaaaaagcccctcaagtattttgacaacaacaccgcaggcatgattaaactcttggaagtcatgagtgaatttggtgtcaaatatatcgtcttttcatcaacagcagcaacctatggtattcctgatgaaattccaatcaaggaaacaacaccgcagcgtccgattaatccatacggtgagagtaaactcatgatggaaaccattatgaaatggtctgaccgggcctacggtatcaagtttgtgccacttcgctatttcaatgtggctggtgcaaaaccagatggctcaatcggtgaagatcacagtcctgaaacacatctactgccaatcattttgcaggttgctcaaggcgtgcgtgagaaaatcatgatttttggtgatgattataacacgccagatggtaccaatgtgcgcgattatgtacacccttttgatttggcggatgctcacctgcttgctcttaactatctgcgccaaggcaatccatcaacggcctttaacttgggatcatcaacaggattttcaaatcttcaaattttagaagccgctcgtaaagttacgggacagaaaatccctgcagaaaaagcagctcgccgttcgggagatccagatactttgattgcatcttcagaaaaagcacgtgaggtgcttggctggaaaccgcaatttgatgacattgaaaaaatcattgcctccgcttgggcatggcattccagctatccaaagggttatgatgacagagactga

SEQ ID NO: 65631 - protein, 333 aa, Streptococcus mutans
MAILVLGGAGYIGSHMVDRLIEKGEEEVVVVDSLVTGHRAAVHPAAKFYQGDLADREFMSMVFRENPDVDAVIHFAAYSLVAESMKKPLKYFDNNTAGMIKLLEVMSEFGVKYIVFSSTAATYGIPDEIPIKETTPQRPINPYGESKLMMETIMKWSDRAYGIKFVPLRYFNVAGAKPDGSIGEDHSPETHLLPIILQVAQGVREKIMIFGDDYNTPDGTNVRDYVHPFDLADAHLLALNYLRQGNPSTAFNLGSSTGFSNLQILEAARKVTGQKIPAEKAARRSGDPDTLIASSEKAREVLGWKPQFDDIEKIIASAWAWHSSYPKGYDDRD

SEQ ID NO: 65632 - DNA, 990 bp, Bordetella bronchiseptica
  CDS (1)..(990): transl_table=11
atgatcgtggtgaccggcgcggccggctttatcggcagcaacctggtgcgcggcctgaaccggcgcggcatccaggacatcatcgccgtcgacgacctgaccgacggcgacaaattccgcaacctcgtcgattgcagcatcgccgactatctcgacaaggacgagttccgcgaacgcgtgcgcggcggcaacctgccggccttgcgtgccgtgctgcaccagggcgcctgctcggacaccaccgagcgcaacggccgctacatgctggacaacaactaccgcgtcacgctggaactgttcgagtactgccaggccgagcgcgtgccgttcctgtacgcctcgtcggccgcggtctacggcggttcgtcggtctatgtggaagacccggccaacgaacatccgctcaatgtctacggctattccaagctgctgttcgaccaggtgctgcgcacgcgcatggacagcctgaccgcccaggtggtggggctgcgctatttcaacgtgtacgggccgcacgagcagcacaagggccgcatggcttcggtggccttccacaacatgaaccagttcctggccgaaggccatgtgcgcctgttcgccggctgggatggctacgaggacggcgggcagagccgcgatttcatttcggtcgaggacgtggtggcggtcaatctgcatttcctcgacaaccctggccagtcgggcgttttcaactgtggcaccgggcgcgcccagccgttcaacgacgtggccgcggcggtggtcaataccctgcgcgccgaacgtggcgaggcggcgctgccgctggccgaactggtcaagaaaggcctgctgcgctatatcccgttcccggatgatctgaaagggcgctaccagagctacacccaggccgacgtcggccggctgcgggcggccggcttcagcgcgccgatgcgcgatgtacagactggcgtatcggaatacgtgcgctattggcgcgccctgaagtag

SEQ ID NO: 65633 - protein, 329 aa, Bordetella bronchiseptica
MIVVTGAAGFIGSNLVRGLNRRGIQDIIAVDDLTDGDKFRNLVDCSIADYLDKDEFRERVRGGNLPALRAVLHQGACSDTTERNGRYMLDNNYRVTLELFEYCQAERVPFLYASSAAVYGGSSVYVEDPANEHPLNVYGYSKLLFDQVLRTRMDSLTAQVVGLRYFNVYGPHEQHKGRMASVAFHNMNQFLAEGHVRLFAGWDGYEDGGQSRDFISVEDVVAVNLHFLDNPGQSGVFNCGTGRAQPFNDVAAAVVNTLRAERGEAALPLAELVKKGLLRYIPFPDDLKGRYQSYTQADVGRLRAAGFSAPMRDVQTGVSEYVRYWRALK

SEQ ID NO: 65634 - DNA, 990 bp, Bordetella pertussis
  CDS (1)..(990): transl_table=11
atgatcgtggtgaccggcgcggccggctttatcggcagcaatctggtgcgcggcctgaaccggcgcggcatccaggacatcatcgccgtcgacgacctgaccgacggcgacaaattccgcaacctcgtcgattgcagcatcgccgactatctcgacaaggacgagttccgcgaacgcgtgcgcggcggcaacctgccggccttgcgtgccgtgctgcaccagggcgcctgctcggacaccaccgagcgcaacggccgctacatgctggacaacaactaccgcgtcacgctggaactgttcgagtactgccaggccgagcgcgtgccgttcctgtacgcctcgtcggccgcagtctacggcggttcgtcggtgtatgtggaagacccggccaacgagcatccgctcaatgtgtacggctattccaagctgctgttcgaccaggtgctgcgcacgcgcatggacagcctgaccgcccaggtggtggggctgcgctatttcaacgtgtacgggccgcacgagcagcacaagggccgcatggcttcggtggccttccacaacatgaaccagttcctggccgaaggccatgtgcgcctgttcgccggctgggatggctacgaggacggcgggcagagccgcgatttcatttcggtcgaagacgtggtggcggtcaatctgcatttcctcgacaaccctgaccagtcgggcgttttcaactgcggcaccgggcgcgcccagccgttcaacgacgtggccgcggcggtggtcaataccctgcgcgccgaacgcggcgaggcggcgctgccgctggccgaactggtcaagaagggcctgctgcgctatatcccgttcccggacgatctgaaagggcgctaccagagctacacccaggccgacgtcagccggctgcgggcgaccggcttcagcgcgccgatgcgcgatgtacagactggcgtatcggaatacgtgcgctattggcgcgccctgaagtag

SEQ ID NO: 65635 - protein, 329 aa, Bordetella pertussis
MIVVTGAAGFIGSNLVRGLNRRGIQDIIAVDDLTDGDKFRNLVDCSIADYLDKDEFRERVRGGNLPALRAVLHQGACSDTTERNGRYMLDNNYRVTLELFEYCQAERVPFLYASSAAVYGGSSVYVEDPANEHPLNVYGYSKLLFDQVLRTRMDSLTAQVVGLRYFNVYGPHEQHKGRMASVAFHNMNQFLAEGHVRLFAGWDGYEDGGQSRDFISVEDVVAVNLHFLDNPDQSGVFNCGTGRAQPFNDVAAAVVNTLRAERGEAALPLAELVKKGLLRYIPFPDDLKGRYQSYTQADVSRLRATGFSAPMRDVQTGVSEYVRYWRALK

SEQ ID NO: 65636 - DNA, 1002 bp, Chromobacterium violaceum
  CDS (1)..(1002): transl_table=11
atgactatcgtcgtcaccggcgccgccggcttcatcggctccaatctggtcaagggactgaaccagcgcggcatcaccgacatcatcgccgtcgacaatctcagcaacggcgacaagttccataacctggtcgattgcgaaatctcgcactacctcgacaagcacgaattcctgcacctgctgctggatggcgagtacgagggcgagctgtccgccatcctgcaccagggcgcgtgctcggacacgatgaaccacgacggcaagtacatgatggacaacaactaccagtacacgctggcgttgttcgactattgccagcacgaggaaatccaattcctgtacgcgtccagcgccgccacctacggcaagggcacggtgttcaaggaagagcgccagcacgaaggcccgctcaacgtctacggctactccaagttcctgttcgaccaagtgctgcgccagcgtatcaaggaaggcctgtccgcccaggctgtcggtttccgctacttcaacgtctacggcccgcgcgagcagcacaagggccgcatggcttcggtggcctttcaccacttcaaccagtaccgcgaacacggcaaggtcaagctgttcggcggctgggatggctgggaaaacggcatgcagagccgtgatttcgtgtcggtggaggatgtggtcaaggtcaacctgttcttcctggacaatcccggcaagagcggcatctacaatctgggcagcggccgttcgcagccgttcaacgacgtggccgaggccacggtgaatgcctgccgccgccacgagggcaagccggcgctgacgctggctgaaatgatccagcagggcatcgtcgagtacatcgacttcccggacgcgctgaagggcaagtaccagagcttcacccaggccgacatcgccaagctgcgcgaagccggctacgccgaggccatgctgtcggttgccgagggcgtcgaccgctatgtcgactggctgatcggccgccagggctga

SEQ ID NO: 65637 - protein, 333 aa, Chromobacterium violaceum
MTIVVTGAAGFIGSNLVKGLNQRGITDIIAVDNLSNGDKFHNLVDCEISHYLDKHEFLHLLLDGEYEGELSAILHQGACSDTMNHDGKYMMDNNYQYTLALFDYCQHEEIQFLYASSAATYGKGTVFKEERQHEGPLNVYGYSKFLFDQVLRQRIKEGLSAQAVGFRYFNVYGPREQHKGRMASVAFHHFNQYREHGKVKLFGGWDGWENGMQSRDFVSVEDVVKVNLFFLDNPGKSGIYNLGSGRSQPFNDVAEATVNACRRHEGKPALTLAEMIQQGIVEYIDFPDALKGKYQSFTQADIAKLREAGYAEAMLSVAEGVDRYVDWLIGRQG

SEQ ID NO: 65638 - DNA, 972 bp, Desulfovibrio vulgaris
  CDS (1)..(972): transl_table=11
atgtacatcgtcaccggaggcgcgggtttcatcggcagtgccatggtctggaagctgaacgagatgggcatagaggacatcgtcgtcgtcgacaacctgtccaccagcgagaagtggaagaacctcgtcaatcgccgctatgtcgactacgtccatcgcgacaccttcatggacatggtgctgcatggcgacctgccgtgggatgtggatgccgtggtgcacatgggggcgtgttccgccaccaccgaacgcgacgccgacttcctcatggagaacaacctgcgttacagccgcatgttgtgtgaattgtgcatggagacgggcgcacgcttcatcaacgccagcagcgcggcgacctacggtgacggcagcctcggtttctccgacgacgataccaccatgctgcgcctcaagccgctgaacatgtacggctactcgaagcagctgttcgacctctgggcgtaccgcgaaggcagactcgacggcatcgccagcctgaagttcttcaacgtctacgggcccaacgaataccacaagggcgacatgcgcagtgtcatctgcaaggcctacgcacagatagggcaggagggcgtcatgcgcctgttccgttcgtgccatcccgattacgccgatggcgggcagatgcgcgacttcatctacgtgaaggattgcgtggaggtcatgtggtggctgttgcagaaccccggcgtcaacggcgtgttcaacgtgggcaccggcaaggcgcgcacgtggaacgacctcgtcaccgcggtgttccgcgccatggaccgtgaaccggtcatcgagtacatcgacatgcctgaacaactgcgcggcaagtaccagtcgttcaccgaagccaccatgggcaagctgcgcgacgcgggctgcccggtacgtttcactgaactggaggatggcgtcaccgaatacgtgcgccggtacctcgccgcggccgacccccacctgtag

SEQ ID NO: 65639 - protein, 323 aa, Desulfovibrio vulgaris
MYIVTGGAGFIGSAMVWKLNEMGIEDIVVVDNLSTSEKWKNLVNRRYVDYVHRDTFMDMVLHGDLPWDVDAVVHMGACSATTERDADFLMENNLRYSRMLCELCMETGARFINASSAATYGDGSLGFSDDDTTMLRLKPLNMYGYSKQLFDLWAYREGRLDGIASLKFFNVYGPNEYHKGDMRSVICKAYAQIGQEGVMRLFRSCHPDYADGGQMRDFIYVKDCVEVMWWLLQNPGVNGVFNVGTGKARTWNDLVTAVFRAMDREPVIEYIDMPEQLRGKYQSFTEATMGKLRDAGCPVRFTELEDGVTEYVRRYLAAADPHL

SEQ ID NO: 65640 - DNA, 999 bp, Fusobacterium nucleatum
  CDS (1)..(999): transl_table=11
atgataattgttacaggtggagctggaatgattggaagtgcttttgtatggaagttaaatgaaatgggaataaaagatatcttaatagttgacaaattaagaaaagaagataaatggttaaatattagaaaaagagaatattatgactggatagataaagataatttaaaagagtggctagtttgtaaagaaaatgctgataatatagaagcagtaatacatatgggagcttgttcagcaacaacagaaacagatgcagacttcttgatggataataattttggctatactaaatttttatggaatttttgtgctgaaaaaaatataaaatatatttatgcatcttcagctgcaacttacggtatgggagaacttggatacaatgatgatgtcagtccagaagagttgcaaaaattaatgcctttaaataaatatggttattcaaagaaattttttgatgattgggcatttaaacaaaaaaatcaacctaaacaatggaatggcttaaaattctttaatgtatatggtccacaagaatatcataagggaagaatggcttcaatggtattccatacatataaccaatataaagaaaatggttatgtaaaactttttaaatcatataaagaaggatttaaggatggagaacaactaagagattttgtctatgtaaaagatgtagtagatataatgtattttatgttagttaatgatgtaaaatctggaatctataatataggtacaggaaaagcaagaagttttatggatttatctatggcaacaatgcgagcagcctctcacaatgataatttagataaaaatgaagttgtgaaattaattgaaatgccagaagatttacaaggtagatatcaatattttacagaagcaaaaattaataaattgagagaaataggatatactaaggaaatgcatagtttagaagaaggagtaaaggactatgtccaaaactatctagctaaagaagattcttatctataa

SEQ ID NO: 65641 - protein, 332 aa, Fusobacterium nucleatum
MIIVTGGAGMIGSAFVWKLNEMGIKDILIVDKLRKEDKWLNIRKREYYDWIDKDNLKEWLVCKENADNIEAVIHMGACSATTETDADFLMDNNFGYTKFLWNFCAEKNIKYIYASSAATYGMGELGYNDDVSPEELQKLMPLNKYGYSKKFFDDWAFKQKNQPKQWNGLKFFNVYGPQEYHKGRMASMVFHTYNQYKENGYVKLFKSYKEGFKDGEQLRDFVYVKDVVDIMYFMLVNDVKSGIYNIGTGKARSFMDLSMATMRAASHNDNLDKNEVVKLIEMPEDLQGRYQYFTEAKINKLREIGYTKEMHSLEEGVKDYVQNYLAKEDSYL

SEQ ID NO: 65642 - DNA, 942 bp, Haemophilus ducreyi
  CDS (1)..(942): transl_table=11
atgattatcgtaactggcggttttggtatgatcggcagcaatatcattaacgcgttaaatgatattggcagaaaagatattttagtggtagataacctaaaaaatggtgaaaaattcattaacttagtggatttaaatatcgcggattattgcgataaagatgattttattgcttcgattattgctggtgatgattttggtgagattgacgcaatttttcaccaaggtgcttgttcctcaacaaccgaatggaatggcaaatatttaatgcaaaataattatgaatattccaaagagttattacatttttgtgtagatcgacaaattccatttttatatgcttctagcgcggccacttatggcggtcgcgctgataattttatcgaagaacggaaatttgaaggcccattaaatgcctatggctattccaaattcctatttgatgaatatgttcgtcgccttttacctgaagcaaattccgccatttgtggctttaaatatttcaatgtttatggtccacgtgaacaacataaagggtcgatggcaagcgtggctttccatcttaataaccaaatgttaaaaggtgaaaatccaaaattatttgctggttctgagcattttttacgtgatttcgtgtatgttgaagatgtggctaaagtcaatatttgggcgtggaaaaataatatttcagggatctataatctcggcacaggtaaagcagaatcattccaaactgttgctcaagcggtgattgattttcacggaaaagggcatattgagaccattccgttccccgatcatttaaaatcgcgttatcaaacctttacccaagcggacttaactaaattacgcgctgctggttatcaagataattttaaaacggtcgcagaaggcactaaagcctatatgagctggttaaatcgttcactgaccaccgaataa

SEQ ID NO: 65643 - protein, 313 aa, Haemophilus ducreyi
MIIVTGGFGMIGSNIINALNDIGRKDILVVDNLKNGEKFINLVDLNIADYCDKDDFIASIIAGDDFGEIDAIFHQGACSSTTEWNGKYLMQNNYEYSKELLHFCVDRQIPFLYASSAATYGGRADNFIEERKFEGPLNAYGYSKFLFDEYVRRLLPEANSAICGFKYFNVYGPREQHKGSMASVAFHLNNQMLKGENPKLFAGSEHFLRDFVYVEDVAKVNIWAWKNNISGIYNLGTGKAESFQTVAQAVIDFHGKGHIETIPFPDHLKSRYQTFTQADLTKLRAAGYQDNFKTVAEGTKAYMSWLNRSLTTE

SEQ ID NO: 65644 - DNA, 927 bp, Haemophilus influenzae
  CDS (1)..(927): transl_table=11
atgattatcgtaacaggtggcgctggttttattggcagcaatattgtcaaagcattgaatgatttaggacgcaaagatattttagtggtcgataacttaaaagatggcacgaaatttgcaaatttagttgatttagacatcgcagattattgtgataaagaagatttcattgcttctattatcgcgggcgatgaatttggcgatattgatgcggtattccacgagggggcttgttctgcgactacggaatgggatggcaaatacattatgcacaacaactacgaatattctaaagagttgttgcattattgccttgaccgcgaaattccttttttctatgcctcaagcgcagcaacttatggagataccaaagtattccgtgaagaacgtgaatttgaaggcccattaaatgtgtatggctattctaaattcttgttcgatcaatatgtgcgtaacattttgccagaagcaaaatcgccagtatgtggtttccgttatttcaatgtttacgggccgcgtgaaaatcataaaggttcaatggcgagtgtggcattccacttgaataaccaaatcttaaaaggcgaaaatccaaaattatttgcaggcagcgaacacttccgccgtgattttgtttatgtgggtgatgtggcagcagtgaatatttggtgttggcaaaatggtatttcgggtatttacaaccttggtacaggaaatgcagaaagtttccgtgcggtggctgatgcggtagtgaaattccacggaaaaggcgagattgaaaccattccattcccagagcatttgaaatctcgttatcaagaatatactcaagcagatttaactaaacttcgctcaacaggctacgataaaccattcaaaacagttgcggaaggcgtgactgaatatatggcgtggttgaatagaaaataa

SEQ ID NO: 65645 - protein, 308 aa, Haemophilus influenzae
MIIVTGGAGFIGSNIVKALNDLGRKDILVVDNLKDGTKFANLVDLDIADYCDKEDFIASIIAGDEFGDIDAVFHEGACSATTEWDGKYIMHNNYEYSKELLHYCLDREIPFFYASSAATYGDTKVFREEREFEGPLNVYGYSKFLFDQYVRNILPEAKSPVCGFRYFNVYGPRENHKGSMASVAFHLNNQILKGENPKLFAGSEHFRRDFVYVGDVAAVNIWCWQNGISGIYNLGTGNAESFRAVADAVVKFHGKGEIETIPFPEHLKSRYQEYTQADLTKLRSTGYDKPFKTVAEGVTEYMAWLNRK

SEQ ID NO: 65646 - DNA, 1005 bp, Neisseria meningitidis
  CDS (1)..(1005): transl_table=11
atgaccatcatcgtaacaggcgcggccggctttatcggcagcaacatcgtcaaagcacttaatcaacgcggtattactgacattgttgccgtcgataatttgagcaaaggcgaaaaattcaaaaaccttgccgagtgcgaaatcgcccattatctcgacaaacacgaattcatccgccaagtgagggaacacattttaccttatcaaaacatcgaagccgttttccatcaaggcgcgtgttccgatacgatgaaccacgacggtttgtatatgatggacaacaactaccagtacacgctggatttgctggactggtgtcaggacgaacgcatccccttcctttatgcctccagtgcggcggtttacggcaaaggagaaatcttccgcgaagagcgcgaactcgaaaaaccgctcaacgtgtacggctactccaaattcctgttcgaccaagtattgcgtcgccgcatgaaagaaggtctcaccgcccaagtcgtcggcttccgctacttcaatgtttacggacaacacgaacaacacaaaggccgcatggcatccgtcgccttccaccacttccaccaataccgcgaacacggttacgtcaacctgttcggcagtaacgacggctacggcaacggcgaacaaacccgcgacttcgtcagcgtcgaagacgttgccaaagtcaacctctacttcttcgaccatcccgaactttccggcatctacaacctcggtaccggccgcagccaacagttcaacgaactcgccgccgccaccgtcaacgcatgccgcgccgccgaaggcaaacctgaaatgagcttgaaagagttggtagaagaagaacttatccgctacattcccttccccgacgcgctcaaaggcaaataccaaagcttcacccaagccgacatcaccaaattgcgcgaagccggatataaggaagaatttttcgatgtcaaatcaggcgtcgaccgctacgtcaaatggatgctggaaaatttggcttaa

SEQ ID NO: 65647 - protein, 334 aa, Neisseria meningitidis
MTIIVTGAAGFIGSNIVKALNQRGITDIVAVDNLSKGEKFKNLAECEIAHYLDKHEFIRQVREHILPYQNIEAVFHQGACSDTMNHDGLYMMDNNYQYTLDLLDWCQDERIPFLYASSAAVYGKGEIFREERELEKPLNVYGYSKFLFDQVLRRRMKEGLTAQVVGFRYFNVYGQHEQHKGRMASVAFHHFHQYREHGYVNLFGSNDGYGNGEQTRDFVSVEDVAKVNLYFFDHPELSGIYNLGTGRSQQFNELAAATVNACRAAEGKPEMSLKELVEEELIRYIPFPDALKGKYQSFTQADITKLREAGYKEEFFDVKSGVDRYVKWMLENLA

SEQ ID NO: 65648 - DNA, 933 bp, Pasteurella multocida
  CDS (1)..(933): transl_table=11
atgattatcgtaactggcggtgctggctttattggaagtaacattgtaaaagccttaaacgaattagggcgtacggatattttagtggtagataatttaaaagatggtacaaagttcgctaatttagtggatttggatattgcagattattgtgacaaagaagattttattgcctcgatcatcgctggtgatgatttaggggatattgaggtcattttccacgaaggcgcctgttctgctactaccgaatgggacggcaagtacatcatgcacaataactatgaatattccaaagagttattgcattattgtttagatcgtgaaattccgttcttttatgcttcatctgcagcaacttatggtgataaaactgaattccgtgaagaacgcgaatttgaagcaccattaaatgtttacggctattccaaattcttatttgatcaatatgtacgtgctattttaccagaagctaactcacctgtttgtggcttccgttatttcaacgtgtacggtccacgtgagaatcacaaaggcgcgatggcaagcgtggcattccacttaaataaccaaatcttaaaaggggaaaaaccaaaattatttgcaggcagtgaacatttccggcgtgactttgtgtatgtgggcgatgtggctgctgtgaatatttggtgttggcaaaacaacatttctggcatctataacttaggaacaggaaatgcggaatctttccttgaagtagcaaaagccgtcgtgaagttccatggtaaaacggaagcagatattgaaatcattccattcccagaacatttaaaaagccgttaccaagaatacacacaagccaatttagataaattacgcgccactggctatgacaaaccgtttaaaacggtcgcacagggtgtagcagaatatatggcatggttaaaccgtaaataa

SEQ ID NO: 65649 - protein, 310 aa, Pasteurella multocida
MIIVTGGAGFIGSNIVKALNELGRTDILVVDNLKDGTKFANLVDLDIADYCDKEDFIASIIAGDDLGDIEVIFHEGACSATTEWDGKYIMHNNYEYSKELLHYCLDREIPFFYASSAATYGDKTEFREEREFEAPLNVYGYSKFLFDQYVRAILPEANSPVCGFRYFNVYGPRENHKGAMASVAFHLNNQILKGEKPKLFAGSEHFRRDFVYVGDVAAVNIWCWQNNISGIYNLGTGNAESFLEVAKAVVKFHGKTEADIEIIPFPEHLKSRYQEYTQANLDKLRATGYDKPFKTVAQGVAEYMAWLNRK

SEQ ID NO: 65650 - DNA, 939 bp, Photorhabdus luminescens
  CDS (1)..(939): transl_table=11
atgattattgtcactggcggtgctggatttattggtagcaatattgtcaaagcactaaatgacgaaggatataaagatattctggtcgtagataatctaaaagatggtactaagttcatcaatctggctgacttggatattgctgattacatggacaaggaagagtttattgccagtattctggccggtgatgacttcggtgatattgacgctattttccatgaaggcgcttgttcatccacaaccgagtgggatggcaaatatatgatggataataactatcaatattccaaagaattgctgcactattgccttgaacgccgcactcctttcctgtacgcctcctcagcagcaacctatggcggccgcacggataattttatcgaagagcgtcaatatgagaagccactcaatgtttatggttactctaagtttctgttcgaccaatatgtccgggaaatcttgcctcaagctgattcacaaatttgtggtttccgttatttcaatgtgtatggaccacgtgaagggcacaaagggagtatggctagcgttgcctttcatttgaataatcaaatcaatcagagacaaaaccccaaattattcgccggcagtgaaggctttcaacgtgattttatctatgttggtgatgccgctgcggttaatctttggttctggaaaaatggcgtttccggtatttataactgtggaacgggtcgtgctgaatctttccaagcggttgcagatgcagttgttgaatgccataaagataaatcactcactgttgaacatattgatttccctgaacatctgaaaggtcgttatcagcgcttcacgcaagcagatctgaccaaacttcgcgcggcgggttatgataagccattcaaaaccgttgccgaaggggtaacggaatatatgcattggctcaatcaggataagtaa

SEQ ID NO: 65651 - protein, 312 aa, Photorhabdus luminescens
MIIVTGGAGFIGSNIVKALNDEGYKDILVVDNLKDGTKFINLADLDIADYMDKEEFIASILAGDDFGDIDAIFHEGACSSTTEWDGKYMMDNNYQYSKELLHYCLERRTPFLYASSAATYGGRTDNFIEERQYEKPLNVYGYSKFLFDQYVREILPQADSQICGFRYFNVYGPREGHKGSMASVAFHLNNQINQRQNPKLFAGSEGFQRDFIYVGDAAAVNLWFWKNGVSGIYNCGTGRAESFQAVADAVVECHKDKSLTVEHIDFPEHLKGRYQRFTQADLTKLRAAGYDKPFKTVAEGVTEYMHWLNQDK

SEQ ID NO: 65652 - DNA, 951 bp, Rhizobium loti
  CDS (1)..(951)
atgatcatcgtcacgggcggcgccggcatgatcggctccaacatcgtcgccgcgctcaatgccgagggccatgacgacatcctggtcgtcgatgatctcaccgacggccacaagatcgccaatctcgccgatctcagcattgccgactatctcgacaaggacgattttctaacccgcatcgaggccggggcgctcggccgcatcgaggccgtcttccaccagggcgcctgctcaaccaccaccgagtggaacggcaagttcatgatggaggtgaattttgcttattcaaagcggctgctgcatgcctgccaggcgccgcgcgtgcccttcctctacgcctcctcggcttctgtctatggcggcggttcggagtttcgcgaggagccggcgctggagcggccgctcaatgtctatgcctattcgaagaaactgttcgacgactatgtcaggcgcaccgtcttcgacaccgatcactcgcaggtcgccggcctgcgctatttcaacgtctacggcccgcgagaggcccacaagggcgccatggcctcggtcgccttccatctgttcaaccaggtcgagcgtggcgagaatccgagactgttcggcgcctatgacggtttcggccccggcgaacagagccgcgacttcatccatgtcggcgacgtcgccgacgtcaatctgtggctctggaagcgaggatcgagcggcatcttcaactgcggcaccggccgcgcccagccgttccgcgccatcgccgaaaccgtcatcgacacgctgggcaagggcgagatcgagttcatccccttccccgaccacctcaagggcagctaccagagcttcacgcaagctgatatgtcccgtttgcgcgcggccgggtataatggccagttccggacagtggaaaccggtgtcagagactatgtcgaatggctgaaagcccaacgatcctcgtga

SEQ ID NO: 65653 - protein, 316 aa, Rhizobium loti
MIIVTGGAGMIGSNIVAALNAEGHDDILVVDDLTDGHKIANLADLSIADYLDKDDFLTRIEAGALGRIEAVFHQGACSTTTEWNGKFMMEVNFAYSKRLLHACQAPRVPFLYASSASVYGGGSEFREEPALERPLNVYAYSKKLFDDYVRRTVFDTDHSQVAGLRYFNVYGPREAHKGAMASVAFHLFNQVERGENPRLFGAYDGFGPGEQSRDFIHVGDVADVNLWLWKRGSSGIFNCGTGRAQPFRAIAETVIDTLGKGEIEFIPFPDHLKGSYQSFTQADMSRLRAAGYNGQFRTVETGVRDYVEWLKAQRSS

SEQ ID NO: 65654 - DNA, 942 bp, Vibrio parahaemolyticus
  CDS (1)..(942)
atgatcatcgtaactggtggtgctggcatgatcggcagcaacattgttaaagcactgaacgaagcaggtattaacgatattctggttgtcgacaacctaaaaaatggcaagaagtttaaaaacttagttgatcttgatatcacagattacatggatcgtgatgacttccttactcaaatcatggcaggtgacgacttcggccctatcgaagcaatcttccatgaaggtgcttgttctgcgacaactgagtgggacggcaagtacatgatgctaaacaactatgagtactcaaaagagttgcttcattactgtttagatcgtgaaattccattcctatacgcgtcatcagctgcgacatacggtgaaacagaaacattcgttgaagagcgtgaatatgaaggcgcactcaatgtatacggctactcgaaacagcaatttgataactatgttcgtcgcctatggaaagacgcagaggagcatggcgagcagctttctcaaatcactggtttccgatacttcaatgtatatgggccacgtgaagatcacaaaggcagcatggcatctgttgcgttccatctgaataaccagatcaatgctggtgaaaaccctaagttatttgaaggtagtggtcactttaaacgtgatttcgtttacgttggtgatgtgtgcaaagtaaacctttggttcctagaaaatggtgtttctggcatcttcaactgcggtactggtcgtgcagaatcttttgaagaagtggcaaaagcagtggtcaaacaccacaacaaaggtgaaatccaaaccattccgttccctgatcacctaaaaggcgcttaccaagaattcactcaagcggatctaactaagcttcgtgcagctggttgtgatgtagaattcaaaacggtagctgaaggtgttgctgaatacttaactatccaaaacagttaa

SEQ ID NO: 65655 - protein, 313 aa, Vibrio parahaemolyticus
MIIVTGGAGMIGSNIVKALNEAGINDILVVDNLKNGKKFKNLVDLDITDYMDRDDFLTQIMAGDDFGPIEAIFHEGACSATTEWDGKYMMLNNYEYSKELLHYCLDREIPFLYASSAATYGETETFVEEREYEGALNVYGYSKQQFDNYVRRLWKDAEEHGEQLSQITGFRYFNVYGPREDHKGSMASVAFHLNNQINAGENPKLFEGSGHFKRDFVYVGDVCKVNLWFLENGVSGIFNCGTGRAESFEEVAKAVVKHHNKGEIQTIPFPDHLKGAYQEFTQADLTKLRAAGCDVEFKTVAEGVAEYLTIQNS

SEQ ID NO: 65656 - DNA, 1047 bp, Salmonella typhi
  CDS (1)..(1047): transl_table=11
atgacggcttacgaagaactacggaccaaactggttctggcaccaaagcgctggctgatcactggcgtagcaggctttattggctccggcttattagaagaattactctttctcaaccagactgtcattggactggataacttttccaccggttatcagcataatctagacgacgttcgcacgtccgtcagtgaggagcaatggtcgcgatttatttttattcagggtgacatcaggaaatttactgactgtcagaaagcgtgtaagaacgttgactatgttctccaccaagccgcgctaggaagcgtgccacgttccctaaaggatcccatcgcgactaatagcgccaatattgatggttttttaaatatgttgacggcggcgagagatgctcatgtctctagtttcacctacgccgcaagcagtagcacctatggagaccatcccgatttacctaaaattgaggaacggatcggtcgaccactcagcccgtatgcggtaacaaaatacgtcaatgaattgtacgctgatgtgtttgcacgtagctatgaatttaacgctattggcctacgctactttaatgtctttggtcgccgccaaaatcctaacggagcgtactcggcagttattcctcgctggatactatcgcttcttaaagatgaaccaatttatatcaatggcgatggctcaacaagcagggatttttgctatatagagaatgtgattcaggccaatctattatcagcaacaactaatgatttagcctctaaaaataaggtctataatgtggcagttggagatagaacttcgttaaatgagctttattatctaattcgcgatgggcttaatttatggcggaacgaacaaagtagagctgaaccaatttataaagattttcgtgacggtgacgttaagcatagccaggcagatattaccaaaataaaaacatttctttcatatgagcctgaatttgatatcaaagaaggacttaagcagactctaaaatggtatatcgataaacattctactttgtattcctcggtataa

SEQ ID NO: 65657 - protein, 348 aa, Salmonella typhi
MTAYEELRTKLVLAPKRWLITGVAGFIGSGLLEELLFLNQTVIGLDNFSTGYQHNLDDVRTSVSEEQWSRFIFIQGDIRKFTDCQKACKNVDYVLHQAALGSVPRSLKDPIATNSANIDGFLNMLTAARDAHVSSFTYAASSSTYGDHPDLPKIEERIGRPLSPYAVTKYVNELYADVFARSYEFNAIGLRYFNVFGRRQNPNGAYSAVIPRWILSLLKDEPIYINGDGSTSRDFCYIENVIQANLLSATTNDLASKNKVYNVAVGDRTSLNELYYLIRDGLNLWRNEQSRAEPIYKDFRDGDVKHSQADITKIKTFLSYEPEFDIKEGLKQTLKWYIDKHSTLYSSV

SEQ ID NO: 65658 - DNA, 981 bp, Methanococcus jannaschii
  CDS (1)..(981): transl_table=11
atgaaatataaaaatatcttagttactggaagtgccggttttattggtttccatctaagtaaatatttaatggataactatgaagatctaaaggttattggaatagataatttaaataactactataacccagttttaaaagaaaaaaggaatgaaattttaaaaaattatgaaaattatacgtttataaaattggatttttcagattgggatgatttagttgaaaatttaaaagataaagagattgatttgattgtgcatttaggagcacaggcaggagttagatattctctacaaaacccatgggcttatataaaatccaatgaaatgggaacattaaacatcttcgaatttgcaagaagatttgatattgagaaggttgtttatgcttcctcttcttctgtctatggagggaataggaagattccttttagtgaagatgatagagtggataaaccaatctctctatatgcctcaacaaagagaagtaatgagttaatggctcatgtatatcatcatctatatggtattaaaatgattggtttaaggttttttactgtttatggagagtatggaagaccagatatggcttacttcaagtttgcaaaaaacattttattgggtaaggagattgaggtctataactatggaaatatggagagggactttacttatatttctgatgttgtggatggaatattgagagctattaaaaaggactttgattatgagatttttaatttgggtaattctaaaccagttaagttgatgtattttattgagttaattgaaaaatatctcaacaaaaaagcaaaaaagaaatttttgccaatgcaggatggagatgttttaagaacctatgctgatttgagtaagagcgaaaagctgttggggtataaaccaaaagttactattgaggagggtttaaagagattttgtaactggtttttggaaaataaagattggcttttaagattataa

SEQ ID NO: 65659 - protein, 326 aa, Methanococcus jannaschii
MKYKNILVTGSAGFIGFHLSKYLMDNYEDLKVIGIDNLNNYYNPVLKEKRNEILKNYENYTFIKLDFSDWDDLVENLKDKEIDLIVHLGAQAGVRYSLQNPWAYIKSNEMGTLNIFEFARRFDIEKVVYASSSSVYGGNRKIPFSEDDRVDKPISLYASTKRSNELMAHVYHHLYGIKMIGLRFFTVYGEYGRPDMAYFKFAKNILLGKEIEVYNYGNMERDFTYISDVVDGILRAIKKDFDYEIFNLGNSKPVKLMYFIELIEKYLNKKAKKKFLPMQDGDVLRTYADLSKSEKLLGYKPKVTIEEGLKRFCNWFLENKDWLLRL

SEQ ID NO: 65660 - DNA, 1005 bp, Escherichia coli O111
  CDS (1)..(1005): transl_table=11
atgaaatacctggttacgggtgccgctggtttcatcggcttccacgttagcaaacgcctccttgaggctggccatcaagtagtcggtattgataatctgaacgattactacgacgtcagccttaaacaagctcgtctggaattactggcacaacctggtttccagtttcataaaattgatttagccgaccgcgaaggcatgaccgatctcttcgcatccgggcatttcgaacgtgtgttcatctcgccgcataggctggcggtacgctattcactcgaaaacccgcatgcctatgctgactcaaatctcacaggatttctgaacatactggaagggtgtcgccataataaaattcagcatttactctatgcttcctccagttctgtttacggcctgaatcgcaaaatgcctttctctacggatgattccgttgatcaccccgtatctctgtatgcggcaaccaaaaaagccaacgaactgatggcccatacttattcccatttgtacggattgcccgcaaccgggttgcgtttctttaccgtgtacggcccctggggtcgtccggatatggcactgtttaagttcaccaaagcaatgctggaagggaaaagtattgacgtctataactacggcaaaatgaagcgtgactttacctatatcgatgatatcgcagaagcaatcattcgcctgcaggatgtcattccacacgcagacacacaatggaccgttgaaacaggcacgccagcagccagcattgccccctatcgcgtctacaatatcggcaatagttcaccggttgagctcatggactatatccaggctttggaagatgcgctgggtattgaagcaaagaaaaacatgctaccgctacagcctggtgatgtgctggaaaccagcgcggacactaaagcactgtatgaggtaattggttttacgcctgaaaccacggtcaaagatggggtgaagaactttgttaactggtaccgtgatttctacaaagtttga

SEQ ID NO: 65661 - protein, 334 aa, Escherichia coli O111
MKYLVTGAAGFIGFHVSKRLLEAGHQVVGIDNLNDYYDVSLKQARLELLAQPGFQFHKIDLADREGMTDLFASGHFERVFISPHRLAVRYSLENPHAYADSNLTGFLNILEGCRHNKIQHLLYASSSSVYGLNRKMPFSTDDSVDHPVSLYAATKKANELMAHTYSHLYGLPATGLRFFTVYGPWGRPDMALFKFTKAMLEGKSIDVYNYGKMKRDFTYIDDIAEAIIRLQDVIPHADTQWTVETGTPAASIAPYRVYNIGNSSPVELMDYIQALEDALGIEAKKNMLPLQPGDVLETSADTKALYEVIGFTPETTVKDGVKNFVNWYRDFYKV

SEQ ID NO: 65662 - DNA, 22 bp, Primer
atgatcatcgttaccggcggcg

SEQ ID NO: 65663 - DNA, 22 bp, Primer
ttatgcgtcgcgattcagccag

SEQ ID NO: 65664 - protein, 328 aa, consensus
  MISC_FEATURE (1)..(328): consensus for the disclosure of xaa see table XV
GXAGXIGSXXXXXLXXXXXXXXXXXXXDXXXXXXXXXXXXXXXXXXXXXXXXXXXXXXXXXXXXXXXXXXXXXXXXXXXXXHXAAXXXXXXXXXXXXXXXXXXNXXXXXXXXXXXXXXXXXXXXXXXXXXXXXXXXXXXXXXXXXXSSXXXXYGXXXXXXXXXXXXXXXXXXXPXXXYXXXKXXXEXXXXXXXXXXXXXXXXXXXXXXXRXFNXXGXXXXXXXXXXXXXXXXXXXXXXXXXXXXXXXXXXXXXXXXXXXXXXXXXXXXXXXXRDXXXXXDXXXXXXXXXXXXXXXXXXXXXXXXXXXXXXXXXXXXXXXXXXXXXNXG

SEQ ID NO: 65665 - protein, 30 aa, consensus
  MISC_FEATURE (1)..(30): consensus for the disclosure of xaa see table XV
XXXGXXGXXGXXXXXXXXXXXXXXXXXXXD

SEQ ID NO: 65666 - protein, 116 aa, consensus
  MISC_FEATURE (1)..(116): consensus for the disclosure of xaa see table XV
XXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXG

SEQ ID NO: 65667 - protein, 57 aa, consensus
  MISC_FEATURE (1)..(57): consensus for the disclosure of xaa see table XV
XXXXXXXXXXXXXXXXXXXXXXXXXXXXXXXXXXXXXXXXXXXXNXXXXXXXXXXXX

SEQ ID NO: 65668 - DNA, 864 bp, Escherichia coli; identical to SEQ ID NO: 46787
  CDS (1)..(864)

SEQ ID NO: 65669 - protein, 287 aa, Escherichia coli; identical to SEQ ID NO: 46788

SEQ ID NO: 65670 - DNA, 891 bp, Mesorhizobium loti MAFF303099; identical to SEQ ID NO: 46789
  CDS (1)..(891): transl_table=11

SEQ ID NO: 65671 - protein, 296 aa, Mesorhizobium loti MAFF303099; identical to SEQ ID NO: 46790

SEQ ID NO: 65672 - DNA, 867 bp, Borrelia burgdorferi B31; identical to SEQ ID NO: 46791
  CDS (1)..(867): transl_table=11

SEQ ID NO: 65673 - protein, 288 aa, Borrelia burgdorferi B31; identical to SEQ ID NO: 46792

SEQ ID NO: 65674 - DNA, 879 bp, Thermotoga maritima MSB8; identical to SEQ ID NO: 46793
  CDS (1)..(879): transl_table=11

SEQ ID NO: 65675 - protein, 292 aa, Thermotoga maritima MSB8; identical to SEQ ID NO: 46794

SEQ ID NO: 65676 - DNA, 885 bp, Bacillus halodurans C-125; identical to SEQ ID NO: 46795
  CDS (1)..(885): transl_table=11

SEQ ID NO: 65677 - protein, 294 aa, Bacillus halodurans C-125; identical to SEQ ID NO: 46796

SEQ ID NO: 65678 - DNA, 864 bp, Pasteurella multocida subsp. multocida str. Pm70; identical to SEQ ID NO: 46797
  CDS (1)..(864): transl_table=11

SEQ ID NO: 65679 - protein, 287 aa, Pasteurella multocida subsp. multocida str. Pm70; identical to SEQ ID NO: 46798

SEQ ID NO: 65680 - DNA, 864 bp, Pseudomonas aeruginosa PAO1; identical to SEQ ID NO: 46799
  CDS (1)..(864): transl_table=11

SEQ ID NO: 65681 - protein, 287 aa, Pseudomonas aeruginosa PAO1; identical to SEQ ID NO: 46800

SEQ ID NO: 65682 - DNA, 885 bp, Neisseria meningitidis Z2491; identical to SEQ ID NO: 46801
  CDS (1)..(885): transl_table=11

SEQ ID NO: 65683 - protein, 294 aa, Neisseria meningitidis Z2491; identical to SEQ ID NO: 46802

SEQ ID NO: 65684 - DNA, 879 bp, Clostridium acetobutylicum ATCC 824; identical to SEQ ID NO: 46803
  CDS (1)..(879): transl_table=11

SEQ ID NO: 65685 - protein, 292 aa, Clostridium acetobutylicum ATCC 824; identical to SEQ ID NO: 46804

SEQ ID NO: 65686 - DNA, 888 bp, Sinorhizobium meliloti 1021; identical to SEQ ID NO: 46805
  CDS (1)..(888): transl_table=11

SEQ ID NO: 65687 - protein, 295 aa, Sinorhizobium meliloti 1021; identical to SEQ ID NO: 46806

SEQ ID NO: 65688 - DNA, 876 bp, Bacillus subtilis subsp. subtilis str. 168; identical to SEQ ID NO: 46807
  CDS (1)..(876): transl_table=11

SEQ ID NO: 65689 - protein, 291 aa, Bacillus subtilis subsp. subtilis str. 168; identical to SEQ ID NO: 46808

SEQ ID NO: 65690 - DNA, 882 bp, Caulobacter crescentus CB15; identical to SEQ ID NO: 46809
  CDS (1)..(882): transl_table=11

SEQ ID NO: 65691 - protein, 293 aa, Caulobacter crescentus CB15; identical to SEQ ID NO: 46810

SEQ ID NO: 65692 - DNA, 864 bp, Salmonella typhimurium LT2; identical to SEQ ID NO: 46811
  CDS (1)..(864): transl_table=11

SEQ ID NO: 65693 - protein, 287 aa, Salmonella typhimurium LT2; identical to SEQ ID NO: 46812

SEQ ID NO: 65694 - DNA, 876 bp, Listeria innocua Clip11262; identical to SEQ ID NO: 46813
  CDS (1)..(876): transl_table=11

SEQ ID NO: 65695 - protein, 291 aa, Listeria innocua Clip11262; identical to SEQ ID NO: 46814

SEQ ID NO: 65696 - DNA, 888 bp, Agrobacterium tumefaciens str. C58; identical to SEQ ID NO: 46815
  CDS (1)..(888): transl_table=11

SEQ ID NO: 65697 - protein, 295 aa, Agrobacterium tumefaciens str. C58; identical to SEQ ID NO: 46816

SEQ ID NO: 65698 - DNA, 945 bp, Brucella melitensis 16M; identical to SEQ ID NO: 46817
  CDS (1)..(945): transl_table=11

SEQ ID NO: 65699 - protein, 314 aa, Brucella melitensis 16M; identical to SEQ ID NO: 46818

SEQ ID NO: 65700 - DNA, 885 bp, Clostridium perfringens str. 13; identical to SEQ ID NO: 46819
  CDS (1)..(885): transl_table=11

SEQ ID NO: 65701 - protein, 294 aa, Clostridium perfringens str. 13; identical to SEQ ID NO: 46820

SEQ ID NO: 65702 - DNA, 879 bp, Fusobacterium nucleatum subsp. nucleatum ATCC 25586; identical to SEQ ID NO: 46821
  CDS (1)..(879): transl_table=11

SEQ ID NO: 65703 - protein, 292 aa, Fusobacterium nucleatum subsp. nucleatum ATCC 25586; identical to SEQ ID NO: 46822

SEQ ID NO: 65704 - DNA, 873 bp, Thermoanaerobacter tengcongensis MB4; identical to SEQ ID NO: 46823
  CDS (1)..(873): transl_table=11

SEQ ID NO: 65705 - protein, 290 aa, Thermoanaerobacter tengcongensis MB4; identical to SEQ ID NO: 46824

SEQ ID NO: 65706 - DNA, 888 bp, Chlorobium tepidum TLS; identical to SEQ ID NO: 46825
  CDS (1)..(888): transl_table=11

SEQ ID NO: 65707 - protein, 295 aa, Chlorobium tepidum TLS; identical to SEQ ID NO: 46826

SEQ ID NO: 65708 - DNA, 864 bp, Yersinia pestis KIM; identical to SEQ ID NO: 46827
  CDS (1)..(864): transl_table=11

SEQ ID NO: 65709 - protein, 287 aa, Yersinia pestis KIM; identical to SEQ ID NO: 46828

SEQ ID NO: 65710 - DNA, 900 bp, Brucella suis 1330; identical to SEQ ID NO: 46829
  CDS (1)..(900): transl_table=11

SEQ ID NO: 65711 - protein, 299 aa, Brucella suis 1330; identical to SEQ ID NO: 46830

SEQ ID NO: 65712 - DNA, 864 bp, Shewanella oneidensis MR-1; identical to SEQ ID NO: 46831
  CDS (1)..(864): transl_table=11

SEQ ID NO: 65713 - protein, 287 aa, Shewanella oneidensis MR-1; identical to SEQ ID NO: 46832

SEQ ID NO: 65714 - DNA, 951 bp, Pseudomonas putida KT2440; identical to SEQ ID NO: 46833
  CDS (1)..(951): transl_table=11

SEQ ID NO: 65715 - protein, 316 aa, Pseudomonas putida KT2440; identical to SEQ ID NO: 46834

SEQ ID NO: 65716 - DNA, 888 bp, Bradyrhizobium japonicum USDA 110; identical to SEQ ID NO: 46835
  CDS (1)..(888)

SEQ ID NO: 65717 - protein, 295 aa, Bradyrhizobium japonicum USDA 110; identical to SEQ ID NO: 46836

SEQ ID NO: 65718 - DNA, 864 bp, Xylella fastidiosa Temecula1; identical to SEQ ID NO: 46837
  CDS (1)..(864): transl_table=11

SEQ ID NO: 65719 - protein, 287 aa, Xylella fastidiosa Temecula1; identical to SEQ ID NO: 46838

SEQ ID NO: 65720 - DNA, 888 bp, Clostridium tetani E88; identical to SEQ ID NO: 46839
  CDS (1)..(888): transl_table=11

SEQ ID NO: 65721 - protein, 295 aa, Clostridium tetani E88; identical to SEQ ID NO: 46840

SEQ ID NO: 65722 - DNA, 867 bp, Vibrio parahaemolyticus RIMD 2210633; identical to SEQ ID NO: 46841
  CDS (1)..(867): transl_table=11

SEQ ID NO: 65723 - protein, 288 aa, Vibrio parahaemolyticus RIMD 2210633; identical to SEQ ID NO: 46842

SEQ ID NO: 65724 - DNA, 867 bp, Bacteroides thetaiotaomicron VPI-5482; identical to SEQ ID NO: 46843
  CDS (1)..(867): transl_table=11

SEQ ID NO: 65725 - protein, 288 aa, Bacteroides thetaiotaomicron VPI-5482; identical to SEQ ID NO: 46844

SEQ ID NO: 65726 - DNA, 885 bp, Enterococcus faecalis V583; identical to SEQ ID NO: 46845
  CDS (1)..(885): transl_table=11

SEQ ID NO: 65727 - protein, 294 aa, Enterococcus faecalis V583; identical to SEQ ID NO: 46846

SEQ ID NO: 65728 - DNA, 864 bp, Coxiella burnetii RSA 493; identical to SEQ ID NO: 46847
  CDS (1)..(864): transl_table=11

SEQ ID NO: 65729 - protein, 287 aa, Coxiella burnetii RSA 493; identical to SEQ ID NO: 46848

SEQ ID NO: 65730 - DNA, 876 bp, Bacillus cereus ATCC 14579; identical to SEQ ID NO: 46849
  CDS (1)..(876): transl_table=11

SEQ ID NO: 65731 - protein, 291 aa, Bacillus cereus ATCC 14579; identical to SEQ ID NO: 46850

SEQ ID NO: 65732 - DNA, 867 bp, Nitrosomonas europaea ATCC 19718; identical to SEQ ID NO: 46851
  CDS (1)..(867): transl_table=11

SEQ ID NO: 65733 - protein, 288 aa, Nitrosomonas europaea ATCC 19718; identical to SEQ ID NO: 46852

SEQ ID NO: 65734 - DNA, 1029 bp, Rhodopirellula baltica SH 1; identical to SEQ ID NO: 46853
  CDS (1)..(1029): transl_table=11

SEQ ID NO: 65735 - protein, 342 aa, Rhodopirellula baltica SH 1; identical to SEQ ID NO: 46854

SEQ ID NO: 65736 - DNA, 864 bp, Wigglesworthia glossinidia endosymbiont of Glossina brevipalpis; identical to SEQ ID NO: 46855
  CDS (1)..(864): transl_table=11

SEQ ID NO: 65737 - protein, 287 aa, Wigglesworthia glossinidia endosymbiont of Glossina brevipalpis; identical to SEQ ID NO: 46856

SEQ ID NO: 65738 - DNA, 873 bp, Candidatus Blochmannia floridanus; identical to SEQ ID NO: 46857
  CDS (1)..(873): transl_table=11

SEQ ID NO: 65739 - protein, 290 aa, Candidatus Blochmannia floridanus; identical to SEQ ID NO: 46858

SEQ ID NO: 65740 - DNA, 927 bp, Bordetella bronchiseptica RB50; identical to SEQ ID NO: 46859
  CDS (1)..(927): transl_table=11

SEQ ID NO: 65741 - protein, 308 aa, Bordetella bronchiseptica RB50; identical to SEQ ID NO: 46860

SEQ ID NO: 65742 - DNA, 867 bp, Chromobacterium violaceum ATCC 12472; identical to SEQ ID NO: 46861
  CDS (1)..(867): transl_table=11

SEQ ID NO: 65743 - protein, 288 aa, Chromobacterium violaceum ATCC 12472; identical to SEQ ID NO: 46862

SEQ ID NO: 65744 - DNA, 891 bp, Porphyromonas gingivalis W83; identical to SEQ ID NO: 46863
  CDS (1)..(891): transl_table=11

SEQ ID NO: 65745 - protein, 296 aa, Porphyromonas gingivalis W83; identical to SEQ ID NO: 46864

SEQ ID NO: 65746 - DNA, 864 bp, Photorhabdus luminescens subsp. laumondii TTO1; identical to SEQ ID NO: 46865
  CDS (1)..(864): transl_table=11

SEQ ID NO: 65747 - protein, 287 aa, Photorhabdus luminescens subsp. laumondii TTO1; identical to SEQ ID NO: 46866

SEQ ID NO: 65748 - DNA, 888 bp, Rhodopseudomonas palustris CGA009; identical to SEQ ID NO: 46867
  CDS (1)..(888): transl_table=11

SEQ ID NO: 65749 - protein, 295 aa, Rhodopseudomonas palustris CGA009; identical to SEQ ID NO: 46868

SEQ ID NO: 65750 - DNA, 879 bp, Bdellovibrio bacteriovorus HD100; identical to SEQ ID NO: 46869
  CDS (1)..(879): transl_table=11

SEQ ID NO: 65751 - protein, 292 aa, Bdellovibrio bacteriovorus HD100; identical to SEQ ID NO: 46870

SEQ ID NO: 65752 - DNA, 867 bp, Treponema denticola ATCC 35405; identical to SEQ ID NO: 46871
  CDS (1)..(867): transl_table=11

SEQ ID NO: 65753 - protein, 288 aa, Treponema denticola ATCC 35405; identical to SEQ ID NO: 46872

SEQ ID NO: 65754 - DNA, 885 bp, Parachlamydia sp. UWE25; identical to SEQ ID NO: 46873
  CDS (1)..(885): transl_table=11

SEQ ID NO: 65755 - protein, 294 aa, Parachlamydia sp. UWE25; identical to SEQ ID NO: 46874

SEQ ID NO: 65756 - DNA, 882 bp, Desulfovibrio vulgaris subsp. vulgaris str. Hildenborough; identical to SEQ ID NO: 46875
  CDS (1)..(882): transl_table=11

SEQ ID NO: 65757 - protein, 293 aa, Desulfovibrio vulgaris subsp. vulgaris str. Hildenborough; identical to SEQ ID NO: 46876

SEQ ID NO: 65758 - DNA, 864 bp, Erwinia carotovora subsp. atroseptica SCRI1043; identical to SEQ ID NO: 46877
  CDS (1)..(864)

SEQ ID NO: 65759 - protein, 287 aa, Erwinia carotovora subsp. atroseptica SCRI1043; identical to SEQ ID NO: 46878

SEQ ID NO: 65760 - DNA, 894 bp, Desulfotalea psychrophila LSv54; identical to SEQ ID NO: 46879
  CDS (1)..(894): transl_table=11

SEQ ID NO: 65761 - protein, 297 aa, Desulfotalea psychrophila LSv54; identical to SEQ ID NO: 46880

SEQ ID NO: 65762 - DNA, 870 bp, Borrelia garinii PBi; identical to SEQ ID NO: 46881
  CDS (1)..(870): transl_table=11

SEQ ID NO: 65763 - protein, 289 aa, Borrelia garinii PBi; identical to SEQ ID NO: 46882

SEQ ID NO: 65764 - DNA, 879 bp, Symbiobacterium thermophilum IAM 14863; identical to SEQ ID NO: 46883
  CDS (1)..(879): transl_table=11

SEQ ID NO: 65765 - protein, 292 aa, Symbiobacterium thermophilum IAM 14863; identical to SEQ ID NO: 46884

SEQ ID NO: 65766 - DNA, 864 bp, Mannheimia succiniciproducens MBEL55E; identical to SEQ ID NO: 46885
  CDS (1)..(864): transl_table=11

SEQ ID NO: 65767 - protein, 287 aa, Mannheimia succiniciproducens MBEL55E; identical to SEQ ID NO: 46886

SEQ ID NO: 65768 - DNA, 876 bp, Bacillus licheniformis ATCC 14580; identical to SEQ ID NO: 46887
  CDS (1)..(876): transl_table=11

SEQ ID NO: 65769 - protein, 291 aa, Bacillus licheniformis ATCC 14580; identical to SEQ ID NO: 46888

SEQ ID NO: 65770 - DNA, 870 bp, Methylococcus capsulatus str. Bath; identical to SEQ ID NO: 46889
  CDS (1)..(870): transl_table=11

SEQ ID NO: 65771 - protein, 289 aa, Methylococcus capsulatus str. Bath; identical to SEQ ID NO: 46890

SEQ ID NO: 65772 - DNA, 867 bp, Legionella pneumophila str. Paris; identical to SEQ ID NO: 46891
  CDS (1)..(867): transl_table=11

SEQ ID NO: 65773 - protein, 288 aa, Legionella pneumophila str. Paris; identical to SEQ ID NO: 46892

SEQ ID NO: 65774 - DNA, 864 bp, Photobacterium profundum SS9; identical to SEQ ID NO: 46893
  CDS (1)..(864): transl_table=11

SEQ ID NO: 65775 - protein, 287 aa, Photobacterium profundum SS9; identical to SEQ ID NO: 46894

SEQ ID NO: 65776 - DNA, 876 bp, Geobacillus kaustophilus HTA426; identical to SEQ ID NO: 46895
  CDS (1)..(876): transl_table=11

SEQ ID NO: 65777 - protein, 291 aa, Geobacillus kaustophilus HTA426; identical to SEQ ID NO: 46896

SEQ ID NO: 65778 - DNA, 864 bp, Idiomarina loihiensis L2TR; identical to SEQ ID NO: 46897
  CDS (1)..(864): transl_table=11

SEQ ID NO: 65779 - protein, 287 aa, Idiomarina loihiensis L2TR; identical to SEQ ID NO: 46898

SEQ ID NO: 65780 - DNA, 867 bp, Azoarcus sp. EbN1; identical to SEQ ID NO: 46899
  CDS (1)..(867): transl_table=11

SEQ ID NO: 65781 - protein, 288 aa, Azoarcus sp. EbN1; identical to SEQ ID NO: 46900

SEQ ID NO: 65782 - DNA, 891 bp, Silicibacter pomeroyi DSS-3; identical to SEQ ID NO: 46901
  CDS (1)..(891): transl_table=11

SEQ ID NO: 65783 - protein, 296 aa, Silicibacter pomeroyi DSS-3; identical to SEQ ID NO: 46902

SEQ ID NO: 65784 - DNA, 891 bp, Rhodobacter sphaeroides 2.4.1; identical to SEQ ID NO: 46903
  CDS (1)..(891)

SEQ ID NO: 65785 - protein, 296 aa, Rhodobacter sphaeroides 2.4.1; identical to SEQ ID NO: 46904

SEQ ID NO: 65786 - DNA, 870 bp, Desulfitobacterium hafniense DCB-2; identical to SEQ ID NO: 46905
  CDS (1)..(870)

SEQ ID NO: 65787 - protein, 289 aa, Desulfitobacterium hafniense DCB-2; identical to SEQ ID NO: 46906

SEQ ID NO: 65788 - DNA, 864 bp, Actinobacillus pleuropneumoniae serovar 1 str. 4074; identical to SEQ ID NO: 46907
  CDS (1)..(864)

SEQ ID NO: 65789 - protein, 287 aa, Actinobacillus pleuropneumoniae serovar 1 str. 4074; identical to SEQ ID NO: 46908

SEQ ID NO: 65790 - DNA, 855 bp, Dechloromonas aromatica RCB; identical to SEQ ID NO: 46909
  CDS (1)..(855)

SEQ ID NO: 65791 - protein, 284 aa, Dechloromonas aromatica RCB; identical to SEQ ID NO: 46910

SEQ ID NO: 65792 - DNA, 867 bp, Methylobacillus flagellatus KT; identical to SEQ ID NO: 46911
  CDS (1)..(867)

SEQ ID NO: 65793 - protein, 288 aa, Methylobacillus flagellatus KT; identical to SEQ ID NO: 46912

SEQ ID NO: 65794 - DNA, 900 bp, Magnetospirillum magnetotacticum MS-1; identical to SEQ ID NO: 46913
  CDS (1)..(900)

SEQ ID NO: 65795 - protein, 299 aa, Magnetospirillum magnetotacticum MS-1; identical to SEQ ID NO: 46914

SEQ ID NO: 65796 - DNA, 822 bp, Rubrivivax gelatinosus PM1; identical to SEQ ID NO: 46915
  CDS (1)..(822)

SEQ ID NO: 65797 - protein, 273 aa, Rubrivivax gelatinosus PM1; identical to SEQ ID NO: 46916

SEQ ID NO: 65798 - DNA, 888 bp, Rhodospirillum rubrum; identical to SEQ ID NO: 46917
  CDS (1)..(888)

SEQ ID NO: 65799 - protein, 295 aa, Rhodospirillum rubrum; identical to SEQ ID NO: 46918

SEQ ID NO: 65800 - DNA, 936 bp, Ralstonia metallidurans CH34; identical to SEQ ID NO: 46919
  CDS (1)..(936)

SEQ ID NO: 65801 - protein, 311 aa, Ralstonia metallidurans CH34; identical to SEQ ID NO: 46920

SEQ ID NO: 65802 - DNA, 924 bp, Burkholderia fungorum LB400; identical to SEQ ID NO: 46921
  CDS (1)..(924)

SEQ ID NO: 65803 - protein, 307 aa, Burkholderia fungorum LB400; identical to SEQ ID NO: 46922

SEQ ID NO: 65804 - DNA, 882 bp, Enterococcus faecium; identical to SEQ ID NO: 46923
  CDS (1)..(882)

SEQ ID NO: 65805 - protein, 293 aa, Enterococcus faecium; identical to SEQ ID NO: 46924

SEQ ID NO: 65806 - DNA, 888 bp, Magnetococcus sp. MC-1; identical to SEQ ID NO: 46925
  CDS (1)..(888)

SEQ ID NO: 65807 - protein, 295 aa, Magnetococcus sp. MC-1; identical to SEQ ID NO: 46926

SEQ ID NO: 65808 - DNA, 879 bp, Geobacter metallireducens GS-15; identical to SEQ ID NO: 46927
  CDS (1)..(879)

SEQ ID NO: 65809 - protein, 292 aa, Geobacter metallireducens GS-15; identical to SEQ ID NO: 46928

SEQ ID NO: 65810 - DNA, 870 bp, Cytophaga hutchinsonii; identical to SEQ ID NO: 46929
  CDS (1)..(870)

SEQ ID NO: 65811 - protein, 289 aa, Cytophaga hutchinsonii; identical to SEQ ID NO: 46930

SEQ ID NO: 65812 - DNA, 885 bp, Clostridium thermocellum ATCC 27405; identical to SEQ ID NO: 46931
  CDS (1)..(885)

SEQ ID NO: 65813 - protein, 294 aa, Clostridium thermocellum ATCC 27405; identical to SEQ ID NO: 46932

SEQ ID NO: 65814 - DNA, 855 bp, Microbulbifer degradans 2-40; identical to SEQ ID NO: 46933
  CDS (1)..(855)

SEQ ID NO: 65815 - protein, 284 aa, Microbulbifer degradans 2-40; identical to SEQ ID NO: 46934

SEQ ID NO: 65816 - DNA, 879 bp, Moorella thermoacetica ATCC 39073; identical to SEQ ID NO: 46935
  CDS (1)..(879)

SEQ ID NO: 65817 - protein, 292 aa, Moorella thermoacetica ATCC 39073; identical to SEQ ID NO: 46936

SEQ ID NO: 65818 - DNA, 867 bp, Thiobacillus denitrificans ATCC 25259; identical to SEQ ID NO: 46937
  CDS (1)..(867)

SEQ ID NO: 65819 - protein, 288 aa, Thiobacillus denitrificans ATCC 25259; identical to SEQ ID NO: 46938

SEQ ID NO: 65820 - DNA, 882 bp, Silicibacter sp. TM1040; identical to SEQ ID NO: 46939
  CDS (1)..(882)

SEQ ID NO: 65821 - protein, 293 aa, Silicibacter sp. TM1040; identical to SEQ ID NO: 46940

SEQ ID NO: 65822 - DNA, 873 bp, Azotobacter vinelandii; identical to SEQ ID NO: 46941
  CDS (1)..(873)

SEQ ID NO: 65823 - protein, 290 aa, Azotobacter vinelandii; identical to SEQ ID NO: 46942

SEQ ID NO: 65824 - DNA, 903 bp, Polaromonas sp. JS666; identical to SEQ ID NO: 46943
  CDS (1)..(903)

SEQ ID NO: 65825 - protein, 300 aa, Polaromonas sp. JS666; identical to SEQ ID NO: 46944

SEQ ID NO: 65826 - DNA, 864 bp, Haemophilus influenzae; identical to SEQ ID NO: 46945
  CDS (1)..(864): transl_table=11

SEQ ID NO: 65827 - protein, 287 aa, Haemophilus influenzae; identical to SEQ ID NO: 46946

SEQ ID NO: 65828 - DNA, 22 bp, Primer
atgatccgcagtatgaccgcct

SEQ ID NO: 65829 - DNA, 24 bp, Primer
ttattcgatgttctgaatctgctc

SEQ ID NO: 65830 - protein, 338 aa, consensus; identical to SEQ ID NO: 46949
  MISC_FEATURE (1)..(338): consensus for the disclosure of xaa see table XV

SEQ ID NO: 65831 - protein, 73 aa, consensus; identical to SEQ ID NO: 46950
  MISC_FEATURE (1)..(73): consensus for the disclosure of xaa see table XV

SEQ ID NO: 65832 - protein, 101 aa, consensus; identical to SEQ ID NO: 46951
  MISC_FEATURE (1)..(101): consensus for the disclosure of xaa see table XV

SEQ ID NO: 65833 - DNA, 924 bp, Escherichia coli
  CDS (1)..(924)
atgagcataattcgccggagggatattaaaatgaatggaaaattgcaaagttcagatgtaaaaaacgaaactccgtacaatattcccttattgattaacgaaaatgtgatctccagcggaatttctctgatctcgctctggcatacctacgccgacgagcattaccgggtgatctggccgcgggacaagaagaaaccgcttatcgccaactcatgggttgcggtgtataccgtacaaggatgtgggaaaattcttttaaagaatggcgaacaaataacactgcatggcaactgtattatattcttaaagccaatggatattcactcttatcactgtgaaggtttagtctgggaacagtactggatggaatttacccccaccagtatgatggatattcccgttggtcagcaaagcgttatttataatggcgaaatttataatcaggaactcaccgaagttgctgagttaataacttcaccagaagcaataaaaaataatctggcagtcgcttttctgacgaaaattatttatcagtggatttgtcttatgtacgcagatggtaaaaaagatccacaacggcggcaaattgaaaaattaattgccactttacatgccagtctgcaacaacgctggagcgtagctgatatggctgccacgatcccctgtagcgaagcctggttgcgtcgtctgtttttacgctataccggcaagacgccgaaagaatattacctcgatgcgcgtctggatctggcgctatcgctattaaagcaacaaggaaactcggttggcgaagtcgctgatacgctcaacttcttcgactcctttcatttcagcaaagcctttaaacataaatttggttatgcgccgtcagccgtgctaaagaatacggaccagcacccaacggatgccagtccacacaattaa

SEQ ID NO: 65834 - protein, 307 aa, Escherichia coli
MSIIRRRDIKMNGKLQSSDVKNETPYNIPLLINENVISSGISLISLWHTYADEHYRVIWPRDKKKPLIANSWVAVYTVQGCGKILLKNGEQITLHGNCIIFLKPMDIHSYHCEGLVWEQYWMEFTPTSMMDIPVGQQSVIYNGEIYNQELTEVAELITSPEAIKNNLAVAFLTKIIYQWICLMYADGKKDPQRRQIEKLIATLHASLQQRWSVADMAATIPCSEAWLRRLFLRYTGKTPKEYYLDARLDLALSLLKQQGNSVGEVADTLNFFDSFHFSKAFKHKFGYAPSAVLKNTDQHPTDASPHN

SEQ ID NO: 65835 - DNA, 1056 bp, Mesorhizobium loti MAFF303099
  CDS (1)..(1056): transl_table=11
atggcatgtgtgcgggacaagccggtttccggcccgccaacctccctgtccgctcctcacctgcggatctctctcgcttttcgagggggattatgcccttattcacgagcgcgaccagagaaggattatgctttcaagggtaattttgtgctacgagatttgatcgccaacggacagtcgatgcgcacgatctcgctgccgcgcggccggcagcgcctgcatgccatgccgacaagcaccggctatgaagtgcgcgaggacgagatctatgactgggacgggcgtaaacgcggccagacgccgttcaccgtgctccagcacacgatcagcggcaccggccggctacgctacgagaaccgcaactaccgcctgcaagagaacgacacgctgctggtgctggtgccgcacaaccaccgctactggctggccagcgacgagcgctgggaatatttctggatctcgatgaacggcgaggaggcgctgcgcatccacaagtcgatcctcagcatctccggtccggtgttccggcttaagccagcgacgatcgatcaccttgctgattgcagcctgcgcctcatcaacggggcggcctcggcgggtgccgcgtccgctatcgcctacgaggcggcgatggcgctctatgacgatgtcttcggctcgcatgcctttgccgagaaactgagcgccatgcagccggtcatcgaccatatcaacgccaatctcgacaggccgctgccggtggcggacctcgtccagatcagtggcctcagccgcgcccatttctcgcgctgcttcgccgagagcgaaggcctgccgcccgccgaattcgtgttgcagcagcgcctgcagcgggcggcgaagctgttgaccaaggcggattttctgccggtgaaggaagtcgccatcctgtgcggcttcgaggatgcgaactatttttcgaaggtcttccgccgtctctacggcaccacgcccagccaattccgcaccaccggcatgtatgccaatctgcgaacgccggccaggcgcggcgtcagggtgtcggacgacgagacctga

SEQ ID NO: 65836 - protein, 351 aa, Mesorhizobium loti MAFF303099
MACVRDKPVSGPPTSLSAPHLRISLAFRGGLCPYSRARPEKDYAFKGNFVLRDLIANGQSMRTISLPRGRQRLHAMPTSTGYEVREDEIYDWDGRKRGQTPFTVLQHTISGTGRLRYENRNYRLQENDTLLVLVPHNHRYWLASDERWEYFWISMNGEEALRIHKSILSISGPVFRLKPATIDHLADCSLRLINGAASAGAASAIAYEAAMALYDDVFGSHAFAEKLSAMQPVIDHINANLDRPLPVADLVQISGLSRAHFSRCFAESEGLPPAEFVLQQRLQRAAKLLTKADFLPVKEVAILCGFEDANYFSKVFRRLYGTTPSQFRTTGMYANLRTPARRGVRVSDDET

SEQ ID NO: 65837 - DNA, 864 bp, Bacillus halodurans C-125
  CDS (1)..(864): transl_table=11
atgactgaaaaaatacagtttgccctcaattccttttctgagcacggagaaaataatgtcttattttcagggtatagtcaaacattcccctatcataaagtggggcctcaagtccacgactattttttgctccatgtcgtccttcgtggaaagggatcatttcactgtgcgggaaagacgtactccctatcagcaggggatagcttttttatttatccaaaggagctagtaacttatgaatcggataggacagatccttggtattatacgtgggtcgctttccaaggccctttttttgaggaaactctacgctctgccggcattcaacctgaatcacctattgtttctctcggcggcaaaggttcgatgattaaacaattattttatgatctttattcgagcatgacagagctaaaagtagctagctccttaaagactaacgcttatttacgacttattatcagtgaatttattgaacaaacaacgattttagacgaacattcacaaaaggaagatcatcaattagatcagcatatacaggatgtcatccgtttgttgagccttcgttactttgaaccattatcaattgaaaccatcgctgcttcttacggctacaaccgaacctacttttcgaagaaattcaaagagtatacaggttactcaccaagtaaatatttactaaatatacgcatgaaaaaagctgaagcattgcttcaaaagtcgctcacgattcaagaggtcgcctcttccgtcggctatagagatcccctctatttctctaagcaatttaaacaatggtcaggagtagccccgagcgtgtttaggcagcagcacttaaaagagtctgagccaaaacagggttaa

SEQ ID NO: 65838 - protein, 287 aa, Bacillus halodurans C-125
MTEKIQFALNSFSEHGENNVLFSGYSQTFPYHKVGPQVHDYFLLHVVLRGKGSFHCAGKTYSLSAGDSFFIYPKELVTYESDRTDPWYYTWVAFQGPFFEETLRSAGIQPESPIVSLGGKGSMIKQLFYDLYSSMTELKVASSLKTNAYLRLIISEFIEQTTILDEHSQKEDHQLDQHIQDVIRLLSLRYFEPLSIETIAASYGYNRTYFSKKFKEYTGYSPSKYLLNIRMKKAEALLQKSLTIQEVASSVGYRDPLYFSKQFKQWSGVAPSVFRQQHLKESEPKQG

SEQ ID NO: 65839 - DNA, 840 bp, Bacillus halodurans C-125
  CDS (1)..(840): transl_table=11
atgaaaaaacacgttctcatcccattaaatgaaaataaactaccccttttcgctgaaacgattgggtttaatcctgtacaagaatatgtcacacggccaaatggctacccttattaccattggattcaaacagtgagcggacaaggctccatcatgtttcaaaatagacagatcaacttgacgacgaataacggggtcctcctcctgccacatatcccccactcgtatcaaaacgcgcaaagtgattccactccatggcaaacactgtatgtaacctttagcgggacgatggtgaaagaggtgttgattacactggaactgtatcaatctgctttttttcactggaatcaagaagctccgatatccacattccttgcgaaagtattgaaacaaagcgacgaaacaagagacagctttagcatcagtgcctcttctgcggtctatgaattccttctgcttttaaaaaagtatggaaaaacgaataatagcaacgcaaaagagacgaatcacttagtgcggttatattcactgattgattggatgaagactcaactttccaacccagatgtaggccttgatgaaatggcacgctttattaatacgtccaaacgccatttgaattcgctgttccaaaaaaacttccacttgacgccctatgcctattttgttaatttgcgaatccaacaatcaaaaaagctcttattagaagacaactgtgccaccatcggtgagattgccaagcaagtggggtttcgctcgacaagccactttgtcgccactttcaggaagatggtcggcatccctccggaaaaataccgtcagctcaatggaggggtttga

SEQ ID NO: 65840 - protein, 279 aa, Bacillus halodurans C-125
MKKHVLIPLNENKLPLFAETIGFNPVQEYVTRPNGYPYYHWIQTVSGQGSIMFQNRQINLTTNNGVLLLPHIPHSYQNAQSDSTPWQTLYVTFSGTMVKEVLITLELYQSAFFHWNQEAPISTFLAKVLKQSDETRDSFSISASSAVYEFLLLLKKYGKTNNSNAKETNHLVRLYSLIDWMKTQLSNPDVGLDEMARFINTSKRHLNSLFQKNFHLTPYAYFVNLRIQQSKKLLLEDNCATIGEIAKQVGFRSTSHFVATFRKMVGIPPEKYRQLNGGV

SEQ ID NO: 65841 - DNA, 861 bp, Streptococcus pneumoniae TIGR4
  CDS (1)..(861): transl_table=11
atgttagttttttcagaataccagactggaacaatcgaccttgccctaagcttttatggatatgaggaatgcacacctaattactcttttggtccagccattcgtgatacatacgttctacattacattactaaaggacaaggaaaatttcattacaagggtaaaattgttgatttaaaagaaggagatttctttctattaaaaccagaggaactaaccttttatcaagcagatagtaaagaaccttgggcctactactggttaggaatcactggagggaaagcccctgattattttgctctttcccaaatttctgatcaatcctatctcatccaatctgaaacttgtcatacccagactactgcaaaactcatctcagacattgtccgcttcgctcagattacaaaatcaagtgaattagctcaactccatatcatgggacaacttcatgaactgatgtttcatctgggaactattgctcccaatcagaaaaaaaagaatatttcatcaacccaccaactctatcttgaatgcaaacgattaattgatagccactatcctcaatcacttacaattcaagatttagcaaaagaactatccgttcacagaagctacttatcaagcgtattcaaagaatttaataccttatcacccaaagaatacctactctacgttcgaatgcaccgagctagacaacttctcgaaaatacccaagagtccatcaaggtaattgcatactcggtaggtttttcagatccactccatttttcgaaagcttataaacaatactttaatcagactccaagtcatacaagaaaagaatactctcaataccaactagtaagaaaggcaacattatga

SEQ ID NO: 65842 - protein, 286 aa, Streptococcus pneumoniae TIGR4
MLVFSEYQTGTIDLALSFYGYEECTPNYSFGPAIRDTYVLHYITKGQGKFHYKGKIVDLKEGDFFLLKPEELTFYQADSKEPWAYYWLGITGGKAPDYFALSQISDQSYLIQSETCHTQTTAKLISDIVRFAQITKSSELAQLHIMGQLHELMFHLGTIAPNQKKKNISSTHQLYLECKRLIDSHYPQSLTIQDLAKELSVHRSYLSSVFKEFNTLSPKEYLLYVRMHRARQLLENTQESIKVIAYSVGFSDPLHFSKAYKQYFNQTPSHTRKEYSQYQLVRKATL

SEQ ID NO: 65843 - DNA, 1002 bp, Sinorhizobium meliloti 1021
  CDS (1)..(1002): transl_table=11
atggcaaacatcgaagcatcccgtcaaaacgtttcccccccaataccggctgttgccgggaatcctatttatccagcggtcctcgtgcctgaactgaatgaggttattgcaaggcccgatcggacgtccccgctcggtcttgagcagtacatagccggccgtacgcttgtcagcggcgacacgcctgcatggagcgacatgttcgtgcaggtctactcccgtctgaacaagcaggagccgtttcttgttcccgctgtcgcggagccgctaatcgtctgggtgatgtcaggcgaggctgtcgtcgaggaacgcgacctcgacggtgactgggttgccaacacggttaccgtcggcgacttcttcctgacccgctccccgacaccatatgaaatgcgttggcgctcggttgacgccgcccccttccaggtcatgcatctttatctctccgttccgcttttcgagcgcgtcgcctacgacgtgctaggctgcgcggcccctccggctttgcgcgacatttccggcggccgggacacgcagctgtcacatctattggcgctcgttcatcaggaattgaccgctgaaggaaagggaagccagttgttcatccaggggcttgcgcaaagtctcgccgtgcatctgatccggaattacgccgcaaatgaagctgacgaccggcagaacgcgctcaccggattcaagctccgtcgcgccgttgcccacctcgaagaacatctagccgagccgttcaatctcgcccagttggccgagacggtcggtatgagcgaatttcatttcagtcgtttgttcaagaaggcgacggggctctcgccctcgcgctacttcattcgccagcgcgttgcccgggcgcagcttcttctacaggagacggacaccagtatcattgagattggcatgtccgttggctattcgagccctagccatttcgcccaggtcttccgtcgcgaaaccggcctgccgccgagtcactatcggcgaggctag

SEQ ID NO: 65844 - protein, 333 aa, Sinorhizobium meliloti 1021
MANIEASRQNVSPPIPAVAGNPIYPAVLVPELNEVIARPDRTSPLGLEQYIAGRTLVSGDTPAWSDMFVQVYSRLNKQEPFLVPAVAEPLIVWVMSGEAVVEERDLDGDWVANTVTVGDFFLTRSPTPYEMRWRSVDAAPFQVMHLYLSVPLFERVAYDVLGCAAPPALRDISGGRDTQLSHLLALVHQELTAEGKGSQLFIQGLAQSLAVHLIRNYAANEADDRQNALTGFKLRRAVAHLEEHLAEPFNLAQLAETVGMSEFHFSRLFKKATGLSPSRYFIRQRVARAQLLLQETDTSIIEIGMSVGYSSPSHFAQVFRRETGLPPSHYRRG

SEQ ID NO: 65845 - DNA, 888 bp, Agrobacterium tumefaciens str. C58
  CDS (1)..(888): transl_table=11
atgggtaattttgtgctgcgggatttgatcgatcagggacccggcatgcgcaccgtctcgctgccgcgcggccgccagacgctacacaccatgccgaccagcagcggttatgaaatccgccgaggcggtaattatgactgggacgggcgcaagcgtgggcagacgcccttcaccgtcctgcaatattgcatcgccggacagggcaacctgcgttacgagaaccgccattatgtggtgaggccgggtgaaaccctgctgctgctgatccctcacaatcaccgttactggctggaagacggaaaggaatgggaattcttctggatttccatgaatggcgaggaagccctgcgcattcaccgcaatatcctctccgtcaccggcccgatcctcaagctccagcaagaaaccgtcgatcatcttgcggaatgctgctcgcgcctcgtcaatggcgcagaaacgccgggggctgcttcggctgtcgcctatgaggcggcgatgacgctttatgacgatgtcttcggctcgcacccctcctttggcggcgaatatcgcaccctgcaacaggtgctaagttatatcgacagccatctcggcgagcggctctcggtgagcgaccttgcggcggtggccggcctcagccgggcgcatttttcccgcatcttcacggcgagcgaaggtctgcctccggcggaattcgtcctgcagcggcggctcaggcgtgcagccaaacttctcaccaccgccgcgaacattcccatcaaggaggtttcggtgctgtgtggcttcgaggatccgaactatttctcgaaggttttccgcaggctttacggcatcaatcccagcgaatttcgcaccaccggcatgtatgcgagcattcggcagggctaa

SEQ ID NO: 65846 - protein, 295 aa, Agrobacterium tumefaciens str. C58
MGNFVLRDLIDQGPGMRTVSLPRGRQTLHTMPTSSGYEIRRGGNYDWDGRKRGQTPFTVLQYCIAGQGNLRYENRHYVVRPGETLLLLIPHNHRYWLEDGKEWEFFWISMNGEEALRIHRNILSVTGPILKLQQETVDHLAECCSRLVNGAETPGAASAVAYEAAMTLYDDVFGSHPSFGGEYRTLQQVLSYIDSHLGERLSVSDLAAVAGLSRAHFSRIFTASEGLPPAEFVLQRRLRRAAKLLTTAANIPIKEVSVLCGFEDPNYFSKVFRRLYGINPSEFRTTGMYASIRQG

SEQ ID NO: 65847 - DNA, 840 bp, Clostridium perfringens str. 13
  CDS (1)..(840): transl_table=11
atgcaaatattgtggaaaaagtatgttaaagaaaactttgaaatgaatgtagatgaatgtggtatagaacaaggtataccaggattaggatataactatgaagtattgaaaaatgctgttattcattacgtaactaagggatatggaacttttaaatttaatggtaaggtatataacttaaaacaaggtgatatttttatactactaaaaggtatgcaagttgagtatgtggcttctattgatgatccttgggaatactactggataggatttagtggttcaaatgctaatgagtatttaaatagaacttctattactaactcctgtgttgctaattgtgaagaaaactcaaaaattccacagataatattaaatatgtgcgaaatatcaaaaacttataatccttcaagatctgatgacatactattactaaaagaactttactcattattgtacgcacttatagaagaattcccaaaaccttttgaatacaaagataaggaattacacacatatattcaagatgctcttaatttcattaattctaattacatgcatagcataactgttcaagaaattgctgattatgtgaacttaagtagaagttatttatataaaatgttcataaaaaaccttggaatttctcctcaaagatatttaataaaccttagaatgtacaaagccacccttttattaaaaagcactaaacttcctataggagaagtcgcaagtagtgtaggttatagtgactccctgttattttcaaaaactttttcaaaacatttttcaatgtctccactaaattacagaaataatcaagtaaataaaccaagtatataa

SEQ ID NO: 65848 - protein, 279 aa, Clostridium perfringens str. 13
MQILWKKYVKENFEMNVDECGIEQGIPGLGYNYEVLKNAVIHYVTKGYGTFKFNGKVYNLKQGDIFILLKGMQVEYVASIDDPWEYYWIGFSGSNANEYLNRTSITNSCVANCEENSKIPQIILNMCEISKTYNPSRSDDILLLKELYSLLYALIEEFPKPFEYKDKELHTYIQDALNFINSNYMHSITVQEIADYVNLSRSYLYKMFIKNLGISPQRYLINLRMYKATLLLKSTKLPIGEVASSVGYSDSLLFSKTFSKHFSMSPLNYRNNQVNKPSI

SEQ ID NO: 65849 - DNA, 894 bp, Shigella flexneri 2a str. 301
  CDS (1)..(894): transl_table=11
atgaatggaaaattgcaaagttcagatgtaaaaaacgaaactccgtacaatattcccttattgattaacgaaaatgtgatctccagcggaatttctctgatctcgctctggcatacctacgccgacgagcattaccgggtgatctggccgcgggacaagaagaaaccgcttatcgccaactcatgggttgcggtgtataccgtacaaggatgtgggaaaattcttttaaagaatggcgaacaaataactctgcatagcaactgtattatatttttaaagccaatggatattcactcttatcactgtgaaggtttagtctgggaacagtactggatggaatttacccccaccagtatgatggatattcccgttggtcagcaaagcgttatttataatggcgaaatttataatcaggaactcaccgaagttgctgagttaataacttcaccagaagcaataaaaaataatctggcagtcgcttttctgacgaaaattatttatcagtggatttgtcttatgtccgcagatggtaaaaaagatccacaacggcggcaaattgaaaaattaattgccactttacatgccagtctgcaacaacgctggagcgtagctgatatggctgccacgatcccctgtagcgaagcctggttgcgtcgtctgtttttacgctataccggcaagacgccgaaagaatattacctcgatgcgcgtctggatctggcgctatcgctattaaagcaacaaggaaactcggttggcgaagtcgctgatacgctcaacttcttcgactcctttcatttcagcaaagcctttaaacataaatttggttatgcgccgtcagccgtgctaaagaatacggaccagcacccaacggatgccagtccacacaattaa

SEQ ID NO: 65850 - protein, 297 aa, Shigella flexneri 2a str. 301
MNGKLQSSDVKNETPYNIPLLINENVISSGISLISLWHTYADEHYRVIWPRDKKKPLIANSWVAVYTVQGCGKILLKNGEQITLHSNCIIFLKPMDIHSYHCEGLVWEQYWMEFTPTSMMDIPVGQQSVIYNGEIYNQELTEVAELITSPEAIKNNLAVAFLTKIIYQWICLMSADGKKDPQRRQIEKLIATLHASLQQRWSVADMAATIPCSEAWLRRLFLRYTGKTPKEYYLDARLDLALSLLKQQGNSVGEVADTLNFFDSFHFSKAFKHKFGYAPSAVLKNTDQHPTDASPHN

SEQ ID NO: 65851 - DNA, 897 bp, Escherichia coli CFT073
  CDS (1)..(897): transl_table=11
gtgagcataattcgccggagggatattaaaatgaatggaaaattgcaaagttcggatgtaaaaaacgaaactccgtacaatattcccttattgattaacgaaaatgtgatctccagcggaatttctctgatatcgctctggcatacctacgccgacgagcattatcgggtgatctggccgcgggacaagaagaaaccgcttatcgccaactcatgggttgcggtgtataccgtacaaggatgtgggaaaattcttttaaagaatgacgaacaaataactctgcatggcaactgtattatatttttaaagccaatggatattcactcttatcactgtgaaggtttggtctgggaacagtactggatggaatttacccccaccagtatgatggatattcccgtcggtcagcaaagcgttatttataatggcgaagtttataatcaggaactcaccgaagttgctgagttaattacttcaccagaagcaataaaaaataatctggcagtcgcttttctgacgaaaattatttatcagtggatttgtcttatgcacgcagtcggtaaaaaagatccacaacggcggcaaattgaaaaattaattgccactttacatgccaatctacaacaacgctggagcgtagctgatatggctgccacgatcccctgtagcgaggcctggttgcgtcgtctgtttttacgctataccggcaagacgccgaaagaatattacctcgatgcgcgtctggatctggcgctatcgctattaaagcaacaagggaactcggttggcgaagtcgctgatacgctcaacttcttcgactcctttcatttcagcaaagcctttaagcataaatttggttatgcgccgtcagctgtgctgaagaatacggacaggtaa

SEQ ID NO: 65852 - protein, 298 aa, Escherichia coli CFT073
MSIIRRRDIKMNGKLQSSDVKNETPYNIPLLINENVISSGISLISLWHTYADEHYRVIWPRDKKKPLIANSWVAVYTVQGCGKILLKNDEQITLHGNCIIFLKPMDIHSYHCEGLVWEQYWMEFTPTSMMDIPVGQQSVIYNGEVYNQELTEVAELITSPEAIKNNLAVAFLTKIIYQWICLMHAVGKKDPQRRQIEKLIATLHANLQQRWSVADMAATIPCSEAWLRRLFLRYTGKTPKEYYLDARLDLALSLLKQQGNSVGEVADTLNFFDSFHFSKAFKHKFGYAPSAVLKNTDR

SEQ ID NO: 65853 - DNA, 888 bp, Gloeobacter violaceus PCC 7421
  CDS (1)..(888): transl_table=11
atgactgcgagctcccgcttcatcgacttcactcaagaagaccagctctccttgccctgcttaccccttgtgtccagttgcagagctgggtggaatagaattcagttggctctctatcgccagccgccttactgcattcctgaacactattccccccatcacgttatctgcatcaacgccggcactccggttacgcttcaacagaccgtagatggaaaatcaaagaccatcgattcgattccaggaggcgttggcatttatccagccaatcgttggcaaactttctattggcatcaagaggccgagtttttgcaactctatctggagccgatgctgcttaatcagttgggaacagagctatatgataaagatcagatcgaattaattccacagttgacatcgtgtattgatccattgatttatcagattgcgatcgctcttaaaacaacattagaaaccgatggtgtcggcagtaaactttattctgatttaatggcaaacgccctggctgtccacattttatgtcggtattcaacaaacaaatcaagtattcagcatgactcaggaaggctgtctgatcaacagctggatcgggtcattaactacattgatgagcatctagatcaaaatttaagcttggctgaattagcggccctagctcgactgagttcctatcactttgcccgtctattcaagcgatccacaggtatcgcacctcaccaatatcacattcgacgccgcgtcgaacgtgctaagcggctacttttggcaagggagttgagtattgcagaagttgcccaggttgttgggtttgccagccaaggacatctcaactaccatttcaagcgtgtcgttgggatagctcccaaagcgtttttgcggcagtag

SEQ ID NO: 65854 - protein, 295 aa, Gloeobacter violaceus PCC 7421
MTASSRFIDFTQEDQLSLPCLPLVSSCRAGWNRIQLALYRQPPYCIPEHYSPHHVICINAGTPVTLQQTVDGKSKTIDSIPGGVGIYPANRWQTFYWHQEAEFLQLYLEPMLLNQLGTELYDKDQIELIPQLTSCIDPLIYQIAIALKTTLETDGVGSKLYSDLMANALAVHILCRYSTNKSSIQHDSGRLSDQQLDRVINYIDEHLDQNLSLAELAALARLSSYHFARLFKRSTGIAPHQYHIRRRVERAKRLLLARELSIAEVAQVVGFASQGHLNYHFKRVVGIAPKAFLRQ

SEQ ID NO: 65855 - DNA, 876 bp, Desulfotalea psychrophila LSv54
  CDS (1)..(876): transl_table=11
atgcaaaccataggcgaactgatgaacaatctggcgacggaggaggggctcaacgaaacctccctctccagaattaaaatatttaaggcaagtgcctattcaccccggggcccgctctgctacaaacaaggagttctctttgtcggtcagggctcaaagagggtatacctcgatgacaaaatatatgagtacaatcccgaaaattacctggtactaacggtgcccatccctgcagagtgcgagacctgcgcgacgacacaaaagccagtgctcctgatgatggtagacattgatgtccaacagctcaaccacatcatcattcagctcggcgaccagcgcccccctccctcctatgctaaagagcaacagggcctttttcttggcaggagaagttctactataaacgagaccctaagaagattactgcaagcactgcaaacaccactggaaagccacatccttggcgaagcacttatccaggagttaatgtttcgtcttatctgtgccgagggcgccgcctctctctatgcccttgccagcaacaatagcaggctctcccaaatcgacagggccttaaagttcatagatacacactatcagcagggcattgccgtagaacaactctcccagctagtcaacatgagtccctctgtcttccaccgtgtttttaaggagataaccgcctcaacccccatccaatatatcaaaaaaatccgcttaagcagagcgcactccctcctcatcgggcagagaatgcgagtcagtgaagcggcagctgaggtgggctatgagagtagcacccagttcagtcgagaatttaaacgctattttggcaacagccccagcgactattccaaaacaaagagagcagaataa

SEQ ID NO: 65856 - protein, 291 aa, Desulfotalea psychrophila LSv54
MQTIGELMNNLATEEGLNETSLSRIKIFKASAYSPRGPLCYKQGVLFVGQGSKRVYLDDKIYEYNPENYLVLTVPIPAECETCATTQKPVLLMMVDIDVQQLNHIIIQLGDQRPPPSYAKEQQGLFLGRRSSTINETLRRLLQALQTPLESHILGEALIQELMFRLICAEGAASLYALASNNSRLSQIDRALKFIDTHYQQGIAVEQLSQLVNMSPSVFHRVFKEITASTPIQYIKKIRLSRAHSLLIGQRMRVSEAAAEVGYESSTQFSREFKRYFGNSPSDYSKTKRAE

SEQ ID NO: 65857 - DNA, 885 bp, Azotobacter vinelandii
  CDS (1)..(885)
atgaaggtcatatccctgccacgcggcaggcatcagttgcacaccatgccgaccaatgccggctatgaccgggtacaggactgcacctaccgctgggatggtcgtcgacgtggcaacacgcctttcgccatcgtgcagcacaccctcgcgggggagggcgacctgcgcttcgaggggcgtcaccatcgactgcgcgccggcgacaccatgctggtgctggtcccgcacgaccattgttactggctggagacagggggttcctgggaattcttctggatcgccatgtacggcaaggaagccctccgcctgcagcgggccttgctggacgagcgcggtccggtgttgcgcctgagcgacaagaccatcgaatgcctggccgaaaacgtcgctgccctgatccgttcgccggaactgaccgccggccgggcgtcggccctggcctacgagtcgctcatggcgttgcacgacgacctgcttgtgcaggatgtcgccttggatgcggcgcgaacgggggtgatcgcctccatccagaatcacatccatgcctgcctgcgttgcgagcccgacactctatccccgcaggcggaggacgacgaactggatgtggcgagcctggcccagttagctggcctgagccgctcccatttttcccggctgttcgcccgcacggtgggcatgtccccggcgcaatatgtcctgaatgaacgcatgaagcgcgcggcccacctactcgaagcgaccgacctgtcggtcaaggcgattgcactgtcggtgggcatccacgatccgaactacttttcgaagctgttccgccacgccttctccctgtcccccagcgagttccgcctcagcggcatgtatgtgaacagccggggccgtctctga

SEQ ID NO: 65858 - protein, 294 aa, Azotobacter vinelandii
MKVISLPRGRHQLHTMPTNAGYDRVQDCTYRWDGRRRGNTPFAIVQHTLAGEGDLRFEGRHHRLRAGDTMLVLVPHDHCYWLETGGSWEFFWIAMYGKEALRLQRALLDERGPVLRLSDKTIECLAENVAALIRSPELTAGRASALAYESLMALHDDLLVQDVALDAARTGVIASIQNHIHACLRCEPDTLSPQAEDDELDVASLAQLAGLSRSHFSRLFARTVGMSPAQYVLNERMKRAAHLLEATDLSVKAIALSVGIHDPNYFSKLFRHAFSLSPSEFRLSGMYVNSRGRL

SEQ ID NO: 65859 - DNA, 831 bp, Pseudomonas fluorescens PfO-1
  CDS (1)..(831)
atgagcgaccagggcgagtcgatccgtttctggcaggccgcgcctctggccggggtcgagctgttgaccgcgcgctacatcgagcatcgtttcgccccgcacgtccacgacggttatgtgatcggcatgatcatggccggcgcccagcgctaccgttatcgcggcgccgaacacctggcgggcagcggtacgctggtgctgatcaatccggacgaagtgcataacggccacaagggcaccgaggacggctggctgtaccgggcgttttatcccgacaccgggcagatcgtcgcgctgttgaatgaactggaactgccgaccgcaccgatgccggccttcggtgcgacgctgtatcgcgatccggatctggtcaacggtttctgtcagttgcatcgcttgctggaaagtcccgccaccgcgttgcaacagcaaaccgtgtggcgggaaatgatgatgctgctgttgcagcgtcacgcggcggtgcagatcaacggcaagcccggcaaagagcaccgcgcggtagcgatggccaaggagctgctgcacgcgcaactggcggcgccgccttcactggaagaactcgcggcggcggtgaatctctcgcctttccacttcgcccgggtgttccgccgcgccaccggcatgccgccgcacagttggctgatgcagcagcggatcgcctgcgcgcggggcttgctgcagagcggctgcctgccggtggaggtcgccacgcagctgggatttgccgaccagagccatctgagccggcaattcaaacaggtttatggcgtggggccggcggcctatcgcagcgcgcggctggatcgctga

SEQ ID NO: 65860 - protein, 276 aa, Pseudomonas fluorescens PfO-1
MSDQGESIRFWQAAPLAGVELLTARYIEHRFAPHVHDGYVIGMIMAGAQRYRYRGAEHLAGSGTLVLINPDEVHNGHKGTEDGWLYRAFYPDTGQIVALLNELELPTAPMPAFGATLYRDPDLVNGFCQLHRLLESPATALQQQTVWREMMMLLLQRHAAVQINGKPGKEHRAVAMAKELLHAQLAAPPSLEELAAAVNLSPFHFARVFRRATGMPPHSWLMQQRIACARGLLQSGCLPVEVATQLGFADQSHLSRQFKQVYGVGPAAYRSARLDR

SEQ ID NO: 65861 - DNA, 918 bp, Enterococcus faecium
  CDS (13)..(918)
ggagggatagacatggagcaatcgatttttttaaaaaaggaacatcaacaagtagaaaaagaattgtattttgatttttgtggtttctctaaaacgatgccgtttcattcttttggtcctgctattcgcaatgattacatcctgcatgtcgtgatggaaggcaaaggatcttatcatgtgaaaaatcaacaattccaattgaaaaaaggtgatctgttcttgattcgtccaggagactcgacgttttacttatcagatggagaagatccgtggatgtattgctggctttcatttggtgggagtgctgcagaagaaatcattcggcagtcgcttttcagagaagaccaatacacgatggtctcttctgacatacaaaaatatatcgacattattttagaatgcatgaaagatacggaagaaaccttggaaaatgaattacagttaacagcattaacctaccgttttttatcagtccttttaaaagatggcggaaaggtcagcggtggtgtacaaaaggttcattcctctttagctgttgaaacagtcaaatacatcgaggcacattatgctgaaaaattgtctgttgaggaaatcgcccagcatttagcggtcaatcggagccatttgtcgcgagtattcaaaaatcatatgggtaccagtatcaaggaatatttgatcggggtacggatcaatcgaggggcgtttcttctttctctgacggatgaatccgtggaaagtattgcctatcaagtagggttcaatagtctagtcgtatttagccgaatgttcaaaaagagtaccggagaaacggctacgaactatcgtaaacgtatgaaaaacgaaaattttaagaatattgctttggataccttgaaaaaacagttggaaaaacaaaccgcagtttcttggacaacctga

SEQ ID NO: 65862 - protein, 301 aa, Enterococcus faecium
MEQSIFLKKEHQQVEKELYFDFCGFSKTMPFHSFGPAIRNDYILHVVMEGKGSYHVKNQQFQLKKGDLFLIRPGDSTFYLSDGEDPWMYCWLSFGGSAAEEIIRQSLFREDQYTMVSSDIQKYIDIILECMKDTEETLENELQLTALTYRFLSVLLKDGGKVSGGVQKVHSSLAVETVKYIEAHYAEKLSVEEIAQHLAVNRSHLSRVFKNHMGTSIKEYLIGVRINRGAFLLSLTDESVESIAYQVGFNSLVVFSRMFKKSTGETATNYRKRMKNENFKNIALDTLKKQLEKQTAVSWTT

SEQ ID NO: 65863 - DNA, 831 bp, Pediococcus pentosaceus ATCC 25745
  CDS (1)..(831)
atgaatggtgaatataaaactttagcgaataaaagcttcgaaagtaatgtactctttttcgggcaagaggcttgcctaccgaattacacttacaaaggtaataatgtcagagacagctatgttatccattacatccaggagggtaaaggtacctttgctgcagctaaccatccagcaaccgtattaaaagccggcgatatttttatactacctaagggaacaccttgtttctatcaagctgacaatgaccaaccgtggaaatacttttggatcggtttttccggtatccgtatcgaagcaatgctttctggttctttattagctcagaaatgctacttacgccaagtacaaaatggccaattttacgccgatctctctgaactttataaagttttacacatccctaattcattgataaatgatgttctattagggtctttgatctatcgaatgttctatgacttattgcgctggtatcccgctgacgccaccaacataaaagtaaagtcaactgaacaatttaacttagctgtttcttacttgcaagaaaattatagtactggttgtaccattatggacctctgtcattatcttaatttatcacgaagctatctctacaccttgtttaaaacgcacgctaatacctcgccacaaaaattactaactaaattgcgcttagaagatgctaaacagcgtctaagcactagtaataattcagtgcaaagcattgccaatatggtaggctacaaggatagcttcactttctccaaggcatttaaacgctacagtggtgctagccccagctattatcgtaaaagcattggaatctaa

SEQ ID NO: 65864 - protein, 276 aa, Pediococcus pentosaceus ATCC 25745
MNGEYKTLANKSFESNVLFFGQEACLPNYTYKGNNVRDSYVIHYIQEGKGTFAAANHPATVLKAGDIFILPKGTPCFYQADNDQPWKYFWIGFSGIRIEAMLSGSLLAQKCYLRQVQNGQFYADLSELYKVLHIPNSLINDVLLGSLIYRMFYDLLRWYPADATNIKVKSTEQFNLAVSYLQENYSTGCTIMDLCHYLNLSRSYLYTLFKTHANTSPQKLLTKLRLEDAKQRLSTSNNSVQSIANMVGYKDSFTFSKAFKRYSGASPSYYRKSIGI

SEQ ID NO: 65865 - DNA, 840 bp, Streptococcus suis 89/1591
  CDS (1)..(840)
atgaatattctaaatatctataatgaattggatagtcataattttgacctaaatgtagaccattacggtgccgaacaatgtgacaagggctattccttcggtcctactatccgtgataattttgtcctgcattttattacaaaaggaagaggaaaaattcttgttgacggaaaaacaagttatcttgctgcaggcgatttgtttattcttccaaaggatgtttccattttctatcaagctgatgatatagacccgtggacctatatatgggttggttttagtggttcacgagcaaaagacctacttaatcaaagtcaactgctagaaaactactacctccactccaatctagagtcaccaattctaggctacatgcatcagattaaccatgttcagatgcatcccatcccctctatcacagaattggtcttaattggctacctcaaccaactcttagcagcactcatcgaggaatttcccagtgaaacattaattaagcctgaaacacaaaccaagcactatgttcagcaagccatcaagatgattcataaccactatgcccatccaattaaagtttctgaaatagcagattttctagctttaagccgaagctatctctataaaatttttaagcaggaaactggctattctatcaaagattatattttacaagtaaaaatgaatcgttcttgtcaactattagaagatgcttctcggagtatcactgaaatcgcctattctgtcggataccaagaccctctcaccttcagtgcggccttcaaaaattatttccatatgagtccgacagaatttagaaaaacacaaaaaaataaggattag

SEQ ID NO: 65866 - protein, 279 aa, Streptococcus suis 89/1591
MNILNIYNELDSHNFDLNVDHYGAEQCDKGYSFGPTIRDNFVLHFITKGRGKILVDGKTSYLAAGDLFILPKDVSIFYQADDIDPWTYIWVGFSGSRAKDLLNQSQLLENYYLHSNLESPILGYMHQINHVQMHPIPSITELVLIGYLNQLLAALIEEFPSETLIKPETQTKHYVQQAIKMIHNHYAHPIKVSEIADFLALSRSYLYKIFKQETGYSIKDYILQVKMNRSCQLLEDASRSITEIAYSVGYQDPLTFSAAFKNYFHMSPTEFRKTQKNKD

SEQ ID NO: 65867 - DNA, 837 bp, Streptococcus mutans
  CDS (1)..(837): transl_table=11
atgaatattctaaatatctataatgaatttgatattaataatttcgatttaagcgttgatcactacggttcagaaaaatgtgatagaggctattcctttggtccaactattcgagacaattatgtcattcatttcatccttgaaggtaaaggaaaacttaccataaatcaacacacccttgacttagcagcaggtgatatcttccttctccccaaagatatctcaaccttttatcaagcagatctccaaatgccttggagctatatctggattggctttagcggttcaaaagccgaaaatattcttaagcagtcaagcctttttaaacgtttttattgtcattctggccgcagctccaagctcttctcacaaatgatgaccattattcaatttgccaacacccccttaacctctgtcaatgaattactaatggtaggtgaactttataagcttttagctgccctcattgaagaatttcctctatctcacttagaagagagcaatagctcaacaaaagcttatgttaaccaagtgaaaaaaataatacattcgcagtatggcagttcccttcgagttaatgatattgctaaaaaactgaatcttagtcgaagttatctctataaaatttttagaaaaagtacaaatctttccataaaagagtacatacttcaagtcagaatgaaaagaagtcagtatttgcttgaaaatcccaaattaagtattgctgaaatatccaattctgttggttttagcgattcacttgcatttagtaaagcctttaaaaattattttggaaaaagccccagtaaatttagaaaagaaatccaaaataattaa

SEQ ID NO: 65868 - protein, 278 aa, Streptococcus mutans
MNILNIYNEFDINNFDLSVDHYGSEKCDRGYSFGPTIRDNYVIHFILEGKGKLTINQHTLDLAAGDIFLLPKDISTFYQADLQMPWSYIWIGFSGSKAENILKQSSLFKRFYCHSGRSSKLFSQMMTIIQFANTPLTSVNELLMVGELYKLLAALIEEFPLSHLEESNSSTKAYVNQVKKIIHSQYGSSLRVNDIAKKLNLSRSYLYKIFRKSTNLSIKEYILQVRMKRSQYLLENPKLSIAEISNSVGFSDSLAFSKAFKNYFGKSPSKFRKEIQNN

SEQ ID NO: 65869 - DNA, 834 bp, Pediococcus pentosaceus
  CDS (1)..(834): transl_table=11
atgaatggtgaatataaaactttagcgaataaaagcttcgaaagtaatgtactctttttcgggcaagaggcttgcctaccgaattacacttacaaaggtaataatgtcagagacagctatgttatccattacatccaggagggtaaaggtacctttgctgcagctaaccatccagcaaccgtattaaaagccggcgatatttttatactacctaagggaacaccttgtttctatcaagctgacaatgaccaaccgtggaaatacttttggatcggtttttccgccggtatccgtatcgaagcaatgctttctggttctttattagctcagaaatgctacttacgccaagtacaaaatggccatatttacgccgatctctctgaactttataaagttttacacatccctaattcattgataaatgatgttctattagggtctttgatctatcgattgttctatgacttattgcgctggtatcccgctgacgccaccaacataaaagtaaagtcaactgaacaatttaacttagctgtttcttacttgcaagaaaattatagtactggttgtaccattatggacctctgtcattatcttaatttatcacgaagctatctctacaccttgtttaaaacgcacgctaatacctcgccacaaaaattactaactaaattgcgcttagaagatgctaaacagcgtctaagcactagtaataattcagtgcaaagcattgccaatatggtaggctacaaggatagcttcactttctccaaggcatttaaacgctacagtggtgctagccccagctattatcgtaaaagcattggaatctaa

SEQ ID NO: 65870 - protein, 277 aa, Pediococcus pentosaceus
MNGEYKTLANKSFESNVLFFGQEACLPNYTYKGNNVRDSYVIHYIQEGKGTFAAANHPATVLKAGDIFILPKGTPCFYQADNDQPWKYFWIGFSAGIRIEAMLSGSLLAQKCYLRQVQNGHIYADLSELYKVLHIPNSLINDVLLGSLIYRLFYDLLRWYPADATNIKVKSTEQFNLAVSYLQENYSTGCTIMDLCHYLNLSRSYLYTLFKTHANTSPQKLLTKLRLEDAKQRLSTSNNSVQSIANMVGYKDSFTFSKAFKRYSGASPSYYRKSIGI

SEQ ID NO: 65871 - DNA, 23 bp, Primer
atgagcataattcgccggaggga

SEQ ID NO: 65872 - DNA, 21 bp, Primer
ttaattgtgtggactggcatc

SEQ ID NO: 65873 - protein, 251 aa, consensus
  MISC_FEATURE (1)..(251): consensus for the disclosure of xaa see table XV
GXGXXXXXXXXXXXXXXXXXXXXGXXXXXXXXXXXXXXXXXXXXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXXXXXSXXXXXXXFXXXXXXXPXXXXXXXRXXXAXXLLXXXXXXXXXXXAXXXGXXXXXXFSXXFXXXXGXXP

SEQ ID NO: 65874 - protein, 78 aa, consensus
  MISC_FEATURE (1)..(78): consensus for the disclosure of xaa see table XV
XXXXXXXXXXXXXXXXXXFXXXXXXXXXXXXXXXXXXXXXXXLXXXXXXXXXXXXXXXXXXXXXXXXXXXXXXXXXXX

SEQ ID NO: 65875 - DNA, 1131 bp, Escherichia coli; identical to SEQ ID NO: 42917
  CDS (1)..(1131)

SEQ ID NO: 65876 - protein, 376 aa, Escherichia coli; identical to SEQ ID NO: 42918

SEQ ID NO: 65877 - DNA, 1137 bp, Mesorhizobium loti MAFF303099; identical to SEQ ID NO: 42919
  CDS (1)..(1137): transl_table=11

SEQ ID NO: 65878 - protein, 378 aa, Mesorhizobium loti MAFF303099; identical to SEQ ID NO: 42920

SEQ ID NO: 65879 - DNA, 1143 bp, Mesorhizobium loti MAFF303099; identical to SEQ ID NO: 42921
  CDS (1)..(1143): transl_table=11

SEQ ID NO: 65880 - protein, 380 aa, Mesorhizobium loti MAFF303099; identical to SEQ ID NO: 42922

SEQ ID NO: 65881 - DNA, 1101 bp, Pyrococcus abyssi GE5; identical to SEQ ID NO: 42923
  CDS (1)..(1101): transl_table=11

SEQ ID NO: 65882 - protein, 366 aa, Pyrococcus abyssi GE5; identical to SEQ ID NO: 42924

SEQ ID NO: 65883 - DNA, 1239 bp, Treponema pallidum subsp. pallidum str. Nichols; identical to SEQ ID NO: 42925
  CDS (1)..(1239): transl_table=11

SEQ ID NO: 65884 - protein, 412 aa, Treponema pallidum subsp. pallidum str. Nichols; identical to SEQ ID NO: 42926

SEQ ID NO: 65885 - DNA, 1152 bp, Thermotoga maritima MSB8; identical to SEQ ID NO: 42927
  CDS (1)..(1152): transl_table=11

SEQ ID NO: 65886 - protein, 383 aa, Thermotoga maritima MSB8; identical to SEQ ID NO: 42928

SEQ ID NO: 65887 - DNA, 1134 bp, Thermotoga maritima MSB8; identical to SEQ ID NO: 42929
  CDS (1)..(1134): transl_table=11

SEQ ID NO: 65888 - protein, 377 aa, Thermotoga maritima MSB8; identical to SEQ ID NO: 42930

SEQ ID NO: 65889 - DNA, 1104 bp, Vibrio cholerae O1 biovar eltor str. N16961; identical to SEQ ID NO: 42931
  CDS (1)..(1104): transl_table=11

SEQ ID NO: 65890 - protein, 367 aa, Vibrio cholerae O1 biovar eltor str. N16961; identical to SEQ ID NO: 42932

SEQ ID NO: 65891 - DNA, 1170 bp, Pasteurella multocida subsp. multocida str. Pm70; identical to SEQ ID NO: 42933
  CDS (1)..(1170): transl_table=11

SEQ ID NO: 65892 - protein, 389 aa, Pasteurella multocida subsp. multocida str. Pm70; identical to SEQ ID NO: 42934

SEQ ID NO: 65893 - DNA, 1080 bp, Pseudomonas aeruginosa PAO1; identical to SEQ ID NO: 42935
  CDS (1)..(1080): transl_table=11

SEQ ID NO: 65894 - protein, 359 aa, Pseudomonas aeruginosa PAO1; identical to SEQ ID NO: 42936

SEQ ID NO: 65895 - DNA, 1149 bp, Pseudomonas aeruginosa PAO1; identical to SEQ ID NO: 42937
  CDS (1)..(1149): transl_table=11

SEQ ID NO: 65896 - protein, 382 aa, Pseudomonas aeruginosa PAO1; identical to SEQ ID NO: 42938

SEQ ID NO: 65897 - DNA, 1176 bp, Neisseria meningitidis MC58; identical to SEQ ID NO: 42939
  CDS (1)..(1176): transl_table=11

SEQ ID NO: 65898 - protein, 391 aa, Neisseria meningitidis MC58; identical to SEQ ID NO: 42940

SEQ ID NO: 65899 - DNA, 1092 bp, Methanothermobacter thermautotrophicus str. Delta H; identical to SEQ ID NO: 42941
  CDS (1)..(1092): transl_table=11

SEQ ID NO: 65900 - protein, 363 aa, Methanothermobacter thermautotrophicus str. Delta H; identical to SEQ ID NO: 42942

SEQ ID NO: 65901 - DNA, 1083 bp, Methanothermobacter thermautotrophicus str. Delta H; identical to SEQ ID NO: 42943
  CDS (1)..(1083): transl_table=11

SEQ ID NO: 65902 - protein, 360 aa, Methanothermobacter thermautotrophicus str. Delta H; identical to SEQ ID NO: 42944

SEQ ID NO: 65903 - DNA, 1074 bp, Campylobacter jejuni subsp. jejuni NCTC 11168; identical to SEQ ID NO: 42945
  CDS (1)..(1074): transl_table=11

SEQ ID NO: 65904 - protein, 357 aa, Campylobacter jejuni subsp. jejuni NCTC 11168; identical to SEQ ID NO: 42946

SEQ ID NO: 65905 - DNA, 1161 bp, Campylobacter jejuni subsp. jejuni NCTC 11168; identical to SEQ ID NO: 42947
  CDS (1)..(1161): transl_table=11

SEQ ID NO: 65906 - protein, 386 aa, Campylobacter jejuni subsp. jejuni NCTC 11168; identical to SEQ ID NO: 42948

SEQ ID NO: 65907 - DNA, 1131 bp, Campylobacter jejuni subsp. jejuni NCTC 11168; identical to SEQ ID NO: 42949
  CDS (1)..(1131): transl_table=11

SEQ ID NO: 65908 - protein, 376 aa, Campylobacter jejuni subsp. jejuni NCTC 11168; identical to SEQ ID NO: 42950

SEQ ID NO: 65909 - DNA, 1155 bp, Campylobacter jejuni subsp. jejuni NCTC 11168; identical to SEQ ID NO: 42951
  CDS (1)..(1155): transl_table=11

SEQ ID NO: 65910 - protein, 384 aa, Campylobacter jejuni subsp. jejuni NCTC 11168; identical to SEQ ID NO: 42952

SEQ ID NO: 65911 - DNA, 1215 bp, Neisseria meningitidis Z2491; identical to SEQ ID NO: 42953
  CDS (1)..(1215): transl_table=11

SEQ ID NO: 65912 - protein, 404 aa, Neisseria meningitidis Z2491; identical to SEQ ID NO: 42954

SEQ ID NO: 65913 - DNA, 1227 bp, Streptococcus pneumoniae TIGR4; identical to SEQ ID NO: 42955
  CDS (1)..(1227): transl_table=11

SEQ ID NO: 65914 - protein, 408 aa, Streptococcus pneumoniae TIGR4; identical to SEQ ID NO: 42956

SEQ ID NO: 65915 - DNA, 1185 bp, Clostridium acetobutylicum ATCC 824; identical to SEQ ID NO: 42957
  CDS (1)..(1185): transl_table=11

SEQ ID NO: 65916 - protein, 394 aa, Clostridium acetobutylicum ATCC 824; identical to SEQ ID NO: 42958

SEQ ID NO: 65917 - DNA, 1095 bp, Clostridium acetobutylicum ATCC 824; identical to SEQ ID NO: 42959
  CDS (1)..(1095): transl_table=11

SEQ ID NO: 65918 - protein, 364 aa, Clostridium acetobutylicum ATCC 824; identical to SEQ ID NO: 42960

SEQ ID NO: 65919 - DNA, 1254 bp, Streptococcus pneumoniae R6; identical to SEQ ID NO: 42961
  CDS (1)..(1254): transl_table=11

SEQ ID NO: 65920 - protein, 417 aa, Streptococcus pneumoniae R6; identical to SEQ ID NO: 42962

SEQ ID NO: 65921 - DNA, 1326 bp, Bacillus subtilis subsp. subtilis str. 168; identical to SEQ ID NO: 42963
  CDS (1)..(1326): transl_table=11

SEQ ID NO: 65922 - protein, 441 aa, Bacillus subtilis subsp. subtilis str. 168; identical to SEQ ID NO: 42964

SEQ ID NO: 65923 - DNA, 1167 bp, Bacillus subtilis subsp. subtilis str. 168; identical to SEQ ID NO: 42965
  CDS (1)..(1167): transl_table=11

SEQ ID NO: 65924 - protein, 388 aa, Bacillus subtilis subsp. subtilis str. 168; identical to SEQ ID NO: 42966

SEQ ID NO: 65925 - DNA, 1314 bp, Yersinia pestis CO92; identical to SEQ ID NO: 42967
  CDS (1)..(1314)

SEQ ID NO: 65926 - protein, 437 aa, Yersinia pestis CO92; identical to SEQ ID NO: 42968

SEQ ID NO: 65927 - DNA, 1131 bp, Yersinia pestis CO92; identical to SEQ ID NO: 42969
  CDS (1)..(1131)

SEQ ID NO: 65928 - protein, 376 aa, Yersinia pestis CO92; identical to SEQ ID NO: 42970

SEQ ID NO: 65929 - DNA, 1209 bp, Caulobacter crescentus CB15; identical to SEQ ID NO: 42971
  CDS (1)..(1209): transl_table=11

SEQ ID NO: 65930 - protein, 402 aa, Caulobacter crescentus CB15; identical to SEQ ID NO: 42972

SEQ ID NO: 65931 - DNA, 1116 bp, Caulobacter crescentus CB15; identical to SEQ ID NO: 42973
  CDS (1)..(1116): transl_table=11

SEQ ID NO: 65932 - protein, 371 aa, Caulobacter crescentus CB15; identical to SEQ ID NO: 42974

SEQ ID NO: 65933 - DNA, 1161 bp, Caulobacter crescentus CB15; identical to SEQ ID NO: 42975
  CDS (1)..(1161): transl_table=11

SEQ ID NO: 65934 - protein, 386 aa, Caulobacter crescentus CB15; identical to SEQ ID NO: 42976

SEQ ID NO: 65935 - DNA, 1191 bp, Sinorhizobium meliloti 1021; identical to SEQ ID NO: 42977
  CDS (1)..(1191): transl_table=11

SEQ ID NO: 65936 - protein, 396 aa, Sinorhizobium meliloti 1021; identical to SEQ ID NO: 42978

SEQ ID NO: 65937 - DNA, 1137 bp, Synechocystis sp. PCC 6803; identical to SEQ ID NO: 42979
  CDS (1)..(1137): transl_table=11

SEQ ID NO: 65938 - protein, 378 aa, Synechocystis sp. PCC 6803; identical to SEQ ID NO: 42980

SEQ ID NO: 65939 - DNA, 1038 bp, Synechocystis sp. PCC 6803; identical to SEQ ID NO: 42981
  CDS (1)..(1038): transl_table=11

SEQ ID NO: 65940 - protein, 345 aa, Synechocystis sp. PCC 6803; identical to SEQ ID NO: 42982

SEQ ID NO: 65941 - DNA, 1158 bp, Synechocystis sp. PCC 6803; identical to SEQ ID NO: 42983
  CDS (1)..(1158): transl_table=11

SEQ ID NO: 65942 - protein, 385 aa, Synechocystis sp. PCC 6803; identical to SEQ ID NO: 42984

SEQ ID NO: 65943 - DNA, 1131 bp, Salmonella typhimurium LT2; identical to SEQ ID NO: 42985
  CDS (1)..(1131): transl_table=11

SEQ ID NO: 65944 - protein, 376 aa, Salmonella typhimurium LT2; identical to SEQ ID NO: 42986

SEQ ID NO: 65945 - DNA, 1188 bp, Nostoc sp. PCC 7120; identical to SEQ ID NO: 42987
  CDS (1)..(1188): transl_table=11

SEQ ID NO: 65946 - protein, 395 aa, Nostoc sp. PCC 7120; identical to SEQ ID NO: 42988

SEQ ID NO: 65947 - DNA, 1221 bp, Nostoc sp. PCC 7120; identical to SEQ ID NO: 42989
  CDS (1)..(1221): transl_table=11

SEQ ID NO: 65948 - protein, 406 aa, Nostoc sp. PCC 7120; identical to SEQ ID NO: 42990

SEQ ID NO: 65949 - DNA, 1149 bp, Nostoc sp. PCC 7120; identical to SEQ ID NO: 42991
  CDS (1)..(1149): transl_table=11

SEQ ID NO: 65950 - protein, 382 aa, Nostoc sp. PCC 7120; identical to SEQ ID NO: 42992

SEQ ID NO: 65951 - DNA, 1161 bp, Ralstonia solanacearum GMI1000; identical to SEQ ID NO: 42993
  CDS (1)..(1161): transl_table=11

SEQ ID NO: 65952 - protein, 386 aa, Ralstonia solanacearum GMI1000; identical to SEQ ID NO: 42994

SEQ ID NO: 65953 - DNA, 1152 bp, Brucella melitensis 16M; identical to SEQ ID NO: 42995
  CDS (1)..(1152): transl_table=11

SEQ ID NO: 65954 - protein, 383 aa, Brucella melitensis 16M; identical to SEQ ID NO: 42996

SEQ ID NO: 65955 - DNA, 1143 bp, Brucella melitensis 16M; identical to SEQ ID NO: 42997
  CDS (1)..(1143): transl_table=11

SEQ ID NO: 65956 - protein, 380 aa, Brucella melitensis 16M; identical to SEQ ID NO: 42998

SEQ ID NO: 65957 - DNA, 1215 bp, Pyrobaculum aerophilum str. IM2; identical to SEQ ID NO: 42999
  CDS (1)..(1215): transl_table=11

SEQ ID NO: 65958 - protein, 404 aa, Pyrobaculum aerophilum str. IM2; identical to SEQ ID NO: 43000

SEQ ID NO: 65959 - DNA, 1095 bp, Pyrococcus furiosus DSM 3638; identical to SEQ ID NO: 43001
  CDS (1)..(1095): transl_table=11

SEQ ID NO: 65960 - protein, 364 aa, Pyrococcus furiosus DSM 3638; identical to SEQ ID NO: 43002

SEQ ID NO: 65961 - DNA, 1158 bp, Corynebacterium glutamicum ATCC 13032; identical to SEQ ID NO: 43003
  CDS (1)..(1158): transl_table=11

SEQ ID NO: 65962 - protein, 385 aa, Corynebacterium glutamicum ATCC 13032; identical to SEQ ID NO: 43004

SEQ ID NO: 65963 - DNA, 1185 bp, Methanopyrus kandleri AV19; identical to SEQ ID NO: 43005
  CDS (1)..(1185): transl_table=11

SEQ ID NO: 65964 - protein, 394 aa, Methanopyrus kandleri AV19; identical to SEQ ID NO: 43006

SEQ ID NO: 65965 - DNA, 1116 bp, Thermoanaerobacter tengcongensis MB4; identical to SEQ ID NO: 43007
  CDS (1)..(1116): transl_table=11

SEQ ID NO: 65966 - protein, 371 aa, Thermoanaerobacter tengcongensis MB4; identical to SEQ ID NO: 43008

SEQ ID NO: 65967 - DNA, 1119 bp, Thermoanaerobacter tengcongensis MB4; identical to SEQ ID NO: 43009
  CDS (1)..(1119): transl_table=11

SEQ ID NO: 65968 - protein, 372 aa, Thermoanaerobacter tengcongensis MB4; identical to SEQ ID NO: 43010

SEQ ID NO: 65969 - DNA, 1083 bp, Methanosarcina mazei Go1; identical to SEQ ID NO: 43011
  CDS (1)..(1083): transl_table=11

SEQ ID NO: 65970 - protein, 360 aa, Methanosarcina mazei Go1; identical to SEQ ID NO: 43012

SEQ ID NO: 65971 - DNA, 1104 bp, Xanthomonas campestris pv. campestris str. ATCC 33913; identical to SEQ ID NO: 43013
  CDS (1)..(1104): transl_table=11

SEQ ID NO: 65972 - protein, 367 aa, Xanthomonas campestris pv. campestris str. ATCC 33913; identical to SEQ ID NO: 43014

SEQ ID NO: 65973 - DNA, 1143 bp, Xanthomonas campestris pv. campestris str. ATCC 33913; identical to SEQ ID NO: 43015
  CDS (1)..(1143): transl_table=11

SEQ ID NO: 65974 - protein, 380 aa, Xanthomonas campestris pv. campestris str. ATCC 33913; identical to SEQ ID NO: 43016

SEQ ID NO: 65975 - DNA, 1290 bp, Xanthomonas campestris pv. campestris str. ATCC 33913; identical to SEQ ID NO: 43017
  CDS (1)..(1290): transl_table=11

SEQ ID NO: 65976 - protein, 429 aa, Xanthomonas campestris pv. campestris str. ATCC 33913; identical to SEQ ID NO: 43018

SEQ ID NO: 65977 - DNA, 1113 bp, Xanthomonas axonopodis pv. citri str. 306; identical to SEQ ID NO: 43019
  CDS (1)..(1113): transl_table=11

SEQ ID NO: 65978 - protein, 370 aa, Xanthomonas axonopodis pv. citri str. 306; identical to SEQ ID NO: 43020

SEQ ID NO: 65979 - DNA, 1116 bp, Chlorobium tepidum TLS; identical to SEQ ID NO: 43021
  CDS (1)..(1116): transl_table=11

SEQ ID NO: 65980 - protein, 371 aa, Chlorobium tepidum TLS; identical to SEQ ID NO: 43022

SEQ ID NO: 65981 - DNA, 1314 bp, Yersinia pestis KIM; identical to SEQ ID NO: 43023
  CDS (1)..(1314): transl_table=11

SEQ ID NO: 65982 - protein, 437 aa, Yersinia pestis KIM; identical to SEQ ID NO: 43024

SEQ ID NO: 65983 - DNA, 1155 bp, Yersinia pestis KIM; identical to SEQ ID NO: 43025
  CDS (1)..(1155): transl_table=11

SEQ ID NO: 65984 - protein, 384 aa, Yersinia pestis KIM; identical to SEQ ID NO: 43026

SEQ ID NO: 65985 - DNA, 1203 bp, Thermosynechococcus elongatus BP-1; identical to SEQ ID NO: 43027
  CDS (1)..(1203): transl_table=11

SEQ ID NO: 65986 - protein, 400 aa, Thermosynechococcus elongatus BP-1; identical to SEQ ID NO: 43028

SEQ ID NO: 65987 - DNA, 1098 bp, Thermosynechococcus elongatus BP-1; identical to SEQ ID NO: 43029
  CDS (1)..(1098): transl_table=11

SEQ ID NO: 65988 - protein, 365 aa, Thermosynechococcus elongatus BP-1; identical to SEQ ID NO: 43030

SEQ ID NO: 65989 - DNA, 1131 bp, Oceanobacillus iheyensis HTE831; identical to SEQ ID NO: 43031
  CDS (1)..(1131): transl_table=11

SEQ ID NO: 65990 - protein, 376 aa, Oceanobacillus iheyensis HTE831; identical to SEQ ID NO: 43032

SEQ ID NO: 65991 - DNA, 1116 bp, Oceanobacillus iheyensis HTE831; identical to SEQ ID NO: 43033
  CDS (1)..(1116): transl_table=11

SEQ ID NO: 65992 - protein, 371 aa, Oceanobacillus iheyensis HTE831; identical to SEQ ID NO: 43034

SEQ ID NO: 65993 - DNA, 1104 bp, Brucella suis 1330; identical to SEQ ID NO: 43035
  CDS (1)..(1104): transl_table=11

SEQ ID NO: 65994 - protein, 367 aa, Brucella suis 1330; identical to SEQ ID NO: 43036

SEQ ID NO: 65995 - DNA, 1125 bp, Brucella suis 1330; identical to SEQ ID NO: 43037
  CDS (1)..(1125): transl_table=11

SEQ ID NO: 65996 - protein, 374 aa, Brucella suis 1330; identical to SEQ ID NO: 43038

SEQ ID NO: 65997 - DNA, 1107 bp, Shigella flexneri 2a str. 301; identical to SEQ ID NO: 43039
  CDS (1)..(1107): transl_table=11

SEQ ID NO: 65998 - protein, 368 aa, Shigella flexneri 2a str. 301; identical to SEQ ID NO: 43040

SEQ ID NO: 65999 - DNA, 1077 bp, Leptospira interrogans serovar Lai str. 56601; identical to SEQ ID NO: 43041
  CDS (1)..(1077): transl_table=11

SEQ ID NO: 66000 - protein, 358 aa, Leptospira interrogans serovar Lai str. 56601; identical to SEQ ID NO: 43042

SEQ ID NO: 66001 - DNA, 1164 bp, Leptospira interrogans serovar Lai str. 56601; identical to SEQ ID NO: 43043
  CDS (1)..(1164): transl_table=11

SEQ ID NO: 66002 - protein, 387 aa, Leptospira interrogans serovar Lai str. 56601; identical to SEQ ID NO: 43044

SEQ ID NO: 66003 - DNA, 1185 bp, Leptospira interrogans serovar Lai str. 56601; identical to SEQ ID NO: 43045
  CDS (1)..(1185): transl_table=11

SEQ ID NO: 66004 - protein, 394 aa, Leptospira interrogans serovar Lai str. 56601; identical to SEQ ID NO: 43046

SEQ ID NO: 66005 - DNA, 1092 bp, Leptospira interrogans serovar Lai str. 56601; identical to SEQ ID NO: 43047
  CDS (1)..(1092): transl_table=11

SEQ ID NO: 66006 - protein, 363 aa, Leptospira interrogans serovar Lai str. 56601; identical to SEQ ID NO: 43048

SEQ ID NO: 66007 - DNA, 1209 bp, Leptospira interrogans serovar Lai str. 56601; identical to SEQ ID NO: 43049
  CDS (1)..(1209): transl_table=11

SEQ ID NO: 66008 - protein, 402 aa, Leptospira interrogans serovar Lai str. 56601; identical to SEQ ID NO: 43050

SEQ ID NO: 66009 - DNA, 1188 bp, Shewanella oneidensis MR-1; identical to SEQ ID NO: 43051
  CDS (1)..(1188): transl_table=11

SEQ ID NO: 66010 - protein, 395 aa, Shewanella oneidensis MR-1; identical to SEQ ID NO: 43052

SEQ ID NO: 66011 - DNA, 1146 bp, Shewanella oneidensis MR-1; identical to SEQ ID NO: 43053
  CDS (1)..(1146): transl_table=11

SEQ ID NO: 66012 - protein, 381 aa, Shewanella oneidensis MR-1; identical to SEQ ID NO: 43054

SEQ ID NO: 66013 - DNA, 1143 bp, Vibrio vulnificus CMCP6; identical to SEQ ID NO: 43055
  CDS (1)..(1143): transl_table=11

SEQ ID NO: 66014 - protein, 380 aa, Vibrio vulnificus CMCP6; identical to SEQ ID NO: 43056

SEQ ID NO: 66015 - DNA, 1143 bp, Bradyrhizobium japonicum USDA 110; identical to SEQ ID NO: 43057
  CDS (1)..(1143)

SEQ ID NO: 66016 - protein, 380 aa, Bradyrhizobium japonicum USDA 110; identical to SEQ ID NO: 43058

SEQ ID NO: 66017 - DNA, 1107 bp, Bradyrhizobium japonicum USDA 110; identical to SEQ ID NO: 43059
  CDS (1)..(1107)

SEQ ID NO: 66018 - protein, 368 aa, Bradyrhizobium japonicum USDA 110; identical to SEQ ID NO: 43060

SEQ ID NO: 66019 - DNA, 1119 bp, Bradyrhizobium japonicum USDA 110; identical to SEQ ID NO: 43061
  CDS (1)..(1119)

SEQ ID NO: 66020 - protein, 372 aa, Bradyrhizobium japonicum USDA 110; identical to SEQ ID NO: 43062

SEQ ID NO: 66021 - DNA, 1194 bp, Bradyrhizobium japonicum USDA 110; identical to SEQ ID NO: 43063
  CDS (1)..(1194)

SEQ ID NO: 66022 - protein, 397 aa, Bradyrhizobium japonicum USDA 110; identical to SEQ ID NO: 43064

SEQ ID NO: 66023 - DNA, 1221 bp, Bradyrhizobium japonicum USDA 110; identical to SEQ ID NO: 43065
  CDS (1)..(1221)

SEQ ID NO: 66024 - protein, 406 aa, Bradyrhizobium japonicum USDA 110; identical to SEQ ID NO: 43066

SEQ ID NO: 66025 - DNA, 1122 bp, Clostridium tetani E88; identical to SEQ ID NO: 43067
  CDS (1)..(1122): transl_table=11

SEQ ID NO: 66026 - protein, 373 aa, Clostridium tetani E88; identical to SEQ ID NO: 43068

SEQ ID NO: 66027 - DNA, 1176 bp, Clostridium tetani E88; identical to SEQ ID NO: 43069
  CDS (1)..(1176): transl_table=11

SEQ ID NO: 66028 - protein, 391 aa, Clostridium tetani E88; identical to SEQ ID NO: 43070

SEQ ID NO: 66029 - DNA, 1320 bp, Lactobacillus plantarum WCFS1; identical to SEQ ID NO: 43071
  CDS (1)..(1320): transl_table=11

SEQ ID NO: 66030 - protein, 439 aa, Lactobacillus plantarum WCFS1; identical to SEQ ID NO: 43072

SEQ ID NO: 66031 - DNA, 1116 bp, Pseudomonas syringae pv. tomato str. DC3000; identical to SEQ ID NO: 43073
  CDS (1)..(1116): transl_table=11

SEQ ID NO: 66032 - protein, 371 aa, Pseudomonas syringae pv. tomato str. DC3000; identical to SEQ ID NO: 43074

SEQ ID NO: 66033 - DNA, 1119 bp, Pseudomonas syringae pv. tomato str. DC3000; identical to SEQ ID NO: 43075
  CDS (1)..(1119): transl_table=11

SEQ ID NO: 66034 - protein, 372 aa, Pseudomonas syringae pv. tomato str. DC3000; identical to SEQ ID NO: 43076

SEQ ID NO: 66035 - DNA, 1164 bp, Vibrio parahaemolyticus RIMD 2210633; identical to SEQ ID NO: 43077
  CDS (1)..(1164): transl_table=11

SEQ ID NO: 66036 - protein, 387 aa, Vibrio parahaemolyticus RIMD 2210633; identical to SEQ ID NO: 43078

SEQ ID NO: 66037 - DNA, 1176 bp, Vibrio parahaemolyticus RIMD 2210633; identical to SEQ ID NO: 43079
  CDS (1)..(1176): transl_table=11

SEQ ID NO: 66038 - protein, 391 aa, Vibrio parahaemolyticus RIMD 2210633; identical to SEQ ID NO: 43080

SEQ ID NO: 66039 - DNA, 1158 bp, Salmonella enterica subsp. enterica serovar Typhi Ty2; identical to SEQ ID NO: 43081
  CDS (1)..(1158): transl_table=11

SEQ ID NO: 66040 - protein, 385 aa, Salmonella enterica subsp. enterica serovar Typhi Ty2; identical to SEQ ID NO: 43082

SEQ ID NO: 66041 - DNA, 1314 bp, Salmonella enterica subsp. enterica serovar Typhi Ty2; identical to SEQ ID NO: 43083
  CDS (1)..(1314): transl_table=11

SEQ ID NO: 66042 - protein, 437 aa, Salmonella enterica subsp. enterica serovar Typhi Ty2; identical to SEQ ID NO: 43084

SEQ ID NO: 66043 - DNA, 1275 bp, Bacteroides thetaiotaomicron VPI-5482; identical to SEQ ID NO: 43085
  CDS (1)..(1275): transl_table=11

SEQ ID NO: 66044 - protein, 424 aa, Bacteroides thetaiotaomicron VPI-5482; identical to SEQ ID NO: 43086

SEQ ID NO: 66045 - DNA, 1149 bp, Coxiella burnetii RSA 493; identical to SEQ ID NO: 43087
  CDS (1)..(1149): transl_table=11

SEQ ID NO: 66046 - protein, 382 aa, Coxiella burnetii RSA 493; identical to SEQ ID NO: 43088

SEQ ID NO: 66047 - DNA, 1161 bp, Coxiella burnetii RSA 493; identical to SEQ ID NO: 43089
  CDS (1)..(1161): transl_table=11

SEQ ID NO: 66048 - protein, 386 aa, Coxiella burnetii RSA 493; identical to SEQ ID NO: 43090

SEQ ID NO: 66049 - DNA, 1110 bp, Coxiella burnetii RSA 493; identical to SEQ ID NO: 43091
  CDS (1)..(1110): transl_table=11

SEQ ID NO: 66050 - protein, 369 aa, Coxiella burnetii RSA 493; identical to SEQ ID NO: 43092

SEQ ID NO: 66051 - DNA, 1155 bp, Coxiella burnetii RSA 493; identical to SEQ ID NO: 43093
  CDS (1)..(1155): transl_table=11

SEQ ID NO: 66052 - protein, 384 aa, Coxiella burnetii RSA 493; identical to SEQ ID NO: 43094

SEQ ID NO: 66053 - DNA, 1350 bp, Streptomyces avermitilis MA-4680; identical to SEQ ID NO: 43095
  CDS (1)..(1350)

SEQ ID NO: 66054 - protein, 449 aa, Streptomyces avermitilis MA-4680; identical to SEQ ID NO: 43096

SEQ ID NO: 66055 - DNA, 1218 bp, Bacillus cereus ATCC 14579; identical to SEQ ID NO: 43097
  CDS (1)..(1218): transl_table=11

SEQ ID NO: 66056 - protein, 405 aa, Bacillus cereus ATCC 14579; identical to SEQ ID NO: 43098

SEQ ID NO: 66057 - DNA, 1146 bp, Nitrosomonas europaea ATCC 19718; identical to SEQ ID NO: 43099
  CDS (1)..(1146): transl_table=11

SEQ ID NO: 66058 - protein, 381 aa, Nitrosomonas europaea ATCC 19718; identical to SEQ ID NO: 43100

SEQ ID NO: 66059 - DNA, 1149 bp, Mycobacterium bovis AF2122/97; identical to SEQ ID NO: 43101
  CDS (1)..(1149): transl_table=11

SEQ ID NO: 66060 - protein, 382 aa, Mycobacterium bovis AF2122/97; identical to SEQ ID NO: 43102

SEQ ID NO: 66061 - DNA, 1098 bp, Helicobacter hepaticus ATCC 51449; identical to SEQ ID NO: 43103
  CDS (1)..(1098): transl_table=11

SEQ ID NO: 66062 - protein, 365 aa, Helicobacter hepaticus ATCC 51449; identical to SEQ ID NO: 43104

SEQ ID NO: 66063 - DNA, 1095 bp, Helicobacter hepaticus ATCC 51449; identical to SEQ ID NO: 43105
  CDS (1)..(1095): transl_table=11

SEQ ID NO: 66064 - protein, 364 aa, Helicobacter hepaticus ATCC 51449; identical to SEQ ID NO: 43106

SEQ ID NO: 66065 - DNA, 1254 bp, Rhodopirellula baltica SH 1; identical to SEQ ID NO: 43107
  CDS (1)..(1254): transl_table=11

SEQ ID NO: 66066 - protein, 417 aa, Rhodopirellula baltica SH 1; identical to SEQ ID NO: 43108

SEQ ID NO: 66067 - DNA, 1149 bp, Wigglesworthia glossinidia endosymbiont of Glossina brevipalpis; identical to SEQ ID NO: 43109
  CDS (1)..(1149): transl_table=11

SEQ ID NO: 66068 - protein, 382 aa, Wigglesworthia glossinidia endosymbiont of Glossina brevipalpis; identical to SEQ ID NO: 43110

SEQ ID NO: 66069 - DNA, 1131 bp, Haemophilus ducreyi 35000HP; identical to SEQ ID NO: 43111
  CDS (1)..(1131): transl_table=11

SEQ ID NO: 66070 - protein, 376 aa, Haemophilus ducreyi 35000HP; identical to SEQ ID NO: 43112

SEQ ID NO: 66071 - DNA, 1188 bp, Prochlorococcus marinus subsp. marinus str. CCMP1375; identical to SEQ ID NO: 43113
  CDS (1)..(1188): transl_table=11

SEQ ID NO: 66072 - protein, 395 aa, Prochlorococcus marinus subsp. marinus str. CCMP1375; identical to SEQ ID NO: 43114

SEQ ID NO: 66073 - DNA, 1161 bp, Bordetella parapertussis 12822; identical to SEQ ID NO: 43115
  CDS (1)..(1161): transl_table=11

SEQ ID NO: 66074 - protein, 386 aa, Bordetella parapertussis 12822; identical to SEQ ID NO: 43116

SEQ ID NO: 66075 - DNA, 1233 bp, Bordetella parapertussis 12822; identical to SEQ ID NO: 43117
  CDS (1)..(1233): transl_table=11

SEQ ID NO: 66076 - protein, 410 aa, Bordetella parapertussis 12822; identical to SEQ ID NO: 43118

SEQ ID NO: 66077 - DNA, 1161 bp, Bordetella bronchiseptica RB50; identical to SEQ ID NO: 43119
  CDS (1)..(1161): transl_table=11

SEQ ID NO: 66078 - protein, 386 aa, Bordetella bronchiseptica RB50; identical to SEQ ID NO: 43120

SEQ ID NO: 66079 - DNA, 1101 bp, Bordetella bronchiseptica RB50; identical to SEQ ID NO: 43121
  CDS (1)..(1101): transl_table=11

SEQ ID NO: 66080 - protein, 366 aa, Bordetella bronchiseptica RB50; identical to SEQ ID NO: 43122

SEQ ID NO: 66081 - DNA, 1206 bp, Prochlorococcus marinus subsp. pastoris str. CCMP1986; identical to SEQ ID NO: 43123
  CDS (1)..(1206): transl_table=11

SEQ ID NO: 66082 - protein, 401 aa, Prochlorococcus marinus subsp. pastoris str. CCMP1986; identical to SEQ ID NO: 43124

SEQ ID NO: 66083 - DNA, 1149 bp, Prochlorococcus marinus subsp. pastoris str. CCMP1986; identical to SEQ ID NO: 43125
  CDS (1)..(1149): transl_table=11

SEQ ID NO: 66084 - protein, 382 aa, Prochlorococcus marinus subsp. pastoris str. CCMP1986; identical to SEQ ID NO: 43126

SEQ ID NO: 66085 - DNA, 1167 bp, Prochlorococcus marinus subsp. pastoris str. CCMP1986; identical to SEQ ID NO: 43127
  CDS (1)..(1167): transl_table=11

SEQ ID NO: 66086 - protein, 388 aa, Prochlorococcus marinus subsp. pastoris str. CCMP1986; identical to SEQ ID NO: 43128

SEQ ID NO: 66087 - DNA, 1167 bp, Prochlorococcus marinus str. MIT 9313; identical to SEQ ID NO: 43129
  CDS (1)..(1167): transl_table=11

SEQ ID NO: 66088 - protein, 388 aa, Prochlorococcus marinus str. MIT 9313; identical to SEQ ID NO: 43130

SEQ ID NO: 66089 - DNA, 1227 bp, Prochlorococcus marinus str. MIT 9313; identical to SEQ ID NO: 43131
  CDS (1)..(1227): transl_table=11

SEQ ID NO: 66090 - protein, 408 aa, Prochlorococcus marinus str. MIT 9313; identical to SEQ ID NO: 43132

SEQ ID NO: 66091 - DNA, 1236 bp, Synechococcus sp. WH 8102; identical to SEQ ID NO: 43133
  CDS (1)..(1236): transl_table=11

SEQ ID NO: 66092 - protein, 411 aa, Synechococcus sp. WH 8102; identical to SEQ ID NO: 43134

SEQ ID NO: 66093 - DNA, 1212 bp, Synechococcus sp. WH 8102; identical to SEQ ID NO: 43135
  CDS (1)..(1212): transl_table=11

SEQ ID NO: 66094 - protein, 403 aa, Synechococcus sp. WH 8102; identical to SEQ ID NO: 43136

SEQ ID NO: 66095 - DNA, 1125 bp, Chromobacterium violaceum ATCC 12472; identical to SEQ ID NO: 43137
  CDS (1)..(1125): transl_table=11

SEQ ID NO: 66096 - protein, 374 aa, Chromobacterium violaceum ATCC 12472; identical to SEQ ID NO: 43138

SEQ ID NO: 66097 - DNA, 1314 bp, Chromobacterium violaceum ATCC 12472; identical to SEQ ID NO: 43139
  CDS (1)..(1314): transl_table=11

SEQ ID NO: 66098 - protein, 437 aa, Chromobacterium violaceum ATCC 12472; identical to SEQ ID NO: 43140

SEQ ID NO: 66099 - DNA, 1152 bp, Chromobacterium violaceum ATCC 12472; identical to SEQ ID NO: 43141
  CDS (1)..(1152): transl_table=11

SEQ ID NO: 66100 - protein, 383 aa, Chromobacterium violaceum ATCC 12472; identical to SEQ ID NO: 43142

SEQ ID NO: 66101 - DNA, 1215 bp, Chromobacterium violaceum ATCC 12472; identical to SEQ ID NO: 43143
  CDS (1)..(1215): transl_table=11

SEQ ID NO: 66102 - protein, 404 aa, Chromobacterium violaceum ATCC 12472; identical to SEQ ID NO: 43144

SEQ ID NO: 66103 - DNA, 1098 bp, Chromobacterium violaceum ATCC 12472; identical to SEQ ID NO: 43145
  CDS (1)..(1098): transl_table=11

SEQ ID NO: 66104 - protein, 365 aa, Chromobacterium violaceum ATCC 12472; identical to SEQ ID NO: 43146

SEQ ID NO: 66105 - DNA, 1155 bp, Porphyromonas gingivalis W83; identical to SEQ ID NO: 43147
  CDS (1)..(1155): transl_table=11

SEQ ID NO: 66106 - protein, 384 aa, Porphyromonas gingivalis W83; identical to SEQ ID NO: 43148

SEQ ID NO: 66107 - DNA, 1104 bp, Wolinella succinogenes DSM 1740; identical to SEQ ID NO: 43149
  CDS (1)..(1104): transl_table=11

SEQ ID NO: 66108 - protein, 367 aa, Wolinella succinogenes DSM 1740; identical to SEQ ID NO: 43150

SEQ ID NO: 66109 - DNA, 1131 bp, Wolinella succinogenes DSM 1740; identical to SEQ ID NO: 43151
  CDS (1)..(1131): transl_table=11

SEQ ID NO: 66110 - protein, 376 aa, Wolinella succinogenes DSM 1740; identical to SEQ ID NO: 43152

SEQ ID NO: 66111 - DNA, 1089 bp, Wolinella succinogenes DSM 1740; identical to SEQ ID NO: 43153
  CDS (1)..(1089): transl_table=11

SEQ ID NO: 66112 - protein, 362 aa, Wolinella succinogenes DSM 1740; identical to SEQ ID NO: 43154

SEQ ID NO: 66113 - DNA, 1149 bp, Gloeobacter violaceus PCC 7421; identical to SEQ ID NO: 43155
  CDS (1)..(1149): transl_table=11

SEQ ID NO: 66114 - protein, 382 aa, Gloeobacter violaceus PCC 7421; identical to SEQ ID NO: 43156

SEQ ID NO: 66115 - DNA, 1146 bp, Photorhabdus luminescens subsp. laumondii TTO1; identical to SEQ ID NO: 43157
  CDS (1)..(1146): transl_table=11

SEQ ID NO: 66116 - protein, 381 aa, Photorhabdus luminescens subsp. laumondii TTO1; identical to SEQ ID NO: 43158

SEQ ID NO: 66117 - DNA, 1131 bp, Photorhabdus luminescens subsp. laumondii TTO1; identical to SEQ ID NO: 43159
  CDS (1)..(1131): transl_table=11

SEQ ID NO: 66118 - protein, 376 aa, Photorhabdus luminescens subsp. laumondii TTO1; identical to SEQ ID NO: 43160

SEQ ID NO: 66119 - DNA, 1071 bp, Photorhabdus luminescens subsp. laumondii TTO1; identical to SEQ ID NO: 43161
  CDS (1)..(1071): transl_table=11

SEQ ID NO: 66120 - protein, 356 aa, Photorhabdus luminescens subsp. laumondii TTO1; identical to SEQ ID NO: 43162

SEQ ID NO: 66121 - DNA, 1158 bp, Photorhabdus luminescens subsp. laumondii TTO1; identical to SEQ ID NO: 43163
  CDS (1)..(1158): transl_table=11

SEQ ID NO: 66122 - protein, 385 aa, Photorhabdus luminescens subsp. laumondii TTO1; identical to SEQ ID NO: 43164

SEQ ID NO: 66123 - DNA, 1128 bp, Photorhabdus luminescens subsp. laumondii TTO1; identical to SEQ ID NO: 43165
  CDS (1)..(1128): transl_table=11

SEQ ID NO: 66124 - protein, 375 aa, Photorhabdus luminescens subsp. laumondii TTO1; identical to SEQ ID NO: 43166

SEQ ID NO: 66125 - DNA, 1152 bp, Vibrio vulnificus YJ016; identical to SEQ ID NO: 43167
  CDS (1)..(1152): transl_table=11

SEQ ID NO: 66126 - protein, 383 aa, Vibrio vulnificus YJ016; identical to SEQ ID NO: 43168

SEQ ID NO: 66127 - DNA, 1176 bp, Vibrio vulnificus YJ016; identical to SEQ ID NO: 43169
  CDS (1)..(1176): transl_table=11

SEQ ID NO: 66128 - protein, 391 aa, Vibrio vulnificus YJ016; identical to SEQ ID NO: 43170

SEQ ID NO: 66129 - DNA, 1146 bp, Rhodopseudomonas palustris CGA009; identical to SEQ ID NO: 43171
  CDS (1)..(1146): transl_table=11

SEQ ID NO: 66130 - protein, 381 aa, Rhodopseudomonas palustris CGA009; identical to SEQ ID NO: 43172

SEQ ID NO: 66131 - DNA, 1152 bp, Rhodopseudomonas palustris CGA009; identical to SEQ ID NO: 43173
  CDS (1)..(1152): transl_table=11

SEQ ID NO: 66132 - protein, 383 aa, Rhodopseudomonas palustris CGA009; identical to SEQ ID NO: 43174

SEQ ID NO: 66133 - DNA, 1155 bp, Geobacter sulfurreducens PCA; identical to SEQ ID NO: 43175
  CDS (1)..(1155): transl_table=11

SEQ ID NO: 66134 - protein, 384 aa, Geobacter sulfurreducens PCA; identical to SEQ ID NO: 43176

SEQ ID NO: 66135 - DNA, 1092 bp, Geobacter sulfurreducens PCA; identical to SEQ ID NO: 43177
  CDS (1)..(1092): transl_table=11

SEQ ID NO: 66136 - protein, 363 aa, Geobacter sulfurreducens PCA; identical to SEQ ID NO: 43178

SEQ ID NO: 66137 - DNA, 1185 bp, Geobacter sulfurreducens PCA; identical to SEQ ID NO: 43179
  CDS (1)..(1185): transl_table=11

SEQ ID NO: 66138 - protein, 394 aa, Geobacter sulfurreducens PCA; identical to SEQ ID NO: 43180

SEQ ID NO: 66139 - DNA, 1149 bp, Bdellovibrio bacteriovorus HD100; identical to SEQ ID NO: 43181
  CDS (1)..(1149): transl_table=11

SEQ ID NO: 66140 - protein, 382 aa, Bdellovibrio bacteriovorus HD100; identical to SEQ ID NO: 43182

SEQ ID NO: 66141 - DNA, 1137 bp, Bdellovibrio bacteriovorus HD100; identical to SEQ ID NO: 43183
  CDS (1)..(1137): transl_table=11

SEQ ID NO: 66142 - protein, 378 aa, Bdellovibrio bacteriovorus HD100; identical to SEQ ID NO: 43184

SEQ ID NO: 66143 - DNA, 1176 bp, Treponema denticola ATCC 35405; identical to SEQ ID NO: 43185
  CDS (1)..(1176): transl_table=11

SEQ ID NO: 66144 - protein, 391 aa, Treponema denticola ATCC 35405; identical to SEQ ID NO: 43186

SEQ ID NO: 66145 - DNA, 1107 bp, Treponema denticola ATCC 35405; identical to SEQ ID NO: 43187
  CDS (1)..(1107): transl_table=11

SEQ ID NO: 66146 - protein, 368 aa, Treponema denticola ATCC 35405; identical to SEQ ID NO: 43188

SEQ ID NO: 66147 - DNA, 1116 bp, Bacillus cereus ATCC 10987; identical to SEQ ID NO: 43189
  CDS (1)..(1116): transl_table=11

SEQ ID NO: 66148 - protein, 371 aa, Bacillus cereus ATCC 10987; identical to SEQ ID NO: 43190

SEQ ID NO: 66149 - DNA, 1104 bp, Methanococcus maripaludis S2; identical to SEQ ID NO: 43191
  CDS (1)..(1104): transl_table=11

SEQ ID NO: 66150 - protein, 367 aa, Methanococcus maripaludis S2; identical to SEQ ID NO: 43192

SEQ ID NO: 66151 - DNA, 954 bp, Gibberella zeae PH-1; identical to SEQ ID NO: 43193
  CDS (1)..(954)

SEQ ID NO: 66152 - protein, 317 aa, Gibberella zeae PH-1; identical to SEQ ID NO: 43194

SEQ ID NO: 66153 - DNA, 1104 bp, Leptospira interrogans serovar Copenhageni str. Fiocruz L1-130; identical to SEQ ID NO: 43195
  CDS (1)..(1104): transl_table=11

SEQ ID NO: 66154 - protein, 367 aa, Leptospira interrogans serovar Copenhageni str. Fiocruz L1-130; identical to SEQ ID NO: 43196

SEQ ID NO: 66155 - DNA, 1101 bp, Leptospira interrogans serovar Copenhageni str. Fiocruz L1-130; identical to SEQ ID NO: 43197
  CDS (1)..(1101): transl_table=11

SEQ ID NO: 66156 - protein, 366 aa, Leptospira interrogans serovar Copenhageni str. Fiocruz L1-130; identical to SEQ ID NO: 43198

SEQ ID NO: 66157 - DNA, 1116 bp, Thermus thermophilus HB27; identical to SEQ ID NO: 43199
  CDS (1)..(1116): transl_table=11

SEQ ID NO: 66158 - protein, 371 aa, Thermus thermophilus HB27; identical to SEQ ID NO: 43200

SEQ ID NO: 66159 - DNA, 1134 bp, Desulfovibrio vulgaris subsp. vulgaris str. Hildenborough; identical to SEQ ID NO: 43201
  CDS (1)..(1134): transl_table=11

SEQ ID NO: 66160 - protein, 377 aa, Desulfovibrio vulgaris subsp. vulgaris str. Hildenborough; identical to SEQ ID NO: 43202

SEQ ID NO: 66161 - DNA, 1182 bp, Desulfovibrio vulgaris subsp. vulgaris str. Hildenborough; identical to SEQ ID NO: 43203
  CDS (1)..(1182): transl_table=11

SEQ ID NO: 66162 - protein, 393 aa, Desulfovibrio vulgaris subsp. vulgaris str. Hildenborough; identical to SEQ ID NO: 43204

SEQ ID NO: 66163 - DNA, 1179 bp, Desulfovibrio vulgaris subsp. vulgaris str. Hildenborough; identical to SEQ ID NO: 43205
  CDS (1)..(1179): transl_table=11

SEQ ID NO: 66164 - protein, 392 aa, Desulfovibrio vulgaris subsp. vulgaris str. Hildenborough; identical to SEQ ID NO: 43206

SEQ ID NO: 66165 - DNA, 1119 bp, Bartonella quintana str. Toulouse; identical to SEQ ID NO: 43207
  CDS (1)..(1119): transl_table=11

SEQ ID NO: 66166 - protein, 372 aa, Bartonella quintana str. Toulouse; identical to SEQ ID NO: 43208

SEQ ID NO: 66167 - DNA, 1119 bp, Bartonella henselae str. Houston-1; identical to SEQ ID NO: 43209
  CDS (1)..(1119): transl_table=11

SEQ ID NO: 66168 - protein, 372 aa, Bartonella henselae str. Houston-1; identical to SEQ ID NO: 43210

SEQ ID NO: 66169 - DNA, 1176 bp, Acinetobacter sp. ADP1; identical to SEQ ID NO: 43211
  CDS (1)..(1176): transl_table=11

SEQ ID NO: 66170 - protein, 391 aa, Acinetobacter sp. ADP1; identical to SEQ ID NO: 43212

SEQ ID NO: 66171 - DNA, 1314 bp, Erwinia carotovora subsp. atroseptica SCRI1043; identical to SEQ ID NO: 43213
  CDS (1)..(1314)

SEQ ID NO: 66172 - protein, 437 aa, Erwinia carotovora subsp. atroseptica SCRI1043; identical to SEQ ID NO: 43214

SEQ ID NO: 66173 - DNA, 1113 bp, Erwinia carotovora subsp. atroseptica SCRI1043; identical to SEQ ID NO: 43215
  CDS (1)..(1113)

SEQ ID NO: 66174 - protein, 370 aa, Erwinia carotovora subsp. atroseptica SCRI1043; identical to SEQ ID NO: 43216

SEQ ID NO: 66175 - DNA, 1149 bp, Erwinia carotovora subsp. atroseptica SCRI1043; identical to SEQ ID NO: 43217
  CDS (1)..(1149)

SEQ ID NO: 66176 - protein, 382 aa, Erwinia carotovora subsp. atroseptica SCRI1043; identical to SEQ ID NO: 43218

SEQ ID NO: 66177 - DNA, 1131 bp, Erwinia carotovora subsp. atroseptica SCRI1043; identical to SEQ ID NO: 43219
  CDS (1)..(1131)

SEQ ID NO: 66178 - protein, 376 aa, Erwinia carotovora subsp. atroseptica SCRI1043; identical to SEQ ID NO: 43220

SEQ ID NO: 66179 - DNA, 1113 bp, Propionibacterium acnes KPA171202; identical to SEQ ID NO: 43221
  CDS (1)..(1113): transl_table=11

SEQ ID NO: 66180 - protein, 370 aa, Propionibacterium acnes KPA171202; identical to SEQ ID NO: 43222

SEQ ID NO: 66181 - DNA, 1182 bp, Desulfotalea psychrophila LSv54; identical to SEQ ID NO: 43223
  CDS (1)..(1182): transl_table=11

SEQ ID NO: 66182 - protein, 393 aa, Desulfotalea psychrophila LSv54; identical to SEQ ID NO: 43224

SEQ ID NO: 66183 - DNA, 1107 bp, Desulfotalea psychrophila LSv54; identical to SEQ ID NO: 43225
  CDS (1)..(1107): transl_table=11

SEQ ID NO: 66184 - protein, 368 aa, Desulfotalea psychrophila LSv54; identical to SEQ ID NO: 43226

SEQ ID NO: 66185 - DNA, 1203 bp, Desulfotalea psychrophila LSv54; identical to SEQ ID NO: 43227
  CDS (1)..(1203): transl_table=11

SEQ ID NO: 66186 - protein, 400 aa, Desulfotalea psychrophila LSv54; identical to SEQ ID NO: 43228

SEQ ID NO: 66187 - DNA, 1188 bp, Desulfotalea psychrophila LSv54; identical to SEQ ID NO: 43229
  CDS (1)..(1188): transl_table=11

SEQ ID NO: 66188 - protein, 395 aa, Desulfotalea psychrophila LSv54; identical to SEQ ID NO: 43230

SEQ ID NO: 66189 - DNA, 1314 bp, Yersinia pseudotuberculosis IP 32953; identical to SEQ ID NO: 43231
  CDS (1)..(1314): transl_table=11

SEQ ID NO: 66190 - protein, 437 aa, Yersinia pseudotuberculosis IP 32953; identical to SEQ ID NO: 43232

SEQ ID NO: 66191 - DNA, 1239 bp, Mannheimia succiniciproducens MBEL55E; identical to SEQ ID NO: 43233
  CDS (1)..(1239): transl_table=11

SEQ ID NO: 66192 - protein, 412 aa, Mannheimia succiniciproducens MBEL55E; identical to SEQ ID NO: 43234

SEQ ID NO: 66193 - DNA, 1077 bp, Mannheimia succiniciproducens MBEL55E; identical to SEQ ID NO: 43235
  CDS (1)..(1077): transl_table=11

SEQ ID NO: 66194 - protein, 358 aa, Mannheimia succiniciproducens MBEL55E; identical to SEQ ID NO: 43236

SEQ ID NO: 66195 - DNA, 1095 bp, Bacillus licheniformis ATCC 14580; identical to SEQ ID NO: 43237
  CDS (1)..(1095): transl_table=11

SEQ ID NO: 66196 - protein, 364 aa, Bacillus licheniformis ATCC 14580; identical to SEQ ID NO: 43238

SEQ ID NO: 66197 - DNA, 1110 bp, Bacillus licheniformis ATCC 14580; identical to SEQ ID NO: 43239
  CDS (1)..(1110): transl_table=11

SEQ ID NO: 66198 - protein, 369 aa, Bacillus licheniformis ATCC 14580; identical to SEQ ID NO: 43240

SEQ ID NO: 66199 - DNA, 1146 bp, Bacillus licheniformis ATCC 14580; identical to SEQ ID NO: 43241
  CDS (1)..(1146): transl_table=11

SEQ ID NO: 66200 - protein, 381 aa, Bacillus licheniformis ATCC 14580; identical to SEQ ID NO: 43242

SEQ ID NO: 66201 - DNA, 1314 bp, Bacillus licheniformis ATCC 14580; identical to SEQ ID NO: 43243
  CDS (1)..(1314): transl_table=11

SEQ ID NO: 66202 - protein, 437 aa, Bacillus licheniformis ATCC 14580; identical to SEQ ID NO: 43244

SEQ ID NO: 66203 - DNA, 1503 bp, Legionella pneumophila subsp. pneumophila str. Philadelphia 1; identical to SEQ ID NO: 43245
  CDS (1)..(1503): transl_table=11

SEQ ID NO: 66204 - protein, 500 aa, Legionella pneumophila subsp. pneumophila str. Philadelphia 1; identical to SEQ ID NO: 43246

SEQ ID NO: 66205 - DNA, 1116 bp, Legionella pneumophila subsp. pneumophila str. Philadelphia 1; identical to SEQ ID NO: 43247
  CDS (1)..(1116): transl_table=11

SEQ ID NO: 66206 - protein, 371 aa, Legionella pneumophila subsp. pneumophila str. Philadelphia 1; identical to SEQ ID NO: 43248

SEQ ID NO: 66207 - DNA, 1083 bp, Bacteroides fragilis YCH46; identical to SEQ ID NO: 43249
  CDS (1)..(1083): transl_table=11

SEQ ID NO: 66208 - protein, 360 aa, Bacteroides fragilis YCH46; identical to SEQ ID NO: 43250

SEQ ID NO: 66209 - DNA, 1134 bp, Bacteroides fragilis YCH46; identical to SEQ ID NO: 43251
  CDS (1)..(1134): transl_table=11

SEQ ID NO: 66210 - protein, 377 aa, Bacteroides fragilis YCH46; identical to SEQ ID NO: 43252

SEQ ID NO: 66211 - DNA, 1101 bp, Bacteroides fragilis YCH46; identical to SEQ ID NO: 43253
  CDS (1)..(1101): transl_table=11

SEQ ID NO: 66212 - protein, 366 aa, Bacteroides fragilis YCH46; identical to SEQ ID NO: 43254

SEQ ID NO: 66213 - DNA, 1131 bp, Bacteroides fragilis YCH46; identical to SEQ ID NO: 43255
  CDS (1)..(1131): transl_table=11

SEQ ID NO: 66214 - protein, 376 aa, Bacteroides fragilis YCH46; identical to SEQ ID NO: 43256

SEQ ID NO: 66215 - DNA, 1143 bp, Bacteroides fragilis YCH46; identical to SEQ ID NO: 43257
  CDS (1)..(1143): transl_table=11

SEQ ID NO: 66216 - protein, 380 aa, Bacteroides fragilis YCH46; identical to SEQ ID NO: 43258

SEQ ID NO: 66217 - DNA, 1224 bp, Bacteroides fragilis YCH46; identical to SEQ ID NO: 43259
  CDS (1)..(1224): transl_table=11

SEQ ID NO: 66218 - protein, 407 aa, Bacteroides fragilis YCH46; identical to SEQ ID NO: 43260

SEQ ID NO: 66219 - DNA, 1110 bp, Bacteroides fragilis YCH46; identical to SEQ ID NO: 43261
  CDS (1)..(1110): transl_table=11

SEQ ID NO: 66220 - protein, 369 aa, Bacteroides fragilis YCH46; identical to SEQ ID NO: 43262

SEQ ID NO: 66221 - DNA, 1098 bp, Bacteroides fragilis YCH46; identical to SEQ ID NO: 43263
  CDS (1)..(1098): transl_table=11

SEQ ID NO: 66222 - protein, 365 aa, Bacteroides fragilis YCH46; identical to SEQ ID NO: 43264

SEQ ID NO: 66223 - DNA, 1224 bp, Bacteroides fragilis YCH46; identical to SEQ ID NO: 43265
  CDS (1)..(1224): transl_table=11

SEQ ID NO: 66224 - protein, 407 aa, Bacteroides fragilis YCH46; identical to SEQ ID NO: 43266

SEQ ID NO: 66225 - DNA, 1149 bp, Burkholderia mallei ATCC 23344; identical to SEQ ID NO: 43267
  CDS (1)..(1149): transl_table=11

SEQ ID NO: 66226 - protein, 382 aa, Burkholderia mallei ATCC 23344; identical to SEQ ID NO: 43268

SEQ ID NO: 66227 - DNA, 1152 bp, Burkholderia pseudomallei K96243; identical to SEQ ID NO: 43269
  CDS (1)..(1152): transl_table=11

SEQ ID NO: 66228 - protein, 383 aa, Burkholderia pseudomallei K96243; identical to SEQ ID NO: 43270

SEQ ID NO: 66229 - DNA, 1155 bp, Methylococcus capsulatus str. Bath; identical to SEQ ID NO: 43271
  CDS (1)..(1155): transl_table=11

SEQ ID NO: 66230 - protein, 384 aa, Methylococcus capsulatus str. Bath; identical to SEQ ID NO: 43272

SEQ ID NO: 66231 - DNA, 1095 bp, Methylococcus capsulatus str. Bath; identical to SEQ ID NO: 43273
  CDS (1)..(1095): transl_table=11

SEQ ID NO: 66232 - protein, 364 aa, Methylococcus capsulatus str. Bath; identical to SEQ ID NO: 43274

SEQ ID NO: 66233 - DNA, 1182 bp, Methylococcus capsulatus str. Bath; identical to SEQ ID NO: 43275
  CDS (1)..(1182): transl_table=11

SEQ ID NO: 66234 - protein, 393 aa, Methylococcus capsulatus str. Bath; identical to SEQ ID NO: 43276

SEQ ID NO: 66235 - DNA, 1140 bp, Nocardia farcinica IFM 10152; identical to SEQ ID NO: 43277
  CDS (1)..(1140): transl_table=11

SEQ ID NO: 66236 - protein, 379 aa, Nocardia farcinica IFM 10152; identical to SEQ ID NO: 43278

SEQ ID NO: 66237 - DNA, 1503 bp, Legionella pneumophila str. Lens; identical to SEQ ID NO: 43279
  CDS (1)..(1503): transl_table=11

SEQ ID NO: 66238 - protein, 500 aa, Legionella pneumophila str. Lens; identical to SEQ ID NO: 43280

SEQ ID NO: 66239 - DNA, 1116 bp, Legionella pneumophila str. Lens; identical to SEQ ID NO: 43281
  CDS (1)..(1116): transl_table=11

SEQ ID NO: 66240 - protein, 371 aa, Legionella pneumophila str. Lens; identical to SEQ ID NO: 43282

SEQ ID NO: 66241 - DNA, 1179 bp, Photobacterium profundum SS9; identical to SEQ ID NO: 43283
  CDS (1)..(1179): transl_table=11

SEQ ID NO: 66242 - protein, 392 aa, Photobacterium profundum SS9; identical to SEQ ID NO: 43284

SEQ ID NO: 66243 - DNA, 1173 bp, Geobacillus kaustophilus HTA426; identical to SEQ ID NO: 43285
  CDS (1)..(1173): transl_table=11

SEQ ID NO: 66244 - protein, 390 aa, Geobacillus kaustophilus HTA426; identical to SEQ ID NO: 43286

SEQ ID NO: 66245 - DNA, 1119 bp, Geobacillus kaustophilus HTA426; identical to SEQ ID NO: 43287
  CDS (1)..(1119): transl_table=11

SEQ ID NO: 66246 - protein, 372 aa, Geobacillus kaustophilus HTA426; identical to SEQ ID NO: 43288

SEQ ID NO: 66247 - DNA, 1158 bp, Salmonella enterica subsp. enterica serovar Paratypi A str. ATCC; identical to SEQ ID NO: 43289
  CDS (1)..(1158): transl_table=11

SEQ ID NO: 66248 - protein, 385 aa, Salmonella enterica subsp. enterica serovar Paratypi A str. ATCC; identical to SEQ ID NO: 43290

SEQ ID NO: 66249 - DNA, 1143 bp, Idiomarina loihiensis L2TR; identical to SEQ ID NO: 43291
  CDS (1)..(1143): transl_table=11

SEQ ID NO: 66250 - protein, 380 aa, Idiomarina loihiensis L2TR; identical to SEQ ID NO: 43292

SEQ ID NO: 66251 - DNA, 1179 bp, Azoarcus sp. EbN1; identical to SEQ ID NO: 43293
  CDS (1)..(1179): transl_table=11

SEQ ID NO: 66252 - protein, 392 aa, Azoarcus sp. EbN1; identical to SEQ ID NO: 43294

SEQ ID NO: 66253 - DNA, 1083 bp, Francisella tularensis subsp. tularensis Schu 4; identical to SEQ ID NO: 43295
  CDS (1)..(1083): transl_table=11

SEQ ID NO: 66254 - protein, 360 aa, Francisella tularensis subsp. tularensis Schu 4; identical to SEQ ID NO: 43296

SEQ ID NO: 66255 - DNA, 1128 bp, Synechococcus elongatus PCC 6301; identical to SEQ ID NO: 43297
  CDS (1)..(1128): transl_table=11

SEQ ID NO: 66256 - protein, 375 aa, Synechococcus elongatus PCC 6301; identical to SEQ ID NO: 43298

SEQ ID NO: 66257 - DNA, 1074 bp, Campylobacter jejuni RM1221; identical to SEQ ID NO: 43299
  CDS (1)..(1074): transl_table=11

SEQ ID NO: 66258 - protein, 357 aa, Campylobacter jejuni RM1221; identical to SEQ ID NO: 43300

SEQ ID NO: 66259 - DNA, 1146 bp, Campylobacter jejuni RM1221; identical to SEQ ID NO: 43301
  CDS (1)..(1146): transl_table=11

SEQ ID NO: 66260 - protein, 381 aa, Campylobacter jejuni RM1221; identical to SEQ ID NO: 43302

SEQ ID NO: 66261 - DNA, 1137 bp, Chloroflexus aurantiacus; identical to SEQ ID NO: 43303
  CDS (1)..(1137)

SEQ ID NO: 66262 - protein, 378 aa, Chloroflexus aurantiacus; identical to SEQ ID NO: 43304

SEQ ID NO: 66263 - DNA, 1101 bp, Magnetospirillum magnetotacticum MS-1; identical to SEQ ID NO: 43305
  CDS (1)..(1101)

SEQ ID NO: 66264 - protein, 366 aa, Magnetospirillum magnetotacticum MS-1; identical to SEQ ID NO: 43306

SEQ ID NO: 66265 - DNA, 1176 bp, Azotobacter vinelandii; identical to SEQ ID NO: 43307
  CDS (1)..(1176)

SEQ ID NO: 66266 - protein, 391 aa, Azotobacter vinelandii; identical to SEQ ID NO: 43308

SEQ ID NO: 66267 - DNA, 1194 bp, Nostoc punctiforme PCC 73102; identical to SEQ ID NO: 43309
  CDS (1)..(1194)

SEQ ID NO: 66268 - protein, 397 aa, Nostoc punctiforme PCC 73102; identical to SEQ ID NO: 43310

SEQ ID NO: 66269 - DNA, 1149 bp, Nostoc punctiforme PCC 73102; identical to SEQ ID NO: 43311
  CDS (1)..(1149)

SEQ ID NO: 66270 - protein, 382 aa, Nostoc punctiforme PCC 73102; identical to SEQ ID NO: 43312

SEQ ID NO: 66271 - DNA, 1269 bp, Nostoc punctiforme PCC 73102; identical to SEQ ID NO: 43313
  CDS (1)..(1269)

SEQ ID NO: 66272 - protein, 422 aa, Nostoc punctiforme PCC 73102; identical to SEQ ID NO: 43314

SEQ ID NO: 66273 - DNA, 1167 bp, Nostoc punctiforme PCC 73102; identical to SEQ ID NO: 43315
  CDS (1)..(1167)

SEQ ID NO: 66274 - protein, 388 aa, Nostoc punctiforme PCC 73102; identical to SEQ ID NO: 43316

SEQ ID NO: 66275 - DNA, 1161 bp, Nostoc punctiforme PCC 73102; identical to SEQ ID NO: 43317
  CDS (1)..(1161)

SEQ ID NO: 66276 - protein, 386 aa, Nostoc punctiforme PCC 73102; identical to SEQ ID NO: 43318

SEQ ID NO: 66277 - DNA, 1152 bp, Nostoc punctiforme PCC 73102; identical to SEQ ID NO: 43319
  CDS (1)..(1152)

SEQ ID NO: 66278 - protein, 383 aa, Nostoc punctiforme PCC 73102; identical to SEQ ID NO: 43320

SEQ ID NO: 66279 - DNA, 1149 bp, Pseudomonas syringae pv. syringae B728a; identical to SEQ ID NO: 43321
  CDS (1)..(1149)

SEQ ID NO: 66280 - protein, 382 aa, Pseudomonas syringae pv. syringae B728a; identical to SEQ ID NO: 43322

SEQ ID NO: 66281 - DNA, 1176 bp, Pseudomonas syringae pv. syringae B728a; identical to SEQ ID NO: 43323
  CDS (1)..(1176)

SEQ ID NO: 66282 - protein, 391 aa, Pseudomonas syringae pv. syringae B728a; identical to SEQ ID NO: 43324

SEQ ID NO: 66283 - DNA, 1161 bp, Desulfovibrio desulfuricans G20; identical to SEQ ID NO: 43325
  CDS (1)..(1161)

SEQ ID NO: 66284 - protein, 386 aa, Desulfovibrio desulfuricans G20; identical to SEQ ID NO: 43326

SEQ ID NO: 66285 - DNA, 1158 bp, Psychrobacter sp. 273-4; identical to SEQ ID NO: 43327
  CDS (1)..(1158)

SEQ ID NO: 66286 - protein, 385 aa, Psychrobacter sp. 273-4; identical to SEQ ID NO: 43328

SEQ ID NO: 66287 - DNA, 1077 bp, Methanococcoides burtonii DSM 6242; identical to SEQ ID NO: 43329
  CDS (1)..(1077)

SEQ ID NO: 66288 - protein, 358 aa, Methanococcoides burtonii DSM 6242; identical to SEQ ID NO: 43330

SEQ ID NO: 66289 - DNA, 1113 bp, Methanococcoides burtonii DSM 6242; identical to SEQ ID NO: 43331
  CDS (1)..(1113)

SEQ ID NO: 66290 - protein, 370 aa, Methanococcoides burtonii DSM 6242; identical to SEQ ID NO: 43332

SEQ ID NO: 66291 - DNA, 1224 bp, Anabaena variabilis ATCC 29413; identical to SEQ ID NO: 43333
  CDS (1)..(1224)

SEQ ID NO: 66292 - protein, 407 aa, Anabaena variabilis ATCC 29413; identical to SEQ ID NO: 43334

SEQ ID NO: 66293 - DNA, 1149 bp, Anabaena variabilis ATCC 29413; identical to SEQ ID NO: 43335
  CDS (1)..(1149)

SEQ ID NO: 66294 - protein, 382 aa, Anabaena variabilis ATCC 29413; identical to SEQ ID NO: 43336

SEQ ID NO: 66295 - DNA, 1179 bp, Anabaena variabilis ATCC 29413; identical to SEQ ID NO: 43337
  CDS (1)..(1179)

SEQ ID NO: 66296 - protein, 392 aa, Anabaena variabilis ATCC 29413; identical to SEQ ID NO: 43338

SEQ ID NO: 66297 - DNA, 1176 bp, Synechococcus elongatus PCC 7942; identical to SEQ ID NO: 43339
  CDS (1)..(1176)

SEQ ID NO: 66298 - protein, 391 aa, Synechococcus elongatus PCC 7942; identical to SEQ ID NO: 43340

SEQ ID NO: 66299 - DNA, 1119 bp, Crocosphaera watsonii WH 8501; identical to SEQ ID NO: 43341
  CDS (1)..(1119)

SEQ ID NO: 66300 - protein, 372 aa, Crocosphaera watsonii WH 8501; identical to SEQ ID NO: 43342

SEQ ID NO: 66301 - DNA, 1053 bp, Crocosphaera watsonii WH 8501; identical to SEQ ID NO: 43343
  CDS (1)..(1053)

SEQ ID NO: 66302 - protein, 350 aa, Crocosphaera watsonii WH 8501; identical to SEQ ID NO: 43344

SEQ ID NO: 66303 - DNA, 1155 bp, Exiguobacterium sp. 255-15; identical to SEQ ID NO: 43345
  CDS (1)..(1155)

SEQ ID NO: 66304 - protein, 384 aa, Exiguobacterium sp. 255-15; identical to SEQ ID NO: 43346

SEQ ID NO: 66305 - DNA, 1116 bp, Mesorhizobium sp. BNC1; identical to SEQ ID NO: 43347
  CDS (1)..(1116)

SEQ ID NO: 66306 - protein, 371 aa, Mesorhizobium sp. BNC1; identical to SEQ ID NO: 43348

SEQ ID NO: 66307 - DNA, 1137 bp, Mesorhizobium sp. BNC1; identical to SEQ ID NO: 43349
  CDS (1)..(1137)

SEQ ID NO: 66308 - protein, 378 aa, Mesorhizobium sp. BNC1; identical to SEQ ID NO: 43350

SEQ ID NO: 66309 - DNA, 1188 bp, Mesorhizobium sp. BNC1; identical to SEQ ID NO: 43351
  CDS (1)..(1188)

SEQ ID NO: 66310 - protein, 395 aa, Mesorhizobium sp. BNC1; identical to SEQ ID NO: 43352

SEQ ID NO: 66311 - DNA, 1137 bp, Crocosphaera watsonii WH 8501; identical to SEQ ID NO: 43353
  CDS (1)..(1137)

SEQ ID NO: 66312 - protein, 378 aa, Crocosphaera watsonii WH 8501; identical to SEQ ID NO: 43354

SEQ ID NO: 66313 - DNA, 1176 bp, Ralstonia eutropha JMP134; identical to SEQ ID NO: 43355
  CDS (1)..(1176)

SEQ ID NO: 66314 - protein, 391 aa, Ralstonia eutropha JMP134; identical to SEQ ID NO: 43356

SEQ ID NO: 66315 - DNA, 1053 bp, Methanococcoides burtonii DSM 6242; identical to SEQ ID NO: 43357
  CDS (1)..(1053)

SEQ ID NO: 66316 - protein, 350 aa, Methanococcoides burtonii DSM 6242; identical to SEQ ID NO: 43358

SEQ ID NO: 66317 - DNA, 1137 bp, Methanococcoides burtonii DSM 6242; identical to SEQ ID NO: 43359
  CDS (1)..(1137)

SEQ ID NO: 66318 - protein, 378 aa, Methanococcoides burtonii DSM 6242; identical to SEQ ID NO: 43360

SEQ ID NO: 66319 - DNA, 1149 bp, Pseudomonas aeruginosa UCBPP-PA14; identical to SEQ ID NO: 43361
  CDS (1)..(1149)

SEQ ID NO: 66320 - protein, 382 aa, Pseudomonas aeruginosa UCBPP-PA14; identical to SEQ ID NO: 43362

SEQ ID NO: 66321 - DNA, 1161 bp, Magnetospirillum magnetotacticum MS-1; identical to SEQ ID NO: 43363
  CDS (1)..(1161)

SEQ ID NO: 66322 - protein, 386 aa, Magnetospirillum magnetotacticum MS-1; identical to SEQ ID NO: 43364

SEQ ID NO: 66323 - DNA, 1323 bp, Magnetospirillum magnetotacticum MS-1; identical to SEQ ID NO: 43365
  CDS (1)..(1323)

SEQ ID NO: 66324 - protein, 440 aa, Magnetospirillum magnetotacticum MS-1; identical to SEQ ID NO: 43366

SEQ ID NO: 66325 - DNA, 1158 bp, Burkholderia cepacia R18194; identical to SEQ ID NO: 43367
  CDS (1)..(1158)

SEQ ID NO: 66326 - protein, 385 aa, Burkholderia cepacia R18194; identical to SEQ ID NO: 43368

SEQ ID NO: 66327 - DNA, 1152 bp, Burkholderia cepacia R18194; identical to SEQ ID NO: 43369
  CDS (1)..(1152)

SEQ ID NO: 66328 - protein, 383 aa, Burkholderia cepacia R18194; identical to SEQ ID NO: 43370

SEQ ID NO: 66329 - DNA, 1152 bp, Burkholderia cepacia R1808; identical to SEQ ID NO: 43371
  CDS (1)..(1152)

SEQ ID NO: 66330 - protein, 383 aa, Burkholderia cepacia R1808; identical to SEQ ID NO: 43372

SEQ ID NO: 66331 - DNA, 1107 bp, Rubrivivax gelatinosus PM1; identical to SEQ ID NO: 43373
  CDS (1)..(1107)

SEQ ID NO: 66332 - protein, 368 aa, Rubrivivax gelatinosus PM1; identical to SEQ ID NO: 43374

SEQ ID NO: 66333 - DNA, 1167 bp, Rubrivivax gelatinosus PM1; identical to SEQ ID NO: 43375
  CDS (1)..(1167)

SEQ ID NO: 66334 - protein, 388 aa, Rubrivivax gelatinosus PM1; identical to SEQ ID NO: 43376

SEQ ID NO: 66335 - DNA, 1158 bp, Pseudomonas fluorescens PfO-1; identical to SEQ ID NO: 43377
  CDS (1)..(1158)

SEQ ID NO: 66336 - protein, 385 aa, Pseudomonas fluorescens PfO-1; identical to SEQ ID NO: 43378

SEQ ID NO: 66337 - DNA, 1122 bp, Pseudomonas fluorescens PfO-1; identical to SEQ ID NO: 43379
  CDS (1)..(1122)

SEQ ID NO: 66338 - protein, 373 aa, Pseudomonas fluorescens PfO-1; identical to SEQ ID NO: 43380

SEQ ID NO: 66339 - DNA, 963 bp, Pseudomonas fluorescens PfO-1; identical to SEQ ID NO: 43381
  CDS (1)..(963)

SEQ ID NO: 66340 - protein, 320 aa, Pseudomonas fluorescens PfO-1; identical to SEQ ID NO: 43382

SEQ ID NO: 66341 - DNA, 1149 bp, Pseudomonas fluorescens PfO-1; identical to SEQ ID NO: 43383
  CDS (1)..(1149)

SEQ ID NO: 66342 - protein, 382 aa, Pseudomonas fluorescens PfO-1; identical to SEQ ID NO: 43384

SEQ ID NO: 66343 - DNA, 1131 bp, Rhodospirillum rubrum; identical to SEQ ID NO: 43385
  CDS (1)..(1131)

SEQ ID NO: 66344 - protein, 376 aa, Rhodospirillum rubrum; identical to SEQ ID NO: 43386

SEQ ID NO: 66345 - DNA, 1191 bp, Rhodospirillum rubrum; identical to SEQ ID NO: 43387
  CDS (1)..(1191)

SEQ ID NO: 66346 - protein, 396 aa, Rhodospirillum rubrum; identical to SEQ ID NO: 43388

SEQ ID NO: 66347 - DNA, 1176 bp, Ralstonia metallidurans CH34; identical to SEQ ID NO: 43389
  CDS (1)..(1176)

SEQ ID NO: 66348 - protein, 391 aa, Ralstonia metallidurans CH34; identical to SEQ ID NO: 43390

SEQ ID NO: 66349 - DNA, 1146 bp, Ralstonia metallidurans CH34; identical to SEQ ID NO: 43391
  CDS (1)..(1146)

SEQ ID NO: 66350 - protein, 381 aa, Ralstonia metallidurans CH34; identical to SEQ ID NO: 43392

SEQ ID NO: 66351 - DNA, 1146 bp, Burkholderia fungorum LB400; identical to SEQ ID NO: 43393
  CDS (1)..(1146)

SEQ ID NO: 66352 - protein, 381 aa, Burkholderia fungorum LB400; identical to SEQ ID NO: 43394

SEQ ID NO: 66353 - DNA, 1146 bp, Burkholderia fungorum LB400; identical to SEQ ID NO: 43395
  CDS (1)..(1146)

SEQ ID NO: 66354 - protein, 381 aa, Burkholderia fungorum LB400; identical to SEQ ID NO: 43396

SEQ ID NO: 66355 - DNA, 1119 bp, Burkholderia fungorum LB400; identical to SEQ ID NO: 43397
  CDS (1)..(1119)

SEQ ID NO: 66356 - protein, 372 aa, Burkholderia fungorum LB400; identical to SEQ ID NO: 43398

SEQ ID NO: 66357 - DNA, 1110 bp, Enterococcus faecium; identical to SEQ ID NO: 43399
  CDS (1)..(1110)

SEQ ID NO: 66358 - protein, 369 aa, Enterococcus faecium; identical to SEQ ID NO: 43400

SEQ ID NO: 66359 - DNA, 1098 bp, Magnetococcus sp. MC-1; identical to SEQ ID NO: 43401
  CDS (1)..(1098)

SEQ ID NO: 66360 - protein, 365 aa, Magnetococcus sp. MC-1; identical to SEQ ID NO: 43402

SEQ ID NO: 66361 - DNA, 1110 bp, Magnetococcus sp. MC-1; identical to SEQ ID NO: 43403
  CDS (1)..(1110)

SEQ ID NO: 66362 - protein, 369 aa, Magnetococcus sp. MC-1; identical to SEQ ID NO: 43404

SEQ ID NO: 66363 - DNA, 1146 bp, Magnetococcus sp. MC-1; identical to SEQ ID NO: 43405
  CDS (1)..(1146)

SEQ ID NO: 66364 - protein, 381 aa, Magnetococcus sp. MC-1; identical to SEQ ID NO: 43406

SEQ ID NO: 66365 - DNA, 1125 bp, Magnetococcus sp. MC-1; identical to SEQ ID NO: 43407
  CDS (1)..(1125)

SEQ ID NO: 66366 - protein, 374 aa, Magnetococcus sp. MC-1; identical to SEQ ID NO: 43408

SEQ ID NO: 66367 - DNA, 1206 bp, Magnetococcus sp. MC-1; identical to SEQ ID NO: 43409
  CDS (1)..(1206)

SEQ ID NO: 66368 - protein, 401 aa, Magnetococcus sp. MC-1; identical to SEQ ID NO: 43410

SEQ ID NO: 66369 - DNA, 1083 bp, Methanosarcina barkeri str. fusaro; identical to SEQ ID NO: 43411
  CDS (1)..(1083)

SEQ ID NO: 66370 - protein, 360 aa, Methanosarcina barkeri str. fusaro; identical to SEQ ID NO: 43412

SEQ ID NO: 66371 - DNA, 1089 bp, Geobacter metallireducens GS-15; identical to SEQ ID NO: 43413
  CDS (1)..(1089)

SEQ ID NO: 66372 - protein, 362 aa, Geobacter metallireducens GS-15; identical to SEQ ID NO: 43414

SEQ ID NO: 66373 - DNA, 1197 bp, Geobacter metallireducens GS-15; identical to SEQ ID NO: 43415
  CDS (1)..(1197)

SEQ ID NO: 66374 - protein, 398 aa, Geobacter metallireducens GS-15; identical to SEQ ID NO: 43416

SEQ ID NO: 66375 - DNA, 1164 bp, Geobacter metallireducens GS-15; identical to SEQ ID NO: 43417
  CDS (1)..(1164)

SEQ ID NO: 66376 - protein, 387 aa, Geobacter metallireducens GS-15; identical to SEQ ID NO: 43418

SEQ ID NO: 66377 - DNA, 1179 bp, Geobacter metallireducens GS-15; identical to SEQ ID NO: 43419
  CDS (1)..(1179)

SEQ ID NO: 66378 - protein, 392 aa, Geobacter metallireducens GS-15; identical to SEQ ID NO: 43420

SEQ ID NO: 66379 - DNA, 1089 bp, Ferroplasma acidarmanus; identical to SEQ ID NO: 43421
  CDS (1)..(1089)

SEQ ID NO: 66380 - protein, 362 aa, Ferroplasma acidarmanus; identical to SEQ ID NO: 43422

SEQ ID NO: 66381 - DNA, 1134 bp, Cytophaga hutchinsonii; identical to SEQ ID NO: 43423
  CDS (1)..(1134)

SEQ ID NO: 66382 - protein, 377 aa, Cytophaga hutchinsonii; identical to SEQ ID NO: 43424

SEQ ID NO: 66383 - DNA, 1131 bp, Cytophaga hutchinsonii; identical to SEQ ID NO: 43425
  CDS (1)..(1131)

SEQ ID NO: 66384 - protein, 376 aa, Cytophaga hutchinsonii; identical to SEQ ID NO: 43426

SEQ ID NO: 66385 - DNA, 1164 bp, Cytophaga hutchinsonii; identical to SEQ ID NO: 43427
  CDS (1)..(1164)

SEQ ID NO: 66386 - protein, 387 aa, Cytophaga hutchinsonii; identical to SEQ ID NO: 43428

SEQ ID NO: 66387 - DNA, 1107 bp, Cytophaga hutchinsonii; identical to SEQ ID NO: 43429
  CDS (1)..(1107)

SEQ ID NO: 66388 - protein, 368 aa, Cytophaga hutchinsonii; identical to SEQ ID NO: 43430

SEQ ID NO: 66389 - DNA, 1080 bp, Clostridium thermocellum ATCC 27405; identical to SEQ ID NO: 43431
  CDS (1)..(1080)

SEQ ID NO: 66390 - protein, 359 aa, Clostridium thermocellum ATCC 27405; identical to SEQ ID NO: 43432

SEQ ID NO: 66391 - DNA, 1170 bp, Clostridium thermocellum ATCC 27405; identical to SEQ ID NO: 43433
  CDS (1)..(1170)

SEQ ID NO: 66392 - protein, 389 aa, Clostridium thermocellum ATCC 27405; identical to SEQ ID NO: 43434

SEQ ID NO: 66393 - DNA, 1137 bp, Microbulbifer degradans 2-40; identical to SEQ ID NO: 43435
  CDS (1)..(1137)

SEQ ID NO: 66394 - protein, 378 aa, Microbulbifer degradans 2-40; identical to SEQ ID NO: 43436

SEQ ID NO: 66395 - DNA, 1182 bp, Trichodesmium erythraeum IMS101; identical to SEQ ID NO: 43437
  CDS (1)..(1182)

SEQ ID NO: 66396 - protein, 393 aa, Trichodesmium erythraeum IMS101; identical to SEQ ID NO: 43438

SEQ ID NO: 66397 - DNA, 1353 bp, Trichodesmium erythraeum IMS101; identical to SEQ ID NO: 43439
  CDS (1)..(1353)

SEQ ID NO: 66398 - protein, 450 aa, Trichodesmium erythraeum IMS101; identical to SEQ ID NO: 43440

SEQ ID NO: 66399 - DNA, 1134 bp, Trichodesmium erythraeum IMS101; identical to SEQ ID NO: 43441
  CDS (1)..(1134)

SEQ ID NO: 66400 - protein, 377 aa, Trichodesmium erythraeum IMS101; identical to SEQ ID NO: 43442

SEQ ID NO: 66401 - DNA, 1155 bp, Desulfovibrio desulfuricans G20; identical to SEQ ID NO: 43443
  CDS (1)..(1155)

SEQ ID NO: 66402 - protein, 384 aa, Desulfovibrio desulfuricans G20; identical to SEQ ID NO: 43444

SEQ ID NO: 66403 - DNA, 1146 bp, Actinobacillus pleuropneumoniae serovar 1 str. 4074; identical to SEQ ID NO: 43445
  CDS (1)..(1146)

SEQ ID NO: 66404 - protein, 381 aa, Actinobacillus pleuropneumoniae serovar 1 str. 4074; identical to SEQ ID NO: 43446

SEQ ID NO: 66405 - DNA, 1155 bp, Chloroflexus aurantiacus; identical to SEQ ID NO: 43447
  CDS (1)..(1155)

SEQ ID NO: 66406 - protein, 384 aa, Chloroflexus aurantiacus; identical to SEQ ID NO: 43448

SEQ ID NO: 66407 - DNA, 1158 bp, Chloroflexus aurantiacus; identical to SEQ ID NO: 43449
  CDS (1)..(1158)

SEQ ID NO: 66408 - protein, 385 aa, Chloroflexus aurantiacus; identical to SEQ ID NO: 43450

SEQ ID NO: 66409 - DNA, 1116 bp, Chloroflexus aurantiacus; identical to SEQ ID NO: 43451
  CDS (1)..(1116)

SEQ ID NO: 66410 - protein, 371 aa, Chloroflexus aurantiacus; identical to SEQ ID NO: 43452

SEQ ID NO: 66411 - DNA, 1083 bp, Campylobacter lari RM2100; identical to SEQ ID NO: 43453
  CDS (1)..(1083): transl_table=11

SEQ ID NO: 66412 - protein, 360 aa, Campylobacter lari RM2100; identical to SEQ ID NO: 43454

SEQ ID NO: 66413 - DNA, 1131 bp, Campylobacter lari RM2100; identical to SEQ ID NO: 43455
  CDS (1)..(1131): transl_table=11

SEQ ID NO: 66414 - protein, 376 aa, Campylobacter lari RM2100; identical to SEQ ID NO: 43456

SEQ ID NO: 66415 - DNA, 1161 bp, Campylobacter lari RM2100; identical to SEQ ID NO: 43457
  CDS (1)..(1161): transl_table=11

SEQ ID NO: 66416 - protein, 386 aa, Campylobacter lari RM2100; identical to SEQ ID NO: 43458

SEQ ID NO: 66417 - DNA, 1314 bp, Vibrio anguillarum; identical to SEQ ID NO: 43459
  CDS (1)..(1314): transl_table=11

SEQ ID NO: 66418 - protein, 437 aa, Vibrio anguillarum; identical to SEQ ID NO: 43460

SEQ ID NO: 66419 - DNA, 1110 bp, Vibrio anguillarum; identical to SEQ ID NO: 43461
  CDS (1)..(1110): transl_table=11

SEQ ID NO: 66420 - protein, 369 aa, Vibrio anguillarum; identical to SEQ ID NO: 43462

SEQ ID NO: 66421 - DNA, 1116 bp, Vibrio anguillarum; identical to SEQ ID NO: 43463
  CDS (1)..(1116): transl_table=11

SEQ ID NO: 66422 - protein, 371 aa, Vibrio anguillarum; identical to SEQ ID NO: 43464

SEQ ID NO: 66423 - DNA, 1158 bp, Salmonella typhimurium; identical to SEQ ID NO: 43465
  CDS (1)..(1158): transl_table=11

SEQ ID NO: 66424 - protein, 385 aa, Salmonella typhimurium; identical to SEQ ID NO: 43466

SEQ ID NO: 66425 - DNA, 1167 bp, Amycolatopsis mediterranei; identical to SEQ ID NO: 43467
  CDS (1)..(1167): transl_table=11

SEQ ID NO: 66426 - protein, 388 aa, Amycolatopsis mediterranei; identical to SEQ ID NO: 43468

SEQ ID NO: 66427 - DNA, 1104 bp, Brucella melitensis; identical to SEQ ID NO: 43469
  CDS (1)..(1104): transl_table=11

SEQ ID NO: 66428 - protein, 367 aa, Brucella melitensis; identical to SEQ ID NO: 43470

SEQ ID NO: 66429 - DNA, 1107 bp, Streptomyces antibioticus; identical to SEQ ID NO: 43471
  CDS (1)..(1107): transl_table=11

SEQ ID NO: 66430 - protein, 368 aa, Streptomyces antibioticus; identical to SEQ ID NO: 43472

SEQ ID NO: 66431 - DNA, 1041 bp, Caulobacter crescentus; identical to SEQ ID NO: 43473
  CDS (1)..(1041): transl_table=11

SEQ ID NO: 66432 - protein, 346 aa, Caulobacter crescentus; identical to SEQ ID NO: 43474

SEQ ID NO: 66433 - DNA, 1137 bp, Streptomyces glaucescens; identical to SEQ ID NO: 43475
  CDS (1)..(1137): transl_table=11

SEQ ID NO: 66434 - protein, 378 aa, Streptomyces glaucescens; identical to SEQ ID NO: 43476

SEQ ID NO: 66435 - DNA, 1281 bp, Streptomyces tendae; identical to SEQ ID NO: 43477
  CDS (1)..(1281): transl_table=11

SEQ ID NO: 66436 - protein, 426 aa, Streptomyces tendae; identical to SEQ ID NO: 43478

SEQ ID NO: 66437 - DNA, 1188 bp, Bordetella bronchiseptica; identical to SEQ ID NO: 43479
  CDS (1)..(1188): transl_table=11

SEQ ID NO: 66438 - protein, 395 aa, Bordetella bronchiseptica; identical to SEQ ID NO: 43480

SEQ ID NO: 66439 - DNA, 1101 bp, Bordetella bronchiseptica; identical to SEQ ID NO: 43481
  CDS (1)..(1101): transl_table=11

SEQ ID NO: 66440 - protein, 366 aa, Bordetella bronchiseptica; identical to SEQ ID NO: 43482

SEQ ID NO: 66441 - DNA, 1137 bp, Streptomyces griseus; identical to SEQ ID NO: 43483
  CDS (1)..(1137): transl_table=11

SEQ ID NO: 66442 - protein, 378 aa, Streptomyces griseus; identical to SEQ ID NO: 43484

SEQ ID NO: 66443 - DNA, 1233 bp, Streptomyces griseus; identical to SEQ ID NO: 43485
  CDS (1)..(1233): transl_table=11

SEQ ID NO: 66444 - protein, 410 aa, Streptomyces griseus; identical to SEQ ID NO: 43486

SEQ ID NO: 66445 - DNA, 1275 bp, Streptomyces griseus; identical to SEQ ID NO: 43487
  CDS (1)..(1275): transl_table=11

SEQ ID NO: 66446 - protein, 424 aa, Streptomyces griseus; identical to SEQ ID NO: 43488

SEQ ID NO: 66447 - DNA, 1104 bp, Vibrio cholerae; identical to SEQ ID NO: 43489
  CDS (1)..(1104): transl_table=11

SEQ ID NO: 66448 - protein, 367 aa, Vibrio cholerae; identical to SEQ ID NO: 43490

SEQ ID NO: 66449 - DNA, 1167 bp, Amycolatopsis mediterranei; identical to SEQ ID NO: 43491
  CDS (1)..(1167): transl_table=11

SEQ ID NO: 66450 - protein, 388 aa, Amycolatopsis mediterranei; identical to SEQ ID NO: 43492

SEQ ID NO: 66451 - DNA, 1167 bp, Actinosynnema pretiosum; identical to SEQ ID NO: 43493
  CDS (1)..(1167): transl_table=11

SEQ ID NO: 66452 - protein, 388 aa, Actinosynnema pretiosum; identical to SEQ ID NO: 43494

SEQ ID NO: 66453 - DNA, 1188 bp, Bordetella pertussis; identical to SEQ ID NO: 43495
  CDS (1)..(1188): transl_table=11

SEQ ID NO: 66454 - protein, 395 aa, Bordetella pertussis; identical to SEQ ID NO: 43496

SEQ ID NO: 66455 - DNA, 1161 bp, Caulobacter crescentus; identical to SEQ ID NO: 43497
  CDS (1)..(1161): transl_table=11

SEQ ID NO: 66456 - protein, 386 aa, Caulobacter crescentus; identical to SEQ ID NO: 43498

SEQ ID NO: 66457 - DNA, 1161 bp, Streptomyces collinus; identical to SEQ ID NO: 43499
  CDS (1)..(1161): transl_table=11

SEQ ID NO: 66458 - protein, 386 aa, Streptomyces collinus; identical to SEQ ID NO: 43500

SEQ ID NO: 66459 - DNA, 1167 bp, Streptomyces fradiae; identical to SEQ ID NO: 43501
  CDS (1)..(1167): transl_table=11

SEQ ID NO: 66460 - protein, 388 aa, Streptomyces fradiae; identical to SEQ ID NO: 43502

SEQ ID NO: 66461 - DNA, 1149 bp, Streptomyces lincolnensis; identical to SEQ ID NO: 43503
  CDS (1)..(1149): transl_table=11

SEQ ID NO: 66462 - protein, 382 aa, Streptomyces lincolnensis; identical to SEQ ID NO: 43504

SEQ ID NO: 66463 - DNA, 1314 bp, Yersinia pseudotuberculosis; identical to SEQ ID NO: 43505
  CDS (1)..(1314): transl_table=11

SEQ ID NO: 66464 - protein, 437 aa, Yersinia pseudotuberculosis; identical to SEQ ID NO: 43506

SEQ ID NO: 66465 - DNA, 1131 bp, Campylobacter jejuni; identical to SEQ ID NO: 43507
  CDS (1)..(1131): transl_table=11

SEQ ID NO: 66466 - protein, 376 aa, Campylobacter jejuni; identical to SEQ ID NO: 43508

SEQ ID NO: 66467 - DNA, 1218 bp, Streptomyces bikiniensis; identical to SEQ ID NO: 43509
  CDS (1)..(1218): transl_table=11

SEQ ID NO: 66468 - protein, 405 aa, Streptomyces bikiniensis; identical to SEQ ID NO: 43510

SEQ ID NO: 66469 - DNA, 1095 bp, Salmonella enterica subsp; identical to SEQ ID NO: 43511
  CDS (1)..(1095): transl_table=11

SEQ ID NO: 66470 - protein, 364 aa, Salmonella enterica subsp; identical to SEQ ID NO: 43512

SEQ ID NO: 66471 - DNA, 1098 bp, Citrobacter freundii; identical to SEQ ID NO: 43513
  CDS (1)..(1098): transl_table=11

SEQ ID NO: 66472 - protein, 365 aa, Citrobacter freundii; identical to SEQ ID NO: 43514

SEQ ID NO: 66473 - DNA, 1134 bp, Aeromonas hydrophila; identical to SEQ ID NO: 43515
  CDS (1)..(1134): transl_table=11

SEQ ID NO: 66474 - protein, 377 aa, Aeromonas hydrophila; identical to SEQ ID NO: 43516

SEQ ID NO: 66475 - DNA, 1119 bp, Aeromicrobium erythreum; identical to SEQ ID NO: 43517
  CDS (1)..(1119): transl_table=11

SEQ ID NO: 66476 - protein, 372 aa, Aeromicrobium erythreum; identical to SEQ ID NO: 43518

SEQ ID NO: 66477 - DNA, 1119 bp, Streptomyces griseoruber; identical to SEQ ID NO: 43519
  CDS (1)..(1119): transl_table=11

SEQ ID NO: 66478 - protein, 372 aa, Streptomyces griseoruber; identical to SEQ ID NO: 43520

SEQ ID NO: 66479 - DNA, 1107 bp, Escherichia coli; identical to SEQ ID NO: 43521
  CDS (1)..(1107): transl_table=11

SEQ ID NO: 66480 - protein, 368 aa, Escherichia coli; identical to SEQ ID NO: 43522

SEQ ID NO: 66481 - DNA, 1260 bp, Streptomyces kanamyceticus; identical to SEQ ID NO: 43523
  CDS (1)..(1260): transl_table=11

SEQ ID NO: 66482 - protein, 419 aa, Streptomyces kanamyceticus; identical to SEQ ID NO: 43524

SEQ ID NO: 66483 - DNA, 1284 bp, Streptomyces kanamyceticus; identical to SEQ ID NO: 43525
  CDS (1)..(1284): transl_table=11

SEQ ID NO: 66484 - protein, 427 aa, Streptomyces kanamyceticus; identical to SEQ ID NO: 43526

SEQ ID NO: 66485 - DNA, 1110 bp, Thiobacillus ferrooxidans; identical to SEQ ID NO: 43527
  CDS (1)..(1110): transl_table=11

SEQ ID NO: 66486 - protein, 369 aa, Thiobacillus ferrooxidans; identical to SEQ ID NO: 43528

SEQ ID NO: 66487 - DNA, 1122 bp, Escherichia coli; identical to SEQ ID NO: 43529
  CDS (1)..(1122): transl_table=11

SEQ ID NO: 66488 - protein, 373 aa, Escherichia coli; identical to SEQ ID NO: 43530

SEQ ID NO: 66489 - DNA, 1173 bp, Micromonospora echinospora; identical to SEQ ID NO: 43531
  CDS (1)..(1173): transl_table=11

SEQ ID NO: 66490 - protein, 390 aa, Micromonospora echinospora; identical to SEQ ID NO: 43532

SEQ ID NO: 66491 - DNA, 1263 bp, Micromonospora echinospora; identical to SEQ ID NO: 43533
  CDS (1)..(1263): transl_table=11

SEQ ID NO: 66492 - protein, 420 aa, Micromonospora echinospora; identical to SEQ ID NO: 43534

SEQ ID NO: 66493 - DNA, 1251 bp, Azospirillum brasilense; identical to SEQ ID NO: 43535
  CDS (1)..(1251): transl_table=11

SEQ ID NO: 66494 - protein, 416 aa, Azospirillum brasilense; identical to SEQ ID NO: 43536

SEQ ID NO: 66495 - DNA, 1167 bp, uncultured bacterium 440; identical to SEQ ID NO: 43537
  CDS (1)..(1167): transl_table=11

SEQ ID NO: 66496 - protein, 388 aa, uncultured bacterium 440; identical to SEQ ID NO: 43538

SEQ ID NO: 66497 - DNA, 1092 bp, Aneurinibacillus thermoaerophilus; identical to SEQ ID NO: 43539
  CDS (1)..(1092): transl_table=11

SEQ ID NO: 66498 - protein, 363 aa, Aneurinibacillus thermoaerophilus; identical to SEQ ID NO: 43540

SEQ ID NO: 66499 - DNA, 1059 bp, Streptomyces diastaticus; identical to SEQ ID NO: 43541
  CDS (1)..(1059): transl_table=11

SEQ ID NO: 66500 - protein, 352 aa, Streptomyces diastaticus; identical to SEQ ID NO: 43542

SEQ ID NO: 66501 - DNA, 1098 bp, Clostridium thermosaccharolyticum; identical to SEQ ID NO: 43543
  CDS (1)..(1098): transl_table=11

SEQ ID NO: 66502 - protein, 365 aa, Clostridium thermosaccharolyticum; identical to SEQ ID NO: 43544

SEQ ID NO: 66503 - DNA, 1104 bp, Shigella dysenteriae; identical to SEQ ID NO: 43545
  CDS (1)..(1104): transl_table=11

SEQ ID NO: 66504 - protein, 367 aa, Shigella dysenteriae; identical to SEQ ID NO: 43546

SEQ ID NO: 66505 - DNA, 1086 bp, Yersinia enterocolitica; identical to SEQ ID NO: 43547
  CDS (1)..(1086): transl_table=11

SEQ ID NO: 66506 - protein, 361 aa, Yersinia enterocolitica; identical to SEQ ID NO: 43548

SEQ ID NO: 66507 - DNA, 1275 bp, Streptomyces tenebrarius; identical to SEQ ID NO: 43549
  CDS (1)..(1275): transl_table=11

SEQ ID NO: 66508 - protein, 424 aa, Streptomyces tenebrarius; identical to SEQ ID NO: 43550

SEQ ID NO: 66509 - DNA, 1392 bp, Micromonospora echinospora; identical to SEQ ID NO: 43551
  CDS (1)..(1392): transl_table=11

SEQ ID NO: 66510 - protein, 463 aa, Micromonospora echinospora; identical to SEQ ID NO: 43552

SEQ ID NO: 66511 - DNA, 1257 bp, Micromonospora echinospora; identical to SEQ ID NO: 43553
  CDS (1)..(1257): transl_table=11

SEQ ID NO: 66512 - protein, 418 aa, Micromonospora echinospora; identical to SEQ ID NO: 43554

SEQ ID NO: 66513 - DNA, 1173 bp, Escherichia coli O157; identical to SEQ ID NO: 43555
  CDS (1)..(1173): transl_table=11

SEQ ID NO: 66514 - protein, 390 aa, Escherichia coli O157; identical to SEQ ID NO: 43556

SEQ ID NO: 66515 - DNA, 1131 bp, Streptomyces sp; identical to SEQ ID NO: 43557
  CDS (1)..(1131): transl_table=11

SEQ ID NO: 66516 - protein, 376 aa, Streptomyces sp; identical to SEQ ID NO: 43558

SEQ ID NO: 66517 - DNA, 1104 bp, Rhizobium leguminosarum bv; identical to SEQ ID NO: 43559
  CDS (1)..(1104): transl_table=11

SEQ ID NO: 66518 - protein, 367 aa, Rhizobium leguminosarum bv; identical to SEQ ID NO: 43560

SEQ ID NO: 66519 - DNA, 1143 bp, Campylobacter coli; identical to SEQ ID NO: 43561
  CDS (1)..(1143): transl_table=11

SEQ ID NO: 66520 - protein, 380 aa, Campylobacter coli; identical to SEQ ID NO: 43562

SEQ ID NO: 66521 - DNA, 1401 bp, Pseudomonas aeruginosa; identical to SEQ ID NO: 43563
  CDS (1)..(1401): transl_table=11

SEQ ID NO: 66522 - protein, 466 aa, Pseudomonas aeruginosa; identical to SEQ ID NO: 43564

SEQ ID NO: 66523 - DNA, 1140 bp, Shigella flexneri; identical to SEQ ID NO: 43565
  CDS (1)..(1140)

SEQ ID NO: 66524 - protein, 379 aa, Shigella flexneri; identical to SEQ ID NO: 43566

SEQ ID NO: 66525 - DNA, 1149 bp, Micromonospora griseorubida; identical to SEQ ID NO: 43567
  CDS (1)..(1149): transl_table=11

SEQ ID NO: 66526 - protein, 382 aa, Micromonospora griseorubida; identical to SEQ ID NO: 43568

SEQ ID NO: 66527 - DNA, 1110 bp, Streptomyces sp; identical to SEQ ID NO: 43569
  CDS (1)..(1110): transl_table=11

SEQ ID NO: 66528 - protein, 369 aa, Streptomyces sp; identical to SEQ ID NO: 43570

SEQ ID NO: 66529 - DNA, 1104 bp, Escherichia coli; identical to SEQ ID NO: 43571
  CDS (1)..(1104): transl_table=11

SEQ ID NO: 66530 - protein, 367 aa, Escherichia coli; identical to SEQ ID NO: 43572

SEQ ID NO: 66531 - DNA, 1257 bp, Bacillus circulans; identical to SEQ ID NO: 43573
  CDS (1)..(1257): transl_table=11

SEQ ID NO: 66532 - protein, 418 aa, Bacillus circulans; identical to SEQ ID NO: 43574

SEQ ID NO: 66533 - DNA, 1083 bp, Pseudomonas aeruginosa; identical to SEQ ID NO: 43575
  CDS (1)..(1083): transl_table=11

SEQ ID NO: 66534 - protein, 360 aa, Pseudomonas aeruginosa; identical to SEQ ID NO: 43576

SEQ ID NO: 66535 - DNA, 1233 bp, Streptomyces globisporus; identical to SEQ ID NO: 43577
  CDS (1)..(1233): transl_table=11

SEQ ID NO: 66536 - protein, 410 aa, Streptomyces globisporus; identical to SEQ ID NO: 43578

SEQ ID NO: 66537 - DNA, 1113 bp, Escherichia coli; identical to SEQ ID NO: 43579
  CDS (1)..(1113): transl_table=11

SEQ ID NO: 66538 - protein, 370 aa, Escherichia coli; identical to SEQ ID NO: 43580

SEQ ID NO: 66539 - DNA, 1161 bp, Pseudomonas aeruginosa; identical to SEQ ID NO: 43581
  CDS (1)..(1161): transl_table=11

SEQ ID NO: 66540 - protein, 386 aa, Pseudomonas aeruginosa; identical to SEQ ID NO: 43582

SEQ ID NO: 66541 - DNA, 1080 bp, Pseudomonas aeruginosa; identical to SEQ ID NO: 43583
  CDS (1)..(1080): transl_table=11

SEQ ID NO: 66542 - protein, 359 aa, Pseudomonas aeruginosa; identical to SEQ ID NO: 43584

SEQ ID NO: 66543 - DNA, 1161 bp, Pseudomonas aeruginosa; identical to SEQ ID NO: 43585
  CDS (1)..(1161): transl_table=11

SEQ ID NO: 66544 - protein, 386 aa, Pseudomonas aeruginosa; identical to SEQ ID NO: 43586

SEQ ID NO: 66545 - DNA, 1215 bp, Pseudomonas aeruginosa; identical to SEQ ID NO: 43587
  CDS (1)..(1215): transl_table=11

SEQ ID NO: 66546 - protein, 404 aa, Pseudomonas aeruginosa; identical to SEQ ID NO: 43588

SEQ ID NO: 66547 - DNA, 1080 bp, Pseudomonas aeruginosa; identical to SEQ ID NO: 43589
  CDS (1)..(1080): transl_table=11

SEQ ID NO: 66548 - protein, 359 aa, Pseudomonas aeruginosa; identical to SEQ ID NO: 43590

SEQ ID NO: 66549 - DNA, 1152 bp, Pseudomonas aeruginosa; identical to SEQ ID NO: 43591
  CDS (1)..(1152): transl_table=11

SEQ ID NO: 66550 - protein, 383 aa, Pseudomonas aeruginosa; identical to SEQ ID NO: 43592

SEQ ID NO: 66551 - DNA, 1140 bp, Streptomyces narbonensis; identical to SEQ ID NO: 43593
  CDS (1)..(1140): transl_table=11

SEQ ID NO: 66552 - protein, 379 aa, Streptomyces narbonensis; identical to SEQ ID NO: 43594

SEQ ID NO: 66553 - DNA, 1167 bp, Actinosynnema pretiosum; identical to SEQ ID NO: 43595
  CDS (1)..(1167): transl_table=11

SEQ ID NO: 66554 - protein, 388 aa, Actinosynnema pretiosum; identical to SEQ ID NO: 43596

SEQ ID NO: 66555 - DNA, 1284 bp, Streptomyces hygroscopicus; identical to SEQ ID NO: 43597
  CDS (1)..(1284): transl_table=11

SEQ ID NO: 66556 - protein, 427 aa, Streptomyces hygroscopicus; identical to SEQ ID NO: 43598

SEQ ID NO: 66557 - DNA, 1281 bp, Streptomyces ansochromogenes; identical to SEQ ID NO: 43599
  CDS (1)..(1281): transl_table=11

SEQ ID NO: 66558 - protein, 426 aa, Streptomyces ansochromogenes; identical to SEQ ID NO: 43600

SEQ ID NO: 66559 - DNA, 1260 bp, Streptomyces virginiae; identical to SEQ ID NO: 43601
  CDS (1)..(1260): transl_table=11

SEQ ID NO: 66560 - protein, 419 aa, Streptomyces virginiae; identical to SEQ ID NO: 43602

SEQ ID NO: 66561 - DNA, 1158 bp, Vibrio cholerae; identical to SEQ ID NO: 43603
  CDS (1)..(1158): transl_table=11

SEQ ID NO: 66562 - protein, 385 aa, Vibrio cholerae; identical to SEQ ID NO: 43604

SEQ ID NO: 66563 - DNA, 1101 bp, Bordetella avium; identical to SEQ ID NO: 43605
  CDS (1)..(1101): transl_table=11

SEQ ID NO: 66564 - protein, 366 aa, Bordetella avium; identical to SEQ ID NO: 43606

SEQ ID NO: 66565 - DNA, 1179 bp, Bordetella avium; identical to SEQ ID NO: 43607
  CDS (1)..(1179): transl_table=11

SEQ ID NO: 66566 - protein, 392 aa, Bordetella avium; identical to SEQ ID NO: 43608

SEQ ID NO: 66567 - DNA, 1167 bp, Kitasatospora sp; identical to SEQ ID NO: 43609
  CDS (1)..(1167): transl_table=11

SEQ ID NO: 66568 - protein, 388 aa, Kitasatospora sp; identical to SEQ ID NO: 43610

SEQ ID NO: 66569 - DNA, 1092 bp, Leptospira interrogans; identical to SEQ ID NO: 43611
  CDS (1)..(1092): transl_table=11

SEQ ID NO: 66570 - protein, 363 aa, Leptospira interrogans; identical to SEQ ID NO: 43612

SEQ ID NO: 66571 - DNA, 1110 bp, Streptomyces galilaeus; identical to SEQ ID NO: 43613
  CDS (1)..(1110): transl_table=11

SEQ ID NO: 66572 - protein, 369 aa, Streptomyces galilaeus; identical to SEQ ID NO: 43614

SEQ ID NO: 66573 - DNA, 1110 bp, Amycolatopsis balhimycina; identical to SEQ ID NO: 43615
  CDS (1)..(1110): transl_table=11

SEQ ID NO: 66574 - protein, 369 aa, Amycolatopsis balhimycina; identical to SEQ ID NO: 43616

SEQ ID NO: 66575 - DNA, 1059 bp, Streptomyces nodosus; identical to SEQ ID NO: 43617
  CDS (1)..(1059): transl_table=11

SEQ ID NO: 66576 - protein, 352 aa, Streptomyces nodosus; identical to SEQ ID NO: 43618

SEQ ID NO: 66577 - DNA, 1224 bp, Bacteroides fragilis; identical to SEQ ID NO: 43619
  CDS (1)..(1224): transl_table=11

SEQ ID NO: 66578 - protein, 407 aa, Bacteroides fragilis; identical to SEQ ID NO: 43620

SEQ ID NO: 66579 - DNA, 1104 bp, Xanthomonas campestris; identical to SEQ ID NO: 43621
  CDS (1)..(1104): transl_table=11

SEQ ID NO: 66580 - protein, 367 aa, Xanthomonas campestris; identical to SEQ ID NO: 43622

SEQ ID NO: 66581 - DNA, 1401 bp, Pseudomonas aeruginosa; identical to SEQ ID NO: 43623
  CDS (1)..(1401): r means g or a

SEQ ID NO: 66582 - protein, 466 aa, Pseudomonas aeruginosa; identical to SEQ ID NO: 43624
  misc_feature (65)..(65): Xaa can be Ala or Thr

SEQ ID NO: 66583 - DNA, 1389 bp, Saccharopolyspora spinosa; identical to SEQ ID NO: 43625
  CDS (1)..(1389): transl_table=11

SEQ ID NO: 66584 - protein, 462 aa, Saccharopolyspora spinosa; identical to SEQ ID NO: 43626

SEQ ID NO: 66585 - DNA, 1158 bp, Saccharopolyspora spinosa; identical to SEQ ID NO: 43627
  CDS (1)..(1158): transl_table=11

SEQ ID NO: 66586 - protein, 385 aa, Saccharopolyspora spinosa; identical to SEQ ID NO: 43628

SEQ ID NO: 66587 - DNA, 1059 bp, Streptomyces natalensis; identical to SEQ ID NO: 43629
  CDS (1)..(1059): transl_table=11

SEQ ID NO: 66588 - protein, 352 aa, Streptomyces natalensis; identical to SEQ ID NO: 43630

SEQ ID NO: 66589 - DNA, 1059 bp, Streptomyces griseus; identical to SEQ ID NO: 43631
  CDS (1)..(1059): transl_table=11

SEQ ID NO: 66590 - protein, 352 aa, Streptomyces griseus; identical to SEQ ID NO: 43632

SEQ ID NO: 66591 - DNA, 1155 bp, Plesiomonas shigelloides; identical to SEQ ID NO: 43633
  CDS (1)..(1155): transl_table=11

SEQ ID NO: 66592 - protein, 384 aa, Plesiomonas shigelloides; identical to SEQ ID NO: 43634

SEQ ID NO: 66593 - DNA, 1125 bp, Micromonospora megalomicea subsp; identical to SEQ ID NO: 43635
  CDS (1)..(1125): transl_table=11

SEQ ID NO: 66594 - protein, 374 aa, Micromonospora megalomicea subsp; identical to SEQ ID NO: 43636

SEQ ID NO: 66595 - DNA, 1305 bp, Streptomyces galilaeus; identical to SEQ ID NO: 43637
  CDS (1)..(1305): transl_table=11

SEQ ID NO: 66596 - protein, 434 aa, Streptomyces galilaeus; identical to SEQ ID NO: 43638

SEQ ID NO: 66597 - DNA, 1059 bp, Streptomyces noursei; identical to SEQ ID NO: 43639
  CDS (1)..(1059): transl_table=11

SEQ ID NO: 66598 - protein, 352 aa, Streptomyces noursei; identical to SEQ ID NO: 43640

SEQ ID NO: 66599 - DNA, 1107 bp, Streptomyces antibioticus; identical to SEQ ID NO: 43641
  CDS (1)..(1107): transl_table=11

SEQ ID NO: 66600 - protein, 368 aa, Streptomyces antibioticus; identical to SEQ ID NO: 43642

SEQ ID NO: 66601 - DNA, 1182 bp, Streptomyces antibioticus; identical to SEQ ID NO: 43643
  CDS (1)..(1182): transl_table=11

SEQ ID NO: 66602 - protein, 393 aa, Streptomyces antibioticus; identical to SEQ ID NO: 43644

SEQ ID NO: 66603 - DNA, 1161 bp, Rhizobium meliloti; identical to SEQ ID NO: 43645
  CDS (1)..(1161): transl_table=11

SEQ ID NO: 66604 - protein, 386 aa, Rhizobium meliloti; identical to SEQ ID NO: 43646

SEQ ID NO: 66605 - DNA, 1164 bp, Aeromonas punctata; identical to SEQ ID NO: 43647
  CDS (1)..(1164): transl_table=11

SEQ ID NO: 66606 - protein, 387 aa, Aeromonas punctata; identical to SEQ ID NO: 43648

SEQ ID NO: 66607 - DNA, 1215 bp, Streptococcus suis; identical to SEQ ID NO: 43649
  CDS (1)..(1215): transl_table=11

SEQ ID NO: 66608 - protein, 404 aa, Streptococcus suis; identical to SEQ ID NO: 43650

SEQ ID NO: 66609 - DNA, 1131 bp, Bacteroides fragilis; identical to SEQ ID NO: 43651
  CDS (1)..(1131): transl_table=11

SEQ ID NO: 66610 - protein, 376 aa, Bacteroides fragilis; identical to SEQ ID NO: 43652

SEQ ID NO: 66611 - DNA, 1176 bp, Acinetobacter lwoffii; identical to SEQ ID NO: 43653
  CDS (1)..(1176): transl_table=11

SEQ ID NO: 66612 - protein, 391 aa, Acinetobacter lwoffii; identical to SEQ ID NO: 43654

SEQ ID NO: 66613 - DNA, 1182 bp, Streptomyces antibioticus; identical to SEQ ID NO: 43655
  CDS (1)..(1182): transl_table=11

SEQ ID NO: 66614 - protein, 393 aa, Streptomyces antibioticus; identical to SEQ ID NO: 43656

SEQ ID NO: 66615 - DNA, 1155 bp, Shigella sonnei; identical to SEQ ID NO: 43657
  CDS (1)..(1155): transl_table=11

SEQ ID NO: 66616 - protein, 384 aa, Shigella sonnei; identical to SEQ ID NO: 43658

SEQ ID NO: 66617 - DNA, 1155 bp, Plesiomonas shigelloides; identical to SEQ ID NO: 43659
  CDS (1)..(1155): transl_table=11

SEQ ID NO: 66618 - protein, 384 aa, Plesiomonas shigelloides; identical to SEQ ID NO: 43660

SEQ ID NO: 66619 - DNA, 1167 bp, Streptomyces lavendulae; identical to SEQ ID NO: 43661
  CDS (1)..(1167): transl_table=11

SEQ ID NO: 66620 - protein, 388 aa, Streptomyces lavendulae; identical to SEQ ID NO: 43662

SEQ ID NO: 66621 - DNA, 1137 bp, Streptomyces bluensis; identical to SEQ ID NO: 43663
  CDS (1)..(1137): transl_table=11

SEQ ID NO: 66622 - protein, 378 aa, Streptomyces bluensis; identical to SEQ ID NO: 43664

SEQ ID NO: 66623 - DNA, 1167 bp, Streptomyces collinus; identical to SEQ ID NO: 43665
  CDS (1)..(1167): transl_table=11

SEQ ID NO: 66624 - protein, 388 aa, Streptomyces collinus; identical to SEQ ID NO: 43666

SEQ ID NO: 66625 - DNA, 1302 bp, Streptomyces violaceoruber; identical to SEQ ID NO: 43667
  CDS (1)..(1302): transl_table=11

SEQ ID NO: 66626 - protein, 433 aa, Streptomyces violaceoruber; identical to SEQ ID NO: 43668

SEQ ID NO: 66627 - DNA, 1140 bp, Streptomyces venezuelae; identical to SEQ ID NO: 43669
  CDS (1)..(1140): transl_table=11

SEQ ID NO: 66628 - protein, 379 aa, Streptomyces venezuelae; identical to SEQ ID NO: 43670

SEQ ID NO: 66629 - DNA, 1092 bp, Leptospira borgpetersenii; identical to SEQ ID NO: 43671
  CDS (1)..(1092): transl_table=11

SEQ ID NO: 66630 - protein, 363 aa, Leptospira borgpetersenii; identical to SEQ ID NO: 43672

SEQ ID NO: 66631 - DNA, 1762 bp, Bacillus stearothermophilus; identical to SEQ ID NO: 43673
  CDS (394)..(1512)

SEQ ID NO: 66632 - protein, 372 aa, Bacillus stearothermophilus; identical to SEQ ID NO: 43674

SEQ ID NO: 66633 - DNA, 1113 bp, Streptomyces peucetius; identical to SEQ ID NO: 43675
  CDS (1)..(1113): transl_table=11

SEQ ID NO: 66634 - protein, 370 aa, Streptomyces peucetius; identical to SEQ ID NO: 43676

SEQ ID NO: 66635 - DNA, 1098 bp, Saccharopolyspora erythraea; identical to SEQ ID NO: 43677
  CDS (1)..(1098): transl_table=11

SEQ ID NO: 66636 - protein, 365 aa, Saccharopolyspora erythraea; identical to SEQ ID NO: 43678

SEQ ID NO: 66637 - DNA, 1524 bp, Rhizobium meliloti; identical to SEQ ID NO: 43679
  CDS (1)..(1524): transl_table=11

SEQ ID NO: 66638 - protein, 507 aa, Rhizobium meliloti; identical to SEQ ID NO: 43680

SEQ ID NO: 66639 - DNA, 1314 bp, Salmonella typhimurium; identical to SEQ ID NO: 43681
  CDS (1)..(1314): transl_table=11

SEQ ID NO: 66640 - protein, 437 aa, Salmonella typhimurium; identical to SEQ ID NO: 43682

SEQ ID NO: 66641 - DNA, 1170 bp, Bacillus subtilis; identical to SEQ ID NO: 43683
  CDS (1)..(1170): transl_table=11

SEQ ID NO: 66642 - protein, 389 aa, Bacillus subtilis; identical to SEQ ID NO: 43684

SEQ ID NO: 66643 - DNA, 1161 bp, Methanococcus jannaschii; identical to SEQ ID NO: 43685
  CDS (1)..(1161): transl_table=11

SEQ ID NO: 66644 - protein, 386 aa, Methanococcus jannaschii; identical to SEQ ID NO: 43686

SEQ ID NO: 66645 - DNA, 1158 bp, Escherichia coli; identical to SEQ ID NO: 43687
  CDS (19)..(1158)

SEQ ID NO: 66646 - protein, 379 aa, Escherichia coli; identical to SEQ ID NO: 43688

SEQ ID NO: 66647 - DNA, 22 bp, Primer
atgattccatttaacgcaccgc

SEQ ID NO: 66648 - DNA, 27 bp, Primer
ttaggaaaagtagttcaacaaagtcgc

SEQ ID NO: 66649 - protein, 357 aa, consensus; identical to SEQ ID NO: 43691
  MISC_FEATURE (1)..(357): consensus for the disclosure of xaa see table XV

SEQ ID NO: 66650 - protein, 26 aa, consensus
  MISC_FEATURE (1)..(26): consensus for the disclosure of xaa see table XV
XXXXXXXXXXXXXXXXXXXXXXXXXX

SEQ ID NO: 66651 - protein, 54 aa, consensus; identical to SEQ ID NO: 43693
  MISC_FEATURE (1)..(54): consensus for the disclosure of xaa see table XV

SEQ ID NO: 66652 - protein, 28 aa, consensus
  MISC_FEATURE (1)..(28): consensus for the disclosure of xaa see table XV
XXXXXXXXXXXXXXXXXXXXXXXXXXXX

SEQ ID NO: 66653 - protein, 29 aa, consensus
  MISC_FEATURE (1)..(29): consensus for the disclosure of xaa see table XV
XXXXXXXXXXXXXXXXXXXXXXXXXXXXX

SEQ ID NO: 66654 - DNA, 768 bp, Escherichia coli
  CDS (1)..(768)
atgcgacatcctttagtgatgggtaactggaaactgaacggcagccgccacatggttcacgagctggtttctaacctgcgtaaagagctggcaggtgttgctggctgtgcggttgcaatcgcaccaccggaaatgtacatcgatatggcgaagcgtgaagctgaaggcagccacatcatgctgggtgcgcaaaacgtggacctgaacctgtccggcgcattcaccggtgaaacctctgctgctatgctgaaagacatcggcgcacagtacatcatcatcggtcactctgaacgtcgtacttaccacaaagaatctgacgaactgatcgcgaaaaaattcgcggtgctgaaagarcagggcctgactccggttctgtgcatcggtgaaaccgaagctgaaaacgaagcgggcaaaactgaagaagtttgcgcacgtcaratcgacgcggtactgaaaactcagggtgctgcggcattcgaaggtgcggttatcgcttacgaacctgtatgggcaatcggtactggcaaatctgcaactccggctcaggcacaggctgttcacaaattcattcgtgaccacatcgctaaagttgacgctaacatcgctgaacaagtgatcattcagtacggcggctctgtaaacgcgtctaacgctgcagaactgtttgctcagccagacatcgacggcgcgctggttggcggtgcgtctctgaaagctgacgctttcgcagtaatcgttaaagctgcagaagcggctaaacaggcttaa

SEQ ID NO: 66655 - protein, 255 aa, Escherichia coli
MRHPLVMGNWKLNGSRHMVHELVSNLRKELAGVAGCAVAIAPPEMYIDMAKREAEGSHIMLGAQNVDLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQPDIDGALVGGASLKADAFAVIVKAAEAAKQA

SEQ ID NO: 66656 - DNA, 828 bp, Gluconobacter oxydans 621H
  CDS (1)..(828)
atgagcattcagccagttggtcagtctttcgggaggttggttgtggatcagaagaacgtctggatcgggacgagctggaagatgaacaagggaccgtccgaagcgattgcggcggcgcgggcgcttgaatccttccagccgccggaagggatccggtcgttcgtgatcccgtctttcacgtcgctgcgggatgtgtgctcggtgctggaagacagcgcgcttctggttggcgcgcagaacatgcactgggaggacagcggcgcctggaccggggaggtttccgcgccgatgattgccgagtgcggagcgtccatcgtggaaatcggccattcggagcgccgacagcatttcggcgagacggactggacggtgaacctaaaggtccaggccgcgctgcggcacggtctgcgtccgctgatctgcattggcgatacgtcggatgaattcgagttcggggtttcgcaggaaacgctggcacgtcaggtgaaaattgcgctgcatggggtgtccagaaaggatctggggcaggtcatggttgcgtatgagccggtctgggccatcggatcagcgggacgtccggccgaggcgtcgttcgtgtccgggatccataccagattgcgtgctgtcgtgcgtgaactggcgggggacagtggcgtgcggattccgctgctttatggcggcagcgtctcgcaggccaatatccgcgattacgtcgcattgccggatgtggacggtgtgtttgtcgggcgtgcggcctgggagcctgcggatttcatgaggctggtggaaagtgtgagcggggttgtgtcccgaaaaattgccgcgtga

SEQ ID NO: 66657 - protein, 275 aa, Gluconobacter oxydans 621H
MSIQPVGQSFGRLVVDQKNVWIGTSWKMNKGPSEAIAAARALESFQPPEGIRSFVIPSFTSLRDVCSVLEDSALLVGAQNMHWEDSGAWTGEVSAPMIAECGASIVEIGHSERRQHFGETDWTVNLKVQAALRHGLRPLICIGDTSDEFEFGVSQETLARQVKIALHGVSRKDLGQVMVAYEPVWAIGSAGRPAEASFVSGIHTRLRAVVRELAGDSGVRIPLLYGGSVSQANIRDYVALPDVDGVFVGRAAWEPADFMRLVESVSGVVSRKIAA

SEQ ID NO: 66658 - DNA, 801 bp, Gluconobacter oxydans 621H
  CDS (1)..(801)
atgcccccatcacccaggcttgtcgttggaaactggaagatgcacggattgcgggagcagtccggccgtctggcccgtgccgtcgccgagggcgcgcagtcccttcccgatgacgtgcggctcgtcctgtgcccacccttcacccagctcgccagcgtgcatggcatcatcaatgccgaagggccggccacgccgctgcgtcttggtgcgcaggactgtcatacgacgtcttcggggcctcataccggggatatctcagctgaaatgctggccgaccttggtgtccgctacgtcattctaggccattccgaacgtcggcaggcccatggcgaaaccgatgtcctgattcgccagaaggtcgaagctgccgaagctgcgggcctcattcccatcgtctgtatcggcgagacgacgcaggagcgtctcgaagggcggacgaccaccgttctggccacgcaggtcgagggatcgttgaccgacggctttaccggtatcctggcttacgagcccgtctgggccatcggaagcggcacgatcccgcccatcgacgagctcgagagaaccctctctctcctgcatggactgttgcagtcccgtctcaagacggatgacattcgcgtgccgatcctgtatggcggctccgtcacaccggctcaggcgccgaccattttttccatcgggtcgcttggcggggtgctggttggcagtgccagtctggaagcagagagcttcctgcgcatcgctgaagcggcatctttccgcctgacgtcccaaccattgtccggaccctatcgttcatga

SEQ ID NO: 66659 - protein, 266 aa, Gluconobacter oxydans 621H
MPPSPRLVVGNWKMHGLREQSGRLARAVAEGAQSLPDDVRLVLCPPFTQLASVHGIINAEGPATPLRLGAQDCHTTSSGPHTGDISAEMLADLGVRYVILGHSERRQAHGETDVLIRQKVEAAEAAGLIPIVCIGETTQERLEGRTTTVLATQVEGSLTDGFTGILAYEPVWAIGSGTIPPIDELERTLSLLHGLLQSRLKTDDIRVPILYGGSVTPAQAPTIFSIGSLGGVLVGSASLEAESFLRIAEAASFRLTSQPLSGPYRS

SEQ ID NO: 66660 - DNA, 750 bp, Homo sapiens
  CDS (1)..(750)
atggcgccctccaggaagttcttcgttgggggaaactggaagatgaacgggcggaagcagagtctgggggagctcatcggcactctgaacgcggccaaggtgccggccgacaccgaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggcccaggaagtacacgagaagctccgaggatggctgaagtccaacgtctctgatgcggtggctcagagcacccgtatcatttatggaggctctgtgactggggcaacctgcaaggagctggccagccagcctgatgtggatggcttccttgtgggtggtgcttccctcaagcccgaattcgtggacatcatcaatgccaaacaatga

SEQ ID NO: 66661 - protein, 249 aa, Homo sapiens
MAPSRKFFVGGNWKMNGRKQSLGELIGTLNAAKVPADTEVVCAPPTAYIDFARQKLDPKIAVAAQNCYKVTNGAFTGEISPGMIKDCGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKSNVSDAVAQSTRIIYGGSVTGATCKELASQPDVDGFLVGGASLKPEFVDIINAKQ

SEQ ID NO: 66662 - DNA, 747 bp, Saccharomyces cerevisiae
  CDS (1)..(747)
atggctagaactttctttgtcggtggtaactttaaattaaacggttccaaacaatccattaaggaaattgttgaaagattgaacactgcttctatcccagaaaatgtcgaagttgttatctgtcctccagctacctacttagactactctgtctctttggttaagaagccacaagtcactgtcggtgctcaaaacgcctacttgaaggcttctggtgctttcaccggtgaaaactccgttgaccaaatcaaggatgttggtgctaagtgggttattttgggtcactccgaaagaagatcttacttccacgaagatgacaagttcattgctgacaagaccaagttcgctttaggtcaaggtgtcggtgtcatcttgtgtatcggtgaaactttggaagaaaagaaggccggtaagactttggatgttgttgaaagacaattgaacgctgtcttggaagaagttaaggactggactaacgtcgttgtcgcttacgaaccagtctgggccattggtaccggtttggctgctactccagaagatgctcaagatattcacgcttccatcagaaagttcttggcttccaagttgggtgacaaggctgccagcgaattgagaatcttatacggtggttccgctaacggtagcaacgccgttaccttcaaggacaaggctgatgtcgatggtttcttggtcggtggtgcttctttgaagccagaatttgttgatatcatcaactctagaaactaa

SEQ ID NO: 66663 - protein, 248 aa, Saccharomyces cerevisiae
MARTFFVGGNFKLNGSKQSIKEIVERLNTASIPENVEVVICPPATYLDYSVSLVKKPQVTVGAQNAYLKASGAFTGENSVDQIKDVGAKWVILGHSERRSYFHEDDKFIADKTKFALGQGVGVILCIGETLEEKKAGKTLDVVERQLNAVLEEVKDWTNVVVAYEPVWAIGTGLAATPEDAQDIHASIRKFLASKLGDKAASELRILYGGSANGSNAVTFKDKADVDGFLVGGASLKPEFVDIINSRN

SEQ ID NO: 66664 - DNA, 750 bp, Mus musculus
  CDS (1)..(750)
atggcgcctaccaggaagttcttcgttgggggcaactggaagatgaacgggaggaagaagtgcctgggagaactcatctgcaccctgaacgcagccaacgtgccggcaggcaccgaggtggtttgtgcaccgcccaccgcttacatcgactttgccagacagaagctggatcccaaaattgctgtggccgcacagaactgctacaaagtgaccaatggggccttcactggggaaatcagccctggcatgatcaaagacttaggagccacctgggtcgtgctggggcactcagaaagaagacatgtctttggagaatcagatgagctgattggccagaaagtgagccacgccctagcagagggactcggggtgatcgcctgcatcggggagaagctagacgaaagggaagccggcatcaccgagaaggtcgtgttcgagcaaaccaaggtcatcgcagataatgtgaaagactggagcaaggtggtcctggcctatgaacctgtgtgggccattgggactggcaagacggcaacccctcagcaggcacaggaagtacacgagaagctccggggatggctgaaatccaatgtcaatgatggggtggctcagagcacccggatcatttatggaggttctgtgactggagcaacctgcaaagagctggcaagccagcctgacgtggacggcttccttgtgggtggcgcatctctcaagcctgaatttgtggacatcatcaatgccaaacaatga

SEQ ID NO: 66665 - protein, 249 aa, Mus musculus
MAPTRKFFVGGNWKMNGRKKCLGELICTLNAANVPAGTEVVCAPPTAYIDFARQKLDPKIAVAAQNCYKVTNGAFTGEISPGMIKDLGATWVVLGHSERRHVFGESDELIGQKVSHALAEGLGVIACIGEKLDEREAGITEKVVFEQTKVIADNVKDWSKVVLAYEPVWAIGTGKTATPQQAQEVHEKLRGWLKSNVNDGVAQSTRIIYGGSVTGATCKELASQPDVDGFLVGGASLKPEFVDIINAKQ

SEQ ID NO: 66666 - DNA, 753 bp, Agrobacterium rhizogenes
  CDS (1)..(753): transl_table=11
atgatcaatacaccccgccggctcatcgtcggcaattggaaaatgaacgggcttacggccgatctcgccgagatcgaaaagctcgcgtggaacatcggcgacctcagcgcagacgtggctatatgtcctccggcaacgcttctgcaatccgccgtgagaataaccgccggaagccgacttcttctcggtgcccaggattgcagcgctcaggaagctggcgcctataccggcgacatatccgccaggatgatcgccgattgccgcgcccgcgtcgtcatactcggtcattccgagcgacgtcagtatcagggcgagacggacgcgatcgtcaggcgcaaggccgagattgcgctcagcgccggcctcactccggtgatctgcgtgggtgagacagaagcagagcatctccgccaggagacgctcgctgtcctgaaaaaccagctgcagggttgcctgcccgccgaaatgaacgaaatcgccttggtcatagcctatgagccggtctggtccatcgggaccggacgcctgccggaccaaggcgaaattctcgccgctcatgcctgcatccgatccagtctgatcgatgcctatggaccggtcggtgctcaaatgcggatcctctacggcggctccgtcaaaccagaaaattcgatcgagattcttgctcttgaaaacgtcgacggtgttcttgtcggcggcgctagtctgcgagccgagagctttcttcaaatctgcgaggcgacgaggacgtag

SEQ ID NO: 66667 - protein, 250 aa, Agrobacterium rhizogenes
MINTPRRLIVGNWKMNGLTADLAEIEKLAWNIGDLSADVAICPPATLLQSAVRITAGSRLLLGAQDCSAQEAGAYTGDISARMIADCRARVVILGHSERRQYQGETDAIVRRKAEIALSAGLTPVICVGETEAEHLRQETLAVLKNQLQGCLPAEMNEIALVIAYEPVWSIGTGRLPDQGEILAAHACIRSSLIDAYGPVGAQMRILYGGSVKPENSIEILALENVDGVLVGGASLRAESFLQICEATRT

SEQ ID NO: 66668 - DNA, 765 bp, Chlamydophila pneumoniae CWL029
  CDS (1)..(765): transl_table=11
atgacaaggcagagttatgttttgggcaattggaaaatgcacaaaacaatccaagaagctaaagagtatgttcaaacattagcttctttactacaaggagaacctctttcctgcactataggcatagcttctccatttacctctttgagagcgattcatgaggtgataaacactacgggagcttttctctggttgggagcacaaaatgtccatcccgagctttcgggtgcttttactggagaaatttccttacctatgcttaaggaggtaggagtggaatttgttttagtaggtcactccgagcgtcgtcatatttttggagagagtgatgcctttattgcttcaaaggtaaagtctgtagctcaggcgggactcgtgcctgttctttgtgttggagagagcttagaagttcgtgaagagggaaaggcgcatcaggtaatcaaaaaacagttgcttttgggattggaacagatggataatggttccgaatttttgatcgcctatgaaccagtatgggctatcggcacagggaaggtggcagaagcttcggatgtgcaagatattcatatgttttgtcgtgaggtagtggcagagaggttctcagaagctacagctgaagagatttcgattttgtacggaggatctgtgaaggtcgataatgctcagcgatttgggcaatgtagcgacgtcgatggtcttttagttggcggagcttctttagaagggcaaagtttttttgaagtcgctaaaaattttaatgtataa

SEQ ID NO: 66669 - protein, 254 aa, Chlamydophila pneumoniae CWL029
MTRQSYVLGNWKMHKTIQEAKEYVQTLASLLQGEPLSCTIGIASPFTSLRAIHEVINTTGAFLWLGAQNVHPELSGAFTGEISLPMLKEVGVEFVLVGHSERRHIFGESDAFIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGASLEGQSFFEVAKNFNV

SEQ ID NO: 66670 - DNA, 1050 bp, Pasteurella multocida subsp. multocida str. Pm70
  CDS (1)..(1050): transl_table=11
atggaaaaaaaaatttactttggtacaaatttaaaaatgtataaaggtaattgtgaaacagtcgattaccttactcagttacttgccctcagagaaaaacttcaatctgattatgatattgaattatttgtcattccttcttatatcgccttaaaagatgctgtacatgcagcggcatcagagacaacgcataaaattcttattggtgcacagaacatgaatgctaaggataaagggcagtttactggcgaaatttcaccactcatgttgaaagagctaggggttcagttggtcatgattgggcattctgaacgtcgccatgttttgaaagaaaccgatcaggaagagaatgagaaagtattgtcagcgttgaagcatggctttaaaacattactctgtgttggtgaaacgttagaacagaaaaattatcagatttccgatgaagtactccggacacaattaaagatcggtttgcacggtgtatcagtgaagcaattacctcatttattcatcgcatatgaacccgtttgggcaattggtgaaggtggtattcctgcaacggcgcaatatgcagatgagaaacagaagatcattaaacaatgtttatttgaaatgtttggtgaggaaagtaaaaagataccggtattgtatgggggaagtgtgaatttagaaaatgcaaatgaattaattatgcagcctcatattgacggattgtttgttgggcgtagcgcctgggatgcacaatgtttttatactttaatagacggtgcgttaaaagccttggcgggtacaacacatcaatttagccctattgctactcagctcattaaacacttaggaggaaaagaaaatatcagtgcgttaacgcattgtgcgagtcggattagagtgatgacgcggaatgaaaatcatataaataaagtagcaatagaaaaaataaatggggtgagcgggttattttcgatcgctaatcaatatcaaattattgtaggtcctaaatgggtagaaaaaatttatagcgaaatgaaagcgttattagaaacagaatag

SEQ ID NO: 66671 - protein, 349 aa, Pasteurella multocida subsp. multocida str. Pm70
MEKKIYFGTNLKMYKGNCETVDYLTQLLALREKLQSDYDIELFVIPSYIALKDAVHAAASETTHKILIGAQNMNAKDKGQFTGEISPLMLKELGVQLVMIGHSERRHVLKETDQEENEKVLSALKHGFKTLLCVGETLEQKNYQISDEVLRTQLKIGLHGVSVKQLPHLFIAYEPVWAIGEGGIPATAQYADEKQKIIKQCLFEMFGEESKKIPVLYGGSVNLENANELIMQPHIDGLFVGRSAWDAQCFYTLIDGALKALAGTTHQFSPIATQLIKHLGGKENISALTHCASRIRVMTRNENHINKVAIEKINGVSGLFSIANQYQIIVGPKWVEKIYSEMKALLETE

SEQ ID NO: 66672 - DNA, 759 bp, Lactococcus lactis subsp. lactis Il1403
  CDS (1)..(759): transl_table=11
atgtcacgtaaaccaattatcgctggtaactggaaaatgaacaaaactttgtcagaagcgcaagcttttgttgaagctgtaaaaaataacttgccttcatctgataatgttgaatcagttatcggtgcacctgcacttttcctcgctcctatggcttaccttcgtcaaggttcagaattgaaacttgctgctgaaaatagctactttgaaaatgctggagcgttcactggtgaaaatagtccagctgctatcgttgatttaggtgttgaatacatcatcatcggtcacagcgaacgtcgtgaatatttccacgaaactgacgaagacatcaacaaaaaagcaaaagcaatcttcgctgctggagcaactccaatcctttgttgtggtgaaactttggaaacttttgaagctggaaaaacagctgaatgggtttcaggtcaaatcgaagctggtcttgctggcttgagtgctgaacaagtttcaaacttggttattgcttatgaaccaatctgggcaatcggaactggtaaaactgcaacaaacgaaatcgctgatgaaacttgtggtgttgttcgttcaacagttgaaaaactttacggaaaagaagtttcagaagctgtacgtatccaatacggtggttcagttaaacctgaaacaatcgaaggattgatggctaaagaaaacatcgacggtgccctcgttggtggagcttcacttgaagctgatagcttccttgcattgcttgaaatgtacaaataa

SEQ ID NO: 66673 - protein, 252 aa, Lactococcus lactis subsp. lactis Il1403
MSRKPIIAGNWKMNKTLSEAQAFVEAVKNNLPSSDNVESVIGAPALFLAPMAYLRQGSELKLAAENSYFENAGAFTGENSPAAIVDLGVEYIIIGHSERREYFHETDEDINKKAKAIFAAGATPILCCGETLETFEAGKTAEWVSGQIEAGLAGLSAEQVSNLVIAYEPIWAIGTGKTATNEIADETCGVVRSTVEKLYGKEVSEAVRIQYGGSVKPETIEGLMAKENIDGALVGGASLEADSFLALLEMYK

SEQ ID NO: 66674 - DNA, 765 bp, Chlamydophila pneumoniae J138
  CDS (1)..(765): transl_table=11
atgacaaggcagagttatgttttgggcaattggaaaatgcacaaaacaatccaagaagctaaagagtatgttcaaacattagcttctttactacaaggagaacctctttcctgcactataggcatagcttctccatttacctctttgagagcgattcatgagatgataaacactacgggagcttttctctggttgggagcacaaaatgtccatcccgagctttcgggtgcttttactggagaaatttccttacctatgcttaaggaggtaggagtggaatttgttttagtaggtcactccgagcgtcgtcatatttttggagagagtgatgcccttattgcttcaaaggtaaagtctgtagctcaggcgggactcgtgcctgttctttgtgttggagagagcttagaagttcgtgaagagggaaaggcgcatcaggtaatcaaaaaacagttgcttttgggattggaacagatggataatggttccgaatttttgatcgcctatgaaccagtatgggctatcggcacagggaaggtggcagaagcttcggatgtgcaagatattcatatgttttgtcgtgaggtagtggcagagaggttctcagaagctacagctgaagagatttcgattttgtacggaggatctgtgaaggtcgataatgctcagcgatttgggcaatgtagcgacgtcgatggtcttttagttggcggagcttctttagaagggcaaagtttttttgaagtcgctaaaaattttaatgtataa

SEQ ID NO: 66675 - protein, 254 aa, Chlamydophila pneumoniae J138
MTRQSYVLGNWKMHKTIQEAKEYVQTLASLLQGEPLSCTIGIASPFTSLRAIHEMINTTGAFLWLGAQNVHPELSGAFTGEISLPMLKEVGVEFVLVGHSERRHIFGESDALIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGASLEGQSFFEVAKNFNV

SEQ ID NO: 66676 - DNA, 780 bp, Streptococcus pneumoniae R6
  CDS (1)..(780): transl_table=11
ttgaaaaaagaggtatgtgaaatgtcacgtaaaccatttatcgctggtaactggaaaatgaacaaaaatccagaagaagctaaagcattcgttgaagcagttgcatcaaaacttccttcatcagatcttgttgaagcaggtatcgctgctccagctcttgatttgacaactgttcttgctgttgcaaaaggctcaaaccttaaagttgctgctcaaaactgctactttgaaaatgcaggtgctttcactggtgaaactagcccacaagttttgaaagaaatcggtactgactacgttgttatcggtcactcagaacgccgtgactacttccatgaaactgacgaagatatcaacaaaaaagcaaaagcaatctttgcgaacggtatgcttccaatcatctgttgtggtgaatcacttgaaacttacgaagctggtaaagctgctgaattcgtaggtgctcaagtatctgctgcattggctggattgactgctgaacaagttgctgcctcagttatcgcttatgagccaatctgggctatcggtactggtaaatcagcttcacaagacgatgcacaaaaaatgtgtaaagttgttcgtgacgttgtagctgctgactttggtcaagaagtcgcagacaaagttcgtgttcaatacggtggttctgttaaacctgaaaatgttgcttcatacatggcttgcccagacgttgacggtgcccttgtaggtggtgcgtcacttgaagctgaaagcttcttggctttgcttgactttgtaaaataa

SEQ ID NO: 66677 - protein, 259 aa, Streptococcus pneumoniae R6
MKKEVCEMSRKPFIAGNWKMNKNPEEAKAFVEAVASKLPSSDLVEAGIAAPALDLTTVLAVAKGSNLKVAAQNCYFENAGAFTGETSPQVLKEIGTDYVVIGHSERRDYFHETDEDINKKAKAIFANGMLPIICCGESLETYEAGKAAEFVGAQVSAALAGLTAEQVAASVIAYEPIWAIGTGKSASQDDAQKMCKVVRDVVAADFGQEVADKVRVQYGGSVKPENVASYMACPDVDGALVGGASLEAESFLALLDFVK

SEQ ID NO: 66678 - DNA, 729 bp, Encephalitozoon cuniculi
  CDS (1)..(729): transl_table=11
atgaagggaaacaaacttcttgcaggaaactggaagatgagttcgtcgttacaaacttttgagataattaaaagcttccgagcgaatctctttgccggaaacgatacgtttattgccgttccgtttccttatattcatgtcgcgaagaagatgtttcctgagtacatcaaggttggagcgcaggattgcagtcagtttaaaagtggcccgtacacaggtgaagtctctgcatccatggtgagcgagatgggtgctgagtatgtgataatcggccattctgaaagacgtaggtggtttggagagacgtctgcgactgtagtaaaaaagattaggaatgctcggagtgagggcctgaagattgttgtgtgcattggggaagacgagaaatgcagggaggacggaaggcacttggatgtaataaaggaccagttactgtctctgggagaggagattgggggagaaggcattgacattgcatatgagcctgtatgggctataggaacggggaaggttcccaccaatgatcagatcagagaggtggtttctgggattaagagatggggtacgggcatggggtttgttgggcgtgtgatatatggggggtctgtctcgatgttgaactgccaaactatcctcgatgtagaggaaatagatggtttcttgattggcggaacctcgttgaaaatggacttttgtatgatttcaagtgagatgagtacgaagacgtga

SEQ ID NO: 66679 - protein, 242 aa, Encephalitozoon cuniculi
MKGNKLLAGNWKMSSSLQTFEIIKSFRANLFAGNDTFIAVPFPYIHVAKKMFPEYIKVGAQDCSQFKSGPYTGEVSASMVSEMGAEYVIIGHSERRRWFGETSATVVKKIRNARSEGLKIVVCIGEDEKCREDGRHLDVIKDQLLSLGEEIGGEGIDIAYEPVWAIGTGKVPTNDQIREVVSGIKRWGTGMGFVGRVIYGGSVSMLNCQTILDVEEIDGFLIGGTSLKMDFCMISSEMSTKT

SEQ ID NO: 66680 - DNA, 750 bp, Schizosaccharomyces pombe
  CDS (1)..(750)
atggcacgtaaattctttgtcggtggtaactttaagatgaatggctctttggagtccatgaagactattattgagggtttgaacaccaccaagcttaacgttggtgatgtcgaaactgtcatcttccctcaaaacatgtacctcatcaccacccgccaacaagtcaagaaggatattggcgttggtgcccaaaacgtcttcgacaagaagaacggtgcctacactggtgagaacagtgctcaatctttgattgatgctggtattacctacactttgactggtcactccgagcgtcgtaccatcttcaaggagtctgacgagttcgttgccgacaagaccaagtttgcccttgaacaaggtcttactgtcgttgcctgcattggtgagactttggccgagcgtgaggctaacgagaccatcaacgttgttgttcgtcaattgaacgccatcgctgacaaggtccagaactggtccaagattgtcattgcttatgagcctgtctgggccattggtactggtaagactgccacccctgagcaagctcaagaggttcacgctgagatccgcaagtgggctaccaacaagcttggtgcatctgttgccgagggtctccgtgtcatctacggtggttccgttaacggtggtaactgcaaggagttcctcaagttccacgatattgacggtttcttggttggcggtgcttctctcaagcctgaattccacaacattgttaatgttcacagcctttaa

SEQ ID NO: 66681 - protein, 249 aa, Schizosaccharomyces pombe
MARKFFVGGNFKMNGSLESMKTIIEGLNTTKLNVGDVETVIFPQNMYLITTRQQVKKDIGVGAQNVFDKKNGAYTGENSAQSLIDAGITYTLTGHSERRTIFKESDEFVADKTKFALEQGLTVVACIGETLAEREANETINVVVRQLNAIADKVQNWSKIVIAYEPVWAIGTGKTATPEQAQEVHAEIRKWATNKLGASVAEGLRVIYGGSVNGGNCKEFLKFHDIDGFLVGGASLKPEFHNIVNVHSL

SEQ ID NO: 66682 - DNA, 759 bp, Streptococcus pyogenes MGAS8232
  CDS (1)..(759): transl_table=11
atgtcacgtaaaccaattattgctggtaactggaaaatgaacaaaaaccctcaagaagcaaaagcattcgttgaggctgtagcaagcaaattaccttcaactgaccttgttgatgttgccgtagcagccccagctgttgatttggtaaccactattgaagctgctaaagattcagttcttaaagttgctgcacaaaactgctactttgaaaacacaggggcattcactggtgaaacatcaccaaaagtgcttgctgaaatgggagctgactatgttgtgattggtcactcagaacgccgtgattacttccatgaaacagatgaagacattaataaaaaagccaaagcaatctttgctaacggtttaactccaattatttgttgtggtgagtctcttgaaacttatgaagctggtaaagccgctgagtttgtaggtgcgcaagtttcagcagcacttgcaggtctttcagcagagcaagtagcttcacttgttttagcttatgagccaatctgggctatcggtactggtaaatcagctactcaagatgatgctcaaaacatgtgtaaagctgttcgtgacgtggtagcagcagactttgggcaagaagttgctgataaagttcgcgttcaatacggtggctctgtaaaacctgaaaatgttaaagattacatggcttgtccagatgttgacggtgcccttgtaggtggtgcatcacttgaagctgatagcttccttgctttgcttgatttccttaactaa

SEQ ID NO: 66683 - protein, 252 aa, Streptococcus pyogenes MGAS8232
MSRKPIIAGNWKMNKNPQEAKAFVEAVASKLPSTDLVDVAVAAPAVDLVTTIEAAKDSVLKVAAQNCYFENTGAFTGETSPKVLAEMGADYVVIGHSERRDYFHETDEDINKKAKAIFANGLTPIICCGESLETYEAGKAAEFVGAQVSAALAGLSAEQVASLVLAYEPIWAIGTGKSATQDDAQNMCKAVRDVVAADFGQEVADKVRVQYGGSVKPENVKDYMACPDVDGALVGGASLEADSFLALLDFLN

SEQ ID NO: 66684 - DNA, 747 bp, Danio rerio
  CDS (1)..(747)
atgtcctcaaggaaattcttcgtcggaggaaactggaaaatgaacggcgataaagagtctctgggcgagctcataatgaccttgaacacggccagtctcaacgataaaacagatgtagtttgtggagcaccgtccatctatttggattacgccaggtctaaactggaccagaggattggtgtggctgctcaaaactgctataaggtgcccaaaggagccttcaccggggagatcagcccagcgatgattaaagactgcggcatcgactgggtgattttgggccattctgagaggcgtcatgtttttggggagagcgatgagctgattggtcagaaggtggcccattgcctggagagcgatttgggcgtgatcgcctgcattggggagaaactggaggagagagaggctggaaccaccgaggacgtggtgtttgagcagaccaaagtcatcgcagacaatgtgaaggactggactcgtgtggtcttggcgtatgaaccagtatgggctattggcactggcaaaactgcctctcctgaacaggcgcaggaggtgcacgagaagctgagagaatggctgagagcgaacgtgtcggatgcagttgctgactctgtgcgcatcatctacggaggctctgttactgggggaaactgcaaagagctggcggcccaggctgacgttgatggcttcctggttggaggggcttcccttaaaccagagtttgtcgacatcatcaatgcccgctcgtag

SEQ ID NO: 66685 - protein, 248 aa, Danio rerio
MSSRKFFVGGNWKMNGDKESLGELIMTLNTASLNDKTDVVCGAPSIYLDYARSKLDQRIGVAAQNCYKVPKGAFTGEISPAMIKDCGIDWVILGHSERRHVFGESDELIGQKVAHCLESDLGVIACIGEKLEEREAGTTEDVVFEQTKVIADNVKDWTRVVLAYEPVWAIGTGKTASPEQAQEVHEKLREWLRANVSDAVADSVRIIYGGSVTGGNCKELAAQADVDGFLVGGASLKPEFVDIINARS

SEQ ID NO: 66686 - DNA, 744 bp, Drosophila melanogaster
  CDS (1)..(744)
atgagccgaaagttctgcgtgggaggcaactggaagatgaacggcgaccagaagtccatcgccgagatcgccaagaccctgagctcggccgccctcgaccccaacacggaggtggtcatcggctgcccggccatctacctgatgtacgcccgcaacctgctgccctgcgagctgggtctggccggccagaatgcctacaaggtggccaagggcgcattcaccggcgagatctcccctgcgatgctgaaggacatcggcgccgactgggtgatcctgggacactcggagcgtcgcgccatcttcggcgaatcggacgccctgatcgccgagaaggccgagcacgccctggccgagggcctcaaggtcatcgcctgcattggtgagaccctggaggagcgcgaggccggcaagaccaacgaggtggtggcccgccaaatgtgcgcctacgcccagaagatcaaggactggaagaacgtggtggtggcctacgagcccgtctgggccattggcaccggccagaccgccacacccgatcaggctcaagaggtccacgccttcctgcgccagtggctgagcgacaacatctccaaggaggtgtccgccagcctgcgcatccagtacggtggatccgtgaccgccgccaacgccaaggagctggccaagaagcccgacatagatggcttcctggtcggaggcgcctccctgaagcccgagttcgtggacatcatcaacgcccggcagtaa

SEQ ID NO: 66687 - protein, 247 aa, Drosophila melanogaster
MSRKFCVGGNWKMNGDQKSIAEIAKTLSSAALDPNTEVVIGCPAIYLMYARNLLPCELGLAGQNAYKVAKGAFTGEISPAMLKDIGADWVILGHSERRAIFGESDALIAEKAEHALAEGLKVIACIGETLEEREAGKTNEVVARQMCAYAQKIKDWKNVVVAYEPVWAIGTGQTATPDQAQEVHAFLRQWLSDNISKEVSASLRIQYGGSVTAANAKELAKKPDIDGFLVGGASLKPEFVDIINARQ

SEQ ID NO: 66688 - DNA, 693 bp, Prochlorococcus marinus subsp. pastoris str. CCMP1986
  CDS (1)..(693): transl_table=11
atgcacatgacttgtgctgacacaaaaaaatatttggaagaatttcttcctcttattgaagaaattcctaatgacagaaaaatagtaattgctcctccctttacagctatttctactttttctaattatacaaactttgattatttaaatattgcaagtcaaaatatccattgggaagataaaggtgcttttactgcagaaatctcccccaatatgcttattgaacacaaagtaaaatatgcaattgttggtcatagtgaacctcggaaatactttagtgaaagtgatgaacaaattaataaaagagctgtctttgctcaatcaagtggactaactccaatagtttgtgtcggtgaaactcttgaacaaagagaaagaggtgaagccgatagggtcatcaccagacaagttgaacagggattagagaatactgatccatctaatcttatagttgcttatgaacctatatgggcaattggtacaggtaaaacttgtgaagcaagtgacgcaaacaagatatgtgctttgataaggagtttgattggttttagtgacgtaatcatccaatatggaggttctgttaaaccaaataatattgatgagatcatgtcaatgagtgatattgatggtgtcttggtaggtggttcttctttagatcctataagtttttcaagaattgcaaatttcgaataa

SEQ ID NO: 66689 - protein, 230 aa, Prochlorococcus marinus subsp. pastoris str. CCMP1986
MHMTCADTKKYLEEFLPLIEEIPNDRKIVIAPPFTAISTFSNYTNFDYLNIASQNIHWEDKGAFTAEISPNMLIEHKVKYAIVGHSEPRKYFSESDEQINKRAVFAQSSGLTPIVCVGETLEQRERGEADRVITRQVEQGLENTDPSNLIVAYEPIWAIGTGKTCEASDANKICALIRSLIGFSDVIIQYGGSVKPNNIDEIMSMSDIDGVLVGGSSLDPISFSRIANFE

SEQ ID NO: 66690 - DNA, 768 bp, Oryza sativa (japonica cultivar-group)
  CDS (1)..(768)
atggctgccaggaagttcttcgtcggcggcaactggaaatgcaatgggacaggggaggacgtgaagaagatcgtcaccgtcctcaacgaggccgaggtgccctccgaggacgtcgtcgaggtggtggtgagcccgccgttcgtgttcctgccgcaggtgaagggtttgctccggccggacttctccgtcgccgcgcagaattgctgggtgcgcaagggcggcgccttcactggcgagatcagtgccgagatgttggtgaacctgcaggtgccttgggtgattctgggacactctgagcggagagcgctgatgggcgaatcaagtgattttgttgctgacaaaattgcgtacgcactttcccaaggtatcaaggtaattgcttgcattggtgagacccttgaacagagagaagcaggaacaacgatggaagttgttgcagcgcaaactaaagctattgcagagaagatatccgattggaccaatgttgttttggcatatgaaccagtttgggccattggaaccggcaaggttgcaacccctgctcaggctcaggaggttcatgatggtctgagaaagtggcttgtgactaatgttagtcctgcagttgctgaatcaaccaggattatttacagaggctccgtaaatggagcaaactgcaaagaacttgctgctaaacctgatgttgatggattccttgttggaggagcttcattgaagcctgaatttgtggacatcatcaagtctgctaccgtcaagtcttctgcttag

SEQ ID NO: 66691 - protein, 255 aa, Oryza sativa (japonica cultivar-group)
MAARKFFVGGNWKCNGTGEDVKKIVTVLNEAEVPSEDVVEVVVSPPFVFLPQVKGLLRPDFSVAAQNCWVRKGGAFTGEISAEMLVNLQVPWVILGHSERRALMGESSDFVADKIAYALSQGIKVIACIGETLEQREAGTTMEVVAAQTKAIAEKISDWTNVVLAYEPVWAIGTGKVATPAQAQEVHDGLRKWLVTNVSPAVAESTRIIYRGSVNGANCKELAAKPDVDGFLVGGASLKPEFVDIIKSATVKSSA

SEQ ID NO: 66692 - DNA, 783 bp, Corynebacterium diphtheriae NCTC 13129
  CDS (1)..(783): transl_table=11
atggcacgtactccacttatcgcaggaaactggaagatgaatcttgatcatcttcaagctgttgcaactgtgcaaaaacttgcttttgcacttccaaaggaatactacgaaaaagtcgacgtagctgtcaccgtaccttttactgatcttcgctctgttcaaacacttatcgaaggcgataagctcgctataacttatggtgctcaagatgtttcgcagcacgaggctggtgcctacactggtgaaatctctgcccagatgcttgccaaactcggatgtacttgggttgttgttgggcactcagagcgtcgtgagtaccatggcgaatcttcggagcttgttgcagtcaaagctaaagctgcgttgaaccaaggaattagccccatcgtttgtgttggagagccccttgaaattcgtgaagctggaacacacgtagaatatgtcgtcgaacagactcgcgcatcgttggcgggtcttactgcagatgatttggcaaagactgttatcgcctacgaacccgtatgggctattggtacgggtaaagtagcatccgctgccgatgcacaggaagtctgcgcagcaattcgtaacctcatcattgagcttgctggtaaagaagtagctgaagggcttcgcattctttatggcggatcagttaaagcagaaacagtagccgagatcgtaggtcaaccggatgttgatggcggcttagtgggtggcgcttctcttgacggtgaagcattcgccaaactagcagctaatgcagcaactgttgtcgactag

SEQ ID NO: 66693 - protein, 260 aa, Corynebacterium diphtheriae NCTC 13129
MARTPLIAGNWKMNLDHLQAVATVQKLAFALPKEYYEKVDVAVTVPFTDLRSVQTLIEGDKLAITYGAQDVSQHEAGAYTGEISAQMLAKLGCTWVVVGHSERREYHGESSELVAVKAKAALNQGISPIVCVGEPLEIREAGTHVEYVVEQTRASLAGLTADDLAKTVIAYEPVWAIGTGKVASAADAQEVCAAIRNLIIELAGKEVAEGLRILYGGSVKAETVAEIVGQPDVDGGLVGGASLDGEAFAKLAANAATVVD

SEQ ID NO: 66694 - DNA, 837 bp, Rhodopseudomonas palustris CGA009
  CDS (1)..(837): transl_table=11
ttgagtctcgcaatcggctctgctagcggaacgcttcaaccctttattgcgagagtgctcatgccggtccccgccgttcgtcctctgattgctggaaactggaagatgaacggcctgaaggattcggtggccgagctcgatgcgatgctgaaaggcgccgcggaactgccgcagggcatcgatctgttggtctgcccgccggcgacgctggtggcgagcttcgcggcgcgagtcgcggaagcccaggccggcaaggcactgccgttctcgatcggcggccaggattgccacgccaacgcctctggcgcccacaccggcgatatcgccgccgagatgctggccgatgccggcgctgcggcaatcatcgtcggccattccgaacgccgcgccgaccatgccgaaaacgacgcgatcgtccgcgccaaggcgcaggcggtgtggcgcgccgggctggtggcgatcgtctgcgtcggcgagactcagggcgagcgcgacgctggccacaccctcgatgtggtcgccggcatgttggccggctcgctgccggacggcgcgaccgcggcgaatctggtggtggcttacgagccggtctgggcgatcggcacgggacggaccccgaccgcggccgatgtcgaggaagttcatggctttattcgcaagactttgagcgatcggttcggcgctgcgggcgagacgatgcgaatcctctacggcggctcggtgaagccctcgaacgcccgcgaattgctggcggtgccgcacgtcaacggcgcgctgatcggcggcgccagcctgaaggcgtccgatttccttgcgattgcggcgggctgcccctaa

SEQ ID NO: 66695 - protein, 278 aa, Rhodopseudomonas palustris CGA009
MSLAIGSASGTLQPFIARVLMPVPAVRPLIAGNWKMNGLKDSVAELDAMLKGAAELPQGIDLLVCPPATLVASFAARVAEAQAGKALPFSIGGQDCHANASGAHTGDIAAEMLADAGAAAIIVGHSERRADHAENDAIVRAKAQAVWRAGLVAIVCVGETQGERDAGHTLDVVAGMLAGSLPDGATAANLVVAYEPVWAIGTGRTPTAADVEEVHGFIRKTLSDRFGAAGETMRILYGGSVKPSNARELLAVPHVNGALIGGASLKASDFLAIAAGCP

SEQ ID NO: 66696 - DNA, 825 bp, Onion yellows phytoplasma OY-M
  CDS (1)..(825): transl_table=11
atgaattacaaaccaagaacaaaagtgattgcaggtaattggaaaatgtacaaatgcaaagacgaagccctggaattcatccaaaaagtaagcttgcaagttcctgaccaaacccaagtccaaactttaattttcccccaacttaccttattagattccttagcacaactccaaggcactaatttacaagtaggggcccaaaatatgttttatgaatccgaaggcgcttttactggcgaagtttcaccacaaaatttgctttcattaggtgtcaagcacgttttattaggacacagcgaaagaagaactttttttggagaaaccgatcaaacagttaatctaaaacttttatcagctctcaaacacaaattagttcctactgtttgtgtgggcgaatcgcttcttaccaaggaaaataaccaaacccaagtttttttagaccaacaattaaccaacatttttgcaggtgttccagaagaagcattacaaaacatcatcatcgcttatgaaccggtttgggcaattggtacaggcaaaagtgcaactccccaagatgctaacaaagtcattgaacaaatcagagacaaagtcactgcactttattcttcccaagcatcttgtgccatgagaattatttacggcggttcagtgtctgttgccaacattaaaaccattttagaacaacccgctattgatggcattttagcaggaaaagcttccctccaaactgaggattttttattttttgctcaaatagcaagcaaacaagccttagcttccactaaagatatttttcaaaaaaatgattgtcctttttgctgttaa

SEQ ID NO: 66697 - protein, 274 aa, Onion yellows phytoplasma OY-M
MNYKPRTKVIAGNWKMYKCKDEALEFIQKVSLQVPDQTQVQTLIFPQLTLLDSLAQLQGTNLQVGAQNMFYESEGAFTGEVSPQNLLSLGVKHVLLGHSERRTFFGETDQTVNLKLLSALKHKLVPTVCVGESLLTKENNQTQVFLDQQLTNIFAGVPEEALQNIIIAYEPVWAIGTGKSATPQDANKVIEQIRDKVTALYSSQASCAMRIIYGGSVSVANIKTILEQPAIDGILAGKASLQTEDFLFFAQIASKQALASTKDIFQKNDCPFCC

SEQ ID NO: 66698 - DNA, 1965 bp, Geobacter sulfurreducens PCA
  CDS (1)..(1965): transl_table=11
atggcaatccgctatattgacgaaatatccgaactcaaagacaaaaaggtcttcatcagggtcgacttcaacgttcccttggatgaacatcagaacatcactgaagacacgcgcatcagggcggtcctccctacgatcaactttgccctcgatgccggcgcgaaagtggttctcgcctctcacctgggacgcccaaagggagagcgcaagcccaagtattccatggccccggcggcaaagcgtctctcgcggcttctgggcaaagaggtactcttggcgcccgactgcatcggcagcgaagtacggcagatgatcgatgccatgaaatccggcgacatcatcatgctggaaaacgtgcgcttttatgaaggtgaggagaaaaatgacgaaaactttgcccgagaactggccaacggctgtgagatctacgtaaacgatgcctttgccgtctcacaccgggctcatgcgtcggttgaagcgataacaaagttctttccggtagttgcggccggatttctcatgaagaacgagatgaattatttcgaaaaggcgatgcaaaagccgattcgccccctggtcgctatcttgggcggggccaaagtctcgggcaaactggaagttctcgaaagccttctcaacaaggtggacaaaatcatcatcggcggcggcatggcattcacctttctgaaggccctcggctacaacgtgggcaagtcgctggtggaggaagacctgatcgaaacggcccgctcaacctacgccaaagcccgtgaaaagggaatcaagttctatctccccgttgattgcgtggctgccgatcgattcaaccccgaggccgagaccaaggtaaccaccattcaggaaatccccgaagagtggatggctctcgatatcggtcctgccacggttgccctcttcaccgaggcactccagagcgccaagaccatcatctggaacggtcccatgggggttttcgagatggatgccttctcccgcggcacctttgccatggtgactgccgtggccaactcctacgcccttaccatcgtcggcggcggcgacaccgactctgcggtccaccgcgccggcgaatatgccaagatcagctacatctccaccggcggcggcgctttccttgagctcctcgaaggcaagaaacttccccggcatcaaggtgctggaagaaaacggaaaataggaggagcggccatgagaacacctgtgattgcaggaaactggaagctgttcaaaaaacgcgccgaggcccgtgagctggtcaatggacttgtttccctggtgaaggacgtccagggggtcgaaatcgtcgtagctccggtcttcaccgtactggccgccgtaaagggcgccctggacggctcagccatcaagctcgctggccaggactgcttctgggaagaggaaggggcttacaccggcgagatttccccgggcatgctcgtggatgccggatgcagccacgtcattatcggccattcggagcgccgtcagtatttcggcgaaactgatgaaaccgtgaatcgtaagatcaaggccgccctcaaagcaggactcgcggccattgcctgcatcggagaatccctggcagagcgcgaagcaggcacgacgttcgacgtgctgcggacgcagctgaacggcggactggccgggctatccgccgacgacctcaaagacgtcatcatcgcctatgagccggtatgggccataggcaccggaaaaaccgccacggacgcccaagcccaggaggctcacgccttcatcagaggggtggtgtccgaacttctcggcaaaccggcagcagaggcggttcgcatcctttacgggggcagcgtaaagccagagaacatcaaggggctcatgacccaacccgatatcgacggcgccctggtgggaggagccagcctcaaggcggactcttttgcggcgattgcctcgttcagcatgtaa

SEQ ID NO: 66699 - protein, 654 aa, Geobacter sulfurreducens PCA
MAIRYIDEISELKDKKVFIRVDFNVPLDEHQNITEDTRIRAVLPTINFALDAGAKVVLASHLGRPKGERKPKYSMAPAAKRLSRLLGKEVLLAPDCIGSEVRQMIDAMKSGDIIMLENVRFYEGEEKNDENFARELANGCEIYVNDAFAVSHRAHASVEAITKFFPVVAAGFLMKNEMNYFEKAMQKPIRPLVAILGGAKVSGKLEVLESLLNKVDKIIIGGGMAFTFLKALGYNVGKSLVEEDLIETARSTYAKAREKGIKFYLPVDCVAADRFNPEAETKVTTIQEIPEEWMALDIGPATVALFTEALQSAKTIIWNGPMGVFEMDAFSRGTFAMVTAVANSYALTIVGGGDTDSAVHRAGEYAKISYISTGGGAFLELLEGKKLPRHQGAGRKRKIGGAAMRTPVIAGNWKLFKKRAEARELVNGLVSLVKDVQGVEIVVAPVFTVLAAVKGALDGSAIKLAGQDCFWEEEGAYTGEISPGMLVDAGCSHVIIGHSERRQYFGETDETVNRKIKAALKAGLAAIACIGESLAEREAGTTFDVLRTQLNGGLAGLSADDLKDVIIAYEPVWAIGTGKTATDAQAQEAHAFIRGVVSELLGKPAAEAVRILYGGSVKPENIKGLMTQPDIDGALVGGASLKADSFAAIASFSM

SEQ ID NO: 66700 - DNA, 786 bp, Mycobacterium avium subsp. paratuberculosis str. k10
  CDS (1)..(786): transl_table=11
gtgagccgcaagccgctgatcgccggcaactggaagatgaacctcaaccacttcgaggccatcgcgctggtgcaaaagatcgcgttcgcgctgccggacaagtactacgacaaggtggacgtcacggtgctgccgccgttcaccgacctgcgcagcgtgcagaccctggtcgacggcgacaagctgcggctcagctacggcgcccaggacctgtcccagcacgactcgggcgcctacaccggcgacatcagcggcgccttcctggccaagctgggctgcacgttcgtcgtcgtcgggcactcggagcggcgcacctaccacaacgaggacgacgcgctggtggccgccaaggccgcgaccgcgctcaagcacgagctgaccccgatcatctgcattggcgagcacctcgaggtccgcgaggcgggcaaccacgtcatccactgcgaggagcagctgcgcggctcgctggccgggctgtccgccgagcagatcggcaaggtcgtcatcgcctacgagccggtgtgggcgattggaaccggacgggtggccagtgcgtccgatgctcaagaggtgtgcgcggcgatccggaaagagttggcgtcactcgcctcggcgcagatcgccgactcggtgcgggtgctctacggcggctcggtgaacgcgaagaacgtcggggagctgatcgcccaggacgacatcgacggcggcctggtgggcggcgcgtcgctggacggcgagcagttcgccacgctggccgccatcgccgccggcgggccgctgccgtga

SEQ ID NO: 66701 - protein, 261 aa, Mycobacterium avium subsp. paratuberculosis str. k10
MSRKPLIAGNWKMNLNHFEAIALVQKIAFALPDKYYDKVDVTVLPPFTDLRSVQTLVDGDKLRLSYGAQDLSQHDSGAYTGDISGAFLAKLGCTFVVVGHSERRTYHNEDDALVAAKAATALKHELTPIICIGEHLEVREAGNHVIHCEEQLRGSLAGLSAEQIGKVVIAYEPVWAIGTGRVASASDAQEVCAAIRKELASLASAQIADSVRVLYGGSVNAKNVGELIAQDDIDGGLVGGASLDGEQFATLAAIAAGGPLP

SEQ ID NO: 66702 - DNA, 756 bp, Lactobacillus johnsonii NCC 533
  CDS (1)..(756): transl_table=11
atgcgtacaccaattattgctggtaactggaaattacacatgaaccctgaacaaaccattgaatttgttaatgcagttaagggtaagttgccagatccaagtaaagttgaatcagttattgctgcacctgcagttgatctttatgttttaaagaagactgctgaaggctcaaacttacatactggtgcagaaaatgcatactttgaagttgaaggtgcctttactggtgaaacttcacctaaagttttgaatgaaatgggtattgactactgtattattggtcactcagaacgtcgtggttacttccacgaaactgatgaagacattaacaagaaagctaaggctttatttgctaatggcgtaactccaatcatttgctgtggtgaatctcttgaaactcgtgaagctaacaagcaagatgaatgggtagtagctcaaattaaagctgctttagatggcttaactgcagaacaagtttctaaacttgttattgcttacgaaccaatttgggctatcggtactggtaagactgcttctgctgatcaagctgaagaaatgtgcaagactattcgtgaaactgtaaaagacttgtacaatgaagaaactgctgaaaacgttcgtatccaatacggtggttcagtaaaaccagctaacgtaaaagaattaatgtctaagcctgacattgatggtggtttagttggtggtgcttctcttgatccagaatcattcttagcattggtaaactaccaagattaa

SEQ ID NO: 66703 - protein, 251 aa, Lactobacillus johnsonii NCC 533
MRTPIIAGNWKLHMNPEQTIEFVNAVKGKLPDPSKVESVIAAPAVDLYVLKKTAEGSNLHTGAENAYFEVEGAFTGETSPKVLNEMGIDYCIIGHSERRGYFHETDEDINKKAKALFANGVTPIICCGESLETREANKQDEWVVAQIKAALDGLTAEQVSKLVIAYEPIWAIGTGKTASADQAEEMCKTIRETVKDLYNEETAENVRIQYGGSVKPANVKELMSKPDIDGGLVGGASLDPESFLALVNYQD

SEQ ID NO: 66704 - DNA, 729 bp, Wolbachia endosymbiont of Drosophila melanogaster
  CDS (1)..(729): transl_table=11
atgtcctttttaatagtagcaaattggaaaatgaatggaatgcgttcttcatttgttgactttataggcaaacttaacaacaagagcaacgaaattacctctaagctagtgatttgccctccttttacgtcatttccaagcagtatagagttgaacaataatattgatataggagcacagaattgccatcataaaaagttcggttcttacacaggtgaaattagtgcagaaatgttaaaagaactagggtgtacttacgtaatgcttgggcattctgaaagggctaatgaaaaagatagtgaaataaaacttaagtcggaaatagcaatagaatcaggcttacacccaattatctgtgtgggtgaaaattcagaagattataagaatgaaaaaacaaaagaagtaatagaatatcaatgcaaaaaccgtttgccaacacacggtgaatataccgtagcatatgagccaatatgggcaataggcacaggtcatgtgccaaataatgatgcaattgctaaggtgatagaggtaataaaattgtgtactagtaaaaaacacattatatatggtggttcagtcagttcagaaaatatagaaaatttgctcagtatctcaaatttatcaggagttttaattggcagtgcaagcttagatttcgatcacttttataaaattatacaacaagttgaaaaaaagttttctcttatcaattctaaaatcagcaactaa

SEQ ID NO: 66705 - protein, 242 aa, Wolbachia endosymbiont of Drosophila melanogaster
MSFLIVANWKMNGMRSSFVDFIGKLNNKSNEITSKLVICPPFTSFPSSIELNNNIDIGAQNCHHKKFGSYTGEISAEMLKELGCTYVMLGHSERANEKDSEIKLKSEIAIESGLHPIICVGENSEDYKNEKTKEVIEYQCKNRLPTHGEYTVAYEPIWAIGTGHVPNNDAIAKVIEVIKLCTSKKHIIYGGSVSSENIENLLSISNLSGVLIGSASLDFDHFYKIIQQVEKKFSLINSKISN

SEQ ID NO: 66706 - DNA, 726 bp, Bdellovibrio bacteriovorus HD100
  CDS (1)..(726): transl_table=11
atgaaaaagatttttgctgctaactggaagctttttaaatctccaaaagaaacgcgtgagttttttggtcagttcaaagaactggcggggaaagcaacgggggaagtggtctttttcccttcagcgatttctttggaagcagccagtgaatctttgaaaggtacaagcatcaagtttggcgctcagaactgttacttccaggcacaaggggctttcacgggtgaaaactcggctcaggtggttaaagatctggggggcagctatgtattgatcggtcacagcgaacgccgtgcgatctttggtgaaggtgatgcgcttgtggcagacaaagtggctttcgttcaaggtctgggcctgacgccgatgttgtgcatcggtgaaaccctgcaagaacgcgaatccgcgaagaccttccgtgttctggaaactcagctaaatctgggtttggcgaaggccgacaaaaccaagccagtggttgttgcctatgagccggtttgggcgatcgggacggggaaagtggcgacaccagagcaggtggcagaaactcacacagacgttttcaatattctaaaagcactgggttttgaaacggcaccgattctttatggtggcagcgtaaaaccggacaatgccgctggtttgatcaaacaaccgcatgtgaatggtttcctggttgggggagcttctttggaagcaaagtccttcagcgagattgcttccgtttag

SEQ ID NO: 66707 - protein, 241 aa, Bdellovibrio bacteriovorus HD100
MKKIFAANWKLFKSPKETREFFGQFKELAGKATGEVVFFPSAISLEAASESLKGTSIKFGAQNCYFQAQGAFTGENSAQVVKDLGGSYVLIGHSERRAIFGEGDALVADKVAFVQGLGLTPMLCIGETLQERESAKTFRVLETQLNLGLAKADKTKPVVVAYEPVWAIGTGKVATPEQVAETHTDVFNILKALGFETAPILYGGSVKPDNAAGLIKQPHVNGFLVGGASLEAKSFSEIASV

SEQ ID NO: 66708 - DNA, 753 bp, Treponema denticola ATCC 35405
  CDS (1)..(753): transl_table=11
gtgaaaaagttttacattgcggcaaattggaagatgaatatgaatagggctgaggccaagcagcttgcaacagaaatgaaggccggcctaaaagacggaaaaaataagtacatgatagctccttcatttactcttctgcaagatgttgcgtccgtgcttaaaggctccaatatcttgctgggtgctcaaaatatgggattggaagaaaagggcgctcataccggggaggtttccgttcttcagcttttggatgtaggtgttcaagccgtaattttaggccattccgaaagaaggcatatatacaaggaaacagatgaccttatcaataaaaaggtaaaacttgcattaaaacacggtcttgaagttatcctctgtgtgggagagcttctcgaagagcgtgaagccggccatgccgaagccgtatgcgaaaggcagattaaaaaaggacttgctgaggtttctgcaaaagatttggataaggtaacgattgcttatgagcctgtttgggcaataggaacgggaaaaaatgcgagccctgaggatgctgatgccatccattcttcaataaggaagaccttagccgctctttacggagaaaaagctgctaaaaatatgataatccagtacggaggctctatgaaacctgaaaatgccgccggtcttttaaaaaagcacaatattgacggaggcctaataggcggagccggtcttaaaacggaaacatttttgcctatagccttgttttccgagtag

SEQ ID NO: 66709 - protein, 250 aa, Treponema denticola ATCC 35405
MKKFYIAANWKMNMNRAEAKQLATEMKAGLKDGKNKYMIAPSFTLLQDVASVLKGSNILLGAQNMGLEEKGAHTGEVSVLQLLDVGVQAVILGHSERRHIYKETDDLINKKVKLALKHGLEVILCVGELLEEREAGHAEAVCERQIKKGLAEVSAKDLDKVTIAYEPVWAIGTGKNASPEDADAIHSSIRKTLAALYGEKAAKNMIIQYGGSMKPENAAGLLKKHNIDGGLIGGAGLKTETFLPIALFSE

SEQ ID NO: 66710 - DNA, 747 bp, Mycoplasma mycoides subsp. mycoides SC str. PG1
  CDS (1)..(747): transl_table=4
atgaaaaaaaaggtaatttttggtaattgaaaaatgaatgggactaatgaaagtttgacagattttttaaaccaagtagataataaaatagatagttcaaaaattatagctggattagctgtaccttatgtaatgttacaaactggactaaaacttgcaaaaaatgttaaaatagctgctcaaaacgtacattataaagataagggtgcttatactggagaaatttcaactacaatgctaaaagaagttggagttgaatatgtaattattggacattctgaaagaagagaaatgtttaatgaaactgatttagatgttaataaaaaggctaaagttttattagaaaacaatataactccaattatttgttgtggtgaaactttacaaactaaagaaagtggaaaaactattgaatttgtaaataatcaaattaatataatgtttgaaggtattaaaaaagaagatgcaatcaaagcaattattgcttatgaaccaatttgagcaattggtactggaaaaacagcaacaagtagtgatgctgaagaagtatgtaaacaaatcagaaataatttatcaaaaatttatgataaaaatacagctgaacaaattattattcagtatggtggaagtgttaaaccatcaaatattcaagaatatttaaaaatgccaaatattgatggagctttagttgggggagcttctttattagctagtgattatttaggtttagttaactataatgaataa

SEQ ID NO: 66711 - protein, 248 aa, Mycoplasma mycoides subsp. mycoides SC str. PG1
MKKKVIFGNWKMNGTNESLTDFLNQVDNKIDSSKIIAGLAVPYVMLQTGLKLAKNVKIAAQNVHYKDKGAYTGEISTTMLKEVGVEYVIIGHSERREMFNETDLDVNKKAKVLLENNITPIICCGETLQTKESGKTIEFVNNQINIMFEGIKKEDAIKAIIAYEPIWAIGTGKTATSSDAEEVCKQIRNNLSKIYDKNTAEQIIIQYGGSVKPSNIQEYLKMPNIDGALVGGASLLASDYLGLVNYNE

SEQ ID NO: 66712 - DNA, 756 bp, Bacillus cereus ATCC 10987
  CDS (1)..(756): transl_table=11
atgcgtaaaccaattatcgcaggtaactggaaaatgaataaaactctatctgaagcagttagcttcgtagaggaagttaaaggtcaaatcccagcagcttcagctgttgatgcagtagtttgctctccagctctattcttagagcgccttgtagcagcgactgaaggaactgatttacaagtaggtgcacaaaacatgcacttcgaaaaaaatggtgcattcactggcgaaattagcccagtagcacttagcgacttaaaagtaggctacgtagtacttggccactctgagcgtcgtgaaatgtttgctgaaacagatgagtcagtaaacaaaaagactatcgcagcatttgaacatggtttaacaccaatcgtatgttgtggtgagactttagaagagcgcgaaagcggaaaaacatttgatctagtagcaggtcaagtgacaaaagcacttgcaggtttaactgaagagcaagttaaagcaactgttatcgcttatgagccaatctgggctatcggtacaggtaaatcttcttcttctgcagacgcaaacgaagtatgtgcgcacatccgtaaagttgttgcagaggctgtttctccagctgctgcagaagctgttcgtattcaatacggcggtagcgtaaaaccagaaaacattaaagagtacatggcacaatctgacatcgacggcgctttagttggcggtgctagcttagagcctgcttcgttcttaggtcttctggaggcggtaaaatga

SEQ ID NO: 66713 - protein, 251 aa, Bacillus cereus ATCC 10987
MRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEAVSPAAAEAVRIQYGGSVKPENIKEYMAQSDIDGALVGGASLEPASFLGLLEAVK

SEQ ID NO: 66714 - DNA, 795 bp, Anopheles gambiae str. PEST
  CDS (1)..(795)
atggtgcattttcaacccccaccgtctgtctactcaccgaaagcatcagccatgggccgtaagttctgcgttggaggcaactggaagatgaatggcgacaaggccagcatcaccgagctgtgcaaaacgctgtccgccggtccgctcgatcccaacaccgaggtggtggtgggctgccccgccccctacctgtcgctggcccgctcgctgctgccggaaacgatcggagtggccgcccagaactgctacaaggtggcgaagggtgcgttcaccggcgagatctcgcccgccatgctgaaggatcttggccttggctgggtcatcctcggtcactcggagcgacgcgccatcttcggcgagaccgacgagctgattgcggagaaggtcgcacacgcccttgccgaggggctgaaggtcatcgcttgcatcggcgagacgctgcaggagcgtgaggccggccagacggaggccgtttgcttccggcagacgaaggccatcgccgcccaggtcaaggactggagcaatgtggtgatcgcgtacgagccagtgtgggccatcggcaccggcaagacggccaccccggaacaggcgcaggaagtgcacgccgcgctgcgcaagtggttcaccgagaacgtgtccgccgacgtgtcgaacgccatccgcatccagtacggcggttcggtgacggcggccaactgccgtgagctcgcggccaagcccgacattgacggattcctggtcggcggtgcctcgctgaagccggagttcatccagatcgtcaacgccagacagtag

SEQ ID NO: 66715 - protein, 264 aa, Anopheles gambiae str. PEST
MVHFQPPPSVYSPKASAMGRKFCVGGNWKMNGDKASITELCKTLSAGPLDPNTEVVVGCPAPYLSLARSLLPETIGVAAQNCYKVAKGAFTGEISPAMLKDLGLGWVILGHSERRAIFGETDELIAEKVAHALAEGLKVIACIGETLQEREAGQTEAVCFRQTKAIAAQVKDWSNVVIAYEPVWAIGTGKTATPEQAQEVHAALRKWFTENVSADVSNAIRIQYGGSVTAANCRELAAKPDIDGFLVGGASLKPEFIQIVNARQ

SEQ ID NO: 66716 - DNA, 744 bp, Gibberella zeae PH-1
  CDS (1)..(744)
atggctcgcaagttcttcgtcggcggcaacttcaagatgaacggctccaagtcgtccatcaaggagattgtcgagaacctcaacaacgctgaccttgacaagaacgctgaggtcgttgtctcccctcctgccctctacctcccccttgtccgcgagactctccgcaaggaaatcgaggttgccgcccagaacgtctacgacaagcccaacggtgctttcactggcgagatctccgtctcccagctcaaggatagcgatatcaactgggctatcctcggccactctgagcgtcgaaccatcatcggcgagtctgatgaggtcatctcctccaagaccaagtacgccaccgagaacggcctcaaggtcatctggtgctgcggcgagtccctcgagacccgtgaggctggcaagaccattgagttcgtctctgcccagatcgagtctctcaagtctcagatctccgactggtccaacattgtcatcgcctacgagcccatctgggccattggcactggcaaggttgctaccactgagcaggcccaggaggtccacaaggccatccgtgacctcctccgcagcatcagcgacaaggttgctgatgagacccgcatcctttacggaggcagtgtcaacgagaagaactgcggcgagctctccaagcaggccgacattgacggtttcctcgttggcggtgcttctctcaagcctgctttcgtcgacatcatcaacgctaccaagcagtaa

SEQ ID NO: 66717 - protein, 247 aa, Gibberella zeae PH-1
MARKFFVGGNFKMNGSKSSIKEIVENLNNADLDKNAEVVVSPPALYLPLVRETLRKEIEVAAQNVYDKPNGAFTGEISVSQLKDSDINWAILGHSERRTIIGESDEVISSKTKYATENGLKVIWCCGESLETREAGKTIEFVSAQIESLKSQISDWSNIVIAYEPIWAIGTGKVATTEQAQEVHKAIRDLLRSISDKVADETRILYGGSVNEKNCGELSKQADIDGFLVGGASLKPAFVDIINATKQ

SEQ ID NO: 66718 - DNA, 747 bp, Ustilago maydis 521
  CDS (1)..(747)
atggctcgcactttcttcgtcggtggtaactggaagatgaacggctcgcttgagtcaaccaagcagctcacccagactttgacacaggccaagctcgactccaatgttgaggttgtcgtatctccgcctgcgcttcacctgcttgccgtccaggagcagctcaagggctccaaggtagccgtggcggcgcagaacgcctaccacaagccaagtggagcgttcactggcgaggtctcagttaccatgctgaaggacgccggtatcccctgggtcatccttggtcactcggagcgacgaactcttttccacgaatctgacgccaacgttgccgaaaagactgcggccgctctcgccgaaaacctctcggtgatcctctgcatcggtgagacgcttgagcaacgcgaagccaacgagacggtcaacgtcgtcgttcgtcaactcgatgctgtcgctgaccacgtcaaggattggtccaagatcgtcgtcgcgtacgagccggtttgggccatcggaacgggcaaggtggccacctcggaacaggctcaggaggttcacgctgcgatccgcaagtgggccactgaaaagctcggcaaggacaccgccgaccagctcagaatcatctacggcggctcggtcgctgctaagaactgcaaggagctcgctcagcgacccgacatcgacggcttcctcgtcggcggcgcttctctcaagcccgaattcgtcgatatcgtcaacgctaacgcttga

SEQ ID NO: 66719 - protein, 248 aa, Ustilago maydis 521
MARTFFVGGNWKMNGSLESTKQLTQTLTQAKLDSNVEVVVSPPALHLLAVQEQLKGSKVAVAAQNAYHKPSGAFTGEVSVTMLKDAGIPWVILGHSERRTLFHESDANVAEKTAAALAENLSVILCIGETLEQREANETVNVVVRQLDAVADHVKDWSKIVVAYEPVWAIGTGKVATSEQAQEVHAAIRKWATEKLGKDTADQLRIIYGGSVAAKNCKELAQRPDIDGFLVGGASLKPEFVDIVNANA

SEQ ID NO: 66720 - DNA, 774 bp, Kluyveromyces lactis NRRL Y-1140
  CDS (1)..(774)
atgcacacacataactcacatacaatcatggctagaacattcttcattggtggtaacttcaagatgaacggaagcaaggcttccatcaaggaaatcgttgacagattgaatggagcttccatcccatctaacgtcgaagtggttatcgctccaccagctatctacttggaccacgctgttgcattaaacaagagaaaggaagttaaaatctctgctcaaaatgcatactccaaggcttccggtgcttacactggtgaaaactccgttgaacaaatcaaggatgtcggtgctgaatgggttatcttgggtcactctgaaagaagaacttacttcaacgaaactgatgaaatcgtcgccgaaaaaaccaaatttgctttggacagcggtgtcaaggttatcctatgtatcggtgaaactttggaagaaaagcaacaaaacatcactctacaagtcgtccaaagacaattgcaagccgtattggaaaaggttcaagactggactaacgtagtcgttgcctacgaaccagtctgggctattggtaccggtttggctgctactgctgaagatgctcaagatatccaccactccatcagagaattcttggctgaaaagctatccagagatgtcgctgactctgttagaatcttgtacggtggttctgctaacggtaagaacgctgttaccttcaaggacaaggctgatgtcgatggtttcttggtcggtggtgcttctttgaagccagaattcgttgacatcatcaactccagagtttaa

SEQ ID NO: 66721 - protein, 257 aa, Kluyveromyces lactis NRRL Y-1140
MHTHNSHTIMARTFFIGGNFKMNGSKASIKEIVDRLNGASIPSNVEVVIAPPAIYLDHAVALNKRKEVKISAQNAYSKASGAYTGENSVEQIKDVGAEWVILGHSERRTYFNETDEIVAEKTKFALDSGVKVILCIGETLEEKQQNITLQVVQRQLQAVLEKVQDWTNVVVAYEPVWAIGTGLAATAEDAQDIHHSIREFLAEKLSRDVADSVRILYGGSANGKNAVTFKDKADVDGFLVGGASLKPEFVDIINSRV

SEQ ID NO: 66722 - DNA, 753 bp, Leptospira interrogans serovar Copenhageni str. Fiocruz L1-130
  CDS (1)..(753): transl_table=11
atgcgtaagacaattattgcaggaaactggaaaatgaatttatctcttaaagaagccgttttcctagcacattcgatccgagaaaaaattccatccatttctaaagataaagtctcgatggtatttccttctactcttcatcttgaaaacgtttccaaaatattagaaggtagcagtgtaattgttggagcccaaaactgttatcactccggacttgcagcttttaccggcgaaacctctcccgatcaactgaaagaaattggtgttaaagttgtaatggtcggtcattcggaacgtcgtcaatttttaggagagtctaactttttttgtaacgataaaatccgttttcttttaaagaacgaatttacagtcctttattgtgttggagaaactctctccgaaagagaatccggtaaaacattggaagtactgtcttctcaaattagagaaggtttaaaaggaattgatagcgtatttttttccaatttaattctggcttatgaaccagtttgggccattggaaccggaaaagttgccaccccctctcaagcccaagaagtacattcttttattcgtaaagaaatttctggtctttttgtaggcgcctcttctatttcagaatccatttctattctctacggtggttctgtaaaaccagacaatattcaagatctattaaaagaaaaagatatagatgggggtttagttggaggagccagccaaaaaatcagttccttcgctggacttttctaa

SEQ ID NO: 66723 - protein, 250 aa, Leptospira interrogans serovar Copenhageni str. Fiocruz L1-130
MRKTIIAGNWKMNLSLKEAVFLAHSIREKIPSISKDKVSMVFPSTLHLENVSKILEGSSVIVGAQNCYHSGLAAFTGETSPDQLKEIGVKVVMVGHSERRQFLGESNFFCNDKIRFLLKNEFTVLYCVGETLSERESGKTLEVLSSQIREGLKGIDSVFFSNLILAYEPVWAIGTGKVATPSQAQEVHSFIRKEISGLFVGASSISESISILYGGSVKPDNIQDLLKEKDIDGGLVGGASQKISSFAGLF

SEQ ID NO: 66724 - DNA, 753 bp, Thermus thermophilus HB27
  CDS (1)..(753): transl_table=11
atgcggcgcgtcttggtggcgggcaactggaaaatgcacaaaacgccctccgaggccagggtgtggttcgccgagctcaagaggctccttccccccttgcagtcggaggccgccgtcctccccgccttccccatcctccccgtggccaaggaggtgctggccgaaacccaggtgggctacggggctcaggacgtctccgcccacaaggagggggcctacacgggggaggtttcggcacggatgctttccgacctcggttgccgctacgccatcgtgggccactcggagcgaaggcgctaccacggggagacggacgccctggtggcggagaaggccaagaggcttctggaggaggggatcacccccatcctctgcgtgggggaacccttggaggtgcgggaaaagggcgaggccgtgccctacaccttgaggcaactccgggggagcctcgagggggtggagccccctggccctgaggccctcgtcatcgcctacgagcccgtgtgggccatcggcacgggcaaaaacgccacccccgaggacgccgaggccatgcaccaggagatccgcaaggccctttccgagcggtacggggaggccttcgcgagccgggttcgcatcctctacgggggaagcgtcaaccccaagaacttcgccgacctcctctccatgcccaacgtggacggggggctcgtgggcggggcgagcctggagctggaaagcttcctcgccctcctcaggatcgcgggttag

SEQ ID NO: 66725 - protein, 250 aa, Thermus thermophilus HB27
MRRVLVAGNWKMHKTPSEARVWFAELKRLLPPLQSEAAVLPAFPILPVAKEVLAETQVGYGAQDVSAHKEGAYTGEVSARMLSDLGCRYAIVGHSERRRYHGETDALVAEKAKRLLEEGITPILCVGEPLEVREKGEAVPYTLRQLRGSLEGVEPPGPEALVIAYEPVWAIGTGKNATPEDAEAMHQEIRKALSERYGEAFASRVRILYGGSVNPKNFADLLSMPNVDGGLVGGASLELESFLALLRIAG

SEQ ID NO: 66726 - DNA, 795 bp, Parachlamydia sp. UWE25
  CDS (1)..(795): transl_table=11
atgagtccatcgcatcgccctgttgtcattacaggcaattggaaaatgtataaaaccgttaaagaggcttgcacttttgcaaaagccttacttccagtggttgaagtaagccctattcaagtatggattgctgttccttttacagccatttatcctgttaaacaagagattcgaaattcgcgattagtaattggtgcgcaaaatatgaacgatgcctctgaaggggcttttacaggcgaaatcgcaggtaaaatggttaaagaagcaggtgcttcctttgttttattagggcactctgaacgtcgccatctttataaagaagataatgcttttattaatcgaaaagtgaagaaagctttagaaattggcctcactcctgtgctttgtgttggtgaaacattcgaagaacgaaaatccggtgaaacacaacaaatcattcgtactcaaatacaagaatgtttagctggattaacagctgaagacttaaagaccttaataattgcttacgaacctgtttgggctattgggaatggtcaaaacgcaaaacctgaaggggcacaagaaattcatcagttttgtcgaaaaatcattaaagaaattttttctgaagagttagccgaacagattgtcattcaatatggcggatcggtgaatccttctaacgcaatctcattacttaaacaacccgatatcgatggtcttttaatcggaggcgcatcactttctcttgaaacttttgttgaaattgtgaatgatggtgggtcaatattcaatctgaaggcaaaattactatga

SEQ ID NO: 66727 - protein, 264 aa, Parachlamydia sp. UWE25
MSPSHRPVVITGNWKMYKTVKEACTFAKALLPVVEVSPIQVWIAVPFTAIYPVKQEIRNSRLVIGAQNMNDASEGAFTGEIAGKMVKEAGASFVLLGHSERRHLYKEDNAFINRKVKKALEIGLTPVLCVGETFEERKSGETQQIIRTQIQECLAGLTAEDLKTLIIAYEPVWAIGNGQNAKPEGAQEIHQFCRKIIKEIFSEELAEQIVIQYGGSVNPSNAISLLKQPDIDGLLIGGASLSLETFVEIVNDGGSIFNLKAKLL

SEQ ID NO: 66728 - DNA, 756 bp, Desulfovibrio vulgaris subsp. vulgaris str. Hildenborough
  CDS (1)..(756): transl_table=11
atgaagaagctcatcgccgccaattggaaaatgtacaagaccatcgacgaggctagggctacgggacgcgaacttgtgtccgccgtcgccgggtcactgcccgcagaccgtgaggtgctcgtgtgcccccccttcacggcgctccatgcccttcatgacaccttcaaggacgtcgaggggtttgccatcggcgggcaggatgtctacccggctaccgaaggggcctacaccggcgaaatcgcacccggcatgttgctcgatgccggatgcggatgggtgctcaccgggcactctgaacggcgtcatattctcggtgaggacgacgagacggtcgcgcgcaagacggctttcagcctgaaggccggactgcgtgtggtactgtgcatcggcgaaaagcttgatgaacgtgaggctggcaggcttgaagacgtgctggcgcatcagctgcaggtcgggcttgcagatgtcgacgcgacctatgtaccccagtcgcttgtggtggcctacgaacccgtatgggctatcggtacgggcaaggtggcggggcctgccgaagtcgtcgaggctcacgctcttgtccgttcgctactcgaagcccgttacggtcgcgacggtgccgccatacgcatcctgtacgggggcagcgtgaagcctgacaacgccgcagaactactttctcttgacaatgtcgacggtctgctggtaggaggcgcttctttgcaggctgtcagcttcagccgcatcattctggcatga

SEQ ID NO: 66729 - protein, 251 aa, Desulfovibrio vulgaris subsp. vulgaris str. Hildenborough
MKKLIAANWKMYKTIDEARATGRELVSAVAGSLPADREVLVCPPFTALHALHDTFKDVEGFAIGGQDVYPATEGAYTGEIAPGMLLDAGCGWVLTGHSERRHILGEDDETVARKTAFSLKAGLRVVLCIGEKLDEREAGRLEDVLAHQLQVGLADVDATYVPQSLVVAYEPVWAIGTGKVAGPAEVVEAHALVRSLLEARYGRDGAAIRILYGGSVKPDNAAELLSLDNVDGLLVGGASLQAVSFSRIILA

SEQ ID NO: 66730 - DNA, 765 bp, Listeria monocytogenes str. 4b F2365
  CDS (1)..(765): transl_table=11
atgcgtaaacccttagttggaattaatatgaaaaactatattaacactcgggctcagacatctgaatggttagaagcgactatccctcttcttaaaaatttttctgatgtggatacgtttatctttccttctatgggcacactcgaaacgaccgccaaccttttagcggggacatcatttggctttggtccacaaaatatggcgccggagaaatccggcccgctaactggtgaattttcggtggaatctatcattgatctaaacgcgaactatgtcgaaattggtcacgcagaacgcaaaaacctttttcatgagaaaactagtgagatagcgaagaagattaaacttgcattggacgaaaaaatcactccggttgtctgtgtgggtgaagaagtccgtgcgaatgatacaaatgaattaaaaaatgcgctaaaaaaacaaatcgaagcgctgtttcagacaattaatttagcacagtgggaaaatgttgttctggcttatgaaccggagtgggcaattggaaaggcgtcttcagctgagacaaactacatcgaaagcgcgcatcaagcgctgcgtgaaattattcgcgaactaggcggcgatgaaacgctcgtaagaattatttacggtggctcggtcagcaaagaaaacgccgcagaaattgtccgtcaaaaaaatgtcgatggtttattcgtcggaagatttggccataaaccgcaaaattttgccgacattgtttctattgttagcaaaacgaaaggatga

SEQ ID NO: 66731 - protein, 254 aa, Listeria monocytogenes str. 4b F2365
MRKPLVGINMKNYINTRAQTSEWLEATIPLLKNFSDVDTFIFPSMGTLETTANLLAGTSFGFGPQNMAPEKSGPLTGEFSVESIIDLNANYVEIGHAERKNLFHEKTSEIAKKIKLALDEKITPVVCVGEEVRANDTNELKNALKKQIEALFQTINLAQWENVVLAYEPEWAIGKASSAETNYIESAHQALREIIRELGGDETLVRIIYGGSVSKENAAEIVRQKNVDGLFVGRFGHKPQNFADIVSIVSKTKG

SEQ ID NO: 66732 - DNA, 729 bp, Mycoplasma mobile 163K
  CDS (1)..(729): transl_table=4
atgagaaaaaaaattattattggtaattgaaaaatgaacaaaactaaaacagaagcagaaaattttgtaaaagagtttaataaaattacaagtgagttaaacttgaaattggacaaaaatttagttgcaggtttagcattaccattcacatcattagggattaaaaaagaaggaaattttgcaaatttagttattgctgcacaaaattttcaccaaaataatagtggagcctttacaggagaaatttcagcagaaatgcttttagatctaggggtaaaaatggttgttttaggtcatagtgaaagaagagagttttttcatgaaactgatgaaatagtaaacatgaaaatgcatcaagcaattaaaaataatttagtcccaattgtttgtgttggagaaacagaactacaatacaattcgaacaaatctaaagaagttataaaaaatcaaattgaaaaatcactaaaaaatttaagtgatttttcaaagattattattgcttatgaaccaatttgggcaattggtacaggaaaaacagctacagttgaatatgcccaagaaatgtgtaagtacattagaagtttaacaaatgaaaaaacaattattcaatatggcggaagtgtaaaaccaaataatattaaagaattgttaagtcaaaaagatattgatggtgctcttgttggtggagcttctttgaatgtaaaagattttattgatttaattaaataa

SEQ ID NO: 66733 - protein, 242 aa, Mycoplasma mobile 163K
MRKKIIIGNWKMNKTKTEAENFVKEFNKITSELNLKLDKNLVAGLALPFTSLGIKKEGNFANLVIAAQNFHQNNSGAFTGEISAEMLLDLGVKMVVLGHSERREFFHETDEIVNMKMHQAIKNNLVPIVCVGETELQYNSNKSKEVIKNQIEKSLKNLSDFSKIIIAYEPIWAIGTGKTATVEYAQEMCKYIRSLTNEKTIIQYGGSVKPNNIKELLSQKDIDGALVGGASLNVKDFIDLIK

SEQ ID NO: 66734 - DNA, 765 bp, Bartonella quintana str. Toulouse
  CDS (1)..(765): transl_table=11
atgtctccaaatattcgaccttttattgctggaaattggaaaatgaatggaactgttgaatctcttggagagttgcgtgctattgctgctggcgttagctctgatttaggccatttgtttgaagcacttatttgcgttccagcaacgcttttatcgcgtgcttctgatgcacttagtggtgaaaatcttctcttgggggggcaaaattgtcattttgatgattgtggtccttatactggggatatttcagcttttatgcttaaagaagcaggagcaagtcatgtcattattgggcattcagaacgtcgcacagtttatcaggaaagtgatgcaattgtttgtgctaaagtgcaagcagcgtggcgggcaggtcttgttgctcttatttgtgttggggaaacattggaagagcgcacaagtaataaagtgttcaatgtgctcacgcgccagcttgaaggatctttgccagatggcgcaacagcagaaaatgtcattattgcttatgaacctgtatgggctataggtactggcaatagcccgacttcagcagttgttgcagaagtccatgattttattcgtcataagatgtgctctcgttttggtgatgatggaagaaagatgcgtttgctttatggtggatcagtaaaaccatctaatgcattcgagcttttgagtactgttcatgtgaatggtgctctgataggtggagcaagtttaaaagcgattgattttttaactatttgcgatgtttatcgtaaattataa

SEQ ID NO: 66735 - protein, 254 aa, Bartonella quintana str. Toulouse
MSPNIRPFIAGNWKMNGTVESLGELRAIAAGVSSDLGHLFEALICVPATLLSRASDALSGENLLLGGQNCHFDDCGPYTGDISAFMLKEAGASHVIIGHSERRTVYQESDAIVCAKVQAAWRAGLVALICVGETLEERTSNKVFNVLTRQLEGSLPDGATAENVIIAYEPVWAIGTGNSPTSAVVAEVHDFIRHKMCSRFGDDGRKMRLLYGGSVKPSNAFELLSTVHVNGALIGGASLKAIDFLTICDVYRKL

SEQ ID NO: 66736 - DNA, 798 bp, Acinetobacter sp. ADP1
  CDS (1)..(798): transl_table=11
atgtcgggctcgactattattccttgggttgtcggcaattggaaaatgaatcctaaacaatctgatgccattcaacttgtacaacaatttaaagatttattaaagcagcaacctatttctgagcagtattgtcatgtgggtgttgcacctatagccatcgcattgacaacaattcaaagcgaactggcaacggcaaaccgtcaagttgcgacggttgcgcaagatgtttctcgttttgctggtacaggtgcttatacaggtgaaataagtgccgaattgctgacagatagccaaattcgatatgtcctgattggacattctgagcgtcgtgacttacttggtgatcatgttgaaattttaaaagcaaaactaagccatgccttaaatgcaggaatgacagtcatttattgtgtaggtgaaagtcttgaacagcgtgaacaaggtttggctgagcagattgtgttgcagcaaatctgtgatattgcacctgtagtgagtgccgagcagtggcagcatcaaatcgtcattgcttatgaaccgatctgggccatcggtacaggccgtactgcatcaccagaagatgcgcaagccattcatgccaaaattcgtgaaggtttatgtcagattaccccagcaggctctcaaattgcattactttatggtggtagtgtcaagccagaaaatgcggtagagttggcggcttgtccagatattaatggggcattggttggcggagcatcactcaatgctgagtcattttataaaattgctcaagcatttgcccaaacgcaacaatag

SEQ ID NO: 66737 - protein, 265 aa, Acinetobacter sp. ADP1
MSGSTIIPWVVGNWKMNPKQSDAIQLVQQFKDLLKQQPISEQYCHVGVAPIAIALTTIQSELATANRQVATVAQDVSRFAGTGAYTGEISAELLTDSQIRYVLIGHSERRDLLGDHVEILKAKLSHALNAGMTVIYCVGESLEQREQGLAEQIVLQQICDIAPVVSAEQWQHQIVIAYEPIWAIGTGRTASPEDAQAIHAKIREGLCQITPAGSQIALLYGGSVKPENAVELAACPDINGALVGGASLNAESFYKIAQAFAQTQQ

SEQ ID NO: 66738 - DNA, 768 bp, Erwinia carotovora subsp. atroseptica SCRI1043
  CDS (1)..(768)
atgcgacatccattagttatgggtaactggaagctgaacggcagcaccaacttggtcaacgaattgatcgcaggcctacgtaaagagctcagcaccgttgacggttgtggcgtagccattgcccccccagctatctacctcgatcaggctaatcaccaactggcgggcagccgcattgcactgggcgcgcagaacgttgacgtgaacctttctggtgccttcaccggtgaaacgtctgccgagatgctgaaagatatcggtgcgaaatacatcatcattggccactctgagcgccgcacctaccataaagaaagcgatgaattcattgcgaagaaatttggcgtgctgaaagacgcgggcttgattccggtgttgtgcattggtgaaactgaagctgaaaacgaagcaggccaaaccgaagccgtgtgcgcacgtcaactggatgccgtactgaatacgctgggtgcgaaagcgtttgaaaacaccgttgtggcctacgaacccgtatgggctatcggcaccggtaaatctgcaactccagcacaggctcaggccgttcacaaattcatccgtgaccacatcgccaagcaagatgctgctgttgctgaacaagttatcatccagtacggcggttcggttaatgctgcgaatgccgcagagctgttcacccagccagacatcgacggcgcgctggtcggtggtgcatcactgaaagccgacgcttttgctgtcatcgtgaaagccgcagccgacgctaaacgcggctaa

SEQ ID NO: 66739 - protein, 255 aa, Erwinia carotovora subsp. atroseptica SCRI1043
MRHPLVMGNWKLNGSTNLVNELIAGLRKELSTVDGCGVAIAPPAIYLDQANHQLAGSRIALGAQNVDVNLSGAFTGETSAEMLKDIGAKYIIIGHSERRTYHKESDEFIAKKFGVLKDAGLIPVLCIGETEAENEAGQTEAVCARQLDAVLNTLGAKAFENTVVAYEPVWAIGTGKSATPAQAQAVHKFIRDHIAKQDAAVAEQVIIQYGGSVNAANAAELFTQPDIDGALVGGASLKADAFAVIVKAAADAKRG

SEQ ID NO: 66740 - DNA, 828 bp, Mesoplasma florum L1
  CDS (1)..(828): transl_table=4
atgttgttatcttttttatttcattgattttcttattgttatataattaaaaatgtacaaaaaaacaagaggagaaatatcatgagacaaaaagtaattttcggaaattgaaaaatgaacggaactaatgctgaacttgttactttcttaaaaaaagttgacaaggctgctaaaaaatcagatgtagttgcaggattaggattaccatttacattattatcaaaaggaattgaaaaagcaaaaaatgttaaagttgctgcacaaaatgttcactttgctgaaaaaggagcatttactggagaagtttcaatttcaatgttacaagaagtaggagtacaatacgttattattggtcactcagaaagaagagaaatgtttgctgaaactgatgaaacagtaaacaaaaaagctactgcattattagctgcaggaatcacaccaattatttgttgtggtgaaactttagaaactaaagaagctaaaaaaactgttacatttgtaaacgcacaaattaaaaaagcatataaaggaattagtgcagaggatgcattaaaaacaattattgcttatgaaccaatctgagctattggaacaggtaaaactgcaacaagtgaagatgctgaaaaagtgtgtgaagctattcgtaaaaatttaacaaaaatttatgacgaaaaaactgcacaacaaattactattcaatatggtggaagtgttaacccatcaaacattgctgaattaatgtcacaaccaaacattgatggagcacttgttggtggagcttcattaaaagctgatgattttattgcattaatcaattacaaaaaataa

SEQ ID NO: 66741 - protein, 275 aa, Mesoplasma florum L1
MLLSFLFHWFSYCYIIKNVQKNKRRNIMRQKVIFGNWKMNGTNAELVTFLKKVDKAAKKSDVVAGLGLPFTLLSKGIEKAKNVKVAAQNVHFAEKGAFTGEVSISMLQEVGVQYVIIGHSERREMFAETDETVNKKATALLAAGITPIICCGETLETKEAKKTVTFVNAQIKKAYKGISAEDALKTIIAYEPIWAIGTGKTATSEDAEKVCEAIRKNLTKIYDEKTAQQITIQYGGSVNPSNIAELMSQPNIDGALVGGASLKADDFIALINYKK

SEQ ID NO: 66742 - DNA, 780 bp, Propionibacterium acnes KPA171202
  CDS (1)..(780): transl_table=11
atgtcccgtaccccgatcatggccggcaactggaagatgaacctcgaccacgttgccgctacctccctcgtccaggatctcggtgaggccctcaaggccgcgggatacgactcctccaagtcagaggccgtcgtcatcccgccgttcactgatatccgtcctgtcgccatcatcattgatggtgacaagttgccgatcgcctacggtgcccaggatatttcggctcacgacgatggcgcctacaccggcgaggtgtccggcgccatgctgtcgaagctgggttgccgctatgtcgtcgttggccactccgagcgtcgcgagtaccacaacgagtccgacgaactggtcaatgccaaggctaagaaggtcatcgaaaatggaatgaccccaatcatctgctgtggtgaggccctcgaggttcgcaaggctggcaagcacgtcgagcataccgttggccagatcaaagccgaccttgacggcattcctgccgaacaggtcgccaagcttgtcatcgcctacgagcccatctgggccatcggcactggcgagactgccaccgctgacgatgcccaggaggtctgccaggccatccgcgaggccgtcaaggagctttacgacgccccgaccgccgaggcggtgcgcattcagtacggtggttcggttaaaccggccaacgtcgctgagatcatggccaagccggacgtcgacggcgctctcgttggcggagcctcgctcaaagctggcgatttctccaagatcgtaactttctacgaggcctga

SEQ ID NO: 66743 - protein, 259 aa, Propionibacterium acnes KPA171202
MSRTPIMAGNWKMNLDHVAATSLVQDLGEALKAAGYDSSKSEAVVIPPFTDIRPVAIIIDGDKLPIAYGAQDISAHDDGAYTGEVSGAMLSKLGCRYVVVGHSERREYHNESDELVNAKAKKVIENGMTPIICCGEALEVRKAGKHVEHTVGQIKADLDGIPAEQVAKLVIAYEPIWAIGTGETATADDAQEVCQAIREAVKELYDAPTAEAVRIQYGGSVKPANVAEIMAKPDVDGALVGGASLKAGDFSKIVTFYEA

SEQ ID NO: 66744 - DNA, 804 bp, Leifsonia xyli subsp. xyli str. CTCB07
  CDS (1)..(804): transl_table=11
gtgaacgaggccggaacgtcgagtgtgcggcgtgtgccgctcatcgccggcaactggaagatgaacctcgatcatctccagtccatcgcggtcgtgcagaagctcgcctggacgctcaaagacgccggtcacgatttcggcgcggtcgaggtggcggtcttcccgccgttcaccgatctgcgcagtgtccagacgctggtcgcggccgacaagcttccgatcgcgttcggcggccaggacgtctccgaacatgactcgggcgcttacaccggcgagatcgctgcgtcgttcctcgcggcactcgaggcccgctatgtgatcatcggccactcggagcggcgcaccctgcacaacgagaccgatgagcaggtcgcggcgaagaccgcgcaagcggtcaagaacggcatctcgccgatcgtctgcgtcggtgagacggccgaagacctggagaagcacggcgcgagcgccgttccggtcgcccagctgcgtgcggccctcgcaggcatcgactcggcggcggactttgtcgtcgcgtacgagcccgtctgggccatcggctcgggccaggcggcgacgccggagcaagccgagcaggtcgccgcggcgctccgcgctgtgatcgcggaggcactgggcgatgaggtcgcggcgaagacccgcatcctctacggcggttcggtgaagtcgggtaacatcgccggcttcatgcgcgagacgaacgtggacggtgctctcgtcggcggtgcgagcctcgatgtcgccgagttcgccgcgatcatccggtaccagaagcacgtgatctga

SEQ ID NO: 66745 - protein, 267 aa, Leifsonia xyli subsp. xyli str. CTCB07
MNEAGTSSVRRVPLIAGNWKMNLDHLQSIAVVQKLAWTLKDAGHDFGAVEVAVFPPFTDLRSVQTLVAADKLPIAFGGQDVSEHDSGAYTGEIAASFLAALEARYVIIGHSERRTLHNETDEQVAAKTAQAVKNGISPIVCVGETAEDLEKHGASAVPVAQLRAALAGIDSAADFVVAYEPVWAIGSGQAATPEQAEQVAAALRAVIAEALGDEVAAKTRILYGGSVKSGNIAGFMRETNVDGALVGGASLDVAEFAAIIRYQKHVI

SEQ ID NO: 66746 - DNA, 756 bp, Desulfotalea psychrophila LSv54
  CDS (1)..(756): transl_table=11
atgaagagaaaggctttgattgcagggaactggaagatgcatatgacggtgcttgaaggttgtcgtctggcagcggaaattgttgcatcctgtaaggattatacggatagagaggtgcttcttgcaccgccctgcacaataataagcgaagtctcccatatccttgcgggtagtaagattatcctctcgtcgcacaatgtctgctgggaagaaaagggtgcctttaccggagagatttctcccactatgctccaagatgcgggggcaagctgtgcaattgttggccactctgaacgtcgccaggtattttttgaaagtgatgaggtgattaacaaacgcttaaagggtgctctggcctttggtttgatgggcattttatgtattggcgagacccttgaggagcgtgaggcgggcaatacccaggccgtgcttgagagacaggtgcgtaagggacttgcagatgttcctgcttcccagatgaaacaggttgttcttgcctatgaacctgtctgggcaattggcaccggagtcacggcaagcaaggagcaggttcaggaaacacacgctgccctgcggcaattaatttcagaaatatatgaaaaagatattgcggaaggactgcgtatattgtatggtggctcggttaaagcaaccaatgtagacgagttgatgtcccaacaggatatcgatggagccttagtaggtggcgcggctttagatagtatatcttttgctcgcataattaattttgaataa

SEQ ID NO: 66747 - protein, 251 aa, Desulfotalea psychrophila LSv54
MKRKALIAGNWKMHMTVLEGCRLAAEIVASCKDYTDREVLLAPPCTIISEVSHILAGSKIILSSHNVCWEEKGAFTGEISPTMLQDAGASCAIVGHSERRQVFFESDEVINKRLKGALAFGLMGILCIGETLEEREAGNTQAVLERQVRKGLADVPASQMKQVVLAYEPVWAIGTGVTASKEQVQETHAALRQLISEIYEKDIAEGLRILYGGSVKATNVDELMSQQDIDGALVGGAALDSISFARIINFE

SEQ ID NO: 66748 - DNA, 762 bp, Borrelia garinii PBi
  CDS (1)..(762): transl_table=11
gtgagaaaaacgtttttagcgggaaattggaaaatgcactatacaagcacagaagcttctattgttgcaaaaaaaatcgcaactgaagttaaaactttaaaggatgattttgtaataatgataactcctccatttacggctttgtctaaggtttcagaatgtattaagggtagcaatattcttcttggtgctcaaaatatgtcttatatggaaagtggagcaaggactagtgaaatttcaccttcaatgcttttagaatttggagtagagtatgttatacttggtcattccgaatgcagattgtatttgggagaaacagatgaaataataaataaaaagattcttacggggcttaagcatccttttaagtacttaattctttgcgttggagaaactcttaatgagagagattctgaaaaaactttagatgttgttttaaatcaggttaaaaaggggctagatggcgtttctgaatcagatattaaaagaataattttagcttatgaacctatttgggcaattggaacgggcaaaactgcaactaaagaggaagcagaagaagttcataaggcaattagacttgagattatgaagctttattcaaagtcggtttcggataatgttataattcagtatggaggctctgttaattcaagcaatgtaaaagagcttatgaatgagcctgatattgatggtgctttaataggcggtgcatctttgaaggccgaatcttttttatctataattaataacgttctttag

SEQ ID NO: 66749 - protein, 253 aa, Borrelia garinii PBi
MRKTFLAGNWKMHYTSTEASIVAKKIATEVKTLKDDFVIMITPPFTALSKVSECIKGSNILLGAQNMSYMESGARTSEISPSMLLEFGVEYVILGHSECRLYLGETDEIINKKILTGLKHPFKYLILCVGETLNERDSEKTLDVVLNQVKKGLDGVSESDIKRIILAYEPIWAIGTGKTATKEEAEEVHKAIRLEIMKLYSKSVSDNVIIQYGGSVNSSNVKELMNEPDIDGALIGGASLKAESFLSIINNVL

SEQ ID NO: 66750 - DNA, 771 bp, Symbiobacterium thermophilum IAM 14863
  CDS (1)..(771): transl_table=11
atgcggacccccatcgttgcggccaactggaagatgcacaagacgcagcctgaggcccggcagttcctcgccgatttcctgccccgggaagccggtatgtccggggtggagatcgtcatctgcccgcccttcaccgcgctggccgcggtggccggggggctcacgggcacccgggtcgggctgggcgcgcagaacatgagcgacaagccctccggagccttcaccggcgaggtctcgggcgcgatgctggtggacgccggctgccggtacgtgatcctcggccactcggagcggaggcggctgttcggggagagcgacgaggtggtcggcgccaaggtgcgcgccgccctgcagcacgggctgatccccatcctctgcatcggggagacgctggaggagcagcaggccggcgaggcggatgccgtcaaccggcggcagctcctggcgggcctggaggggctgactcccgagcaggtggcgaacctcgtcatcgcgtacgaaccggtctgggccatcggcaccggccggaactgcgaccccggcgacgcccaggcgcgcatcgccgcggtgcgggcggtggtggccgaggccttcgggccggaggccgccgcgcgcgtgcgcatccagtacggcggctccgtaaagccggagaacatggcggcctacatggcccagccggatatcgacggcgccctggtcggcggcgccagcctggacccgacctcgttcgccgcgatctgcgcggccgccgccgaggcccgggcccggtga

SEQ ID NO: 66751 - protein, 256 aa, Symbiobacterium thermophilum IAM 14863
MRTPIVAANWKMHKTQPEARQFLADFLPREAGMSGVEIVICPPFTALAAVAGGLTGTRVGLGAQNMSDKPSGAFTGEVSGAMLVDAGCRYVILGHSERRRLFGESDEVVGAKVRAALQHGLIPILCIGETLEEQQAGEADAVNRRQLLAGLEGLTPEQVANLVIAYEPVWAIGTGRNCDPGDAQARIAAVRAVVAEAFGPEAAARVRIQYGGSVKPENMAAYMAQPDIDGALVGGASLDPTSFAAICAAAAEARAR

SEQ ID NO: 66752 - DNA, 768 bp, Mannheimia succiniciproducens MBEL55E
  CDS (1)..(768): transl_table=11
atggcacgtcgtcctttagttatgggtaactggaaattaaacggtagcaaagcgtttactaaagaattaatcgaaggcttaaaagccgaattagcgggcgttgaaggttgtgatgtggcgatcgctccgccggtaatgtatcttgcggaagcggaagccgcacttgcaggcagtaaaatcgtattaggttcacaaaacgttgatgtgaatgtcaaaggcgccttcaccggcgatatttcaaccgaaatgttaaaagatttcggtgcgaaatatattattatcggccactccgaacgtcgcacataccataaagaaagcgatgaatttgttgcacaaaaattcggtgcgttaaaagaagcgggtttaacccctgtattatgtatcggtgaaagtgaagcggaaaacgaagcgggtaaaaccgaagaagtttgcgcgcgtcaaatcgatgcggtaatcaatgccttaggcgttgaagctttcaacggtgcggttatcgcttatgaaccgatttgggcaatcggtaccggcaaatctgccactcctgcacaggcacaagcggttcacgcgtttatccgcggccatatcgctgcaaaatcacaagcggttgcggatcaggtcattatccaatacggcggttccgtaaatgatgccaatgctgcggaattattcactcaaccggatatcgacggtgcgttagtgggcggtgcttcattaaaagcgcctgcatttgcggtaatcgttaaagcggcggcaaaagcaaaagcttaa

SEQ ID NO: 66753 - protein, 255 aa, Mannheimia succiniciproducens MBEL55E
MARRPLVMGNWKLNGSKAFTKELIEGLKAELAGVEGCDVAIAPPVMYLAEAEAALAGSKIVLGSQNVDVNVKGAFTGDISTEMLKDFGAKYIIIGHSERRTYHKESDEFVAQKFGALKEAGLTPVLCIGESEAENEAGKTEEVCARQIDAVINALGVEAFNGAVIAYEPIWAIGTGKSATPAQAQAVHAFIRGHIAAKSQAVADQVIIQYGGSVNDANAAELFTQPDIDGALVGGASLKAPAFAVIVKAAAKAKA

SEQ ID NO: 66754 - DNA, 783 bp, Mannheimia succiniciproducens MBEL55E
  CDS (1)..(783): transl_table=11
atgaaaaagtattattttggtaccaatctcaaaatgtacaaaggaatagccgatacaactcggtttttagcccaactctccgaattaactcatgatattcgggctaataacgatatagaattatttgtcattccgtcttataccgctatccaatccgctattcaaaccacactagccacttctcatgataatccgattattattggcgctcaaaatatgaatcctaacgataacgggcaatatacaggagatatttcaccattaatgctgaaagaaataggaactcaattggtaatgatcgggcattccgaaagacgccacaaatttggcgaaacagatcggcaggaaaatgaaaaagtactatcggctttaaaacatgatctaacgacactactttgcgttggcgaaacacttgaacaaaaaaattataatatttccgacgaagtattaagaactcaattgaaaataggtctatcgggaattaatacaaatcaattagccaaactaagaatagcttatgaacccgtatgggcaattggtgaaagcggcattcctgccaccgcagattatgcgaatgaaaaacatgcagttattaaacaatgtttaattgagttatttggtgacgcgggaaaagatattcccgttttctacggcggtagcgttaatgcggaaaactcgaatgaactattcggacaacaatatattgacgggctatttataggtcgtagtgcttgggatgcagaaaacttcttcaaaattattgaacgtatcgttaataaataa

SEQ ID NO: 66755 - protein, 260 aa, Mannheimia succiniciproducens MBEL55E
MKKYYFGTNLKMYKGIADTTRFLAQLSELTHDIRANNDIELFVIPSYTAIQSAIQTTLATSHDNPIIIGAQNMNPNDNGQYTGDISPLMLKEIGTQLVMIGHSERRHKFGETDRQENEKVLSALKHDLTTLLCVGETLEQKNYNISDEVLRTQLKIGLSGINTNQLAKLRIAYEPVWAIGESGIPATADYANEKHAVIKQCLIELFGDAGKDIPVFYGGSVNAENSNELFGQQYIDGLFIGRSAWDAENFFKIIERIVNK

SEQ ID NO: 66756 - DNA, 762 bp, Bacillus licheniformis ATCC 14580
  CDS (1)..(762): transl_table=11
atgagaaaaccaattatagccggtaactggaagatgaataaagtgctttcagaagctgtcagcttcgttgaagaagtgaaatcttccattcccgcagcagataaagcagaagctgttgtctgtgcgcctgcactgttccttgaaaagctcacatcagctgtaaaaggcacagatctgaaagtcggcgcgcaaaacatgcattttgaagaaagcggagctttcacgggtgaaatcagccctgcggctttgaaagaccttggagttgaatactgcgtcatcggccactccgagcgccgcgaaatgtttgctgaaacggatgaaacggtcaacaaaaaagcgcatgctgcatttaaatacggcatcgttccgatcatctgcgtaggtgaaacgcttgaagagcgcgaagcaaacaaaacaaacgagcttgttgcagaccaagtgaaaaaagcacttgcaggtttaacaactgaacaggtagctgcttccgtgatcgcttatgagccgatctgggcgattggaaccggcaagtcttcaactgcacaagatgcaaacgaagtatgcgcgcacatccgcaaaaccgtggcatcagagttcggacaaactgcagcagacagcgtccgcattcagtacggcggaagcgtaaaacctgcgaacattaaagaatatatggccgaatccgatatcgacggcgctcttgttggcggagcaagccttgagccgcagtctttcgtgcaattattggaggcaggtcaatatgagtaa

SEQ ID NO: 66757 - protein, 253 aa, Bacillus licheniformis ATCC 14580
MRKPIIAGNWKMNKVLSEAVSFVEEVKSSIPAADKAEAVVCAPALFLEKLTSAVKGTDLKVGAQNMHFEESGAFTGEISPAALKDLGVEYCVIGHSERREMFAETDETVNKKAHAAFKYGIVPIICVGETLEEREANKTNELVADQVKKALAGLTTEQVAASVIAYEPIWAIGTGKSSTAQDANEVCAHIRKTVASEFGQTAADSVRIQYGGSVKPANIKEYMAESDIDGALVGGASLEPQSFVQLLEAGQYE

SEQ ID NO: 66758 - DNA, 756 bp, Bacteroides fragilis YCH46
  CDS (1)..(756): transl_table=11
atgagaaagaacattgttgcaggaaactggaaaatgaacaaaacccttcaggagggtattgctcttgcaaaagaactgaatgaagctttggctaacgaaaagcctaactgtgatgtcattatctgtactccgtttattcaccttgcttctgttactcccttggtagatgcagctaagatcggtgtaggtgctgagaactgtgctgacaaagaatccggagcttatacaggtgaagtatcggctgctatggtagcttctaccggtgctaaatacgttattctgggtcactcggaacgtcgtgcttactatggtgaaacggttgagatcctgaaggacaaagtgaaactggctttggcaaatggtctgactccgattttctgtatcggtgaggttctggaagaacgcgaggctaacaaacagaacgaggttgttgctgctcagttggcatctgtattcgatctttcggcggaagatttctctaagatcgttctggcttacgaaccggtttgggctatcggtaccggtaaaacagcttctcctgctcaggctcaggaaatccatgcgttcatccgttcggctgttgctgagaaatacggaaaagaaatcgctgacaacacttcaatcctttatggtggtagctgcaaaccttctaatgctaaagaactgtttgctaaccctgatgttgacggtggtctgatcggtggtgctgccctgaaagttgctgacttcaaaggtatcattgacgcattcaattaa

SEQ ID NO: 66759 - protein, 251 aa, Bacteroides fragilis YCH46
MRKNIVAGNWKMNKTLQEGIALAKELNEALANEKPNCDVIICTPFIHLASVTPLVDAAKIGVGAENCADKESGAYTGEVSAAMVASTGAKYVILGHSERRAYYGETVEILKDKVKLALANGLTPIFCIGEVLEEREANKQNEVVAAQLASVFDLSAEDFSKIVLAYEPVWAIGTGKTASPAQAQEIHAFIRSAVAEKYGKEIADNTSILYGGSCKPSNAKELFANPDVDGGLIGGAALKVADFKGIIDAFN

SEQ ID NO: 66760 - DNA, 756 bp, Burkholderia mallei ATCC 23344
  CDS (1)..(756): transl_table=11
atgtcgaaacaaagaatcaagcgggtgatcggcaactggaagatgcacggtcgcctgagcggcaacgaggcgctgctcgacgaagtcgcgcagggcgcgcaagccgtgcccgagcacgtcggcatcggcgtgtgcgtgccgtttccgtatctcgcgcaggcgcgggcccggcttcacggcggtcgcgtcgcgtggggcgcgcaggacgtatctgcgcacgagcagggcgcctttaccggcgaagtcgcggccggcatggtcgcggagttcggcgcggcgtacgcgatcgtcgggcactcggagcgccgcgcgtatcacggcgaatcgaacgagatcgtcgcggcgaaggcgcaacgtgcgctcgccgcggggctgacgcccgtcgtgtgcgtcggcgagacgctcgccgagcgcgaagcgggggcgaccgagcaggtcgtcggcgtgcagctcgacgcggtgctcgcggtgctgtcgcaggacgaggcggcgcgcatcgtcgtcgcgtacgagcccgtatgggcgatcggcacgggccgcagcgcgacggcggagcaggcgcagcaggtgcacgcgttcctgcgcgggcggctcgcggcgaagggcgccgagcgcgtgtcgctgctgtatggcggcagcgtgaaggccgacaacgcggccgagctgttcggccagcctgacatcgacggcggcctgatcggcggcgcgtcgttgaagagcggggatttcctggcgatttgccgggcggcgcagtaa

SEQ ID NO: 66761 - protein, 251 aa, Burkholderia mallei ATCC 23344
MSKQRIKRVIGNWKMHGRLSGNEALLDEVAQGAQAVPEHVGIGVCVPFPYLAQARARLHGGRVAWGAQDVSAHEQGAFTGEVAAGMVAEFGAAYAIVGHSERRAYHGESNEIVAAKAQRALAAGLTPVVCVGETLAEREAGATEQVVGVQLDAVLAVLSQDEAARIVVAYEPVWAIGTGRSATAEQAQQVHAFLRGRLAAKGAERVSLLYGGSVKADNAAELFGQPDIDGGLIGGASLKSGDFLAICRAAQ

SEQ ID NO: 66762 - DNA, 753 bp, Methylococcus capsulatus str. Bath
  CDS (1)..(753): transl_table=11
atgcgtcgtcctctggtggttggaaactggaagatgaacggcaggagcgcgagcgtggctcgcctgctgaacgacatcctggccggcatcggagactgtaaggcagaagtcggggtgtgcgtgccgttcgtttacatcccccaggcatccgagatactgaagggcaccaaggtgatgctgggtgcgcagaacgtcgcggaccacaactccggcgcgttcaccggcgagatttcagccggcatgctgcgcgagttcggctgtgagctggccatcgtcgggcactcggaacggcgtctgctctatggcgagtcgaacgaactcgtggcgtcccgctacgaacaggcgatccagggacatctcaaaccgatcctctgcgtcggcgaaacgctggagcagagggagcagggcaggacccttgcggtgatcggggcgcagatcgacaccgtgttcgaattcgccggcgtccagtccctggagcatgcggtgatcgcttacgagccggtttgggccgtcgggaccgggcgcagcgcgaccaccggccaggcccaggaggtgcactatcacatccggagtttgatcgcccggtggaatccggaagtggctcaggcggtgcagattatctatggtggaagcgtgaagccggagaattccgctgaattgtttgcgatgcccgacatcgatggcggcctgatcggcggtgcctcgctcgatgcgcgggcgtttctgtcgatctgtcattcagtttcagtttag

SEQ ID NO: 66763 - protein, 250 aa, Methylococcus capsulatus str. Bath
MRRPLVVGNWKMNGRSASVARLLNDILAGIGDCKAEVGVCVPFVYIPQASEILKGTKVMLGAQNVADHNSGAFTGEISAGMLREFGCELAIVGHSERRLLYGESNELVASRYEQAIQGHLKPILCVGETLEQREQGRTLAVIGAQIDTVFEFAGVQSLEHAVIAYEPVWAVGTGRSATTGQAQEVHYHIRSLIARWNPEVAQAVQIIYGGSVKPENSAELFAMPDIDGGLIGGASLDARAFLSICHSVSV

SEQ ID NO: 66764 - DNA, 786 bp, Nocardia farcinica IFM 10152
  CDS (1)..(786): transl_table=11
atggcacgtaaaccgctcatcgccggcaactggaagatgaacctcaaccatctcgaggccatcgccctggtgcagaagatcgccttcgcgctgccggagaagtacttcgagaaggtcgacgtcgcggtgatcccgccgttcgtggacatccgcagcgtgcagacgctggtggagggcgacaagctgctgctcacctacggcgcgcaggacgtctcggtgcacgagtccggcgcctacaccggcgagatcagcgcgagcatgctcgccaagctgggctgcaccttcgtggtggtcgggcactccgagcggcgccagtaccaccacgaggacgacgccaccgtgctcggcaaggccaagaaggccctcgagcacggcctcaccccgatcgtgtgcatcggtgaggggctcaacgtccgcgaggcgggcacgcacgtggaatacaacctcgagcagctgcgcgggtcgctgaagggcctgtccgccgagcagatcgcgaaggtcgtcatcgcctacgagccggtctgggccatcggcaccggcaaggtggcgagcgcggccgacgcgcaggaggtgtgcggcgccatccgcgccgagctggccgagctggccggacccgaggtggccgcgcaggtgcgggtgctctacggcggctcggtgaacgccaagaacgtcggggaactggtcgcccagcccgatgtcgacggtgcgctggtcggcggggcctcgctcaagggtgacgagttcgccaccctgtccgcgatcgccgcgggcggcccgctgccctga

SEQ ID NO: 66765 - protein, 261 aa, Nocardia farcinica IFM 10152
MARKPLIAGNWKMNLNHLEAIALVQKIAFALPEKYFEKVDVAVIPPFVDIRSVQTLVEGDKLLLTYGAQDVSVHESGAYTGEISASMLAKLGCTFVVVGHSERRQYHHEDDATVLGKAKKALEHGLTPIVCIGEGLNVREAGTHVEYNLEQLRGSLKGLSAEQIAKVVIAYEPVWAIGTGKVASAADAQEVCGAIRAELAELAGPEVAAQVRVLYGGSVNAKNVGELVAQPDVDGALVGGASLKGDEFATLSAIAAGGPLP

SEQ ID NO: 66766 - DNA, 750 bp, Legionella pneumophila str. Lens
  CDS (1)..(750): transl_table=11
gtgaggcaaaagatagttgctggtaactggaaaatgaatggccagattcaacaggtgactgaattggtttcgcaaattgagaaattaattggctttgattgcgcagcacaggttgctgtaatgcctcccagcatttatatacccaaggtaagagactgcttaaggacggggaagattgtagtaggtgcgcaaaatgtttatccgaaagattatggtgcctacacaggtgaactgtcagctcccatgcttaaagattttgattgccgatatgttctggtggggcactcggagcgcaggcaattttttcatgaagatgaaaattttgtggcgcaaaaattccaccatgtcaaagatcatggtatgatacctgttctttgtgttggtgaaactctttctgaaagagagaatggaaaaacagagcaggttattgctcaacaggtgctcgcagtgagtgcaaaagggaaagattgttttcgtgattgcgtagtggcttatgagcctgtatgggcaattgggacaggaaaaactgctacacctgaacaggcacaaaaaatacaccagtttattagagatctggttggagaaataaatgatagcgatgcgaaacatttgacgctcatatatggtggcagtgttaatgaaaataatgcaaaagccttattttccatgccagatattgatggagggttagtgggtggagcatcgttgaatgcaaaacaatttgtggaaattgtgaaatgtatcaattga

SEQ ID NO: 66767 - protein, 249 aa, Legionella pneumophila str. Lens
MRQKIVAGNWKMNGQIQQVTELVSQIEKLIGFDCAAQVAVMPPSIYIPKVRDCLRTGKIVVGAQNVYPKDYGAYTGELSAPMLKDFDCRYVLVGHSERRQFFHEDENFVAQKFHHVKDHGMIPVLCVGETLSERENGKTEQVIAQQVLAVSAKGKDCFRDCVVAYEPVWAIGTGKTATPEQAQKIHQFIRDLVGEINDSDAKHLTLIYGGSVNENNAKALFSMPDIDGGLVGGASLNAKQFVEIVKCIN

SEQ ID NO: 66768 - DNA, 789 bp, Photobacterium profundum SS9
  CDS (1)..(789): transl_table=11
atgatttggagaaaaactatgcgtcatcctgtagttatgggtaactggaaactaaacggcagcaaagaaatggttgttaatctactaaacggtcttaacgctgaacttgaaggcgtaacaggcgttgacgtagcagttgctccaccagcacttttcatcgatcttgctgagcatacgcttactgaagctggcagcgcgatcatcctaggtgctcaaaactcagatctaaataacagcggtgcattcactggcgatatgtctccagcaatgcttaaagagttcggcgcatctcatatcatcatcggtcactctgagcgtcgtgaataccacaacgaatcagacgagtttgttgctaagaaattcgcattcctaaaagaaaacggcctaacgcctgttctttgtatcggcgaatctgacgctcaaaacgaagctggcgaaacaatggcagtttgtgcacgtcaacttgacgctgttatcaacactcaaggtgttgaagctcttgaaggcgctatcatcgcttacgaaccaatatgggctatcggtactggtaaagcagctacagctgaagatgcacaacgcatccacgctcaaatccgtgctcacattgcagagaaatctgaagaagttgctaagaaccttgttattcaatacggcggttctgttaagccagaaaacgcagcagcatactttgcacaaccagacatcgatggtgctctagttggcggtgcagcacttgacgcgaaaagctttgccgctatcgctaaagcagcagctgaagcaaaagcgtaa

SEQ ID NO: 66769 - protein, 262 aa, Photobacterium profundum SS9
MIWRKTMRHPVVMGNWKLNGSKEMVVNLLNGLNAELEGVTGVDVAVAPPALFIDLAEHTLTEAGSAIILGAQNSDLNNSGAFTGDMSPAMLKEFGASHIIIGHSERREYHNESDEFVAKKFAFLKENGLTPVLCIGESDAQNEAGETMAVCARQLDAVINTQGVEALEGAIIAYEPIWAIGTGKAATAEDAQRIHAQIRAHIAEKSEEVAKNLVIQYGGSVKPENAAAYFAQPDIDGALVGGAALDAKSFAAIAKAAAEAKA

SEQ ID NO: 66770 - DNA, 753 bp, Thermus thermophilus HB8
  CDS (1)..(753): transl_table=11
atgcggcgcgtcttggtggcgggcaactggaaaatgcacaaaacgccctccgaggccagggtgtggttcgccgagctcaagaggctccttccccccctgcagtcggaggccgccgtcctccccgccttccccatcctccccgtggccaaggaggtgctggccgaaacccaggtgggctacggggctcaggacgtctccgcccacaaggagggggcctacacgggggaggtttcggcacggatgctttccgacctcggttgccgctacgccatcgtgggccactcggagcgaaggcgctaccacggggagacggacgccctggtggcggagaaggccaagaggcttctggaggaggggatcacccccatcctctgcgtgggggaacccttggaggtgcgggaaaagggcgaggccgtgccctacaccttgaggcaactccgggggagcctcgagggggtggagccccctggcccagaggccctcgtcatcgcctacgagcccgtgtgggccatcggcacgggcaaaaacgccacccccgaggacgccgaggccatgcaccaggcgatccgcaaggccctttccgagcggtacggggaggccttcgcgagccgggttcgcatcctctacggaggaagcgtcaaccccaagaacttcgccgacctcctctccatgcccaacgtggacggggggctcgtgggcggggcgagcctggagctggaaagcttcctcgccctcctcaggatcgcgggttag

SEQ ID NO: 66771 - protein, 250 aa, Thermus thermophilus HB8
MRRVLVAGNWKMHKTPSEARVWFAELKRLLPPLQSEAAVLPAFPILPVAKEVLAETQVGYGAQDVSAHKEGAYTGEVSARMLSDLGCRYAIVGHSERRRYHGETDALVAEKAKRLLEEGITPILCVGEPLEVREKGEAVPYTLRQLRGSLEGVEPPGPEALVIAYEPVWAIGTGKNATPEDAEAMHQAIRKALSERYGEAFASRVRILYGGSVNPKNFADLLSMPNVDGGLVGGASLELESFLALLRIAG

SEQ ID NO: 66772 - DNA, 762 bp, Geobacillus kaustophilus HTA426
  CDS (1)..(762): transl_table=11
atgagaaaacgcatcattgcaggcaactggaaaatgcataaaacattggcggaagccgttcaatttgtcgagaacgtaaaagggcacgtgccgccggccgacgaagtcgattccgtcgtttgcgcgccgtttctctttttggatcggttggtgcaagcggcagacggcacggatttaaaaatcggggcgcaaacgatgcactttgccgatcaaggggcgtacacaggcgaagtgagcccggtcatgctgaaagacctcggcgtcacgtacgtcatcctcggccattcggagcgccggcaaatgttcgccgaaacagatgagaccgtgaacaaaaaagtgttggccgccttcacccgcgggcttataccgattatttgctgcggcgaatcgcttgaggagcgggaagcggggcagacgaacgccgttgtcgcctcgcaagtggaaaaagcgctcgccggcttgacgccggaacaagtgaagcaagcggtcatcgcttacgagccgatttgggcgatcgggacgggcaaatcatcaacaccggaagacgccaacagcgtctgcggccatatccgttcggttgtttcgcgcctgtttggcccggaggcggcggaagcgatccgcattcaatacggcggcagcgtcaaaccggacaacatccgcgacttcttggcgcaagaacagatcgacggcgccttagtcggcggggcgagcctcgagccggcttcattcttgcaattggtggaggcggggcgccatgagtaa

SEQ ID NO: 66773 - protein, 253 aa, Geobacillus kaustophilus HTA426
MRKRIIAGNWKMHKTLAEAVQFVENVKGHVPPADEVDSVVCAPFLFLDRLVQAADGTDLKIGAQTMHFADQGAYTGEVSPVMLKDLGVTYVILGHSERRQMFAETDETVNKKVLAAFTRGLIPIICCGESLEEREAGQTNAVVASQVEKALAGLTPEQVKQAVIAYEPIWAIGTGKSSTPEDANSVCGHIRSVVSRLFGPEAAEAIRIQYGGSVKPDNIRDFLAQEQIDGALVGGASLEPASFLQLVEAGRHE

SEQ ID NO: 66774 - DNA, 807 bp, Anaplasma marginale str. St. Maries
  CDS (1)..(807): transl_table=11
ttggtagagcacctgacttgtaatcagggggttgtcggttcgagtccggcagccggctctcttgtactgagtgtggagcttatgtcctttcttgtcgtagctaactggaagatgaatggggataccgctctggtgagggattttcttgctgcgattgacaccagctttgcatcggaccttctcaacaaaggctcgcttgaattggtcatatgccctccgtttactttgatgtcagcgttcgactctaggtgtccatcggtaaggcttggggcgcagaactgcttttctggggttagtaaaggctgtactggtgagataagtgctgcaatgttaaaagagtgtggctgtgactatgtcatccttgggcactctgataggcgtggtacatttgctgaagaaaattcagacatcagactaaaggctgaatccgctatagaagaggggattacacctataatatgcgttggtgagacactgcaggaaaggaatagtggcatctctagtgatatactagtcgagcaatgcagcaaatgttgcccgaagtacggggaatttataattgcatacgaaccggtttgggccataggaggctcaactattcctgatttagagataataagagaatcttttgatacaatcaggtcccatggttctgcgcgtaccatactttacggcgggtctgtaaaccagggcaacatacgcgctctaaagtcacaaattgatggcctatctggagtgctggttggaagtgcaggaacgaaagtagatgagttttgcggaattataagcaatgtgttggaattatag

SEQ ID NO: 66775 - protein, 268 aa, Anaplasma marginale str. St. Maries
MVEHLTCNQGVVGSSPAAGSLVLSVELMSFLVVANWKMNGDTALVRDFLAAIDTSFASDLLNKGSLELVICPPFTLMSAFDSRCPSVRLGAQNCFSGVSKGCTGEISAAMLKECGCDYVILGHSDRRGTFAEENSDIRLKAESAIEEGITPIICVGETLQERNSGISSDILVEQCSKCCPKYGEFIIAYEPVWAIGGSTIPDLEIIRESFDTIRSHGSARTILYGGSVNQGNIRALKSQIDGLSGVLVGSAGTKVDEFCGIISNVLEL

SEQ ID NO: 66776 - DNA, 759 bp, Idiomarina loihiensis L2TR
  CDS (1)..(759): transl_table=11
atgcctaatgcatcactagtgattgcaaattggaaaatgaacggaaatcgcgagctaacgaaaacaatgtcggcggctttgcgggaaaaacttaatcagcttcagcaagttaagttagtcatttgtcctccgttcacccttattggcgagctggctaatcaatgttattacgatgacattgccattggtgctcagaatgtatctgaacacactggtggtgcctttaccggcgaaatctcaaccgcacagctacaagagtttggtgttagctatgtgttagtgggacattcagaacgtcggcagctgttcgcagaaaccgacaaaatggtgaatgagaaagccttggctacggttaatgccggtatgacagcggtgatttgtgttggtgagaataaagcacaacgcgatgagggaaacacctgggaagttgtagcacagcaagcgcaagcggctttagctgatcttcctaaggagcaagccggtaaaattgttttggcctatgagcctgtttgggcaattggtactggagaaacggcttcaccagaacaagcacaggacgttcatgcaaaattaagagcgttactggtagagcaatttggcgcgattggtgagaaaatgccgttattgtacggcggctcagttaaagctgacaacgctgccgaattatttgcgcaaaaagacattgatggcggcctgataggtggcgcaagtctgaaagaatcagattttgttgctatttgccaagctgctcaagggtaa

SEQ ID NO: 66777 - protein, 252 aa, Idiomarina loihiensis L2TR
MPNASLVIANWKMNGNRELTKTMSAALREKLNQLQQVKLVICPPFTLIGELANQCYYDDIAIGAQNVSEHTGGAFTGEISTAQLQEFGVSYVLVGHSERRQLFAETDKMVNEKALATVNAGMTAVICVGENKAQRDEGNTWEVVAQQAQAALADLPKEQAGKIVLAYEPVWAIGTGETASPEQAQDVHAKLRALLVEQFGAIGEKMPLLYGGSVKADNAAELFAQKDIDGGLIGGASLKESDFVAICQAAQG

SEQ ID NO: 66778 - DNA, 816 bp, Azoarcus sp. EbN1
  CDS (1)..(816): transl_table=11
atggctcgatttgacggattcgagtgcatggaacgcaagcttgtcgtcggcaactggaagatgaacggcgatctggtaagcaatcaggcgctcttcgaacagcttgtcgaccgtagtccctccagcatcgatactgccctgtgtgttccgtttccttatctggcgcagggtcagcgagcgttgtcggggagtgcgataatgctcggcgcccagaatctgagtgaattcgatgccggagcgtatacgggcgaagtcagcgggcggatgctttcggacttcgattgccgcttcgtcatcgtcggccattcggagcggcgtacggtgttccgggaggatgaccagctggttgcgcgaaaggcacgtgccgcgctggcggcaggtctcgtgcctatcgtatgcgtcggcgagtcgcttgccgagcgggacgcaggccaggcagaagacgtcctgttgcgccagctcgaagcattggtccagctgctcgacggcgcgtcgctggcacggcttgtgatcgcgtacgagccggtgtgggcgatcgggaccggacgggcggcttccccggagcaggtccaggagatcctttcgttcgtacgacgctggttgtccggtcacgtgggaaattctcgcgcgatccggatcctgtatgggggaagcgtgaaggcagacagtgccgctgcattgttcagtctgcctgattcggacggcgggctgattggcggcgcgtcgcttgttgcccagcaatttcttgagatctgtgaagctgctgccaaggctgcacaggacggcaatatgggtgatttcaaaggttctcgatga

SEQ ID NO: 66779 - protein, 271 aa, Azoarcus sp. EbN1
MARFDGFECMERKLVVGNWKMNGDLVSNQALFEQLVDRSPSSIDTALCVPFPYLAQGQRALSGSAIMLGAQNLSEFDAGAYTGEVSGRMLSDFDCRFVIVGHSERRTVFREDDQLVARKARAALAAGLVPIVCVGESLAERDAGQAEDVLLRQLEALVQLLDGASLARLVIAYEPVWAIGTGRAASPEQVQEILSFVRRWLSGHVGNSRAIRILYGGSVKADSAAALFSLPDSDGGLIGGASLVAQQFLEICEAAAKAAQDGNMGDFKGSR

SEQ ID NO: 66780 - DNA, 750 bp, Zymomonas mobilis subsp. mobilis ZM4
  CDS (1)..(750): transl_table=11
atgacaatacgcaagctcatcgccggcaattggaaaatgaacggttctttaggcatgttgcacgaactggacgggatcgccaaggcaacctttaaccatccagaacttgatgtcgtgatttgtccatccttcacgctgatagcgcccgctattgtgcggcaacccgatatgaccttcggggcgcaagattgccattatgatgaaagtggttcgcataccggctgtgtttcggcaccgatgctccgtgaggtcggtgcaagttatgtcatcgttggccatagcgaaagacgtattgaacagaatgaaaccaatgaagagatccgagcaaaaacgacaacggcgatagccaatggccttgtgacgattgtctgtattggcgaatcccgtgctgcccacgcatcggggcaggctttgcctattatcggggcgcagctggatggctgtattccgcccgatgccaccagcgataatctcgttgttgcctatgaacccatctgggctatcggaacgggtaataccccaccgcctgaaagcattgccgaaatgcacgcctcgattcgtgaccgcttgtgcttgttattaggaagcgaagggaagaaggtccgcatcttatatggaggctctgttaccggcaaaaatgccgaagaattgatggccattccagatgtcaatggaacccttgtcggtggtgccagccttaccgcagaacaatttgttcctatcattgaagctgggggacgtttagcctag

SEQ ID NO: 66781 - protein, 249 aa, Zymomonas mobilis subsp. mobilis ZM4
MTIRKLIAGNWKMNGSLGMLHELDGIAKATFNHPELDVVICPSFTLIAPAIVRQPDMTFGAQDCHYDESGSHTGCVSAPMLREVGASYVIVGHSERRIEQNETNEEIRAKTTTAIANGLVTIVCIGESRAAHASGQALPIIGAQLDGCIPPDATSDNLVVAYEPIWAIGTGNTPPPESIAEMHASIRDRLCLLLGSEGKKVRILYGGSVTGKNAEELMAIPDVNGTLVGGASLTAEQFVPIIEAGGRLA

SEQ ID NO: 66782 - DNA, 756 bp, Silicibacter pomeroyi DSS-3
  CDS (1)..(756): transl_table=11
atgcggcgcaaacttgcagcagggaactggaagatgaacggcaccggcgccgcgctcgacgcgctggaggcaattgccggggcgcattccgccgccgctgttgatctgctgatctgtccgcccgccacgctcctttaccgcgctgcacaggtcgcagaaggcagccgggtgcggatcggcggccaggattgccacgccgtcaccgcaggtgcccataccggcgatatcagcgccatgatgctagccgacgccggtgccagcgccgtcatccttggccattccgaacgccgcgccgatcatggcgagaccgacgcgcaggtctgcgacaaggcgcgcgcggcgcttgaggccgggctgatcgccatcatctgcatcggcgagaccctggcccagcgcgaggcgggccagacgctcgacgtggtctgcgcgcaactggccggttcggtgcccgacgggatcgacggcacccgggtcgtggtcgcctatgagccggtctgggccatcggcaccgggctggtgccgacgctggaacagattgccgaggttcacgacaccctgcgccagcagctgatcgggcggttcgggtcggagaccgccgaggcgatccgcctgctttatggcggctcggtcaagccgggcaacgcggccgaaatctttgcggtttcgaacgtggatggcgcgctggtcggcggcgccagcctgactgccgccgatttctcgcccatcgtcagcgcgctggaacaggcggcgggctga

SEQ ID NO: 66783 - protein, 251 aa, Silicibacter pomeroyi DSS-3
MRRKLAAGNWKMNGTGAALDALEAIAGAHSAAAVDLLICPPATLLYRAAQVAEGSRVRIGGQDCHAVTAGAHTGDISAMMLADAGASAVILGHSERRADHGETDAQVCDKARAALEAGLIAIICIGETLAQREAGQTLDVVCAQLAGSVPDGIDGTRVVVAYEPVWAIGTGLVPTLEQIAEVHDTLRQQLIGRFGSETAEAIRLLYGGSVKPGNAAEIFAVSNVDGALVGGASLTAADFSPIVSALEQAAG

SEQ ID NO: 66784 - DNA, 762 bp, Francisella tularensis subsp. tularensis Schu 4
  CDS (1)..(762): transl_table=11
atgcaaaaattaataatgggtaactggaaaatgaatggtaactctacaagcataaaagagctctgtagtggtatatcacaagtgcaatatgatacttcaagagtagctattgctgtttttccatcaagtgtttatgttaaagaagtaatctcacagctgccagagaaagtaggtgttggtctacaaaatattactttttatgatgatggtgcttatactggtgagatatctgctaggatgttggaagatattggttgtgactacttactaattggtcattctgagagaagatctctatttgctgagtctgatgaagatgtttttaaaaagcttaacaagattatagatactactataacgccagtagtgtgtattggtgaatcactagatgatagacaaagtggtaagctcaaacaagttttagcaacacaactaagcttaatcttagaaaatttatctgttgagcagttagcaaaagtcgtaattgcatatgaacctgtctgggcaataggcacaggagttgtggcttcactagagcagattcaagaaacacatcaatttattcgttcattgttagctaaagttgatgaaagacttgctaaaaatataaaaatagtgtatggtggtagcctaaaagctgaaaatgctaaagatatattaagcttaccagatgtcgacggtggtttaattggtggcgcatctttgaaggctgctgaatttaacgaaataataaatcaagcaaacaagatatgtacggaataa

SEQ ID NO: 66785 - protein, 253 aa, Francisella tularensis subsp. tularensis Schu 4
MQKLIMGNWKMNGNSTSIKELCSGISQVQYDTSRVAIAVFPSSVYVKEVISQLPEKVGVGLQNITFYDDGAYTGEISARMLEDIGCDYLLIGHSERRSLFAESDEDVFKKLNKIIDTTITPVVCIGESLDDRQSGKLKQVLATQLSLILENLSVEQLAKVVIAYEPVWAIGTGVVASLEQIQETHQFIRSLLAKVDERLAKNIKIVYGGSLKAENAKDILSLPDVDGGLIGGASLKAAEFNEIINQANKICTE

SEQ ID NO: 66786 - DNA, 762 bp, Synechococcus elongatus PCC 6301
  CDS (1)..(762): transl_table=11
gtgaacggtcttgcaaggagcgaacagtcagccgtgcgtcggatcatcattgccgggaactggaaaatgtacaaaacccaggccgaagccctggagttcttgcaagcctttttgccacagctcagcgaaacgccagaatcgcgcaaagttgtgctctgtgcacccttcacgaccctgtctagcctgagcaaaaccctccacggcagccgggtgcgcgtgggtgctcaaaacattcactgggccaaggaaggggctttcactggcgaaatctcgggagcaatgctgacggagattggcgttcgctatgtagtggttggtcacagtgagcgccgtcagtacttcggggaaacagatgaaaccgtcaaccagcgcttgctggcagcccaatccttcggtctgttaccgattctctgcgtgggtgagtcgaagcaacagcgcgatgctggtgagactgaagccgtgatcagtcgtcagttggagcgtgggttggtcggtgccgatcaaaccaacttggtgattgcctacgaaccgatctgggcgatcgggactggtgatacctgtgcagccgaggaagctaatcgcgtcattggcctgattcgcagtcagctcaaggatactgatgtgccgatccagtacggtggttcggtcaaacctgagaacatcgacgagatcatggcgcagccagaaattgatggagccttggtcggcggtgctagcctcgaagctgagagtttcgcccgcatcgtcaattaccagagctaa

SEQ ID NO: 66787 - protein, 253 aa, Synechococcus elongatus PCC 6301
MNGLARSEQSAVRRIIIAGNWKMYKTQAEALEFLQAFLPQLSETPESRKVVLCAPFTTLSSLSKTLHGSRVRVGAQNIHWAKEGAFTGEISGAMLTEIGVRYVVVGHSERRQYFGETDETVNQRLLAAQSFGLLPILCVGESKQQRDAGETEAVISRQLERGLVGADQTNLVIAYEPIWAIGTGDTCAAEEANRVIGLIRSQLKDTDVPIQYGGSVKPENIDEIMAQPEIDGALVGGASLEAESFARIVNYQS

SEQ ID NO: 66788 - DNA, 756 bp, Bacillus clausii KSM-K16
  CDS (1)..(756): transl_table=11
atgcgtaaaccaattattgcaggaaactggaaaatgaataaaacaatcggcgaagctgttgattttgtcgaagcagtaaaagcaaacgttcccgcacaggcaacggttgattcggttgtttgtgcgccagccttgtttcttgaccgtttgctccaagcggtaaaaggaactgagttaaaaattggtgctcaaacgatgcattttgaagacaatggcgcatttacaggggagatcagccctaaagcattgtctgatatgggtgtccattatgtgattatcggccattcagaacggcgagaaatgtttgccgagacagatgagactgtcaataagaaagtgcatgccgcattcgcccatcatttggttccgattatgtgttgcggtgaaacggctgaagagcgtgaagcgggtaagatggaagctgttgtaaaagagcaagtagaaaatggccttgctggtttaagcgaagaacaagttaaacaaacagtaattgcgtacgagcctatttgggcgatcggcacaggcaaatcagcgacagaaaaagacgcgaatgaagcttgcgcttatgtgcgtcaaacggtggccgctaatttttctgaagaagcagctgaggcgattcgcatccagtacggcggcagcgtaaaacctggcaacattaaagactacatggcccaacctgacatagatggcgccctcgttggtggagccagcttggacgcagattcgtttttagaattagtgggggcagcaaaatga

SEQ ID NO: 66789 - protein, 251 aa, Bacillus clausii KSM-K16
MRKPIIAGNWKMNKTIGEAVDFVEAVKANVPAQATVDSVVCAPALFLDRLLQAVKGTELKIGAQTMHFEDNGAFTGEISPKALSDMGVHYVIIGHSERREMFAETDETVNKKVHAAFAHHLVPIMCCGETAEEREAGKMEAVVKEQVENGLAGLSEEQVKQTVIAYEPIWAIGTGKSATEKDANEACAYVRQTVAANFSEEAAEAIRIQYGGSVKPGNIKDYMAQPDIDGALVGGASLDADSFLELVGAAK

SEQ ID NO: 66790 - DNA, 723 bp, Ehrlichia ruminantium str. Welgevonden
  CDS (1)..(723): transl_table=11
atgtcattactcatcgttgctaactggaagatgcatggtgatttttttactttttcttcgtttacaaaggagcttagtaaccgtttaattaatatagaagataaagtaaaggtagtattatgcccaccatttattgcgttatctacttatgttaattgtccacataatattaagtttggtggacagaactgttgttatgtatctagtgggaagtacactggagaaattagtgctagtatgttatataactctggatgtagttatgtaatagtgggtcactctgaaaggaggagtacgtttcatgaaactgatcatgatgttaggttaaaagctgaatgtgcgatcgaatcaggattaataccaattatttgtgttggagaaactttactagatagggaaaatggtatgctaaaagatactttattaagtcaatgtagtaaatcttttcctaaaaatggtaagtttatcatagcatatgagccagtatgggcaatagggaacaataaaataccttctactgatgtaataatagaagctttagagattattaggtcatatgattatgtatctgatatcatatatggtggagcagtaaatcatactaatgtaggtgatattgtcagtataaatcaattatctggtgttttagttggtagtgctagtttagatatggagagtttttttaatataatatgtagtgctataaatgtggggcaaagttaa

SEQ ID NO: 66791 - protein, 240 aa, Ehrlichia ruminantium str. Welgevonden
MSLLIVANWKMHGDFFTFSSFTKELSNRLINIEDKVKVVLCPPFIALSTYVNCPHNIKFGGQNCCYVSSGKYTGEISASMLYNSGCSYVIVGHSERRSTFHETDHDVRLKAECAIESGLIPIICVGETLLDRENGMLKDTLLSQCSKSFPKNGKFIIAYEPVWAIGNNKIPSTDVIIEALEIIRSYDYVSDIIYGGAVNHTNVGDIVSINQLSGVLVGSASLDMESFFNIICSAINVGQS

SEQ ID NO: 66792 - DNA, 756 bp, Dehalococcoides ethenogenes 195
  CDS (1)..(756): transl_table=11
atgagacagattattattgccgggaactggaaaatgaataccactctttccgaagcttgtacactagtgcaaggcatgaaatatgaacttgaccaaataagcggcattcagaaaatagtctgcccgccgtttatatctttagccccggtaaaaaccatactggacggcagcagtatccatttgggtgctcaaaaccttttctacgaagaaaaaggggcttacaccggagaaatttcccccctgatgctgcaagatatctgcccatatgtgattataggccactctgaaaggcgggcctatttcggcgagaccggacaagtagttaaccggaagataaaagccgcccttcaggcaggtataatgccaatagtgtgcgtgggcgaaaaactggaagagaatgaaaacggccagacccgccaaatactggaaacccagatgaaagaggctttagccgggattaacccaagcagtatcataatagcctatgagcctatctgggccataggcacaggcaaggctgccactgcagcggaagccaataacactataagttatatccgcaaggtattgggtgatatatggggcaataccgcatcccggattacgcctattctatatggcggcagcgtaaatgaaaaaaatactgccgaacttctttgccagtcagatatagacggagctttggtaggcggagcttccctgaaagcagagtcttttgtcagcatatgccgccaggctgctgatgtaagaaaataa

SEQ ID NO: 66793 - protein, 251 aa, Dehalococcoides ethenogenes 195
MRQIIIAGNWKMNTTLSEACTLVQGMKYELDQISGIQKIVCPPFISLAPVKTILDGSSIHLGAQNLFYEEKGAYTGEISPLMLQDICPYVIIGHSERRAYFGETGQVVNRKIKAALQAGIMPIVCVGEKLEENENGQTRQILETQMKEALAGINPSSIIIAYEPIWAIGTGKAATAAEANNTISYIRKVLGDIWGNTASRITPILYGGSVNEKNTAELLCQSDIDGALVGGASLKAESFVSICRQAADVRK

SEQ ID NO: 66794 - DNA, 750 bp, Rhodobacter sphaeroides 2.4.1
  CDS (1)..(750)
atggggaagaagatgcgcaaacttgcggccggaaactggaagatgaacggaaccgaggcggatctgggcgagatcgacgccctgctcgccgcgcatccgtcgccccgctgcgagatgctgatctgtccgcccgcaacgcttgttgcgcgcatggcgggacgcgcggcgcagggcctgatggtcggcgggcaggactgccaccccaagacctccggcgcccataccggcgacgtctcggccgccatgctcgccgatgccggggcgagccacgtcattctcggccattccgaacgccgcgccgatcatggcgagacggactcgctcgtgcggctgaaggccgaagcggcctggggcgcgggccttgtcgccatcgtctgcgtgggcgaaaccgaggcccagcgcgacgcgggccagacgctcgacgtgatcggggcacagcttgcgggctcggtgccggaagccgccaccgcggccaacaccgtgatcgcctacgagccggtctgggccatcggcaccggccgcacgcccacgaccgccgagatcgccgaggttcacgccttcctccgcgcgcggctcgccgagcggttttcggatgcggagggcttccggctgctctacggcggctcggtgaagccgtcgaatgcggccgagatcttcgccgtgccgaatgtcgatggcgcgctggtcggcggcgcgagcctcaaggccgcggatttcggcgggatcgtggcggccctttcggccgcctga

SEQ ID NO: 66795 - protein, 249 aa, Rhodobacter sphaeroides 2.4.1
MGKKMRKLAAGNWKMNGTEADLGEIDALLAAHPSPRCEMLICPPATLVARMAGRAAQGLMVGGQDCHPKTSGAHTGDVSAAMLADAGASHVILGHSERRADHGETDSLVRLKAEAAWGAGLVAIVCVGETEAQRDAGQTLDVIGAQLAGSVPEAATAANTVIAYEPVWAIGTGRTPTTAEIAEVHAFLRARLAERFSDAEGFRLLYGGSVKPSNAAEIFAVPNVDGALVGGASLKAADFGGIVAALSAA

SEQ ID NO: 66796 - DNA, 750 bp, Xylella fastidiosa Dixon
  CDS (1)..(750)
atgcgccccaagattgtggttgggaattggaagttgcatggtagccacgcgttcgcacaggcattggttgcgcaggttgctgctggtttgccgctgcctggagtcagtgtgattatcttgccgccattgctgtatctgagtgatttgacgcagcgcttcaaaggggaaggtttggcgtttggtgcgcagaacgtcagtcaccatgataaaggtgcttacactggggaagtttcggcggcgatggtggctgatgtcggtgctcattacactttggttgggcattctgaacgtcgggagtatcaccatgaggacagtgagttggtggcgcgtaaatttgctgctgctctgagtgctgggttgcgaccaattctatgtgttggggagagtttgccccagcgtgaggctggacaggcagaggttgccattgcgatgcagcttgcgcctgtgttggctctggttggcccgcagggtgttgcccgtggcttgattgcctatgagccggtttgggcgattggtactggccgtcatgcggatccgagccaagtccaagcgatgcacgcttttattcgtggtgaaattgcgaggcaagatgctagaatcggcgattctctgttgattctatacggaggcggcatcaagccttgcaacgctgctgagttgttttcccagcaggatgtcgatggtgggttgattggtggtgcttcgttggttgctgatgatttcttggctatcgctcgtgcgacggtttag

SEQ ID NO: 66797 - protein, 249 aa, Xylella fastidiosa Dixon
MRPKIVVGNWKLHGSHAFAQALVAQVAAGLPLPGVSVIILPPLLYLSDLTQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 66798 - DNA, 741 bp, Azotobacter vinelandii
  CDS (1)..(741)
atgcgtggaaaactggtcatcggcaactggaagatgaacggcagcctggacgccaaccggcgcctgctgcaggaactgctgccgccgctggcggcggtgaaggggctcgaggtggcggtctgtccgcccttcccgtacctggcgcaggtcggcgccctgctggaaggctccagcgtggcgctgggcgcgcagaacctccatagcgccgggcagggcgccttcaccggcgaggtcggcgccggcatgctcgaggagttgggctgccgctacgtgctggtcggccattccgagcggcgcagcctgttcggcgagagcgacgagacggtggcggagaagttcgaggcggcgctgcgggccggactggtgccggtgctgtgcgtcggcgaaaccctggcgcagcgccgcgacggcagcaccgaggcggtcatcgccgggcaggtgcgggcggtcctgcaacgggtcggcggcgccgggatcgccgccggggtgatcgcctacgaaccggtgtgggccatcggcaccggcgaaaccgccagtcccgagcaggcccaggcggtacaccggcacatccgcgcgctgctgggcgaggccaccgccacgccgatcctctacggcggcagcgtcaagccggacaacgccgccgcgctgttcgcccagccggacatcgacggcggcctgatcggcggggcctcgctggaggccgcctccttcctggcgatctgccgggcggcgcagtcctag

SEQ ID NO: 66799 - protein, 246 aa, Azotobacter vinelandii
MRGKLVIGNWKMNGSLDANRRLLQELLPPLAAVKGLEVAVCPPFPYLAQVGALLEGSSVALGAQNLHSAGQGAFTGEVGAGMLEELGCRYVLVGHSERRSLFGESDETVAEKFEAALRAGLVPVLCVGETLAQRRDGSTEAVIAGQVRAVLQRVGGAGIAAGVIAYEPVWAIGTGETASPEQAQAVHRHIRALLGEATATPILYGGSVKPDNAAALFAQPDIDGGLIGGASLEAASFLAICRAAQS

SEQ ID NO: 66800 - DNA, 762 bp, Azotobacter vinelandii
  CDS (1)..(762)
atgaacatgaagcgcaaacaggtcatcggcaactggaagatgaacggcgacctggccgccaaccggcgcctgctggacgaactgctgccgtcgctggcggcgctcgacggcgtcgaactggcggtctgtccgcccttcccctacctggcgcaggtcgccgccctgctggagggctccggcgtggcgctgggcgcgcagaacctcaacgtggcggcgaagggcgccttcaccggcgaagtcagcgccggcatgctcggggagctgggctgccgctacgtgctggtcggccattccgagcggcgcagcctgtacggcgagtgcgacgagacggtggcggagaagttcgccgtggcgctcagggccggcctggtgccggtgctgtgcgtcggcgagaccctggcgcagcgccgccaggggcgtaccgaggcgctggtgtccgcgcagttgcaggcggtcctgcgccgctcgggcatcgagggcctcgccgccggggtgatcgcctacgagccggtgtgggccatcggcaacggcgagaccgccagccccgagcaggcccaggcggtgcaccggcatatccgcgacctgctggcccagcacgaccccgcgcggggcgtggccacgccgatcctctacggcggcagcgtcaaggccgacaacgccgccgcgctgttcgcccagccggacatcgacggcgggctgatcggcggcgcctcgctggaggcggccgcgttcgccgcgatctgccaggccgccgcacgctag

SEQ ID NO: 66801 - protein, 253 aa, Azotobacter vinelandii
MNMKRKQVIGNWKMNGDLAANRRLLDELLPSLAALDGVELAVCPPFPYLAQVAALLEGSGVALGAQNLNVAAKGAFTGEVSAGMLGELGCRYVLVGHSERRSLYGECDETVAEKFAVALRAGLVPVLCVGETLAQRRQGRTEALVSAQLQAVLRRSGIEGLAAGVIAYEPVWAIGNGETASPEQAQAVHRHIRDLLAQHDPARGVATPILYGGSVKADNAAALFAQPDIDGGLIGGASLEAAAFAAICQAAAR

SEQ ID NO: 66802 - DNA, 747 bp, Nostoc punctiforme PCC 73102
  CDS (1)..(747)
ttgactaaattacctgtgcggaaaatcgttattgccggcaactggaaaatgttcaaaacccaggcagagactcaggagtttttgcaaggatttttgccccacttagaggaaaccccccaagggcgagaagtaatattgtgtcctcctttcactgatttaagcgttttgtccaagactttgcacggtagcctcatccaactgggggcacaaaatatccattgggaagaatttggagcctatacgggtgagatttctggcccgatgctgacagaaagcggtgtgcgctttgtgattgtcggtcatagcgaacgacggcaatactttggtgaaacggacgcaactgttaatctgcgcctccgaactgctcaaaggtttggtttgactccaattctctgtgttggtgaaactaaacaacaacgagatgcaggagaaactgaatcactgattgctctccaactcgacaaaggtttggtagatatcgatcagaataatttggtgattgcctacgagccaatttgggcaattggcactggtgaaacttgtgaagcagtggaagctaatcgaataattggcttaattcggagccagttgagtaatccaaatgtatcaattcaatatggtggctcagtgaagccaaataatattgatgaaatcatggctcaaccagaaatcgatggcgttttagtcggaggagcaagtttagaaccggagagtttcgctcggattgtgaattttcacttagtgtaa

SEQ ID NO: 66803 - protein, 248 aa, Nostoc punctiforme PCC 73102
MTKLPVRKIVIAGNWKMFKTQAETQEFLQGFLPHLEETPQGREVILCPPFTDLSVLSKTLHGSLIQLGAQNIHWEEFGAYTGEISGPMLTESGVRFVIVGHSERRQYFGETDATVNLRLRTAQRFGLTPILCVGETKQQRDAGETESLIALQLDKGLVDIDQNNLVIAYEPIWAIGTGETCEAVEANRIIGLIRSQLSNPNVSIQYGGSVKPNNIDEIMAQPEIDGVLVGGASLEPESFARIVNFHLV

SEQ ID NO: 66804 - DNA, 723 bp, Desulfovibrio desulfuricans G20
  CDS (1)..(723)
atgtataagaccccgcaggaagctgcgcttaccgccggagaacttgtaaaagctgtggggacagtgccggatgaccgtgaggtacttgtttttccgccttttgtggggcttgcacaggttgctcaggctttttccggtgttgccggtttttattgcggagctcaaaacgtctatcccgcagatgaaggagcgtataccggcgaaatatcgccggggatgatcgtgtctacaggtgccgcgtgggcgttgaccggacattcggagcgccggagcgttctgggtgaaagcagtgcctttgtggggcagaagaccgcattttgtctggaaaaaggcctgaatgtggtgctgtgcatcggcgaaacgctggaagaacgtgaaggcgggcagctggaaaaggtgcttcgcggacagctttccgaggggctgtccggtgtgccggccggtattgctcctgaacggctggctatagcttatgagcctgtctgggccataggtacaggcaaagttgccggtaccgccgaaattgccgcaacccacgctgtggtgcgcggtatgctgcgcgaattgttgcccgcagcggctgattccatgcgtattctgtacggtggcagcgtaaagcccgacaatgcggccgctatcatttctcttgacaatgtggacggagtcttggtaggtggcgcttctttacaggctgaaagcttcagccggataattcttgcctga

SEQ ID NO: 66805 - protein, 240 aa, Desulfovibrio desulfuricans G20
MYKTPQEAALTAGELVKAVGTVPDDREVLVFPPFVGLAQVAQAFSGVAGFYCGAQNVYPADEGAYTGEISPGMIVSTGAAWALTGHSERRSVLGESSAFVGQKTAFCLEKGLNVVLCIGETLEEREGGQLEKVLRGQLSEGLSGVPAGIAPERLAIAYEPVWAIGTGKVAGTAEIAATHAVVRGMLRELLPAAADSMRILYGGSVKPDNAAAIISLDNVDGVLVGGASLQAESFSRIILA

SEQ ID NO: 66806 - DNA, 771 bp, Actinobacillus pleuropneumoniae serovar 1 str. 4074
  CDS (1)..(771)
atggcacgtcgtccacttgtaatgggtaactggaaattaaacggtagcaaagcatttacaaaagagttaatcgccggcttaaaagcggaattagcggatgttaaaggctgtgacgttgcaatcgcgccgccggtaatgtacttagcggaagcggaagcggcattagcgggtcaatcagtcatcgcattaggcgcacaaaacgtagacgtaaacgtacaaggtgcatttaccggtgatatttcaaccgaaatgttaaaagacttcggtgcaaaatatattattatcggtcactccgagcgtcgtacttatcacaaagaatgcgatacgttcattgcgaaaaaattcgctgcgttaaaagcggcgggtttagtaccggtattatgtatcggtgaaaccgaagcggaaaacgaagcgggtcaaaccgaagcggtatgcgcaaaacaaattgatgcggtaatcgatgcgttaggcgttgaagcgtttaacggtgcggtaatcgcctacgaaccgatttgggctatcggtaccggtaaatccgcaactcctgcgcaagcgcaagcggttcacgcattcatccgcggtcacattgcagcgaaatcacaagcggttgcggatcaagtgattatccaatacggcggttcggtaaacgatgcgaatgcggcggaattattcactcagccggatatcgacggtgcgttagtcggcggtgcgtcattaaaagcgcctgcatttgcggttatcgtcaaagcggcggaaaaagcgaaagcgtaa

SEQ ID NO: 66807 - protein, 256 aa, Actinobacillus pleuropneumoniae serovar 1 str. 4074
MARRPLVMGNWKLNGSKAFTKELIAGLKAELADVKGCDVAIAPPVMYLAEAEAALAGQSVIALGAQNVDVNVQGAFTGDISTEMLKDFGAKYIIIGHSERRTYHKECDTFIAKKFAALKAAGLVPVLCIGETEAENEAGQTEAVCAKQIDAVIDALGVEAFNGAVIAYEPIWAIGTGKSATPAQAQAVHAFIRGHIAAKSQAVADQVIIQYGGSVNDANAAELFTQPDIDGALVGGASLKAPAFAVIVKAAEKAKA

SEQ ID NO: 66808 - DNA, 756 bp, Fusobacterium nucleatum subsp. vincentii ATCC 49256
  CDS (1)..(756): transl_table=11
ttgagaagattagttattgcagggaactggaaaatgtataaaaacaataaagaagctgttgaaacattaacacaattaaaaaatttaacaaaagatataaagaatgtagatatagttataggagctccatttacttgtctttcagatgcagttaagactgttgaaggaagtaatgtaaaaatagcagcagaaaatgtatatcctaaaattgaaggggcatatacaggagaaatttctcctaaaatgcttaaagatattggtgttacttatgtaattttagggcattctgaaagaagagaatattttaaagaaagtgatgaatttataaatcaaaaagttaaagcagttttagaaataggaatgaaacctatactttgtataggagaaaaattagaagaaagagaaagcggaaaaacttttgaagttttgagtaaacaaataaaaggtggacttgcagatttatctaaggaagaagcaggaaaagttataattgcttatgaaccagtttgggcaataggaactggaaaaacagcaactcctgaaatggcacaagaaactcataaggcagttagaaatgttttggctgaaatgtttggaaaagatatagctgataagatgataattcaatatgggggctcaatgaaaccagaaaatgcaaaagatttgttaagtcaagaagatattgatggaggacttgttggaggagcttcattaaaagcagattcattctttgaaattataaaagcaggaaattaa

SEQ ID NO: 66809 - protein, 251 aa, Fusobacterium nucleatum subsp. vincentii ATCC 49256
MRRLVIAGNWKMYKNNKEAVETLTQLKNLTKDIKNVDIVIGAPFTCLSDAVKTVEGSNVKIAAENVYPKIEGAYTGEISPKMLKDIGVTYVILGHSERREYFKESDEFINQKVKAVLEIGMKPILCIGEKLEERESGKTFEVLSKQIKGGLADLSKEEAGKVIIAYEPVWAIGTGKTATPEMAQETHKAVRNVLAEMFGKDIADKMIIQYGGSMKPENAKDLLSQEDIDGGLVGGASLKADSFFEIIKAGN

SEQ ID NO: 66810 - DNA, 810 bp, Psychrobacter sp. 273-4
  CDS (1)..(810)
atgcaagcttgggtaattggaaattggaagcagaatccagcaacgagccatgacgttgacgcgctactgaatgaattatgcactgctattagtacaactaagcaacttagccacaacaactccacgcgctgtcaaataatggtggcaccaagttttttgcatttagcagcagtgagtagtcgcctcaaagacacctcggtactatgtgccgcccaagacgtcagtgcctatagtgccagtgtgggcgcctataccggtgactgttcagcccagcagattgctgatgttggggctacatggaccatccttggtcactcagagcgccgtcagtaccaccaagaatccaacgatactttattgcaaaaaatgacccatgctttgacccaagagttgggcgtagtattttgtatcggtgaaacccaagcacaatatgatgccaagcaaacgctgccagtcatcgatagtcagttagcagtggtcaaaaagctcattgctgagcagccagaagttattgattcattatcgactcgtctcattattgcttacgagccggtatgggcgattggtactggtaaagtaccaacagtgtcagaggtgagtgccactcatcaatatatcaagcaaacactggcaggttttgccgattcgttatctaacatgactgttttgtatggcggtagtgtcaatgctgataatgcagatagctttgctgctgatcctatgattcatggtgctttggttggcggcgcttcactaaaggcagagagctttttggcgattgtcaccgcttttagtaaaggcagtatgtaa

SEQ ID NO: 66811 - protein, 269 aa, Psychrobacter sp. 273-4
MQAWVIGNWKQNPATSHDVDALLNELCTAISTTKQLSHNNSTRCQIMVAPSFLHLAAVSSRLKDTSVLCAAQDVSAYSASVGAYTGDCSAQQIADVGATWTILGHSERRQYHQESNDTLLQKMTHALTQELGVVFCIGETQAQYDAKQTLPVIDSQLAVVKKLIAEQPEVIDSLSTRLIIAYEPVWAIGTGKVPTVSEVSATHQYIKQTLAGFADSLSNMTVLYGGSVNADNADSFAADPMIHGALVGGASLKAESFLAIVTAFSKGSM

SEQ ID NO: 66812 - DNA, 792 bp, Haemophilus influenzae R2866
  CDS (1)..(792)
atggcacgtcgtcctttagttatgggtaactggaaattaaacggtagcaaagcattcacgaaagaattaatcgagggattaaaagcggaattacatgatgtaacaggttgtgatgtagcaattgcccctcccgttatgtatttaggtacggctgaagcagcactttctggttgtggttgcagctgtggcggtaaaagtgtgattcaattaggtgcacaaaacgtagatatcaatgtgaaaggtgcatttactggtgatatttctagcgaaatgttaaaagattttggtgcaaaatatatcattattggccactctgaacgccgcacttatcataaagaaagcgacgaatttgtggcgaaaaaatttggtgcattaaaagaagctggtttagtgccagtattatgtattggtgaatctgaagcagaaaacgaagcaggcaaaacagaagaagtatgtgcgcgtcaaattgatgcagtcatcaatgcattaggcgtagaagcattcaacggtgcagtgatcgcatacgaaccaatctgggcgattggcacgggtaaatctgcgactccagcacaagcacaagcagttcatgcatttatccgtggtcacatcgcggcgaaatctcaagctgtggcagagcaagtaattattcaatacggcggttctgtaaatgatgcaaatgccgctgaattatttactcagccagacatcgatggcgcattagtgggtggtgcatcattaaaagcccctgcatttgcagtaattgttaaagcagcagctgcagcgaaaaactaa

SEQ ID NO: 66813 - protein, 263 aa, Haemophilus influenzae R2866
MARRPLVMGNWKLNGSKAFTKELIEGLKAELHDVTGCDVAIAPPVMYLGTAEAALSGCGCSCGGKSVIQLGAQNVDINVKGAFTGDISSEMLKDFGAKYIIIGHSERRTYHKESDEFVAKKFGALKEAGLVPVLCIGESEAENEAGKTEEVCARQIDAVINALGVEAFNGAVIAYEPIWAIGTGKSATPAQAQAVHAFIRGHIAAKSQAVAEQVIIQYGGSVNDANAAELFTQPDIDGALVGGASLKAPAFAVIVKAAAAAKN

SEQ ID NO: 66814 - DNA, 693 bp, Anabaena variabilis ATCC 29413
  CDS (1)..(693)
atgttcaaaacccaggcagagtctcaagagttcttaaaagaatttctgcctgcattagaggaaacacctcaagaacgggaagtgctgctttgcgttcctttcactgatctggccattttgtctcagagtctacatggtagccttgtacaactcggagcgcaaaacgtccactgggcagaaaatggagcctacactggtgaaatttctggcccaatgttgacagaaattggtgtccgttacgtcattgtcggtcatagtgaacgacgacaattttttggggaaacagacgagacagttaatttacgtctccaagctgctcaaaagtatgggttaacgccgattctttgtgtaggcgaaaccaaacaacagcgagattctggagaaactgaatcactaattgtcagccaactagacaaagacctcataaatgtcgatcagacgaatttggtaattgcttatgaaccaatttgggcaattggtactggtgacacttgtgaaacaacagaggctaatcgagttattggcttaattcgtagccaattgaagaatcctgatgtgccgattcaatatggtggctcagtcaaaccaaataatattgacgagattatggctcaaccagaaattgatggcgttctcgtgggcggagcaagtctagaagctgcaagtttcgcccgaattgtgaactatcagtaa

SEQ ID NO: 66815 - protein, 230 aa, Anabaena variabilis ATCC 29413
MFKTQAESQEFLKEFLPALEETPQEREVLLCVPFTDLAILSQSLHGSLVQLGAQNVHWAENGAYTGEISGPMLTEIGVRYVIVGHSERRQFFGETDETVNLRLQAAQKYGLTPILCVGETKQQRDSGETESLIVSQLDKDLINVDQTNLVIAYEPIWAIGTGDTCETTEANRVIGLIRSQLKNPDVPIQYGGSVKPNNIDEIMAQPEIDGVLVGGASLEAASFARIVNYQ

SEQ ID NO: 66816 - DNA, 696 bp, Synechococcus elongatus PCC 7942
  CDS (1)..(696)
atgtacaaaacccaggccgaagccctggagttcttgcaagcctttttgccacagctcagcgaaacgccagaatcgcgcaaagttgtgctctgtgcacccttcacgaccctgtctagcctgagcaaaaccctccacggcagccgggtgcgcgtgggtgctcaaaacattcactgggccaaggaaggggctttcactggcgaaatctcgggagcaatgctgacggagattggcgttcgctatgtagtggttggtcacagtgagcgccgtcagtacttcggggaaacagatgaaaccgtcaaccagcgcttgctggcagcccaatccttcggtctgttaccgattctctgcgtgggtgagtcgaagcaacagcgcgatgctggtgagactgaagccgtgatcagtcgtcagttggagcgtgggttggtcggtgccgatcaaaccaacttggtgattgcctacgaaccgatctgggcgatcgggactggtgatacctgtgcagccgaggaagctaatcgcgtcattggcctgattcgcagtcagctcaaggatactgatgtgccgatccagtacggtggttcggtcaaacctgagaacatcgacgagatcatggcgcagccagaaattgatggagccttggtcggcggtgctagcctcgaagctgagagtttcgcccgcatcgtcaattaccagagctaa

SEQ ID NO: 66817 - protein, 231 aa, Synechococcus elongatus PCC 7942
MYKTQAEALEFLQAFLPQLSETPESRKVVLCAPFTTLSSLSKTLHGSRVRVGAQNIHWAKEGAFTGEISGAMLTEIGVRYVVVGHSERRQYFGETDETVNQRLLAAQSFGLLPILCVGESKQQRDAGETEAVISRQLERGLVGADQTNLVIAYEPIWAIGTGDTCAAEEANRVIGLIRSQLKDTDVPIQYGGSVKPENIDEIMAQPEIDGALVGGASLEAESFARIVNYQS

SEQ ID NO: 66818 - DNA, 753 bp, Methylobacillus flagellatus KT
  CDS (1)..(753)
atgcgtcgcaagctggttgtcggcaactggaaaatgaatggcaaccttgctcagaacaagcggttgctggaagcgcttgtgcgtggcttgcaggatgttgagcatgtggatatcgctgtatgcgtcccttatccctacctgttccaggcccagaaaatactcagcggtaccaatatcgcctggggcgcgcagaatgtggccaagcatgaaaatggcgcttataccggcgaagtcagcgccgccatgctcaaggagttcggtgccagctatgtcattgttgggcactcggaacgcagcgatgcctattgtgaaagcaatgccaatattgccgagaagttcgcgatcgccaagcattacggcatcacacccatcttctgcgtcggggaaaccctgcaggagcgcgagtcaggggtgatggagtacgcaattgccaatcagctggatgcggtactttctgtctcggggggcgctttactcgaccaggcagtcattgcctatgagcctgtatgggcgatcggcaccaacaggacagccacgccggaacaggcacgtgctgcgcattctttcatacgcgagcgtatcgccgccatgcatccgggggcggccgaaagcgtaagaatcatctacgggggtagcgtaaacccgagaaatgcggcacaattgctgtctatgccggatatagacggcggattgatcggcaggtgttccttggatgctgatgattttgaaagaatttgccgcgctgcttgctga

SEQ ID NO: 66819 - protein, 250 aa, Methylobacillus flagellatus KT
MRRKLVVGNWKMNGNLAQNKRLLEALVRGLQDVEHVDIAVCVPYPYLFQAQKILSGTNIAWGAQNVAKHENGAYTGEVSAAMLKEFGASYVIVGHSERSDAYCESNANIAEKFAIAKHYGITPIFCVGETLQERESGVMEYAIANQLDAVLSVSGGALLDQAVIAYEPVWAIGTNRTATPEQARAAHSFIRERIAAMHPGAAESVRIIYGGSVNPRNAAQLLSMPDIDGGLIGRCSLDADDFERICRAAC

SEQ ID NO: 66820 - DNA, 732 bp, Crocosphaera watsonii WH 8501
  CDS (1)..(732)
atggctgtaggaaaaattatcattgcaggtaactggaaaatgcacaaaactcaggccgaggccctggagtttttaacggtattaaaatcaaaagtagaagagacaaacgaaaccagagagatcgttctctgtgtcccctttactgcccttagtatcctctccaaaagcttgcatgggggaaaagttcgtttaggggcccaaaacgtccactgggaggataaaggggcttacactggtgaaatttctggccccatgctaacagagttgagtgtagactatgttgtaattggtcatagcgaacgccgtcaatatttctcagaaaccgacgaaaccgctaatttacgagttattaccgcccaacgtcatggcttaacccctattctctgtgtgggagaaagcaagcaacaaagagacgcaggagaagccgaaagcgttatcattaatcagttgcaaaaaggtttagtggatgtagatcaaagcaacttagttattgcttatgaacctatttgggccatcggcaccggagatacttgtgagtcaacagaagctaaccgtattattcgtgtcattcgtgatcaattatctaataaaaatgtcaccattcaatatgggggttccgtaaagcctaataatattgatgaaattatggcccagtcagatattgatggggctttggttgggggtgcaagtttagatcctgttaactttgcccgtattattaattatcaataa

SEQ ID NO: 66821 - protein, 243 aa, Crocosphaera watsonii WH 8501
MAVGKIIIAGNWKMHKTQAEALEFLTVLKSKVEETNETREIVLCVPFTALSILSKSLHGGKVRLGAQNVHWEDKGAYTGEISGPMLTELSVDYVVIGHSERRQYFSETDETANLRVITAQRHGLTPILCVGESKQQRDAGEAESVIINQLQKGLVDVDQSNLVIAYEPIWAIGTGDTCESTEANRIIRVIRDQLSNKNVTIQYGGSVKPNNIDEIMAQSDIDGALVGGASLDPVNFARIINYQ

SEQ ID NO: 66822 - DNA, 753 bp, Exiguobacterium sp. 255-15
  CDS (1)..(753)
atgcgtaaaccaattatcgcaggtaactggaaaatgaatcttaccctcaaggatgctgtggcattcgctgaggaagtcaaaggaactgtacccgcttcttcgaaagtcgacgcggctgtctgtgcaccgtctgtattccttgcacacttgacagaagcgacagctggaacggacctgaaaatcggcgctcaaaacatgtacgaccaagagagcggcgcattcacaggtgaaatcagcccagtgatgctcaaagaacttggcgtaacatacgtcgtcctcggtcactcagaacgtcgtgagtactttggagaaactgatgcattcatcaacagcaaaacgaaaaaagcattcgagcatggtctcgtgccaatcgtttgtgtcggtgaaacactcgaagaacgcgaaggcggaaaattcgaatcagtgatccgtgaacaaacaacgaacagcttaaaaggtttgacagtcgatcaagtcaaaaaccttgttgttgcatatgagcctgtctgggcaatcggaacaggaaaatcagcaacagaacaagacgcacaagattcttgtaaattcgttcgcgatgtcatcgcagctgaattcggtacggaagctgcagaagcagtccgcatccagtacggcggtagtgtcaaaccggacaacatcaaagaatatatggctcagcctgacatcgacggtgctttagttggtggcgcaagtcttgagacaggatcgttcctcaaactcttggaggcgatttaa

SEQ ID NO: 66823 - protein, 250 aa, Exiguobacterium sp. 255-15
MRKPIIAGNWKMNLTLKDAVAFAEEVKGTVPASSKVDAAVCAPSVFLAHLTEATAGTDLKIGAQNMYDQESGAFTGEISPVMLKELGVTYVVLGHSERREYFGETDAFINSKTKKAFEHGLVPIVCVGETLEEREGGKFESVIREQTTNSLKGLTVDQVKNLVVAYEPVWAIGTGKSATEQDAQDSCKFVRDVIAAEFGTEAAEAVRIQYGGSVKPDNIKEYMAQPDIDGALVGGASLETGSFLKLLEAI

SEQ ID NO: 66824 - DNA, 771 bp, Rubrobacter xylanophilus DSM 9941
  CDS (1)..(771)
atggcgggggagaggaggccgctcatggcggccaactggaagatgaacaagaccgtgcgggaggcgcaggactacatggccgcgctcctgccgcgggtggccgacctcgccggggaggtggacgtggctgtcttcgccccgttcacctgcctctcagaggtcgcccggatggcggagggctcgggcgtcctcgccggggcgcagaacttcttctacgaggactcgggggcctacaccggcgaggtctccgccccgatgctcctggacgtgggggcgcgggcctccatcgtcggccactcggagcggcgggagctgttctgcgagaccgacgagtcggtggcgagaaaggcccgccgcgccgtggaggccgggctcctgcccgtcgtctgcgtcggggagaccgaggaggagcgcgacgcgggccggatgtgggagaaggtctccggtcaggtgcgggcggtggtcgaggggctcggggacgcctccggggggcgggtggtcttcgcctacgagcccatctgggccataggcaccggaaagaccgcctcccccgaggacgcccaggacgccatcggtcgcatccgggggctgctccgcgagctgaggggggaggggttcgccgaggaagcgcgcctcctctacggcggctccataaagccggagaacatctccgagatcatggcgcaaaaagacgtcgacggcggcctggtcggcggggcgagcctggaggtgggctcctttctgcagctcgtcgaggcggcgcgggggtga

SEQ ID NO: 66825 - protein, 256 aa, Rubrobacter xylanophilus DSM 9941
MAGERRPLMAANWKMNKTVREAQDYMAALLPRVADLAGEVDVAVFAPFTCLSEVARMAEGSGVLAGAQNFFYEDSGAYTGEVSAPMLLDVGARASIVGHSERRELFCETDESVARKARRAVEAGLLPVVCVGETEEERDAGRMWEKVSGQVRAVVEGLGDASGGRVVFAYEPIWAIGTGKTASPEDAQDAIGRIRGLLRELRGEGFAEEARLLYGGSIKPENISEIMAQKDVDGGLVGGASLEVGSFLQLVEAARG

SEQ ID NO: 66826 - DNA, 765 bp, Mesorhizobium sp. BNC1
  CDS (1)..(765)
atgacacccacaatccgccccctcatcgccggtaattggaagatgcacggcactgagagctcactgggtgagttgaaagccatcggcagcggttttgtggaggccgcgggagcgggagcggacggtgtcatttgtgtgccggcaacgctgctggcgcgcgcatccgacatattggcgaaaacgccggttgcgacgggtggccaggactgccatccggcgaccagcggtgcccatacgggcgatattgccgctgagatgctggccgactgcggcgcgagctacgtaatcgtcgggcattcggaacgccgcaccgatcatcatgaggccgatgaggatgtcgcagccaaggcggaagccgcctggcgcgccggcctcactgccatcatctgcatcggggaaaccaagatacagcgcgaggcgggcgaaacgctgtcggtgctttcccggcagattgccggttccgttccgccgggagctacggcgaaaaattccgtaatcgcctacgagccggtttgggccataggtaccggcctcacgccgacggtggaagatgtggcccaggcgcacgcccatctgcgtgccgagcttggaatgaagctgggtattgaagccgatgggatgcggcttctatacggcgggtcggtgaagccgtcgaatgcgggcgaactgctttccatactgaacgtggatggggcgctgattggcggcgccagcctcaaggctgccgatttcctcgcgatttcggcggctgttaaaggcaaataa

SEQ ID NO: 66827 - protein, 254 aa, Mesorhizobium sp. BNC1
MTPTIRPLIAGNWKMHGTESSLGELKAIGSGFVEAAGAGADGVICVPATLLARASDILAKTPVATGGQDCHPATSGAHTGDIAAEMLADCGASYVIVGHSERRTDHHEADEDVAAKAEAAWRAGLTAIICIGETKIQREAGETLSVLSRQIAGSVPPGATAKNSVIAYEPVWAIGTGLTPTVEDVAQAHAHLRAELGMKLGIEADGMRLLYGGSVKPSNAGELLSILNVDGALIGGASLKAADFLAISAAVKGK

SEQ ID NO: 66828 - DNA, 756 bp, Magnetospirillum magnetotacticum MS-1
  CDS (1)..(756)
atgaccaatcgacgcaagctgatcgccgggaactggaagatgaacgggctgaaggccgatggtctggcgctggccaagggcctggccgacaagctggcgtcggcctcgcccaattgcgacatgctggtctgtccgccctttaccctgatcgcccccgtcgccgatgccctggccgggtccaagctggcggtgggtggccaggattgccacgccaagacctcgggcgctcataccggcgacacctcgcccgccatgctggccgatctgggctgcaaatacgccatcgtcggccattccgagcgccgcaccgatcacgccgagaccgacaatgtggtcaaggccaaggccgccgccgccctgagcgcgggcctggtggccatcgtctgtatcggcgagaccctggcccagcgcgatgcgggccagaccatcgaggtcaaccgctcccagctcaacggctccctgcccgaaggcgccaatgccgccaatacggttatcgcctatgagccggtctgggccatcggcaccggccgggtcgccacgcccgcccaggcgcaggaagtgcatgccgctatccgcgccgaactggtcaagctggtgggcgcggccgaggcgggcaagatgcgcatcctctacggcggttccatgaagccggacaacgccaaggaattgctggccctgcccgatgtggatggcggcctgatcggcggcgcggcgctcaaggtggcggatttctgggccatcgccgagagctgctga

SEQ ID NO: 66829 - protein, 251 aa, Magnetospirillum magnetotacticum MS-1
MTNRRKLIAGNWKMNGLKADGLALAKGLADKLASASPNCDMLVCPPFTLIAPVADALAGSKLAVGGQDCHAKTSGAHTGDTSPAMLADLGCKYAIVGHSERRTDHAETDNVVKAKAAAALSAGLVAIVCIGETLAQRDAGQTIEVNRSQLNGSLPEGANAANTVIAYEPVWAIGTGRVATPAQAQEVHAAIRAELVKLVGAAEAGKMRILYGGSMKPDNAKELLALPDVDGGLIGGAALKVADFWAIAESC

SEQ ID NO: 66830 - DNA, 768 bp, Ehrlichia canis str. Jake
  CDS (1)..(768)
atgagttcaagtcttatagccggcacgttatttttagtaatttttatgtcattgctcatcgttgctaattggaagatgtatggtgactttattaccttttcctcttttacaaaggaattaagtattaatttaactaatgtaaaggctgatttagaggtagtgttatgtccaccttttattgcactacctaaagtggttgattgtatttcttgtattaagtttggtgcacagaattgcttttatgaaactgaaggaaaatatactggtgaagttagtgcgaaaatgttatatgattgtggatgtagttatgtaatagttggtcattctgaaagaagaagcatatttcatgaatctgattaccatgtacagttgaaagcaagtgctgctattaaatctgggttgataccaattgtttgtgttggagaaactttattagatagagaaaatggtatgctaaaagactcattattaaatcaatgttataattcttttcctaaaagtggtaaatttattatagcttatgagcctgtgtgggcaatagggagtaatactataccttctattgatatgataactgaagctttagaggttattaggtcatacgatagtacatctgacattatatatggtggtgcagtaaatcaagataatataagagatgttattgctataaatcaattatctggtgtattggttggtagtgcaagtttaaaattagatagtttttataatataatacatggtgctgtaaatgtgaggcaaaactaa

SEQ ID NO: 66831 - protein, 255 aa, Ehrlichia canis str. Jake
MSSSLIAGTLFLVIFMSLLIVANWKMYGDFITFSSFTKELSINLTNVKADLEVVLCPPFIALPKVVDCISCIKFGAQNCFYETEGKYTGEVSAKMLYDCGCSYVIVGHSERRSIFHESDYHVQLKASAAIKSGLIPIVCVGETLLDRENGMLKDSLLNQCYNSFPKSGKFIIAYEPVWAIGSNTIPSIDMITEALEVIRSYDSTSDIIYGGAVNQDNIRDVIAINQLSGVLVGSASLKLDSFYNIIHGAVNVRQN

SEQ ID NO: 66832 - DNA, 732 bp, Burkholderia cepacia R1808
  CDS (1)..(732)
atgatcggcaactggaagatgcacggccggctggccggcaaccaggcgctgctgaacgaagtggtgcagggcgcggacgcagtggtggccggcacgtcgatcggcgtatgcgtgccgttcccctatctcgcgcaggttcaggcggtgctcggcggcagccgggtggcgttcggcgcacaggacgtgtcggcgcacgagcagggcgcgtacaccggcgaagtggcggccgcgatggtcgcggaattcggcgcgcagtatgcgatcgtcggtcactcggagcgtcgcgcgtatcacggcgagcgcaacgagaccgtcgccgcgaaggcgcagcgcgcgctcgcggcgggcctcacgccggtcgtgtgcgtcggcgaaacgctcgacgagcgcgaagcgggcacgacggagcaggtcgtcggtgcgcagctcgacgccgtgctggccgtgctgacggccgacgaggcggcgcgcatcgtcgtcgcgtacgagccggtctgggcgatcggcaccggcaagagcgcgacgtcggcgcaggcgcaggacgttcacgcggtcctgcgtgcgcgtctcgcggcgaagggtgcggcgcacgtgtcggtgctgtacggtggcagcgtcaagccggacaacgcggaagaactgttcgcgcagccggacatcgacggcggcctgatcggcggcgcgtcgctgaaggctgaagattttctggcgatctgccgggctgcgcgttga

SEQ ID NO: 66833 - protein, 243 aa, Burkholderia cepacia R1808
MIGNWKMHGRLAGNQALLNEVVQGADAVVAGTSIGVCVPFPYLAQVQAVLGGSRVAFGAQDVSAHEQGAYTGEVAAAMVAEFGAQYAIVGHSERRAYHGERNETVAAKAQRALAAGLTPVVCVGETLDEREAGTTEQVVGAQLDAVLAVLTADEAARIVVAYEPVWAIGTGKSATSAQAQDVHAVLRARLAAKGAAHVSVLYGGSVKPDNAEELFAQPDIDGGLIGGASLKAEDFLAICRAAR

SEQ ID NO: 66834 - DNA, 756 bp, Listeria monocytogenes str. 1/2a F6854
  CDS (1)..(756): transl_table=11
atgcgtaaaccaattattgctggtaactggaaaatgaacaaaactgctgcaaaagcaggacaatttgcagaagacgtaaaaaataacgtgccatcaagcgatgctgttgaatcagtagttgctgcaccggctctatttttacaagaattagttcgtcttactgaaggaactaatcttcgtgtatctgcacaaaactgttattttgaagacgaaggtgctttcactggcgaaattagcccgtttgcacttgctgacttaggcgtttcttatgttattatcggacactctgaacgtcgtgagtacttccacgaaacagacgaagatattaacaaaaaagcacatgcaatcttcaaacacggcatgacaccaatcatttgctgtggtgaaacattagatcaacgtgaagctggtcaaacagatacttgggtacgtggtcaaatccgtgcagctcttgctggattaacggaagaacaagtaatcaaatctgttattgcttatgaaccaatttgggcaatcggtactgggaaatcttctacaagtgctgatgcaaacgaaacttgtgcagttattcgtgcagaagttgctgacgctgtatctcaaaaagcagcagacgcagttcgtattcaatacggcggtagcgtaaaacctgaaaacattgctgattatcttgcagagtccgacattgacggcgctcttgtaggtggggcaagcttagaaccagcatcgttcttagcattattggaggcagtaaaataa

SEQ ID NO: 66835 - protein, 251 aa, Listeria monocytogenes str. 1/2a F6854
MRKPIIAGNWKMNKTAAKAGQFAEDVKNNVPSSDAVESVVAAPALFLQELVRLTEGTNLRVSAQNCYFEDEGAFTGEISPFALADLGVSYVIIGHSERREYFHETDEDINKKAHAIFKHGMTPIICCGETLDQREAGQTDTWVRGQIRAALAGLTEEQVIKSVIAYEPIWAIGTGKSSTSADANETCAVIRAEVADAVSQKAADAVRIQYGGSVKPENIADYLAESDIDGALVGGASLEPASFLALLEAVK

SEQ ID NO: 66836 - DNA, 723 bp, Bacillus cereus G9241
  CDS (1)..(723): transl_table=11
atgaataaaactctatctgaagcagttagcttcgtagaggaagttaaaggtcaaatcccagcagcttcagctgttgatgcagtagtttgctctccagctctattcttagagcgccttgtagcagcgactgaaggaactgatttacaagtaggtgcacaaaacatgcacttcgaaaaaaatggtgcattcactggcgaaattagcccagtagcacttagcgacttaaaagtaggctacgtagtacttggccactctgagcgtcgtgaaatgtttgctgaaacagatgagtcagtaaacaaaaagactatcgcagcatttgaacatggtttaacaccaatcgtatgttgtggtgagactttagaagagcgcgaaagcggaaaaacatttgatctagtagcaggtcaagtaacaaaagcacttgcaggtttaacagaagagcaagttaaagcaactgttatcgcttatgagccaatctgggctatcggtacaggtaaatcttcttcttctgcagatgcaaacgaagtatgtgcgcacatccgtaaagttgttgcagaagctgtttctccagaagctgcagaagctgttcgtatccaatacggcggtagcgtaaaaccagaaaacattaaagagtacatggcacaatctgacatcgacggcgctttagttggcggtgctagcttagagcctgcttcgttcttaggtcttctgggggcggtaaaatga

SEQ ID NO: 66837 - protein, 240 aa, Bacillus cereus G9241
MNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEAVSPEAAEAVRIQYGGSVKPENIKEYMAQSDIDGALVGGASLEPASFLGLLGAVK

SEQ ID NO: 66838 - DNA, 756 bp, Rubrivivax gelatinosus PM1
  CDS (1)..(756)
atgagtgacatccgccgcaaactggtggtcggcaactggaagatgcacggcacccacgccacgaacgaggccctgctcgaagggctgaagtcggccggccccttgccctgcgaggccgcggtgtgcgcaccgtttccctatctggcgcaggcggcggagcggctggcccgcagtgcgatcgcctggggtgcgcaggactgctcggtgcacgagcagggcgcctacaccggcgaggtctcggtggcgatgctggccgacttcggctgccgctacgtgatcgtcgggcactcggagcggcgtgccctgcacgccgaaagcgatcagctggtggccgacaaggcccaggcggcgctggccaggggtgtgacgccgatcgtctgcgtcggcgagacactcgcgcagcgcgatgcaggcgagacggaagacgttgtcaagcggcagctctcggccgtgatccatacgcttgcgcactgcgttggcgagatggtggtggcctatgagccggtgtgggccatcggcacgggccgcacagccagcccggagcaagcgcaggcggtccatgcgctgctgcgggctcagcttgctgcggccacgccgcgcgctgcgcagatgaagttgctctacggcggcagcgtcaagcccgacaacgccgcgacgctgttcgctcaggtcgacatcgacggcggcctgatcggcggcgcgtcgctgaaagccgctgatttcatcgcgatctgtcgtgccgcgagcacgcgctga

SEQ ID NO: 66839 - protein, 251 aa, Rubrivivax gelatinosus PM1
MSDIRRKLVVGNWKMHGTHATNEALLEGLKSAGPLPCEAAVCAPFPYLAQAAERLARSAIAWGAQDCSVHEQGAYTGEVSVAMLADFGCRYVIVGHSERRALHAESDQLVADKAQAALARGVTPIVCVGETLAQRDAGETEDVVKRQLSAVIHTLAHCVGEMVVAYEPVWAIGTGRTASPEQAQAVHALLRAQLAAATPRAAQMKLLYGGSVKPDNAATLFAQVDIDGGLIGGASLKAADFIAICRAASTR

SEQ ID NO: 66840 - DNA, 723 bp, Pseudomonas fluorescens PfO-1
  CDS (1)..(723)
atgcacggtacccgcgccagcgtcgctgagctgatcaacggccttcgtcatctggccttgccaagcggtgttgatgtcgcggtattcccgccttgcttgtatatcaatcaagtgattgatggcttgaaaggtaaatcgatttcggttggtgcgcagaattctgcggtggaatccatgcaaggtgccttgacgggcgagattgcgccgagtcagttggtggatgcaggttgttccctggtgcttgtcgggcactccgagcgtcgccagatcatgggcgagcgagacggaatgctgaatcgcaagtttgcagcggcgcaggcatgtggcttgattccggtgttgtgtgtaggggagaccctggagcagcgcgaagccggaaagactcttgaggttgtcgggcgtcagctgggcagtatcatcgaggagctgggtgtcggtgcttttgccaatgcggtgattgcttatgagccggtctgggcgattggtaccgggctgactgcaacgccgcagcaggctcaggatgtgcataaggccattcgtgagcagttggcggcagagaattctgaagtggcacgaggtgtgcgacttctatacggcggcagcgtgaaggcggccaatgcggtcgaactgttcggcatgccggatatcgatggggggctcattggtggggcttccctgaatgcagatgagttcggtgcgatttgtcgcgccgcgggaaactga

SEQ ID NO: 66841 - protein, 240 aa, Pseudomonas fluorescens PfO-1
MHGTRASVAELINGLRHLALPSGVDVAVFPPCLYINQVIDGLKGKSISVGAQNSAVESMQGALTGEIAPSQLVDAGCSLVLVGHSERRQIMGERDGMLNRKFAAAQACGLIPVLCVGETLEQREAGKTLEVVGRQLGSIIEELGVGAFANAVIAYEPVWAIGTGLTATPQQAQDVHKAIREQLAAENSEVARGVRLLYGGSVKAANAVELFGMPDIDGGLIGGASLNADEFGAICRAAGN

SEQ ID NO: 66842 - DNA, 720 bp, Rhodospirillum rubrum
  CDS (1)..(720)
atgaacggcctcaaggccgagggccagggcctcgcccgggatcttgcccagaggcttaacaaggccggtggggtcgatttcgaccttcttctttgtccgccttttccgttgatcagcacggtggtcggcgccgtggccggatcgggcatcgccgttggcggccaggattgccatgccaaggccaagggcgcccatacgggcgatgtctcggccccgatgctggccgatctcggctgccagttcgtcatcgtcggccattcggaacgccgggccgatcacggcgaaaccgatgccctggtcaaggccaaggccgaggccgccctggccgccggtctgatcgccgtgatctgcgtcggcgagaccgaggcccagcgcgacgccggggaaaccctggccgtggtctcgggccaattggccggatcgttgcccacccacgcggattcgggcaaggtggtcatcgcctatgaacccgtctgggccatcggtaccggtcgcgtgccgacgaccgaggatgtcgccaaggtccatggcgcgctgcgcaaggatctggtcggcgccctgggggcggacggcaatggcgtgcgcctgctttacggcggatcggtcaagcccgacaacgccgccgagctgatggccttggaaaacgtcgatggcgccctggtcggcggcgccagcctcaaggccgaggatttctgggcgatcgcccagtcctgcgcttaa

SEQ ID NO: 66843 - protein, 239 aa, Rhodospirillum rubrum
MNGLKAEGQGLARDLAQRLNKAGGVDFDLLLCPPFPLISTVVGAVAGSGIAVGGQDCHAKAKGAHTGDVSAPMLADLGCQFVIVGHSERRADHGETDALVKAKAEAALAAGLIAVICVGETEAQRDAGETLAVVSGQLAGSLPTHADSGKVVIAYEPVWAIGTGRVPTTEDVAKVHGALRKDLVGALGADGNGVRLLYGGSVKPDNAAELMALENVDGALVGGASLKAEDFWAIAQSCA

SEQ ID NO: 66844 - DNA, 741 bp, Rhodospirillum rubrum
  CDS (1)..(741)
atgcacaagaccatcgccgaggccgaggcctatgtcggcgaactgaccgcctcgccgctgctcgaccgggtcgaggcgttcatcgtgccgcccttcaccgccctggccgccgtccaccgggctttgggcgacgccccggtccacctgggcgcccagaccatgcattggcaagacgagggggcgcagaccggcgagatttccccgctgatgctgcgcgattgcggcgtcggtatcgtcgaactcggccattccgagcgccgcgccagccatggggaaaccgacgccaccgtcaacgccaaggtggccagcgccctgcgccacggtttgcggccgctgatctgcgttggcgaccagggcgacgacctggacgccggagcctcgatcgaaacggtcctgcgccaagtcaagctggccatcaaaggcatcgacacggccagcctgggccgggcgctcatcgcctatgaaccggtctgggcgatcggcgaagccgggcgaccggccgaaccggcgcatgtggccgaggttcatggcgccctgcgcgccatgctcggccaacggggcttggctgccctgcccctgctttatggcggcagcgtcgatcgcgccaatgccggggctctcaccgccctagccaacgttgacggcctgttcgtcggccgcgccgcctggacggcgcgcggcttcgaagaggtgatcgaggccgctttgcacggggccaaggaccgggcgggtcttgcgtaa

SEQ ID NO: 66845 - protein, 246 aa, Rhodospirillum rubrum
MHKTIAEAEAYVGELTASPLLDRVEAFIVPPFTALAAVHRALGDAPVHLGAQTMHWQDEGAQTGEISPLMLRDCGVGIVELGHSERRASHGETDATVNAKVASALRHGLRPLICVGDQGDDLDAGASIETVLRQVKLAIKGIDTASLGRALIAYEPVWAIGEAGRPAEPAHVAEVHGALRAMLGQRGLAALPLLYGGSVDRANAGALTALANVDGLFVGRAAWTARGFEEVIEAALHGAKDRAGLA

SEQ ID NO: 66846 - DNA, 819 bp, Ralstonia metallidurans CH34
  CDS (1)..(819)
atggacccgacccccctcccgccgcacccagttcgcggccaacgccgacgactgctggtggccggcaactggaagatgaacggcagtctggccggcgtacaggcgctggcggcggcgatcgccgacggtgccgtggcacgcctggaccgtgtgcaactggtactgttcccaccctttacctacctgcccgaggcgcagcgccgcctgggcgccagcggcatggcctggggcgcacagaacgtctcggggcatgaagacggtgccttcaccggcgaagtatcggcccagatgttgcgggagttcggctgcgcctgtgtgctggtcggccactccgagcggcgcacgctgttcggcgagaacgacgccgtcgtggcgcgcaagttccttgcggtccgccaagccggaatgacgccggtgctgtgcgtcggcgagtcgctgccggagcgcgagcaaggtgcgaccgaggatgtggtggcgcgccagctccaggcggtgcttgatctggccggggcgagtgcgtttgccgatgcggtcgtggcctacgagcccgtgtgggcgatcggcacgggcaaaacggccacacccgcccaggcgcaggacgttcacgccttcatccgtggccgactggccgaggcggacccggccatcgcagcgtcgctgcacgtcctttacggcggcagcatgaagcgagcgaacgcacgcgagctgctcgccatgcccgacatcgatggcggcctgttgggcggggcgtcgctgaacgtcgacgagttcatggccgtggccatcacggcccagcggctcgcgcaggagaacacttaa

SEQ ID NO: 66847 - protein, 272 aa, Ralstonia metallidurans CH34
MDPTPLPPHPVRGQRRRLLVAGNWKMNGSLAGVQALAAAIADGAVARLDRVQLVLFPPFTYLPEAQRRLGASGMAWGAQNVSGHEDGAFTGEVSAQMLREFGCACVLVGHSERRTLFGENDAVVARKFLAVRQAGMTPVLCVGESLPEREQGATEDVVARQLQAVLDLAGASAFADAVVAYEPVWAIGTGKTATPAQAQDVHAFIRGRLAEADPAIAASLHVLYGGSMKRANARELLAMPDIDGGLLGGASLNVDEFMAVAITAQRLAQENT

SEQ ID NO: 66848 - DNA, 756 bp, Enterococcus faecium
  CDS (1)..(756)
atgcgtaaacctattatcgcaggtaactggaaaatgaacaaaactgcatcagaagcaaaagaatttgctgaagcagtaaaaaacaaaatcccttcaaatgacaaagttgattcagtcatcggatctcctgcattattcttacaagaattaatgacatcagctgaaggtacagaactaaaaatctcagcacaaaactgctactgggaaaactcaggtgcgttcactggtgaaacttcaccagcagctcttgctgatctaggtgttcattatgtgatcatcggacattcagaacgtcgtgaatatttccatgaaacagacgaagacatcaataaaaaagcaaaagctatctttgcaaatggtatgacaccaatcctatgctgcggcgaatctttagaaacctatgaagcaggcaaaactgctgaatggatcgaaggacaaattacagctggtttagctgatctttcagctgaacaagtgtcaaacatggttattgcttatgaaccaatctgggcaatcggtactggtaaatcagctgacgcacaaatcgctgacgaaatttgtggagttgtacgtcaaacagttgaaaaactttatggaaaagaagtatcagaagcagttcgtatccaatacggcggttctgtaaaaccagaaaatattgctgaatacatggcaaaagaaaatgttgacggtgctttagtcggtggcgcaagcttgcaagcagattcattcttgtcattgttagacgctgtaaaataa

SEQ ID NO: 66849 - protein, 251 aa, Enterococcus faecium
MRKPIIAGNWKMNKTASEAKEFAEAVKNKIPSNDKVDSVIGSPALFLQELMTSAEGTELKISAQNCYWENSGAFTGETSPAALADLGVHYVIIGHSERREYFHETDEDINKKAKAIFANGMTPILCCGESLETYEAGKTAEWIEGQITAGLADLSAEQVSNMVIAYEPIWAIGTGKSADAQIADEICGVVRQTVEKLYGKEVSEAVRIQYGGSVKPENIAEYMAKENVDGALVGGASLQADSFLSLLDAVK

SEQ ID NO: 66850 - DNA, 768 bp, Magnetococcus sp. MC-1
  CDS (1)..(768)
atgcgtcgagctttaattgctggtaactggaagttgaacggtacgacccaagcggccacagccctagccaccgctgtgcgggatggtgtggccgcaaacaagcccgattgcgatgtattggtgtgccccacctttaccgtgctcagtgcggtgcagggggttgtggccggttcaggtgtggatcttggtgcgcaaaatatggctgttgccagcagtggcgcgtttaccggtgagatctccggtgagatgctcaaggatgttggctgtagctatgtgatcctgggccattctgagcggcgcacgctgtttggtgaaaccaatgaacaggtggcacaaaaggtagcctctgcctatcgggatggtttgacccccattctttgcgtgggtgagaccctagagcagcgtgaagcggaacagaccatgcaggtgttggagcaacaactgctggcctgcttgccggtgctgcccgctgatgcggcaaaacagcagcaactggtggtggcgtatgaaccggtttgggccattggcaccggaaaagtggccagcaccgcccaggcgcaagaagcccatgcctttatccgtggtctgctggctaaagagttgggggccaatgtggccgatgcggtacgtattctctatggcggttccatgaaacccgataatgccaaggaattgttgggacaagccgatgtggatggcggtttgatcggcggggcagcattaaaggcgaatgatttccttgccatcatggatggtttaacggcataa

SEQ ID NO: 66851 - protein, 255 aa, Magnetococcus sp. MC-1
MRRALIAGNWKLNGTTQAATALATAVRDGVAANKPDCDVLVCPTFTVLSAVQGVVAGSGVDLGAQNMAVASSGAFTGEISGEMLKDVGCSYVILGHSERRTLFGETNEQVAQKVASAYRDGLTPILCVGETLEQREAEQTMQVLEQQLLACLPVLPADAAKQQQLVVAYEPVWAIGTGKVASTAQAQEAHAFIRGLLAKELGANVADAVRILYGGSMKPDNAKELLGQADVDGGLIGGAALKANDFLAIMDGLTA

SEQ ID NO: 66852 - DNA, 786 bp, Thermobifida fusca
  CDS (1)..(786)
atggcaaccgccaagcgcaagccgctgattgcgggtaactggaagctgaacaacaaccacctcgaggccatcgcgctggtgcagaagatggccttcgccctcaacgacgccgactacgacgccgcagacatcgcggttctgccgccgttcaccgcgatccgcagcgtgcagaccctggtggaaggggacaaactgcggatcacctacggtgcccaggacatctcccagcacgagaagggcgcctacaccggtgaagtgtccggcccgatgctggccaaactcaactgcacgtacgcgctggccgggcactcggagcggcgcgaataccaccacgaggacgacgcggtcgtcaacgcgaaagtcaaagcggccttcgccagcggcatcacgcccatcctgtgcctgggtgaagggttggaggtccgcaaggcgggacgccacgtcgagcacaccctcgcccagttggaaggcgcgctcaagggcgtgaccgaggagcaagtccgcaccctggtcgtggcctacgagccggtgtgggcgatcggtaccggcgaagtcgccacgcccgaggacgcccaggaggtgtgcgcggcgctgcgcaagcggattggtgaactgtactcccctgaggccgcacagcagacccgcatcctctacggcgggtcggtgaagagcggcaacgtcgcagcgatcatggcgcaagcagacgttgacggcgcgctggtcggcggtgcgagcctggacgctgacgagttcgtcaagctgatccgcgccgcggtccagggctga

SEQ ID NO: 66853 - protein, 261 aa, Thermobifida fusca
MATAKRKPLIAGNWKLNNNHLEAIALVQKMAFALNDADYDAADIAVLPPFTAIRSVQTLVEGDKLRITYGAQDISQHEKGAYTGEVSGPMLAKLNCTYALAGHSERREYHHEDDAVVNAKVKAAFASGITPILCLGEGLEVRKAGRHVEHTLAQLEGALKGVTEEQVRTLVVAYEPVWAIGTGEVATPEDAQEVCAALRKRIGELYSPEAAQQTRILYGGSVKSGNVAAIMAQADVDGALVGGASLDADEFVKLIRAAVQG

SEQ ID NO: 66854 - DNA, 735 bp, Novosphingobium aromaticivorans DSM 12444
  CDS (1)..(735)
atgaacgggagccgcgccatgctggccgaagcccgcgcgatcgaccgggcggcggggcgctatcccgacgtgcaggtggccatcgcccctccgttcaccctgatcggcgcgctgcgcgaagcggtgagcgccatgggcgtgggcgggcaggactgccacaccgaggtcaagggcgcgcataccggcgacgtctcggcagcgatgctggtcgacaccggggccgacttcgcgattctaggccacagcgagcgccgcaaggatcacggcgagaacgacgcgctggtcaaggccaaggccgaagcggcgctgacggcgggcctcgacatcatcgtatgtgtcggcgaaacgctggaccagcgcgacgcgggcaaggcggaggcggttgtctcatcgcaggtcgacggttcgcttccttcaccggaaacggccgccgaggcagttgcagcgggtaaggtcgcggttgcctatgagccggtctgggccatcggcaccggccgcgtggccgctgtcgaggacgtggtgacgatgcacgccgcaatccgcgcccgcctcgtcgcgctttatggtgaatccggcagcaaggtccgcattctctacggcggttcggtgaattccggaaacgccgcggaactgctggcggcggacggcgtcggcggcgcgctggtcggcggcgcgagcctgacggccgaggcgttcctgcccatcgtcgcggcggcgggtaccggcgaagcctga

SEQ ID NO: 66855 - protein, 244 aa, Novosphingobium aromaticivorans DSM 12444
MNGSRAMLAEARAIDRAAGRYPDVQVAIAPPFTLIGALREAVSAMGVGGQDCHTEVKGAHTGDVSAAMLVDTGADFAILGHSERRKDHGENDALVKAKAEAALTAGLDIIVCVGETLDQRDAGKAEAVVSSQVDGSLPSPETAAEAVAAGKVAVAYEPVWAIGTGRVAAVEDVVTMHAAIRARLVALYGESGSKVRILYGGSVNSGNAAELLAADGVGGALVGGASLTAEAFLPIVAAAGTGEA

SEQ ID NO: 66856 - DNA, 756 bp, Cytophaga hutchinsonii
  CDS (1)..(756)
atgagaaagaaagtaattgcaggaaattggaaaatgaacaaaacacttgaagaaggcttgtcattagcttctgaagtggcaaatatggcaaaggatgaagttcctgcagatgtaaatcttgtaatgtgtattccttatatctcattggctgctgtttcaaaagtaatcaacgataaagtagctatcggcgcgcaaaacgtatatcaaaaagaatccggtgcatttacaggtgagatttcagctccgatgttgaagtctgtaggtgtaaagtatgtaatcatcggacacagcgaaagaagagaatattttggtgaaacaaatcagcaattggctgataaagtaactatttccctggcaaatggtttaacgccattattctgctgcggagaaacacttgcacaaagagaagcaggtatccacatcaattttgtaaatgctcagttaacagaaagcttattccatttatcaccggaagatttcaaaaaagtagttattgcatacgaaccaatctgggcaatcggaacaggcgttacagcttctgacgagcaggcacaggaaatgcacgcgaagatccgtgagcacctggcatctaaatatggtgctgcagtagcagatgagatcagcattttatatggtggcagcatgaaaccggacaatgcaaaaggcctgttggcttgcaaagatattgacggggggttgatcggcggtgcatcgttaaagtcacgtgactttattgatatcgctaagtcatactaa

SEQ ID NO: 66857 - protein, 251 aa, Cytophaga hutchinsonii
MRKKVIAGNWKMNKTLEEGLSLASEVANMAKDEVPADVNLVMCIPYISLAAVSKVINDKVAIGAQNVYQKESGAFTGEISAPMLKSVGVKYVIIGHSERREYFGETNQQLADKVTISLANGLTPLFCCGETLAQREAGIHINFVNAQLTESLFHLSPEDFKKVVIAYEPIWAIGTGVTASDEQAQEMHAKIREHLASKYGAAVADEISILYGGSMKPDNAKGLLACKDIDGGLIGGASLKSRDFIDIAKSY

SEQ ID NO: 66858 - DNA, 756 bp, Clostridium thermocellum ATCC 27405
  CDS (1)..(756)
atgagtagaaaagttattgcagccggaaactggaaaatgaacaaaacaccgaaggaagccgttgagttcgtacaggctttaaaaggaagagtggcagatgccgataccgaagtagtggtaggtgtgccctttgtatgtttgcctggagttgttgaggcggcaaaaggatcaaatatcaaggttgccgcacaaaacatgcactgggaggaaaaaggtgcttttaccggagaagtatccggacctatgctggccgaacttggtgttgactatgttatcataggtcactccgaaagaagacaatacttcggtgaaacagatgaaactgttaataaaaaggtacatgcggcattcaaatatggcttaaagccgattatctgcgttggtgagtccctcactcaaagagaacagggggttaccgccgaactggtaagataccaggttaagattgctttgctgggactttccgccgaacaggtgaaagaggctgtaatagcctatgaacctatctgggccattggtacaggaaagactgctacaaatgagcaggcagaagaagtttgcggcataataagagaatgcataaaagagctttacggtcaggatgttgccgaagctatcagaattcagtacggcggaagtgttaatgctgccaatgcggcagaactcttcaatatgccgaacatcgacggaggccttgtgggaggcgcaagcttaaagcttgatgactttgagaaaatcgcaaagtacaacaagtaa

SEQ ID NO: 66859 - protein, 251 aa, Clostridium thermocellum ATCC 27405
MSRKVIAAGNWKMNKTPKEAVEFVQALKGRVADADTEVVVGVPFVCLPGVVEAAKGSNIKVAAQNMHWEEKGAFTGEVSGPMLAELGVDYVIIGHSERRQYFGETDETVNKKVHAAFKYGLKPIICVGESLTQREQGVTAELVRYQVKIALLGLSAEQVKEAVIAYEPIWAIGTGKTATNEQAEEVCGIIRECIKELYGQDVAEAIRIQYGGSVNAANAAELFNMPNIDGGLVGGASLKLDDFEKIAKYNK

SEQ ID NO: 66860 - DNA, 708 bp, Microbulbifer degradans 2-40
  CDS (1)..(708)
atgtgcggagattttcgtactaaccagaagcgccttgaggatttatcttcactttggtttggagttcatcaaacggaagtgagtgttagccccgcatacccgtatttggcgcaagccgcaggcatgctggagaacacaaatatatccctgtgtgcgcaggatgtaagcacccgagaaaacggggctttcaccggcgaagttagcgcggcaatgttagccgatatggggtgcaggtatgtgatggtggggcacagtgagcgccgtcattatcacaacgaaggttacgatttaattgcggaaaagtttcaagccgtttgcgaggctaaaatgattcccattttgtgcttaggcgagaccacagctgatcgcgaagcagatagaacgtttgacgttattggtcgccagttgttaaaggtggttaatgcgtgtggcttagaagggttggcgaaaggtgttgttgcctacgagcctatctgggctatagggacggggcgtgcggctacaccagagcaagctcaagatgtgcactcctacattagggaaatattggggccagaaggcgaacaaatccgtattttatacggcggtagcgttaagcctgataccgctgaaggattatttgctaaaaaagatatcgatggtgcattggtggggggggcttcccttgatgcgcgtgactttgtcgcaatatgtcgagcggcagagtag

SEQ ID NO: 66861 - protein, 235 aa, Microbulbifer degradans 2-40
MCGDFRTNQKRLEDLSSLWFGVHQTEVSVSPAYPYLAQAAGMLENTNISLCAQDVSTRENGAFTGEVSAAMLADMGCRYVMVGHSERRHYHNEGYDLIAEKFQAVCEAKMIPILCLGETTADREADRTFDVIGRQLLKVVNACGLEGLAKGVVAYEPIWAIGTGRAATPEQAQDVHSYIREILGPEGEQIRILYGGSVKPDTAEGLFAKKDIDGALVGGASLDARDFVAICRAAE

SEQ ID NO: 66862 - DNA, 756 bp, Microbulbifer degradans 2-40
  CDS (1)..(756)
atgggtgtgaaatctaaaatagttattggcaattggaaaatgaacggcagtgccgagttggtggagtcgttcacacgtaccatgttggataatcaagcggcttacgcaggtattcgcgtggtactttgcccgccgtttactcttctgcaggctatggctgatgcgctggaaggtgggcctatcttgcttggcgcacaaaatgtaagcgagtttgagcaaggggcgcataccggcgaaatatccgcgcctatgttggcttcgatgggcaccaaaatggttattattggccatagcgaacgaagggcgtcgcgcggtgaaaacgatcgtattattgccgctaaagtaaaacaggcgctttctgtaggtatgctacccgtactttgcgtgggggaaaccgccgaagaaaaagcgcgtggtgactcaggagcggtggtgtggcagcagttatcggttgtgctacatgctattggcagtgagctctttggccagctgatagtagcttatgaacccatatgggctatcgggtctgggtcgactgcctctactgacgatattcttacaattactaccgctattcacgcgaagttagcgcagctaggtattcagttaccactcttatacggtggcagtgttaacgcaggcaacgcagctcaaatatcatctttacctactattagcggcttgttggtgggcggtgcctccttgcaggcaggccagtttctacttttgtgtagtaataccgcaaagggcgcatag

SEQ ID NO: 66863 - protein, 251 aa, Microbulbifer degradans 2-40
MGVKSKIVIGNWKMNGSAELVESFTRTMLDNQAAYAGIRVVLCPPFTLLQAMADALEGGPILLGAQNVSEFEQGAHTGEISAPMLASMGTKMVIIGHSERRASRGENDRIIAAKVKQALSVGMLPVLCVGETAEEKARGDSGAVVWQQLSVVLHAIGSELFGQLIVAYEPIWAIGSGSTASTDDILTITTAIHAKLAQLGIQLPLLYGGSVNAGNAAQISSLPTISGLLVGGASLQAGQFLLLCSNTAKGA

SEQ ID NO: 66864 - DNA, 723 bp, Oenococcus oeni PSU-1
  CDS (1)..(723)
atgcgaaaaccaattattattgcaaactggaagatgaattttttgcgcgatcaagctaatttatacgttaaaaagttgattaaaaagcttggtaacaaagaaaatatcgaagttggaattgcttctcaggatctttttttaactgatttgattaaactaactgaaaatactcccatttcgatagttgctcaaaatgcttattgggaaaattttggtccctttacgggcgaaacttctcccaaagcattagccaatgttggggtagattatgtcatgcttgggcattttgaacgacgcgaactattcaacgaaactaattcaactgttaatttaaaagttcggacagctttgaataacggtatggatgtgattgttgatgttgaggagctggagcaggttgctccggtcctagaaggtgtttcagaagaacagatgcaacaaattatcatcggattcgaaccgacctttgcaattggaaccggaatgtcagccagcactaagggtgccgaggatgttgccgaacaaattagaaagacggttagaaagctctatggaagcgatgtcgccgattcaacaagaattttgtatggcggatcggtgaatcgcgataatttaaaaagtttaatcaaacaaaaggatatcgatggtgttttagtcggtaaagctgctttggactttcaaagtttttgggaacttgttgaaattattgagaattcgctttaa

SEQ ID NO: 66865 - protein, 240 aa, Oenococcus oeni PSU-1
MRKPIIIANWKMNFLRDQANLYVKKLIKKLGNKENIEVGIASQDLFLTDLIKLTENTPISIVAQNAYWENFGPFTGETSPKALANVGVDYVMLGHFERRELFNETNSTVNLKVRTALNNGMDVIVDVEELEQVAPVLEGVSEEQMQQIIIGFEPTFAIGTGMSASTKGAEDVAEQIRKTVRKLYGSDVADSTRILYGGSVNRDNLKSLIKQKDIDGVLVGKAALDFQSFWELVEIIENSL

SEQ ID NO: 66866 - DNA, 756 bp, Pediococcus pentosaceus ATCC 25745
  CDS (1)..(756)
ttgcgtactccaattattgctggaaactggaaaatgaacaaaaacccccaagaaactcaagaattcttggatgctatcaaaggtaagttacctgatgcttctgtagtagaatcagttattgctgctcctgctatcgatttaagcactttagtagctttctcaaaagatgaacaactaaagactgctgctgaaaacagctacttcgaagacgaaggtgctttcactggcgaaacaagtcctaaggctttaaacgaaatgggcgttaactatgttgttatcggtcattcagaacgtcgacaatacttcggtgaaactgacgaagatattaacaagaaggctaaggcaatcttcaacaacaacatgacaccaatcatttgctgtggagaaactcttgaacaacgtgaagctggcgaaactaatgaatgggttgctggtcaaatcacaaacgctcttaaagatttaactgcagaacaagttgctgcatcagtgatcgcttacgaaccaatctgggctatcggtactggtaagacagcttcaagtgatcaagctcaagaagtttgtcacgtaattcgtgaaacagttgctaagctttacgatcaaactgttgctgacaaagtacgtattcaatacggtggtagtgtaaaacctgctaacattgctgaattaatgggcaaagaagatattgatggtggacttgttggtggagcatcacttgatccagaatcattcctagaattagttaactacaagggttaa

SEQ ID NO: 66867 - protein, 251 aa, Pediococcus pentosaceus ATCC 25745
MRTPIIAGNWKMNKNPQETQEFLDAIKGKLPDASVVESVIAAPAIDLSTLVAFSKDEQLKTAAENSYFEDEGAFTGETSPKALNEMGVNYVVIGHSERRQYFGETDEDINKKAKAIFNNNMTPIICCGETLEQREAGETNEWVAGQITNALKDLTAEQVAASVIAYEPIWAIGTGKTASSDQAQEVCHVIRETVAKLYDQTVADKVRIQYGGSVKPANIAELMGKEDIDGGLVGGASLDPESFLELVNYKG

SEQ ID NO: 66868 - DNA, 693 bp, Trichodesmium erythraeum IMS101
  CDS (1)..(693)
atgtacaagacccaactagaagctaaagagtttctcgagggtttgatgtctcaactaacaaaaacccccgaagaacgtgaagtagttctctgcactcccttcacggcactagattttatgtcaaaaattttgcatgggagtctgatcaggttaggtgcgcaaaatgttcactgggaagatgaaggagcatatacaggagaaatttctggcttaatgctgaaagatgtgggagttagttatgtaattgtgggtcacagtgagcgccgtcaatattttggcgaaactgatgaaacggtgaatatgcgcttaaaagctgctcagaagcacggtttaacccctattctctgtgtgggagaaactaaacaacaaagagattcaggtgagacagaatcacatatattttctcagttggccaatgatttagttgatgtcgatcaagaaaatctagtaattgcttatgaaccaatatgggccattggtactggtgatacctgtgaagctaaagaagctaaccgagttattggtttaattcgtggtaagttaaataattctaatgtcactattcaatatggcggttctgttaaacctaataatgttgatgatattatggcacaagaagaaattgatggtgctttagttgggggtgcaagtttgaatcccgagagttttagtcgtttggttaactatcaataa

SEQ ID NO: 66869 - protein, 230 aa, Trichodesmium erythraeum IMS101
MYKTQLEAKEFLEGLMSQLTKTPEEREVVLCTPFTALDFMSKILHGSLIRLGAQNVHWEDEGAYTGEISGLMLKDVGVSYVIVGHSERRQYFGETDETVNMRLKAAQKHGLTPILCVGETKQQRDSGETESHIFSQLANDLVDVDQENLVIAYEPIWAIGTGDTCEAKEANRVIGLIRGKLNNSNVTIQYGGSVKPNNVDDIMAQEEIDGALVGGASLNPESFSRLVNYQ

SEQ ID NO: 66870 - DNA, 717 bp, Moorella thermoacetica ATCC 39073
  CDS (1)..(717)
atgcataatacaacggaagaggcccgggatttggtcaccctgctgcggcccctggtaggtacggcccgggcggaggtagtggtctgcccgccttttacggccatagcggccacagttaacgccgcctccgggtccaacatctccgttggtgcccaggacctcttctgggaggataagggggcctacaccggcgaggtttccgggcccatgctgcgggaccttggctgccgttatgtcatcatcggccactccgaacggcgccagtatttcggcgagactgatgccacagtgaataaaaagctcctggctgcctaccgcaatgaattgctccccatcgtctgcgtcggtgaaaccctggcggagagggaggccggccacaccctggaggttgtcggccgccaggtccgggaagggttaaagggcctggaaaccggccaggcccgggatctggttgtcgcctacgagcccgtctgggccattggcaccggcaagacagctacggccgccgacgcccaggaggttatcgcctttatccgtaaaaccctcggagagatgtacggcgaaacagccgcggcaatcaggatccagtacggcggcagcgtcaagccggagaatattgccgagctcatggcccagcccgatatcgacggtgccctggtgggcggggccagcctggatgccgtttccttcgccgccattgttaattacgatcaatag

SEQ ID NO: 66871 - protein, 238 aa, Moorella thermoacetica ATCC 39073
MHNTTEEARDLVTLLRPLVGTARAEVVVCPPFTAIAATVNAASGSNISVGAQDLFWEDKGAYTGEVSGPMLRDLGCRYVIIGHSERRQYFGETDATVNKKLLAAYRNELLPIVCVGETLAEREAGHTLEVVGRQVREGLKGLETGQARDLVVAYEPVWAIGTGKTATAADAQEVIAFIRKTLGEMYGETAAAIRIQYGGSVKPENIAELMAQPDIDGALVGGASLDAVSFAAIVNYDQ

SEQ ID NO: 66872 - DNA, 747 bp, Thiobacillus denitrificans ATCC 25259
  CDS (1)..(747)
atgcgcaagaagctcgtagccggtaactggaaaatgcacggcagcctcgccgagaacgcggcgctgctcgccgcgctcaaacccgctctgcaggggatcgaggctgcggtctgcgtgccgtttccctatctggcacaggtgcagaccgcgctggcaggctcgtcgcttgcgtggggcgcacaaaacgtttccgagcatggcaagggtgcatttaccggtgaagtgtcggcgtcaatgctgctcgatttcggctgcaagtacgtcatcgtcggccattccgagcggcgcagcctctatggcgagtcggacgcgctcgtggccgcgaaatacatggctgcgcaggccgccgggctcacgccgatcctctgcgtcggcgaatcgctcgccgagcgtgagtcgggcgtcaccgagcaggtcgtcgcgcgccagctcgacgccgtggtcgccgccgccggcatcgcatcgttggcccgggcggtcgtcgcgtacgagcccgtctgggcgatcggaacgggcaagaccgcgagccccgaacaggcgcaggccgtgcacgcgttcattcgcggcaagctcgccgacctcgatgctgcggtcgcagccggcctgatcattcagtatgggggtagcgtaaaggccgcaaatgcggcagaattgatggctcagccggatatcgacggcgggctgatcggcggcgcctcgctgcttgccgatgagttcgtggcaatctgtcgggcggctgccaaataa

SEQ ID NO: 66873 - protein, 248 aa, Thiobacillus denitrificans ATCC 25259
MRKKLVAGNWKMHGSLAENAALLAALKPALQGIEAAVCVPFPYLAQVQTALAGSSLAWGAQNVSEHGKGAFTGEVSASMLLDFGCKYVIVGHSERRSLYGESDALVAAKYMAAQAAGLTPILCVGESLAERESGVTEQVVARQLDAVVAAAGIASLARAVVAYEPVWAIGTGKTASPEQAQAVHAFIRGKLADLDAAVAAGLIIQYGGSVKAANAAELMAQPDIDGGLIGGASLLADEFVAICRAAAK

SEQ ID NO: 66874 - DNA, 741 bp, Silicibacter sp. TM1040
  CDS (1)..(741)
atggcgcgcaaactcgcggcaggcaactggaaaatgaacggcaccggcgagcacctcgccgaacttgaaaaccttgcacagggtgatctgccggagggcgtcgatgtgctgatctgcccgcccgcaacgctcatctcgcgcgcggccgaccgtgccggtgacatcgcaattggcgggcaggattgccacgcaaagacgtctggcgcacatactggcgatctgagcgctgacatgcttcgggatgcgggggcaacctatgtgatcattggccactcggaacgccgcgccgatcacggcgaaggagacgcggatgtgcgcgccaagaccgaggccgctcaggctgcgggccttgtggccgtggtttgcatcggtgaaacgctcgaggagcgcgaggctggcaccaccctagaggtggttggcgcgcagctcgcgggctccctgcccgatggtgtcacggcggagaacacagttgtcgcctatgaacccgtctgggccatcggcacaggcaaggttcccacgctcgatcagatcgctgaggtgcatgacgctctgcgtgcagatctggtggcgcgctttggtgcagcgggcaaggacctgccactgctctatggtggttccgtgaaaccaggcaatgcagccgagatctttggggtttccaacgtcgatggcgcgcttgtgggtggcgccagcctaaaggctgcggacttcggccccatcattgcggccctcgccgcaagctga

SEQ ID NO: 66875 - protein, 246 aa, Silicibacter sp. TM1040
MARKLAAGNWKMNGTGEHLAELENLAQGDLPEGVDVLICPPATLISRAADRAGDIAIGGQDCHAKTSGAHTGDLSADMLRDAGATYVIIGHSERRADHGEGDADVRAKTEAAQAAGLVAVVCIGETLEEREAGTTLEVVGAQLAGSLPDGVTAENTVVAYEPVWAIGTGKVPTLDQIAEVHDALRADLVARFGAAGKDLPLLYGGSVKPGNAAEIFGVSNVDGALVGGASLKAADFGPIIAALAAS

SEQ ID NO: 66876 - DNA, 753 bp, Chloroflexus aurantiacus
  CDS (1)..(753)
atgcgtattccattaatcgccggcaactggaagatgtacaagacggttggcgaagcaacgacgctggtgcgcgatttgctggccggtctcggtgaattatcggatcgcgaagctatcgtttgtccgcccttcaccgcactcgctgccgtggcagcgctggtcgccgatagcccgctggggttgggggcgcagaatctgtaccccgaagcgcagggtgcgtttaccggtgaggtctcgccgccaatgctggttgatattggctgtcgttacgtcattattggtcatagcgagcgtcgtcagtattttggcgagagtgatgcgtttgtgaatcgaaaattgcgtgccgcccttgcccatggtctgcgtcccattgtgtgtgttggcgagagtaagccccagcgtgacgccgggcaggccgagccgattgtgacggcacaggtgcgtgctgccctgcttgaggtgcctccggatcaaatggcaaacgtggtgattgcttacgagccgatctgggccattggtaccggcgatacggcaactcctgcggatgcgcaggcgatgcatgcggcaattcgggcaactctggccgaattgtacggttctgagattgccgcaacggtacgtatccagtacggtggcagtgtgaagccggataatatcgacgaattgatggctcagcccgatattgatggtgcgttggttggtggtgcttcgttacaggcagccagttttctgcggatcatccattatcagtag

SEQ ID NO: 66877 - protein, 250 aa, Chloroflexus aurantiacus
MRIPLIAGNWKMYKTVGEATTLVRDLLAGLGELSDREAIVCPPFTALAAVAALVADSPLGLGAQNLYPEAQGAFTGEVSPPMLVDIGCRYVIIGHSERRQYFGESDAFVNRKLRAALAHGLRPIVCVGESKPQRDAGQAEPIVTAQVRAALLEVPPDQMANVVIAYEPIWAIGTGDTATPADAQAMHAAIRATLAELYGSEIAATVRIQYGGSVKPDNIDELMAQPDIDGALVGGASLQAASFLRIIHYQ

SEQ ID NO: 66878 - DNA, 768 bp, Polaromonas sp. JS666
  CDS (1)..(768)
atgaaaaagctgattgcgggaaactggaagatgaatggcagtctggctgccaatgccgcgttgctggaggcgctgggggaagggctgaaagacctgagcctcccgctcacctgcgaggtggccgtgtgcgtaccagcgccctacctggcacaggttcaaggcctgaaatcgagccgatccagcctgtcagccctggcagtgggggcgcaggatgtttcggcgcaagcctcgggtgcctacaccggcgaggtcagtgcggccatgctccaggacttcggctgccggtatgtgatcgtgggccattccgagcgtcgccagtaccacggcgaatcagatgcgctggtggccgacaaggccaaggcggcactggcggcagggatcacgcccatcgtctgcattggtgaaacgctggccgagcgcgagggcggccacacggaagaggtggtcaagcgccagcttgccgcggtgatccatgtcaacgggcactgcatcagcgagatcgtggtggcctacgaacccgtctgggccataggcaccggaaaaacggcttcgcccgaagaggcgcaggcggttcatgcggtgctgcgggcccagctcagggcggcgaccgaccatccgatgcgtgtgaaaatcctgtacggcggcagcatgaatgcggccaatgcggcagcgctcctgagccagcccgacatcgacggcggcctgataggcggcgcctcgctcaaagccccggattttttgaaaattattgctgcagcccagatttga

SEQ ID NO: 66879 - protein, 255 aa, Polaromonas sp. JS666
MKKLIAGNWKMNGSLAANAALLEALGEGLKDLSLPLTCEVAVCVPAPYLAQVQGLKSSRSSLSALAVGAQDVSAQASGAYTGEVSAAMLQDFGCRYVIVGHSERRQYHGESDALVADKAKAALAAGITPIVCIGETLAEREGGHTEEVVKRQLAAVIHVNGHCISEIVVAYEPVWAIGTGKTASPEEAQAVHAVLRAQLRAATDHPMRVKILYGGSMNAANAAALLSQPDIDGGLIGGASLKAPDFLKIIAAAQI

SEQ ID NO: 66880 - DNA, 744 bp, Drosophila simulans
  CDS (1)..(744)
atgagccgaaagttctgcgtgggaggcaactggaagatgaacggcgaccagaagtccatcgccgagatcgccaagaccctgagctcggccgccctcgaccccaacacggaggtggtcatcggctgcccggccatctacctgatgtacgcccgcaacctgcttccctgcgagctgggtctggccggccagaacgcctacaaggtggccaagggcgccttcaccggcgagatctcgcctgcgatgctgaaggacatcggcgccgactgggtgatcctgggacactcggagcgccgcgccattttcggcgagtcggacgccctgatcgccgagaaggccgagcacgccctggccgaaggcctcaaggtcatcgcctgcattggtgagaccctggaggagcgcgaggctggcaagaccaacgaggtgatggcccgccagatgtgcgcctacgcccagaagatcaaggactggaagaacgtggtggtggcctacgagcccgtctgggccattggcaccggcaagaccgccacaccagatcaggctcaagaggtccacgccttcctgcgccagtggctgagcgacaacatctccaaggaggtgtccgctagcctgcgtatccagtatggtggatccgtgaccgccgccaacgccaaggagctggccaagaagcccgacatcgatggcttcctggtcggaggcgcctccctgaagcccgagttcgtggacatcatcaacgcccggcagtaa

SEQ ID NO: 66881 - protein, 247 aa, Drosophila simulans
MSRKFCVGGNWKMNGDQKSIAEIAKTLSSAALDPNTEVVIGCPAIYLMYARNLLPCELGLAGQNAYKVAKGAFTGEISPAMLKDIGADWVILGHSERRAIFGESDALIAEKAEHALAEGLKVIACIGETLEEREAGKTNEVMARQMCAYAQKIKDWKNVVVAYEPVWAIGTGKTATPDQAQEVHAFLRQWLSDNISKEVSASLRIQYGGSVTAANAKELAKKPDIDGFLVGGASLKPEFVDIINARQ

SEQ ID NO: 66882 - DNA, 744 bp, Drosophila yakuba
  CDS (1)..(744)
atgagccgaaagttctgcgtgggaggcaactggaagatgaacggcgaccagaagtccatcgccgagatcgccaagaccctcagctccgccgccctggaccccaacacggaggtggtcattggctgcccggccatctacttgatgtacgcccgcaacctgctgccctgcgaactgggtctggccggccagaatgcctacaaggtggccaagggtgccttcaccggcgagatctcgccggcaatgctgaaggacatcggcgccgactgggtgatccttggacactcggagcgtcgcgccatctttggcgagtcggacgccctgatcgccgagaaggccgagcacgccctggccgagggcctcaaggtcatcgcctgcattggtgagaccctggaggagcgcgaggccggcaagaccaacgaggtggtggcccgccagatgtgcgcctacgcccagaagatcaaggactggaagaacgtggtggtggcctacgagcccgtctgggccattggcaccggcaagaccgccacacccgatcaggcacaagaagtccacgccttcctgcgccagtggctgagcgacaacatctccaaggaggtctccgccagcctgcgcatccagtacggtggatccgtgaccgccgccaacgccaaggagctggccaagaagcccgacatagatggcttcctcgtcggaggcgcctccctgaagcccgagttcgtggacatcatcaatgcccgccagtaa

SEQ ID NO: 66883 - protein, 247 aa, Drosophila yakuba
MSRKFCVGGNWKMNGDQKSIAEIAKTLSSAALDPNTEVVIGCPAIYLMYARNLLPCELGLAGQNAYKVAKGAFTGEISPAMLKDIGADWVILGHSERRAIFGESDALIAEKAEHALAEGLKVIACIGETLEEREAGKTNEVVARQMCAYAQKIKDWKNVVVAYEPVWAIGTGKTATPDQAQEVHAFLRQWLSDNISKEVSASLRIQYGGSVTAANAKELAKKPDIDGFLVGGASLKPEFVDIINARQ

SEQ ID NO: 66884 - DNA, 774 bp, Giardia lamblia
  CDS (1)..(774)
atgcctgctcgtcgtcccttcatcggcggtaacttcaagtgtaacggctctcttgactttatcaagagccacgtggcggcaattgctgcccataagatccctgattccgtggacgtcgtcattgccccctccgccgtacacctgtcaacagccattgcggcaaacacgtcaaaacagttgaggatagcagcgcagaatgtgtacctagaggggaacggggcgtggactggcgagacaagtgttgagatgcttcaggacatgggtttgaagcatgtgatagtagggcactctgaaagacgcagaatcatgggggagaccgacgagcaaagcgccaagaaggctaagcgtgccctggaaaaggggatgacggtcatcttctgcgtcggagagaccttggatgagcgcaaggccaaccgcaccatggaggtgaacatcgcccagcttgaggcgcttggcaaggagctcggagagtccaagatgctctggaaggaggttgtcattgcttacgagcccgtgtggtccattggcacgggcgtggtggccacgcccgagcaggcagaggaggtacatgtggggctccgaaagtggtttgcggagaaggtttgtgccgagggcgcacagcatatccgtatcatttacgggggatcggccaatggaagcaactgcgagaagctcggccagtgtccgaatattgacggcttccttgtcggtggcgcttccctcaagccggagtttatgacgatgatcgacattcttgcgaagacccgtacatag

SEQ ID NO: 66885 - protein, 257 aa, Giardia lamblia
MPARRPFIGGNFKCNGSLDFIKSHVAAIAAHKIPDSVDVVIAPSAVHLSTAIAANTSKQLRIAAQNVYLEGNGAWTGETSVEMLQDMGLKHVIVGHSERRRIMGETDEQSAKKAKRALEKGMTVIFCVGETLDERKANRTMEVNIAQLEALGKELGESKMLWKEVVIAYEPVWSIGTGVVATPEQAEEVHVGLRKWFAEKVCAEGAQHIRIIYGGSANGSNCEKLGQCPNIDGFLVGGASLKPEFMTMIDILAKTRT

SEQ ID NO: 66886 - DNA, 1071 bp, Astasia longa
  CDS (1)..(1071)
atgggttactacacagtgacaacccaggtgcaagagaattatgtccaatcctggtacaaagggaaattggctcctttcgttggtggttgtcttttagcaacatgcctctccctcagtttcagcggagaaaccgctcagcagaactatgcagtttccgcaaaaccagccgtccatgcgattccactgacagccatgggcgttgggactcggtctggagtgccacaaactgctgcacaaaagcgtttccccagcaggtcttcggctctccaaatggcagctgcagtgtgggcaccctctgcaaagatgcctcggaagttcattgttggaggaaactggaagtgcaatggtgatcggccaagcatcaatgccttggtgcaagccttgaacactggcgaaagcgccatcggatctggcgttgaggttgttgtggcaccacccatgttgtatggtgactatgccagaggtttgttgcgacctgactttggagttgcattccagaactgctggactggtggcaatggagccttcactggagaggtcagcgccaacatgataaaagatgcaggatttgactgggtgatcttggggcactctgagcgccgcagcctgccagagatcatggagacagatgcaactgtggccaccaagactgcctatgctttgaaagcaggcctgaaagtcatcctctgcattggggaaactcttgatgcccggcagagtgggaagacggatgaggtcaacgctcggcagcttgctgcagtagcagagaaagtgtctgactggagcaacatcgtcattgcctacgagcctgtctgggccattggcacaggggtggtggccaccccagagcaggcgcaggagacccatgctcagatccgcaagtggcttgctgagaacctcagcccccaagtggcccagcagatgcgaatcatgtatggcgggtccgccaatgcggccaatgccgactctcttgccaagcagccggatgtggacggtttcttggtgggtggtgcctcactgaagccagagttcttgaagatcgcggagtcctggaagagtaaggtggaatga

SEQ ID NO: 66887 - protein, 356 aa, Astasia longa
MGYYTVTTQVQENYVQSWYKGKLAPFVGGCLLATCLSLSFSGETAQQNYAVSAKPAVHAIPLTAMGVGTRSGVPQTAAQKRFPSRSSALQMAAAVWAPSAKMPRKFIVGGNWKCNGDRPSINALVQALNTGESAIGSGVEVVVAPPMLYGDYARGLLRPDFGVAFQNCWTGGNGAFTGEVSANMIKDAGFDWVILGHSERRSLPEIMETDATVATKTAYALKAGLKVILCIGETLDARQSGKTDEVNARQLAAVAEKVSDWSNIVIAYEPVWAIGTGVVATPEQAQETHAQIRKWLAENLSPQVAQQMRIMYGGSANAANADSLAKQPDVDGFLVGGASLKPEFLKIAESWKSKVE

SEQ ID NO: 66888 - DNA, 768 bp, Astasia longa
  CDS (1)..(768)
atgccacgaaaattttttgttggtggcaattggaaacgtaacggaacaagggacaccatttccaagatcgttgaagagttcaacaaaggcccttcagttgccgatgctgatgttgaggtcgttattggtgttccattcgtgtatgccgacttcactcaagagaaactccgcaaagactggaaattgtcggtgcagaactgctggattggaaagggtggggcattcactggagaagtgtcagcagagatgatcaaggatgctggaattccatgggtcatccttgggcactctgagaggaggcacttgcctgaactcaaggaatctgatgagactgttgccatcaaggtggcttatgcacttgcaaatggcctgaaagtgatggcttgcattggggagcttcttgaagaacgagaaaaaggtcaaactcaggcagtgaatgaacgtcagctgaaagcaattgctgccaagctgaaggaggaagattggaagaatgttgtcattgcatatgaacctgtgtgggccattggaacgggaaaggtggcaacccctgaacaggcccaagaggttcacgagcaggttcgtgcatgggttgccagcaatgtcagtccctcagttgcagctgaagttcgcattctgtatggtggttcagtgacagcgaagaactctgtggaactggcagggaagccagatgtggatggtttcttggttggtggagcgtctctcaagcccgagttcttggacatcgttgctgcttacaagcacaagtaa

SEQ ID NO: 66889 - protein, 255 aa, Astasia longa
MPRKFFVGGNWKRNGTRDTISKIVEEFNKGPSVADADVEVVIGVPFVYADFTQEKLRKDWKLSVQNCWIGKGGAFTGEVSAEMIKDAGIPWVILGHSERRHLPELKESDETVAIKVAYALANGLKVMACIGELLEEREKGQTQAVNERQLKAIAAKLKEEDWKNVVIAYEPVWAIGTGKVATPEQAQEVHEQVRAWVASNVSPSVAAEVRILYGGSVTAKNSVELAGKPDVDGFLVGGASLKPEFLDIVAAYKHK

SEQ ID NO: 66890 - DNA, 849 bp, Chlamydomonas reinhardtii
  CDS (1)..(849)
atgcagctttgcaaggttcagcgtgccagtgccgctcgcagctcgcgggcgagccgtagccagcgtgttgaggtcgtgtgtgccagcagcgccaagttcttcgtgggtggcaactggaagtgcaacggcagcgtggcaaacgtcgcaaagcttgtcgatgagctcaacgctggcactatccctcggggtgtggacgtggttgtggcccctcccttcatttacatcgactacgtcatgcagcacctcgaccgggacaagtaccagctctcggctcagaacgcttggatcggcggcaatggtgccttcaccggcgaggtcagcgctgagcagctgactgatttcggcgtgccgtgggttattctgggtcactcggagcgccgctcgctattcggcgagtccaacgaggtggtggcgaagaagacttcgcacgccctggccgcgggtctcggtgtaatcgcctgcattggcgagactctcgagcagcgcaacagcggctctgtgttcaaggttctggacgcccagatggatgcacttgttgacgaggtgaaggactggactaaggtcgtgctcgcgtatgagccagtgtgggccatcggcacgggcgtggtggcgtcgccggagcaggcgcaggaggtgcacgcctacctgcgccaatactgcgctaagaagctcggcgcggctgtcgccgacaagctccgcatcatctatggcggctccgtcagcgacaccaactgcaaggacctctcgaagcaggaggacattgacggcttcctggtcggcggcgcctcgctaaagggcgcggcattcgtaacgatctgcaacgctgcggggcctaaggcgaagccgtaa

SEQ ID NO: 66891 - protein, 282 aa, Chlamydomonas reinhardtii
MQLCKVQRASAARSSRASRSQRVEVVCASSAKFFVGGNWKCNGSVANVAKLVDELNAGTIPRGVDVVVAPPFIYIDYVMQHLDRDKYQLSAQNAWIGGNGAFTGEVSAEQLTDFGVPWVILGHSERRSLFGESNEVVAKKTSHALAAGLGVIACIGETLEQRNSGSVFKVLDAQMDALVDEVKDWTKVVLAYEPVWAIGTGVVASPEQAQEVHAYLRQYCAKKLGAAVADKLRIIYGGSVSDTNCKDLSKQEDIDGFLVGGASLKGAAFVTICNAAGPKAKP

SEQ ID NO: 66892 - DNA, 924 bp, Porphyra yezoensis
  CDS (1)..(924)
atggctttcatcaccagtggtgcagcggctgtcagcggggcgtcgctgactgcgcgccgtgccttcactggcgccgcggtgtgcccagttccgtcggggcggacttccccggcggccgcgacgtggagcatgtcggccggcggtcttcgtaccttcctcgtgggcgggaactggaagtgcaacctgtccaaggatgctatcaccagcctgtgcaaggagcttgcggccgcgcctgacctggagacggataaggtggaggtggtgctggcgcctccgacgccctacctggaccacacccgctctgtactgcgccaggactttgaggtcgcggcgcagaatatctgggtgggtggcccaggtgcctataccggcgagacagctgccgagatgatcaaggacgtcggctgcacgtgggtgattttgggccattcggagcggcgtaacctgctgcaaatccgggagtcggacgactttattgcgcaaaaaacgaagaccgccctctcccacggcctgaaggtcatgttctgcattggtgagacgctggaggagagggaggagggccgcaccctggatgtgtgcgtgcggcagctgcatgcgcttgccgagacgatcggggcggacgactggaaggacgtggtgattgcgtacgagccggtttgggccatcgggacgggtaagattgccactcctgaccaggtggaggaggttcacgagaagatccgtcactacctggcgggagacgtcaacgacaaggtggctcaggagacccgcatcctgtatggtggcagcgtcagccctggcaactgcaatgagctcgctcagctgcctgacgtggacggcttcctggtgggtggcgctagcctcaaggcctccttcctggaggtcatcgagtccttcaagagcgacctcgcggcaactgtgtag

SEQ ID NO: 66893 - protein, 307 aa, Porphyra yezoensis
MAFITSGAAAVSGASLTARRAFTGAAVCPVPSGRTSPAAATWSMSAGGLRTFLVGGNWKCNLSKDAITSLCKELAAAPDLETDKVEVVLAPPTPYLDHTRSVLRQDFEVAAQNIWVGGPGAYTGETAAEMIKDVGCTWVILGHSERRNLLQIRESDDFIAQKTKTALSHGLKVMFCIGETLEEREEGRTLDVCVRQLHALAETIGADDWKDVVIAYEPVWAIGTGKIATPDQVEEVHEKIRHYLAGDVNDKVAQETRILYGGSVSPGNCNELAQLPDVDGFLVGGASLKASFLEVIESFKSDLAATV

SEQ ID NO: 66894 - DNA, 759 bp, Helicosporidium sp
  CDS (1)..(759)
atggctcgcaaattcttcgtgggtggcaactggaaatgcaacggcaccaaggagtcggtgtcggcgctggtgaaggctctgtctgcggccaagctgccgtcggctgacaaggtggatgtcgtggtcgctccgactttcctgcacctgtcgcaggctctgtcctcgcttccctcccgcgtggaggtgtccgctcaaaactgctggatcaagggcggcggcgccttcacgggcgaaatctcggcggagcagatcgtggatctgggtgccaagtgggtgattctgggccactcagagcgtcgccacatcatgggcgagtccgacgccacggtggcggacaaggtggcctacgccctgtccaagggtctgggcgtcatcttctgcatcggcgagcagctgagcgagcgcgaggccaaccataccatggacgtctgcactcgccagatggccgctctcgcctccaaaatctccgactggagccgcatcgtggtcgcctacgagcccgtctgggccatcggcacgggcaaggtggccaccccggaccaggcgcaggaagtgcacggcctctgccgtcgctgggtcgcccagcatgtcagccccgccgtcgccgagaccacccgcatcatctacgggggatctgtgactgcgggcaactgccgcgacctggctgcccagcccgacatcgacggtttcctggtgggcggagcctccctcaagcccgagtttgtggacatcgtggcctctgcagagctcaaatcgtga

SEQ ID NO: 66895 - protein, 252 aa, Helicosporidium sp
MARKFFVGGNWKCNGTKESVSALVKALSAAKLPSADKVDVVVAPTFLHLSQALSSLPSRVEVSAQNCWIKGGGAFTGEISAEQIVDLGAKWVILGHSERRHIMGESDATVADKVAYALSKGLGVIFCIGEQLSEREANHTMDVCTRQMAALASKISDWSRIVVAYEPVWAIGTGKVATPDQAQEVHGLCRRWVAQHVSPAVAETTRIIYGGSVTAGNCRDLAAQPDIDGFLVGGASLKPEFVDIVASAELKS

SEQ ID NO: 66896 - DNA, 750 bp, Macaca fascicularis
  CDS (1)..(750)
atggcgccttccaggaagttcttcgttggggggaactggaagatgaacgggcggaagcagaatctgggggagctcatcggcactctgaacgcggccaaggtgccggcagacaccgaagtggtttgtgctccccccactgcctatatcgacttcgcccggcagaagctagatcccaagattgctgtggctgcacagaactgctacaaagtgactaatggggcctttactggggagatcagccctggcatgatcaaagactgcggagccacgtgggtggtcctggggcactcagagagaagacatgtctttggggagtcagatgagctgattgggcagaaagtggcccatgctctggctgagggactcggagtaatcgcctgtattggggagaagctagatgaaagggaagctggcatcactgagaaggttgttttcgagcagacaaaggtcatcgcagataatgtgaaagactggagcaaggttgtcctggcctatgagcctgtgtgggccattggtactggcaagactgcaacgccccaacaggcccaggaagtacatgagaagctccgaggatggcttaagtccaacgtctctgaagcagtggctcagagcacccgtatcatttatggaggctctgtgactggggcaacctgcaaggagctggccagccagcctgacgtggatggcttccttgtgggtggtgcttccctcaagcccgaattcgtggacatcatcaatgccaaacaatga

SEQ ID NO: 66897 - protein, 249 aa, Macaca fascicularis
MAPSRKFFVGGNWKMNGRKQNLGELIGTLNAAKVPADTEVVCAPPTAYIDFARQKLDPKIAVAAQNCYKVTNGAFTGEISPGMIKDCGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKSNVSEAVAQSTRIIYGGSVTGATCKELASQPDVDGFLVGGASLKPEFVDIINAKQ

SEQ ID NO: 66898 - DNA, 747 bp, Bombyx mori
  CDS (1)..(747)
atgggtcgcaaatttgttgttggaggtaactggaagatgaatggtgacaaaaatcaaatcaacgaaatagttaataatctaaaaaagggacctctagatcctaatgttgaggtaattgttggtgttcctgctatttacctgtcttatgtgaagactatcattcctgataatgtcgaagttgcagcccagaactgttggaagtctccaaaaggagcttttactggtgaaatttcacccgctatgatcaaagacgttggagtaaattgggttatacttggtcattctgaaagaagaacaatttttggtgaaaaagatgaacttgttgctgaaaaggttgctcatgcccttgaatctggcttgaaagtcattgcctgtattggtgagactctcgaagagagagaatctggcaagactgaggaagttgtttttagacaattaaaagctttagtatcggccattggtgacaaatgggaaaatattgtgcttgcctatgaacctgtatgggctattggtacaggcaagactgctactccccaacaggctcaagatgtccaccatgctcttcgtaactggttgtcggccaatgtgagtgggagtgtatctgacgctgtacgtattcagtacggtggctcggtcacagctgctaatgctaaggagcttgcatcctgcaaagacattgatggtttcttagttggtggagccagtcttaagcctgagtttgtagaaattgtaaatgctaatcaataa

SEQ ID NO: 66899 - protein, 248 aa, Bombyx mori
MGRKFVVGGNWKMNGDKNQINEIVNNLKKGPLDPNVEVIVGVPAIYLSYVKTIIPDNVEVAAQNCWKSPKGAFTGEISPAMIKDVGVNWVILGHSERRTIFGEKDELVAEKVAHALESGLKVIACIGETLEERESGKTEEVVFRQLKALVSAIGDKWENIVLAYEPVWAIGTGKTATPQQAQDVHHALRNWLSANVSGSVSDAVRIQYGGSVTAANAKELASCKDIDGFLVGGASLKPEFVEIVNANQ

SEQ ID NO: 66900 - DNA, 915 bp, Oryza sativa
  CDS (1)..(915)
atggcggcgccgtcgtccctcgcgtcctcccacctctcccgcctcgccgacctccgccgcgcaggcgtcgccgccgccgccccggcgcatccgcagcagctccgcctcgggtgctcccgccgccgcgcccagcgcgtcgtcgccatggccggatccggcaagttcttcgttggaggcaactggaagtgcaatggaacgaaggactctgtcagcaagcttgtgactgaattgaatgctgctacacttgaacctgatgttgatgttgtggttgcaccaccattcatttatattgatcaggttaagaactcactaactgatcgtattgaggtatctgctcagaatgtttggattggaaaaggaggagcatacactggagagatcagtgcggagcaattggtggacattggctgccaatgggttattcttgggcattcagagcgtagacatgtcattggtgaagatgatcagtttattgggaagaaggctgcatatgccttgagtcaaaatgtaaaggttattgcctgcataggggagctgttggaagagagagaagcagggaaaacttttgacgtctgttttaagcagatgaaggcttttgcagacagtattacaaactgggcggatgtagtaattgcatatgagcctgtttgggctattggaaccgggaaagttgctactcctgagcaagctcaggaagttcatgctgctgttcgtgattggttgaaaaccaacgtgtcacctgaggttgcttccggcattcgaattatatatggaggttctgtaaatgcagccaattgtgccgagctagcaaagaaagaagatattgacggcttccttgttggtggtgcctctttgaagggtccggattttgccactattatcaactcggtgacttccaagaaagttgcagcctga

SEQ ID NO: 66901 - protein, 304 aa, Oryza sativa
MAAPSSLASSHLSRLADLRRAGVAAAAPAHPQQLRLGCSRRRAQRVVAMAGSGKFFVGGNWKCNGTKDSVSKLVTELNAATLEPDVDVVVAPPFIYIDQVKNSLTDRIEVSAQNVWIGKGGAYTGEISAEQLVDIGCQWVILGHSERRHVIGEDDQFIGKKAAYALSQNVKVIACIGELLEEREAGKTFDVCFKQMKAFADSITNWADVVIAYEPVWAIGTGKVATPEQAQEVHAAVRDWLKTNVSPEVASGIRIIYGGSVNAANCAELAKKEDIDGFLVGGASLKGPDFATIINSVTSKKVAA

SEQ ID NO: 66902 - DNA, 762 bp, Glycine max
  CDS (1)..(762)
atgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggttcgcaaaggtggtgcttatactggagaggttagtgctgaaatgcttgttaatttgggaattccttgggttattattggtcactctgaacggaggcagcttttgaatgaattaaatgagtttgtgggagataaagttgcctatgcacttcaacaaggtctgaaagttatagcatgcattggggaaactcttgaacagcgtgaagctggtacaacaacggctgttgttgctgagcaaacaaaagcaattgcagctaaaatatcaaattgggacaatgtcgttttggcctatgagccagtttgggccattggaacaggaaaggttgcaactcctgctcaggctcaagaggttcatgctgatttaaggaaatgggttcatgacaatgtgagtgctgaagttgctgcatctgtaagaattatctatggaggctctgtaaatggaggaaactgcaaagaattggcagcacagcccgatgttgatggatttttggttggtggtgcatccctcaaggcggaatttgtggacatcataaacgctgctactgtgaagaagaattga

SEQ ID NO: 66903 - protein, 253 aa, Glycine max
MGRKFFVGGNWKCNGTTEEVKKIVTTLNEAKVPGEDVVEVVVSPPFVFLPFVKSLLRPDFHVSAQNCWVRKGGAYTGEVSAEMLVNLGIPWVIIGHSERRQLLNELNEFVGDKVAYALQQGLKVIACIGETLEQREAGTTTAVVAEQTKAIAAKISNWDNVVLAYEPVWAIGTGKVATPAQAQEVHADLRKWVHDNVSAEVAASVRIIYGGSVNGGNCKELAAQPDVDGFLVGGASLKAEFVDIINAATVKKN

SEQ ID NO: 66904 - DNA, 750 bp, Rattus norvegicus
  CDS (1)..(750)
atggcgccttccaggaagttcttcgtcgggggcaactggaagatgaacgggaagaagaaatgcctgggagaactcatctgcaccctgaacgcagccaagatgccggcagacaccgaggtggtttgtgcaccgccaaccgcctacatcgacttcgccaggcagaagctggatcccaaaattgctgtggctgcacagaactgctacaaagtgaccaatggggctttcactggggaaatcagccctggcatgatcaaagacttaggagctacctgggtggtgctgggacactcggaaagaagacacgtctttggggaatcagacgagttgattgggcagaaagtgaaccatgccctatccgagggactcggagtgatcgcctgcattggggagaagttagacgaaagggaagctggcatcactgataaggttgtttttgagcaaaccaaggccatcgcagataatgtgaaggactggtccaaggtggtcctggcctatgaaccggtatgggccattgggactggcaagactgcaacccctcaacaggcccaggaagtacacgagaagctccggggatggctgaagtgcaacgtctctgaggaggtggctcagtgcactcggatcatttatggaggttctgtgactggagcgacttgcaaagagctggcaagccagcctgatgtggatggcttcctcgtgggcggtgcatctctcaagcctgaattcgtggacattatcaatgccaaacaatga

SEQ ID NO: 66905 - protein, 249 aa, Rattus norvegicus
MAPSRKFFVGGNWKMNGKKKCLGELICTLNAAKMPADTEVVCAPPTAYIDFARQKLDPKIAVAAQNCYKVTNGAFTGEISPGMIKDLGATWVVLGHSERRHVFGESDELIGQKVNHALSEGLGVIACIGEKLDEREAGITDKVVFEQTKAIADNVKDWSKVVLAYEPVWAIGTGKTATPQQAQEVHEKLRGWLKCNVSEEVAQCTRIIYGGSVTGATCKELASQPDVDGFLVGGASLKPEFVDIINAKQ

SEQ ID NO: 66906 - DNA, 765 bp, Solanum chacoense
  CDS (1)..(765)
atgggcagaactttcttcgtcggcggcaactggaaatgcaatggaacaagtgaggagatcaagaagatagtagcgacactcaatgctggtcaagtgccatcacaagatgttgttgaggttgttgtgagccctccatatgtatttcttcctctggtcaagaatgagctgcgatctgattttcatgttgctgcccaaaattgttgggttaagaaggggggtgctttcaccggtgaagttagtgctgatatgcttgttaatctgggcattccgtgggtcattttgggtcattctgaaagaagagccattttaggtgaatcaaatgagtttgttggagacaaggtagcatatgctctttcacaaggtttgagggtaattgcatgtgttggggagactcttgagcaaagagaatcaggatctaccatggatgttgttgcagcacaaacaaaggctattgcagagcgagtaaaagattggtcaaatgtggtggtagcttatgagcctgtttgggctattggtactggaaaggttgcaacccctgcacaagcccaggaagtacatgctgaattgaggaaatggcttcaagcaaatgttagcgctgaagttgctgcttcaaccaggatcatctatggaggatctgtaagcggtgcaaactgcaaggagttggctggacagccagatgttgacggttttcttgtaggtggagcttctttgaagccggagttcattgacatcatcaaggctgctgaggtgaagaaaggcgcctaa

SEQ ID NO: 66907 - protein, 254 aa, Solanum chacoense
MGRTFFVGGNWKCNGTSEEIKKIVATLNAGQVPSQDVVEVVVSPPYVFLPLVKNELRSDFHVAAQNCWVKKGGAFTGEVSADMLVNLGIPWVILGHSERRAILGESNEFVGDKVAYALSQGLRVIACVGETLEQRESGSTMDVVAAQTKAIAERVKDWSNVVVAYEPVWAIGTGKVATPAQAQEVHAELRKWLQANVSAEVAASTRIIYGGSVSGANCKELAGQPDVDGFLVGGASLKPEFIDIIKAAEVKKGA

SEQ ID NO: 66908 - DNA, 1074 bp, Euglena gracilis
  CDS (1)..(1074)
atggactactacacagttgcccacatcgatgaaccttgcagtcaaccctggtacaagagcagggtagcagctttttttggtggctgtctcttggcaacttgcatgtccttgaggttcaagggcacagttcaggaaaactacgctgtggggaccaagccagctgttcattcccttccactggctgctcttggaacttggggtcgctctcaagtgccccaaaatccccctcagaatggcttcaacaactttggtcgcaggagttctgcccttcaaatgacagttggaggctgggctccttctgcaaaaatgccaaggaagttcattgtgggaggaaactggaagtgcaatggtgatcgtgccagcatcaaggctttgatccaagctttgaatgctggtgaaagcacgattggctctggagttgatgttgttgttgcaccacccatgttgtatggggattatgccagaggactcttgaggtcagactttggagttgcattccagaactgctgggttggtggaaatggtgccttcactggtgaggtgagcgctgatatgatcaaagatgcaggatttgactgggtcatcctgggacactcagaacgccgcagcttgccagaaatcaaggagacggatgagaccgttgcaaccaagaccgcatacgccctggaggcaggcctgaaggtcatgctgtgcatcggcgaaaccttggatgcccgccagagcggcaagacggacgaggtcaacgcccggcagctggcggcggtggcggagaaggtgtccgactggagcaacatcgtcatcgcgtacgagcccgcgtgggccatcggcaccggggtagtggccacccctgagcaggcacaggagacgcacactcagatccgcaagtggctggctgagaacatcagcccccaggtggcccagcagatgcgcatcatgtatggtgggtccgccaacgcagcgaatgccgactccctggcccggcagcccgacatcgatggcttcttggtcggcggggcctctttgaggcctgagttcctgcggattgtggaatcctggaagaggaaggtggaatga

SEQ ID NO: 66909 - protein, 357 aa, Euglena gracilis
MDYYTVAHIDEPCSQPWYKSRVAAFFGGCLLATCMSLRFKGTVQENYAVGTKPAVHSLPLAALGTWGRSQVPQNPPQNGFNNFGRRSSALQMTVGGWAPSAKMPRKFIVGGNWKCNGDRASIKALIQALNAGESTIGSGVDVVVAPPMLYGDYARGLLRSDFGVAFQNCWVGGNGAFTGEVSADMIKDAGFDWVILGHSERRSLPEIKETDETVATKTAYALEAGLKVMLCIGETLDARQSGKTDEVNARQLAAVAEKVSDWSNIVIAYEPAWAIGTGVVATPEQAQETHTQIRKWLAENISPQVAQQMRIMYGGSANAANADSLARQPDIDGFLVGGASLRPEFLRIVESWKRKVE

SEQ ID NO: 66910 - DNA, 768 bp, Euglena gracilis
  CDS (1)..(768)
atgccacgaaaatttttcgttggtggaaattggaaatgcaacggaacacgagaaagcatttcaaagattattgaggagttcaacaagggtccttcggtggccgatgctgacgttgaggttgtaattggatgcccatttgtttatgccgattacaccagagaaaagttgagacaagattgggcattgtctgttcaaaactgttggatcgggaagggtggtgccttcactggtgagatttcagcggagatgattaaggatgcaggaatcccttgggtcattcttggacattctgagaggcgacacctgcctgagttgaaggagtccgatgaaactgttgccatcaaagtggcgtatgctctggcaaatgggttgaaggtcatggcttgcattggagagctgctggaagaacgagagggaggccaaactcaggctgtcaatgaacgtcagttgaaagcaattgcggccaagttgaaggaggaggactggaagaatgttgtcattgcatatgaacctgtgtgggcaattgggacgggaaaggttgcaacccctgaacaagcccaagaggtgcacgagcaagttcgtgcctgggttgccagcaatgtcagcccttcagttgccgctgaggttcgaattctgtatggtggttcagtgacagcaaagaacagtgcggagctggcaggaaagcctgatgtggatggtttcttggttggtggagcctctttgaagcctgaattcttggatatcgttgccgcttacaagcacaagtga

SEQ ID NO: 66911 - protein, 255 aa, Euglena gracilis
MPRKFFVGGNWKCNGTRESISKIIEEFNKGPSVADADVEVVIGCPFVYADYTREKLRQDWALSVQNCWIGKGGAFTGEISAEMIKDAGIPWVILGHSERRHLPELKESDETVAIKVAYALANGLKVMACIGELLEEREGGQTQAVNERQLKAIAAKLKEEDWKNVVIAYEPVWAIGTGKVATPEQAQEVHEQVRAWVASNVSPSVAAEVRILYGGSVTAKNSAELAGKPDVDGFLVGGASLKPEFLDIVAAYKHK

SEQ ID NO: 66912 - DNA, 798 bp, Klebsiella pneumoniae
  CDS (1)..(798): s means g or c
atgatgaccccgatatggttaggaaccagctggaaaatgaacaagccgctgtcccaggcgatggcctggtgcgaaacgctggcagcgcggatgccggagggctgtcaccctgctattcagcccttcgtcattccctccttcaccgcgatccaacccgtcagccattttctgcaaacgcatcagttaccgcttctgaccggcgcgcagaatatgcatgaagcggatcagggcgcctggaccggggaaatctcggcggccatgttggcagaaaccggcgccacgcttgttgagctgggacattcagaacgacgcgccgcctttaatgaaagcgatgccgcgattaatcgaaaagtgcatagcgccttaggtcatggcctgcgcccgctgatctgtattggcgatagcgccgaggagaaacgctggcaggtgtcgcgtgaaagcgtggtgcggcagatgaagatcgccctgtatggcctgagccaccagcaggcgctgcggaccctgattgcgtatgaaccggtgtgggccattggcgaacatggtacgcccgcctcaccgcaggaggcgggtgtcattcatcaggcgctacgtcaggcgctttgcgagcggtttggtcacgagacgggaacccgtatcccgctgctctatggcggcassgtaacgctgcaaaacgcggtggaattgctgcgccagcaggagatcaatgggttgtttatcggccgcgcggcctgggacgcgcaaggctattgcgacattgttcaacgcgttacacaggaatttattttgcaggcgcagtaa

SEQ ID NO: 66913 - protein, 265 aa, Klebsiella pneumoniae
  misc_feature (219)..(219): Xaa can be Arg or Ser or Thr
MMTPIWLGTSWKMNKPLSQAMAWCETLAARMPEGCHPAIQPFVIPSFTAIQPVSHFLQTHQLPLLTGAQNMHEADQGAWTGEISAAMLAETGATLVELGHSERRAAFNESDAAINRKVHSALGHGLRPLICIGDSAEEKRWQVSRESVVRQMKIALYGLSHQQALRTLIAYEPVWAIGEHGTPASPQEAGVIHQALRQALCERFGHETGTRIPLLYGGXVTLQNAVELLRQQEINGLFIGRAAWDAQGYCDIVQRVTQEFILQAQ

SEQ ID NO: 66914 - DNA, 747 bp, Brachydanio rerio
  CDS (1)..(747)
atgtcctcaaggaaattcttcgtcggaggaaactggaaaatgaacggcgataaagagtctctgggcgagctcataatgaccttgaacacggccagtctcaacgatgaaacagatgtagtttgtggagcaccgtccatctatctggattacgccaggtctaaactggaccagaggattggtgtggctgctcaaaactgctataaggtgcccaaaggagccttcaccggggagatcagcccagcgatgattaaagactgcggcatcgactgggtgattttgggccattctgagaggcgtcatgtttttggggagagcgatgagctgattggtcagaaggtggcccattgcctggagagcgatttgggcgtgatcgcctgcattggggagaaactggaggagaaagaggctggaaccaccgaggatgtggtgtttgagcagaccaaagtcatcgcagacaatgtgaaggactggactcgtgtggtcttggcgtatgaaccagtatgggctattggcactggcaaaactgcctctcctggacaggcgcaggaggtgcacgagaagctgagaggatggctgagagcgaacgtgtcggatgcagttgctgactctgtgcgcatcatctacggaggctctgttactgggggaaactgcaaagagctggcggcccaggctgacgttgatggcttcctggttggaggggcttcccttaaaccagagtttgtcgacatcatcaatgcccgctcatag

SEQ ID NO: 66915 - protein, 248 aa, Brachydanio rerio
MSSRKFFVGGNWKMNGDKESLGELIMTLNTASLNDETDVVCGAPSIYLDYARSKLDQRIGVAAQNCYKVPKGAFTGEISPAMIKDCGIDWVILGHSERRHVFGESDELIGQKVAHCLESDLGVIACIGEKLEEKEAGTTEDVVFEQTKVIADNVKDWTRVVLAYEPVWAIGTGKTASPGQAQEVHEKLRGWLRANVSDAVADSVRIIYGGSVTGGNCKELAAQADVDGFLVGGASLKPEFVDIINARS

SEQ ID NO: 66916 - DNA, 747 bp, Xenopus laevis
  CDS (1)..(747)
atgtctcccaggaagttcttcgtcgggggcaattggaagatgaacggagacaagaagagtctgggggagctgatcaacaccctgaacagcggcaagatgaacgcggacacagaggtggtctgtggtgcaccagccatttatctggactttgcacggcagaagctggacgccaaaattgctctttctgcgcagaattgttataaagtggccaagggagcattcaccggagagatcagcccagcaatgattaaagactgtggtgctacatgggtgattcttgggcactctgagagacggcatgtgtttggagagtgtgacgagctcattgggcaaaaagtggcacacgcactaagtgaaggcattggagtgatcgcctgtattggtgagaagctagaccagcgtgaggcgggaatcactgagaaggtggtgtttgagcagacaaaggccatagcagataatgtcaaggactggagtaaggtggtcttggcctatgaaccagtctgggctattggaactgggaaaactgccacacctgaacaggcccaggaagtgcacaagaaactgcgtgagtgggtgaaaaccaacgtatctgaaggtgttgcccagtctgttcgtattatatatggaggttcagtaacaggaggcacatgcagagagctggccggccagcctgacattgatgggttcctggtgggaggagcatctctgaagccggagttcattgaaataatcaatgccaagcattaa

SEQ ID NO: 66917 - protein, 248 aa, Xenopus laevis
MSPRKFFVGGNWKMNGDKKSLGELINTLNSGKMNADTEVVCGAPAIYLDFARQKLDAKIALSAQNCYKVAKGAFTGEISPAMIKDCGATWVILGHSERRHVFGECDELIGQKVAHALSEGIGVIACIGEKLDQREAGITEKVVFEQTKAIADNVKDWSKVVLAYEPVWAIGTGKTATPEQAQEVHKKLREWVKTNVSEGVAQSVRIIYGGSVTGGTCRELAGQPDIDGFLVGGASLKPEFIEIINAKH

SEQ ID NO: 66918 - DNA, 897 bp, Cyanidioschyzon merolae
  CDS (1)..(897)
atgtttgtgacgctcggtgtgccaagccgcgcagtcagtagcaaggcggagagctacgcacagcgcttgcgcatcgtaagaacagcacgtacacgtctattcatgtccgcccaaagcgcccggaagttcttcgtgggtggcaactggaaatgcaacggttcgaagcagtccgtccaggagctgtgcgaagcgttcaacgctgggaaaaacatcgactttaacagggtcgaagtcgttgtcgcaccgccatcggtttatgccatgttgacgagatcgattttgcggcctgatttcggggtagcactgcagaactgctgggtcggaaaaccgggagcgttcaccggtgaggttgcggtcgaaatgatccgggatatcgggcttagtcacgtgattctagggcattcggagaggcgtcatttaccggaaatacgggaaagcgatgacgtcattggtcgcaaaacaaaatacgctatcgacaaaggcgtgcacgtgattctgtgcataggggaactcttagaggagcgcgaagccggccgcacccgggaggtcaatgagcggcagctctcggcggtaagggcacatctcagcgccgacgactgggccaaagtggttattgcgtacgagcctgtctgggccattggaactggcaaggttgcgacggcggctcaggcacaagaggcccactcggaaatccgcagctggattcgtcggcaggtcagcgaagcctgtgcgtcacagatgcgaattctctacggtggctcggtcaccccggaaaactgtcttgaacttgctgcgcagcctgacgtcgatggttttctggtcggtggggcgagtctgaaacccactttcctcgatatcgtaagggcgtatcaagcgaaggaaaccgtaagcgtataa

SEQ ID NO: 66919 - protein, 298 aa, Cyanidioschyzon merolae
MFVTLGVPSRAVSSKAESYAQRLRIVRTARTRLFMSAQSARKFFVGGNWKCNGSKQSVQELCEAFNAGKNIDFNRVEVVVAPPSVYAMLTRSILRPDFGVALQNCWVGKPGAFTGEVAVEMIRDIGLSHVILGHSERRHLPEIRESDDVIGRKTKYAIDKGVHVILCIGELLEEREAGRTREVNERQLSAVRAHLSADDWAKVVIAYEPVWAIGTGKVATAAQAQEAHSEIRSWIRRQVSEACASQMRILYGGSVTPENCLELAAQPDVDGFLVGGASLKPTFLDIVRAYQAKETVSV

SEQ ID NO: 66920 - DNA, 774 bp, Dictyostelium discoideum
  CDS (1)..(774)
atgacaggaactagaactttttttgttggtggaaatcataaaatgaatggtagtaaatcaatgttagaatctttaagtaaaggaatgaatgaatcagttgaaaataaagaaaatgttgatattttcattgcaccatcatatccatatttagaatttttatcaaataaattagataataaaaagtttaaagtttgttcacaaaattgttatagtgttgccaaaggtgcattcacaggtgaaatcagtgctaatatgttggttgatttaggtattccatacgttatcattggtcatagtgagagaagaaatgtatttagcgaatcaagtgagttaattacaaagaaaacaaagtatgcaatttcattaggtctcacagttatcttatgtttaggtgaacttttagcagacagaaaatcaaataacactgaacacatcctaagtgaacaattgaaagatttcgcttcattcactccagaagaatggtcaaagatcgtaattgcctatgaaccagtttgggcaattggtactggtgccgttgcaactccacaagaagctcaagatactcatgttttcattcgtaaatggattagtgaaaaggtttctgaagatgttgcaaagaaaacctcgatcatgtatggtggttctgttaatgctgacaattgtcataacctttcaaagcaatctgatatcgatggtttcttagttggtggtgcttcccttgttgccagtgatttcattgccatcattaaatctgctgttccaaagaaatattga

SEQ ID NO: 66921 - protein, 257 aa, Dictyostelium discoideum
MTGTRTFFVGGNHKMNGSKSMLESLSKGMNESVENKENVDIFIAPSYPYLEFLSNKLDNKKFKVCSQNCYSVAKGAFTGEISANMLVDLGIPYVIIGHSERRNVFSESSELITKKTKYAISLGLTVILCLGELLADRKSNNTEHILSEQLKDFASFTPEEWSKIVIAYEPVWAIGTGAVATPQEAQDTHVFIRKWISEKVSEDVAKKTSIMYGGSVNADNCHNLSKQSDIDGFLVGGASLVASDFIAIIKSAVPKKY

SEQ ID NO: 66922 - DNA, 759 bp, Schistosoma japonicum
  CDS (1)..(759)
atgtctggatctcgcaaattttttgttggggggaactggaaaatgaacggaagcagagatgacaacgataagttacttaagttactctcagaagctcattttgatgataacacggaagttttaattgctccaccttcagtctttttgcacgaaattcgaaaaagtttgaagaaagagatacacgtggctgctcaaaattgctataaggtaccaaagggtgcatttactggggaaatcagtccttcaatgataaaagatgttggttgtgattgggttatacttggtcattctgaacgaagaagtatatttaatgaatccgatgagcttgtagctgaaaaagttcaacatgcacttgcagaaggtctaagcgttgtagcatgtattggggaaacactatcagagcgtgaatctggtaaaacagaagaagtgtgtgtaagacaattaaatgctattgctaataagattaaatcaattgatgaatggaaacgagttgttgtagcatatgaacctgtatgggctattggaacaggtaaagttgcttcaccaggtcaagctcaagaagttcataattttcttcgtaaatggtttaaaacaaatacaccatctggagttgaccaacaaatacgtattatctatggtggatcagtaaccgcagcaaattgtaaagaattagctcaacaacatgatgtggatggatttttagttggtggtgcttcattaaaaccggaatttattgatatatgtaaagctagacaataa

SEQ ID NO: 66923 - protein, 252 aa, Schistosoma japonicum
MSGSRKFFVGGNWKMNGSRDDNDKLLKLLSEAHFDDNTEVLIAPPSVFLHEIRKSLKKEIHVAAQNCYKVPKGAFTGEISPSMIKDVGCDWVILGHSERRSIFNESDELVAEKVQHALAEGLSVVACIGETLSERESGKTEEVCVRQLNAIANKIKSIDEWKRVVVAYEPVWAIGTGKVASPGQAQEVHNFLRKWFKTNTPSGVDQQIRIIYGGSVTAANCKELAQQHDVDGFLVGGASLKPEFIDICKARQ

SEQ ID NO: 66924 - DNA, 744 bp, Tenebrio molitor
  CDS (1)..(744)
atggcccgaaaattcgtagtcggtggcaactggaagatgaacggggacaagaaacaaatcaacgaaatcatcggctttctgaaaagcggccccctcaatcaagacacagaagttgtagttggtgtgccagcaatctacctagagcttgttcgaacatgtgtaccagcaagtattggagtggccgctcagaactgttacaaagtcccaaaaggggcattcactggggaaatttcgccagccatgatcaaagacgttggtgcagattgggtaatcttgggtcattcagagcgtcgccagatttttggtgaatcagatgagttgattgctgaaaaggtgtgtcatgcattagagtcaggcttgaaagttattgcctgtattggagaaactttggaggagagagaagcggggaaaactgaagaagtagtcttcagacaaactaaagctattgctgccaaagttaatgactggtcaaatgttgtcattgcttatgagcctgtttgggctattggtactggtaagactgctactcctcaacaagctcaagatgttcataaagccttgagacagtggatttgtgagaacattgatgctaaagttggaaatagtatcagaatccaatatggaggttcagtgactgccgctaactgcaaagaattagcttcccaacctgacatagatgggttcttggtgggaggtgcttcccttaaacctgaatttgtaaatattgttaatgccaagcaataa

SEQ ID NO: 66925 - protein, 247 aa, Tenebrio molitor
MARKFVVGGNWKMNGDKKQINEIIGFLKSGPLNQDTEVVVGVPAIYLELVRTCVPASIGVAAQNCYKVPKGAFTGEISPAMIKDVGADWVILGHSERRQIFGESDELIAEKVCHALESGLKVIACIGETLEEREAGKTEEVVFRQTKAIAAKVNDWSNVVIAYEPVWAIGTGKTATPQQAQDVHKALRQWICENIDAKVGNSIRIQYGGSVTAANCKELASQPDIDGFLVGGASLKPEFVNIVNAKQ

SEQ ID NO: 66926 - DNA, 756 bp, Leishmania infantum
  CDS (1)..(756)
atgtcctccaagccgcagccgatcgctgctgcgaactggaagtgcaacggcaccaccgcctccatcgagaagctggtgcaggtgctcaacgaacacaacatctcccatgacgtgcagtgcgtcgtggcaccgacctttgtgcacatcccattggttcaggcgaagctccgcaaccccaaatacgccgtcagcgccgagaacgcgatcgccaagagcggcgccttcaccggtgaagtgtcgatgccgatcctgaaggacctgggcatcaactgggtcattcttggtcactcggagcgccgcacctactacggcgagacggacgagattgtagcgcaaaaagttgcggatgcgtgcaagcagggcttcatggtgattgcttgcattggagagacgctgcagcagcgtgaagcgaaccagacagcgaaggtggtgctgagccagacgtcagcgatcgccacgaagctgccgacggaggcgtgggaccagattgtgctcgcctacgagccggtgtgggccatcggcaccggcaaggtcgccacgcccgagcaggcgcaggaggtgcacgccctgttgcgcaagtgggtgagcgagaagatcggcgccgacgtcgccgcgaggctccgcatcctgtacggtggctccgtcagcgccggcaatgccaagacgctctacatgaagcctgatattaacggcttcctggtcggcggcgcgtccctcaagccggagttccgagacatcattgatgccacccggtga

SEQ ID NO: 66927 - protein, 251 aa, Leishmania infantum
MSSKPQPIAAANWKCNGTTASIEKLVQVLNEHNISHDVQCVVAPTFVHIPLVQAKLRNPKYAVSAENAIAKSGAFTGEVSMPILKDLGINWVILGHSERRTYYGETDEIVAQKVADACKQGFMVIACIGETLQQREANQTAKVVLSQTSAIATKLPTEAWDQIVLAYEPVWAIGTGKVATPEQAQEVHALLRKWVSEKIGADVAARLRILYGGSVSAGNAKTLYMKPDINGFLVGGASLKPEFRDIIDATR

SEQ ID NO: 66928 - DNA, 744 bp, Xiphophorus maculatus
  CDS (1)..(744)
atggtacggaggttcttcgtcgggggaaactggaagatgaacggaaataaggagagcctggaacagctgatcaccactctgaacaccgccagcctggacgatcagaccgaggtggtgtgtgctgcaccttccatctatctggactttgctcggtcccttctggatcctagaattggggtctcagcccagaactgctacaaagtggctaaaggagcatttacaggagagatcagcccagccatgataaaggacagcggggcagactgggtgatcctcggacactcagagaggcgccatgtgttcggggaaagtgatgagctaattggccaaaaggttgctcacgcgctggagagcgatctcggagtgatcgcctgtatcggtgagacgctggaggagcgcgaggcagataccacagaagaagtcatctacgctcagacacaggtcattgcagaaaatgtgacggactgggggaaagtggtgctggcgtatgaacctgtttgggccatcggcactggaaagacagccacacctgagcaggctcaggaagttcatgaaaagctgagggcttggttcacagcaaatgtatcagatgatgtggctgactccctgcgcatcatttatggaggttcagtcaccggcgcaaactgcagggagctggcgtctcagggcgacgtggacggctttctggttggcggagcctctctgagacccgagtttgttgacatcatcaacgcacgtgcataa

SEQ ID NO: 66929 - protein, 247 aa, Xiphophorus maculatus
MVRRFFVGGNWKMNGNKESLEQLITTLNTASLDDQTEVVCAAPSIYLDFARSLLDPRIGVSAQNCYKVAKGAFTGEISPAMIKDSGADWVILGHSERRHVFGESDELIGQKVAHALESDLGVIACIGETLEEREADTTEEVIYAQTQVIAENVTDWGKVVLAYEPVWAIGTGKTATPEQAQEVHEKLRAWFTANVSDDVADSLRIIYGGSVTGANCRELASQGDVDGFLVGGASLRPEFVDIINARA

SEQ ID NO: 66930 - DNA, 744 bp, Xiphophorus maculatus
  CDS (1)..(744)
atgagcaggaaattcttcgtcggtggcaactggaaaatgaacggcgacaagaaaagcctcggggagctcatccagaccctgaatagtggcaaggtggactccaatgtcgaggtggtgtgcggtgctccatccatctacctggacttcgccaggtccaaactggatgccaagtttggagtggcggctcagaactgctacaaagtttccaagggtgccttcactggggagattagccctgcgatgatcaaggactgcggcgtgaactgggttatcctgggacactccgagcggcgccacgtcttcggcgagagcgacgagctgattggtcagaagactgctcatgctctggagagcggtctcggcgtgatcgcctgcatcggcgagaagctggatgagagggagggaggcatcacagagaaggtggtgtttgcccagaccaaagtcatcgcagacaacgtaaaggactggagcaaggtcgtgcttgcttatgagcctgtgtgggctattggcactgggaagactgcgtctccccagcaggcccaggaagttcatgagaaactgagggcgtggctgaagaccaacgtgtctgatgctgtagccaactctgtgaggatcatctatggaggttcagtaactggtggtacctgtaaagaactggcctcccagaaggacgtggacggtttcctggtgggtggagcctctctcaagccagagttcatcgacatcatcaatgccaaggcgtaa

SEQ ID NO: 66931 - protein, 247 aa, Xiphophorus maculatus
MSRKFFVGGNWKMNGDKKSLGELIQTLNSGKVDSNVEVVCGAPSIYLDFARSKLDAKFGVAAQNCYKVSKGAFTGEISPAMIKDCGVNWVILGHSERRHVFGESDELIGQKTAHALESGLGVIACIGEKLDEREGGITEKVVFAQTKVIADNVKDWSKVVLAYEPVWAIGTGKTASPQQAQEVHEKLRAWLKTNVSDAVANSVRIIYGGSVTGGTCKELASQKDVDGFLVGGASLKPEFIDIINAKA

SEQ ID NO: 66932 - DNA, 747 bp, Brachydanio rerio
  CDS (1)..(747)
atgtctggcaggaagtttttcgtcggtggaaactggaaaatgaacggcgacaaaaagagcatcgaagagctcgccaatacactgaatagcgccaagctcaacccagacaccgaggttgtgtgtggcgctccaaccatctacctagactacgccaggtctaagctcgatcctaacattgatgtggctgcacagaactgctacaaggttgcaaagggagctttcaccggggagatcagccctgccatgattaaggactgtggagtaaaatgggtgattctgggacactcagagagacgccacgtgtttggagagagtgatgagctgatcggccagaaggtggctcatgctcttgagaatggtttgggagtgatcgcctgcattggtgagaagctggatgagcgggaggctggaatcacagagaaagttgtttttgcacagaccaagttcatcgcagataacgtgaaagactggagcaaagtggttcttgcttacgaacctgtatgggccattggcactggtaaaactgcatcacctcagcaggctcaggaggtgcatgacaagctccggcagtggttaaagaccaatgtctcagaggctgtcgccaactccgtcaggatcatttacggaggttcggtcactggaggaacctgcaaggaactggcttctcagaaagacctggacggattccttgttggcggagcttctctaaaaccagagtttatcgacattattaacgcaaaagcataa

SEQ ID NO: 66933 - protein, 248 aa, Brachydanio rerio
MSGRKFFVGGNWKMNGDKKSIEELANTLNSAKLNPDTEVVCGAPTIYLDYARSKLDPNIDVAAQNCYKVAKGAFTGEISPAMIKDCGVKWVILGHSERRHVFGESDELIGQKVAHALENGLGVIACIGEKLDEREAGITEKVVFAQTKFIADNVKDWSKVVLAYEPVWAIGTGKTASPQQAQEVHDKLRQWLKTNVSEAVANSVRIIYGGSVTGGTCKELASQKDLDGFLVGGASLKPEFIDIINAKA

SEQ ID NO: 66934 - DNA, 750 bp, Acipenser brevirostrum
  CDS (1)..(750)
atggctcctacaaggaaattcttcgtgggtggaaactggaagctgaacggtgataagaagagcctaggcgagctgatacacaccctgaactccgggaaaatcaacgccgacacggacgtggtgtgtggagctcccaccatctacctggacttcgtgcgctccaaactggactccaagatgggcgtggcagctcagaactgctacaaggtggcaaagggagcgttcactggggaggtcagcccggcgatgatcaaggactgcggggtgtcctgggtcattctggggcactcggagaggcgccacgtatttggggagtctgacgagctgattggccagaaggtggcgcacgccctgcaggagggcctgggggtcatcgcctgcatcggggagaagctagatgagagggaggctggcatcactgagaaggtggtgtttgaacagaccaaggccattgcagacaatgtgaaagactggagcaaggtggttctggcttatgagccggtgtgggccatcggaactggcaagaccgccagcccccagcaggctcaggaggtgcatgagaagctgcggcagtggctgaagacccacgtgtcggaggaggtgggcggagccgtgcgcatcatctacgggggctctgtaacagcggctacctgtaaggaactcgcctccaagcccgacgtcgacgggttccttgtgggcggggcatcgctcaaaccagagttcattgacatcatcaacgctttccagtga

SEQ ID NO: 66935 - protein, 249 aa, Acipenser brevirostrum
MAPTRKFFVGGNWKLNGDKKSLGELIHTLNSGKINADTDVVCGAPTIYLDFVRSKLDSKMGVAAQNCYKVAKGAFTGEVSPAMIKDCGVSWVILGHSERRHVFGESDELIGQKVAHALQEGLGVIACIGEKLDEREAGITEKVVFEQTKAIADNVKDWSKVVLAYEPVWAIGTGKTASPQQAQEVHEKLRQWLKTHVSEEVGGAVRIIYGGSVTAATCKELASKPDVDGFLVGGASLKPEFIDIINAFQ

SEQ ID NO: 66936 - DNA, 723 bp, Cowdria ruminantium
  CDS (1)..(723): transl_table=11
atgtcattactcatcgttgctaactggaagatgcatggtgatttttttactttttcttcgtttacaaaggagcttagtaaccgtttaattaatatagaagataaagtaaaggtagtattatgcccaccatttattgcgttatctacttatgttaattgtccacataatattaagtttggtggacagaactgttgttatgtatctagtgggaagtacactggagaaattagtgctagtatgttatataactctggatgtagttatgtaatagtgggtcactctgaaaggaggagtacgtttcatgaaactgatcatgatgttaggttaaaagctgaatgtgcgatcgaatcaggattaataccaattatttgtgttggagaaactttactagatagggaaaatggtatgctaaaagatactttattaagtcaatgtagtgaatcttttcctaaaaatggtaagtttatcatagcatatgagccagtatgggcaatagggaacaataaaataccttctactgatgtaataatagaagctttagagattattaggtcatatgattatgtatctgatatcatatatggtggagcagtaaatcatactaatgtaggtgatattgtaagtatcaatcaattgtctggtgttttagttggtagtgctagtttagatatggagagtttttttaatataatatgtagtgctataaatgtgaggcaaagttaa

SEQ ID NO: 66937 - protein, 240 aa, Cowdria ruminantium
MSLLIVANWKMHGDFFTFSSFTKELSNRLINIEDKVKVVLCPPFIALSTYVNCPHNIKFGGQNCCYVSSGKYTGEISASMLYNSGCSYVIVGHSERRSTFHETDHDVRLKAECAIESGLIPIICVGETLLDRENGMLKDTLLSQCSESFPKNGKFIIAYEPVWAIGNNKIPSTDVIIEALEIIRSYDYVSDIIYGGAVNHTNVGDIVSINQLSGVLVGSASLDMESFFNIICSAINVRQS

SEQ ID NO: 66938 - DNA, 762 bp, Triticum aestivum
  CDS (1)..(762)
atgggccgcaagttcttcgtcggcggcaactggaaatgcaatggaactgtcgaacaggtagagagcatcgtcaatactctgaacgctggacagatcgcctctacggatgttgtcgaggttgtcgttagcccgccctatgtcttccttcccaccgtcaagggtaagctgcgcccagagatccaagttgctgctcagaactgctgggtgaagaagggcggtgctttcaccggtgaagtcagtgctgagatgcttgtcaacctcggcgttccctgggtcatccttggacactctgaaaggaggagcttgatgggagaatcaagcgagtttgttggagagaaggttgcatatgcactcgctcagggcttgaaggtcattgcatgtgttggtgagactcttgagcagcgagaagctggatcaaccatggcggttgtcgctgaacagacaaaagcaattgctgacaagatcaaggactggaccaacgtggtcgtcgcctatgaaccagtgtgggccattggcaccggtaaagttgcatcaccggctcaggcacaggaagtccatgccaatctgagggactggctcaagaccaatgtgagccccgaggttgctgaatccacgaggatcatctatggaggatctgtaactggcgcaagctgcaaggagttggccgcgcagcccgacgtcgatggtttcctcgttggtggagcttccttgaagcctgagttcatcgacatcatcaacgccgccgccgtgaagtccgcctaa

SEQ ID NO: 66939 - protein, 253 aa, Triticum aestivum
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAAAVKSA

SEQ ID NO: 66940 - DNA, 744 bp, Drosophila melanogaster
  CDS (1)..(744)
atgagccgaaagttctgcgtgggaggcaactggaagatgaacggcgaccagaagtccatcgccgagatcgccaagaccctgagctcggccgccctcgaccccaacacggaggtggtcatcggctgcccggccatctacctgatgtacgcccgcaacctgctgccctgcgagctgggtctggccggccagaatgcctacaaggtggccaagggcgcattcaccggcgagatctcgcctgcgatgctgaaggacatcggcgccgactgggtgatcctgggacactcggaacgtcgcgccatcttcggcgaatcggacgccctgatcgccgagaaggccgagcacgccctggccgagggcctcaaggtcatcgcctgcattggtgagaccctggaggagcgtgaggccggcaagaccaacgaggtggtggcccgccaaatgtgcgcctacgcccagaagatcaaggactggaagaacgtggtggtggcctacgagcccgtctgggccattggcaccggcaagaccgccacacccgatcaggctcaagaggttcacgccttcctgcgccagtggctgagcgacaacatctccaaggaggtgtccgccagcctgcgcatccagtacggtggatctgtgactgccgccaacgccaaggagctggccaagaagcccgacatcgatggcttcctgttcggaggcgcctccctgaagcccgagttcgtggacatcatcaacgcccggcagtaa

SEQ ID NO: 66941 - protein, 247 aa, Drosophila melanogaster
MSRKFCVGGNWKMNGDQKSIAEIAKTLSSAALDPNTEVVIGCPAIYLMYARNLLPCELGLAGQNAYKVAKGAFTGEISPAMLKDIGADWVILGHSERRAIFGESDALIAEKAEHALAEGLKVIACIGETLEEREAGKTNEVVARQMCAYAQKIKDWKNVVVAYEPVWAIGTGKTATPDQAQEVHAFLRQWLSDNISKEVSASLRIQYGGSVTAANAKELAKKPDIDGFLFGGASLKPEFVDIINARQ

SEQ ID NO: 66942 - DNA, 765 bp, Brucella melitensis
  CDS (1)..(765): transl_table=11
atgactccgggaatccgtccgctggttgctggcaactggaaaatgaatggcaagggagaatccctgaccgaactgcgcgccatcgctgcgggcctcagctccgacctcggccgcaagctcgatgcggtcatatgtgtgccggccaccttgctttcgcgtgcggctgaaacgctggaaggcgaaacggtcggccttggcggacaggatgcccatttcaagacatccggcgcgcatacgggcgacatttcgccggaaatgctcaaggaagctggtgccacccatgtcattctcggccattccgagcgccgcaccgatcatcacgagagcaataagctcatttgcgccaagacggaagccgcatgggctgcggggctggtggctatcgtctgcgttggagaaaccgccagcgagcgaaaggcggagcgtgcgctcgatgtcattggcgaccagctttccggttcgctgccggatggggttacggcggaaaacacaatcattgcctatgaacccatatgggctatcggcaccgggttgacgccgacggttcaggatgttcgtgcagcgcacgccttcatgcgtgaacagttgatcgaacgtttcggcgcaaaaggcgcgcatctgcgccttctttatgggggttcggtgaagccgtccaatgctgccgaattgctcggtgttgcagatgttgacggcgctcttgtcggcggtgcgagtttgaaggcggcagacttcctcgccatatgcgaaacctatcgcaatctataa

SEQ ID NO: 66943 - protein, 254 aa, Brucella melitensis
MTPGIRPLVAGNWKMNGKGESLTELRAIAAGLSSDLGRKLDAVICVPATLLSRAAETLEGETVGLGGQDAHFKTSGAHTGDISPEMLKEAGATHVILGHSERRTDHHESNKLICAKTEAAWAAGLVAIVCVGETASERKAERALDVIGDQLSGSLPDGVTAENTIIAYEPIWAIGTGLTPTVQDVRAAHAFMREQLIERFGAKGAHLRLLYGGSVKPSNAAELLGVADVDGALVGGASLKAADFLAICETYRNL

SEQ ID NO: 66944 - DNA, 774 bp, Giardia lamblia
  CDS (1)..(774)
atgcctgctcgtcgccccttcatcggcggtaacttcaagtgtaacggctctcttgactttatcaagagccacgtggcggcaattgctgcccataagatccctgattccgtggacgtcgtcattgccccttccgccgtacacctgtcaacagccattgcggcaaacacgtcaaaacagttgaggatagcagcgcagaatgtgtacctagaggggaacggggcgtggactggcgagacaagtgttgagatgcttcaggacatgggtttgaagcatgtgatagtagggcactctgaaagacgcagaatcatgggggagaccgacgagcaaagcgccaagaaggctaagcgtgccctggaaaaggggatgacggtcatcttctgcgtcggagagaccttggacgagcgcaaggccaaccgcaccatggaggtgaacatcgcccagcttgaggcgcttggcaaggagctcggagagtccaagatgctctggaaggaggttgtcattgcttacgagcccgtgtggtccattggcacgggcgtggtggccacgcccgagcaggcagaggaggtccatgtggggctccgaaagtggtttgcggagaaggtttgtgccgagggcgcacagcatatccgtatcatttacgggggatcggccaatggaagcaactgcgagaagcttggccagtgtccgaatattgacggcttccttgtcggtggcgcttccctcaagccggagtttatgacgatgatcgacattcttacgaagacccgtacatag

SEQ ID NO: 66945 - protein, 257 aa, Giardia lamblia
MPARRPFIGGNFKCNGSLDFIKSHVAAIAAHKIPDSVDVVIAPSAVHLSTAIAANTSKQLRIAAQNVYLEGNGAWTGETSVEMLQDMGLKHVIVGHSERRRIMGETDEQSAKKAKRALEKGMTVIFCVGETLDERKANRTMEVNIAQLEALGKELGESKMLWKEVVIAYEPVWSIGTGVVATPEQAEEVHVGLRKWFAEKVCAEGAQHIRIIYGGSANGSNCEKLGQCPNIDGFLVGGASLKPEFMTMIDILTKTRT

SEQ ID NO: 66946 - DNA, 771 bp, Rhizobium loti
  CDS (1)..(771)
atgacgccaggaattcgcccgcttgtcgccggcaactggaaaatgaacggcaccagcgcttcgctgaacgagctcaggatgatcggcaacgggttcatgagcgggctcgacgcggagaccgaggcgctggtctgcgttcccgcgacgctgctttcccatgcagccgagattctgtcgcgcacgccggtccatgcgggcggcgaggattgccacaccaaggaaagcggcgcctacaccggctgtatctcggcggaaatgctgaaggacgccggcgcgagccatgttattgtcggccattccgaatgccgcgaacaacgcggcgaggacgatgcgacggtccaggccaaggccgccgccgcatggcgcgccgggctcgtggccatcatttgcatcggcgagacgcagcagcagcgtgaggcgggcgccacgctcgaggtgctgtcgcgccaggtcgcaggttcggtgccgccgagtgccacgccatccaacaccgtcattgcctatgagccggtgtgggcgatcggcaccggcctgacgccgaccgcggccgatgtggccgaagcgcatgcgcatatccgcgaaaggctgtcggagaaacttggtgcctctgccgccaagacgcgcattctctacggtggctcggtcaagccgtccaacgcggtggaactgctgggcgtcaggaatgtcgatggcgcgctggttggcggcgccagcctgaaagcggccgatttcctcggtatcgccgaggcctatcgcagcatttcaggctga

SEQ ID NO: 66947 - protein, 256 aa, Rhizobium loti
MTPGIRPLVAGNWKMNGTSASLNELRMIGNGFMSGLDAETEALVCVPATLLSHAAEILSRTPVHAGGEDCHTKESGAYTGCISAEMLKDAGASHVIVGHSECREQRGEDDATVQAKAAAAWRAGLVAIICIGETQQQREAGATLEVLSRQVAGSVPPSATPSNTVIAYEPVWAIGTGLTPTAADVAEAHAHIRERLSEKLGASAAKTRILYGGSVKPSNAVELLGVRNVDGALVGGASLKAADFLGIAEAYRSISG

SEQ ID NO: 66948 - DNA, 771 bp, Brucella suis
  CDS (1)..(771)
atgaccaaattctggattggcacaagctggaaaatgaacaagacgctggccgaagcccgccttttcgcggaagcgctgaaagccgccgatgcaggccgctcgccagacatccagcgttttgtcatcccgcctttcaccgccgtgcgtgaggtgaaggaaatcctctccggcacatccgtgaaggtcggcgcgcagaacatgcactgggccgatcagggtgcatggaccggcgaaatctccccgctgatgctgaaagattgcaatctcgacattgttgaactgggccattcggagcgccgcgaacatttcggcgagaccaacgagacggtcggcttgaaagtggaagccgccgtgcgccacggcctgatcccgctcatctgcatcggtgaaacgctggaagaccgtgaaagcggacgcgcagccgcggtgcttgaagaagaagtgcgcggcgcgctttccaagctttccgaggcgcagaagcaggccgaaatcctcttcgcctatgagccagtctgggccatcggcgaaaacggcattcccgcttccgccgactatgccgatgcgcgacaggccgaaatcatcgcggtggcacaaagcgtgctcgctcgccgcgtgccgtgcctttatggcggctcggtcaatccgggcaattgcgaagaactgatcgcctgcccgcatatcgatgggcttttcatcggccgttcggcgtggaacgtcgaaggctatctcgacattctggccaggtgcgccaccaaggttcaagcgaattaa

SEQ ID NO: 66949 - protein, 256 aa, Brucella suis
MTKFWIGTSWKMNKTLAEARLFAEALKAADAGRSPDIQRFVIPPFTAVREVKEILSGTSVKVGAQNMHWADQGAWTGEISPLMLKDCNLDIVELGHSERREHFGETNETVGLKVEAAVRHGLIPLICIGETLEDRESGRAAAVLEEEVRGALSKLSEAQKQAEILFAYEPVWAIGENGIPASADYADARQAEIIAVAQSVLARRVPCLYGGSVNPGNCEELIACPHIDGLFIGRSAWNVEGYLDILARCATKVQAN

SEQ ID NO: 66950 - DNA, 774 bp, Giardia lamblia
  CDS (1)..(774)
atgcctgctcgtcgtcccttcatcggtggtaacttcaaatgcaatggatcgctcgacttcattaagagccacgtagcgtccatcgcctcctataagatccccgagtccgtggacgttgttgttgctccctcctttgtgcacctttctacagctattgcggcgaatacttcgaagtgtctgaaaatagcagcacagaacgtgtatctggaagggaacggtgcatggaccggcgagacaagcgtcgagatgctgctggacatggggctgagccatgtaataataggacactctgaaagacgtagaatcatgggcgagaccaatgagcagagtgctaagaaggcgaagcgtgctctggacaaaggtatgactgttatcttctgcaccggagagaccctggatgaacgcaaggccaataacactatggaggtgaatattgctcagctcgaggctcttaagaaggagattggagaatcaaagaagttatgggagaacgttgtaattgcctatgagccggtgtggtctatcggcacgggtgtggtggccacaccggagcaggcagaggaagtccatgtgggactccgcaaatggtttgcggaaaaggtttgcgcagaaggtgcgcagcacatccgcatcatctatggagggtctgccaatgggagtaactgcgagaagcttggccagtgcccgaatatcgacggattcctcgtcggaggtgcttccctcaagccggaatttacaacgatgattgatattctcgcgaagactcgtgcatag

SEQ ID NO: 66951 - protein, 257 aa, Giardia lamblia
MPARRPFIGGNFKCNGSLDFIKSHVASIASYKIPESVDVVVAPSFVHLSTAIAANTSKCLKIAAQNVYLEGNGAWTGETSVEMLLDMGLSHVIIGHSERRRIMGETNEQSAKKAKRALDKGMTVIFCTGETLDERKANNTMEVNIAQLEALKKEIGESKKLWENVVIAYEPVWSIGTGVVATPEQAEEVHVGLRKWFAEKVCAEGAQHIRIIYGGSANGSNCEKLGQCPNIDGFLVGGASLKPEFTTMIDILAKTRA

SEQ ID NO: 66952 - DNA, 765 bp, Rhizobium loti
  CDS (1)..(765)
atgcgcgtggtctactgggtcggtacaagctggaagatgaacaagacgctcgccgaggcactggatttcgcggagcgcctggcaggcttcattcccggtttcgatgaccgcatccagcccttcgtcatcccacctttcacggcggtgcgcgaggtcaagcgggcgctgtcgtcgacgcgcatcaaggtcggtgcgcagaacatgcattgggccgatgccggcgcctggaccggcgagatttcgccaccgatgctgagggattgcgggctcgatctggtcgaactcggccacagcgaacggcgcgagcattttggcgagaccgatcgcaccgtcggcctgaaaacggctgccgccgtgaagcacgggatgataccgctgatctgtgtcggcgagacgctggccgagcgcgaaagtgggcaggccgatgccgtgctgagcgcccaggtcgagggcgcgctgcagttcctcgaaggcgaggcgaagaccgcgaaaatcctgttcgcctacgagccggtctgggcgatcggcgacaagggcattccggccagcgccgactatgccgacaagcagcaggcattgatcaagacagtggccggcgccctgctgccgtcggtgccgccggtgctttatggcggcagcgtcaatcccggcaatgccgccgagctggtcggccagcccaatatagacggcctcttcatcggccgttccgcctggcaggcggacggctacatcgacattctcggccgcgcctcggcggcgatctga

SEQ ID NO: 66953 - protein, 254 aa, Rhizobium loti
MRVVYWVGTSWKMNKTLAEALDFAERLAGFIPGFDDRIQPFVIPPFTAVREVKRALSSTRIKVGAQNMHWADAGAWTGEISPPMLRDCGLDLVELGHSERREHFGETDRTVGLKTAAAVKHGMIPLICVGETLAERESGQADAVLSAQVEGALQFLEGEAKTAKILFAYEPVWAIGDKGIPASADYADKQQALIKTVAGALLPSVPPVLYGGSVNPGNAAELVGQPNIDGLFIGRSAWQADGYIDILGRASAAI

SEQ ID NO: 66954 - DNA, 768 bp, Rhizobium meliloti
  CDS (1)..(768): transl_table=11
atgagcaagtctggtctctgggtcggcacgagctggaagatgaacaagacgctggccgaggcaatggtcttcgccgacggtcttgctgccgccgacgatgcgcgcgatcagcggatacagcgcttcgtcattcctccgttcaccgccgcgcggcaggtgaaggaaaggcttaaggcgacgagcgtcaaggtcggtgcgcagaacatgcactgggacgatgccggcgcctggaccggcgaaatttccccggtcatgctgagcgattgcgatctcgacatcgtcgagctcggccacagcgagcggcgggagcatttcggcgagaccgaccgcaccgtgggcttgaagacggcagccgccgtcaagcatgggctcgtgccgttgatctgcatcggcgaaactctcgcgcaacgcgaagcgggcgaggcggatactgtcctgaagcgccaggtggaaggcgcctttgcctttctcgaaggcgcggcgcggaaggcgcccgttcttctggcttacgagcccgtctgggcgatcggcgtcaacggcataccggcgaccgccgactatgcggacgcccgccatcgcctcattggcgaagtcgccgagcgtgcactcggcgtgaaggttccggtgctctatggcggcagcgtcaatcctcagaactgcgaggaattgatcctccaaccccatatcgacgggctcttcatcggccgctccgcctgggacgtcggcggctatctcgacattttgcaacgcgtagcccgggcgatctga

SEQ ID NO: 66955 - protein, 255 aa, Rhizobium meliloti
MSKSGLWVGTSWKMNKTLAEAMVFADGLAAADDARDQRIQRFVIPPFTAARQVKERLKATSVKVGAQNMHWDDAGAWTGEISPVMLSDCDLDIVELGHSERREHFGETDRTVGLKTAAAVKHGLVPLICIGETLAQREAGEADTVLKRQVEGAFAFLEGAARKAPVLLAYEPVWAIGVNGIPATADYADARHRLIGEVAERALGVKVPVLYGGSVNPQNCEELILQPHIDGLFIGRSAWDVGGYLDILQRVARAI

SEQ ID NO: 66956 - DNA, 948 bp, Arabidopsis thaliana
  CDS (1)..(948)
atggcagctacctctctcactgcccctccttctttctccggtctccgccgcatttctcccaagctcgacgctgccgccgtctcctcccaccaatccttcttccaccgcgtcaattcctctacccgtctcgtttcttcctcttcttcttctcatcgctctcccagaggtgttgttgccatggctggatccggaaagtttttcgttggaggaaactggaagtgtaacgggactaaggactccatcgccaagcttatctccgatctcaacagtgcaaccttggaagcagatgtagatgttgttgtgtcacctccatttgtctacatcgaccaggtcaaatcctcgttgacagaccgtattgacatatcaggtcagaactcttgggttgggaaaggtggagccttcactggtgaaatcagcgtggaacagctcaaagaccttggctgcaagtgggtcattcttgggcattccgaacggagacatgtcatcggagaaaaagatgagtttatcgggaagaaagctgcatatgcattgagtgagggtcttggagtgatagcttgtattggggaaaagctagaagagagggaagcaggcaagacgtttgatgtttgcttcgcgcaactgaaggcgtttgctgatgctgtgcctagctgggacaatatagttgttgcatacgagcctgtatgggcaattggaactggtaaagttgcatctcctcagcaagcacaagaagtccatgtagctgtccgcggttggctaaagaagaatgtctctgaggaagttgcttccaaaacgagaatcatatatggaggttctgtcaatggaggcaacagtgcagagcttgccaaagaagaagacattgatggatttcttgttggtggtgcctccttgaagggtcctgagtttgcaaccattgtgaactcagtcacgtcgaagaaagttgctgcttga

SEQ ID NO: 66957 - protein, 315 aa, Arabidopsis thaliana
MAATSLTAPPSFSGLRRISPKLDAAAVSSHQSFFHRVNSSTRLVSSSSSSHRSPRGVVAMAGSGKFFVGGNWKCNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNIVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 66958 - DNA, 945 bp, Fragaria ananassa
  CDS (1)..(945)
atggcggtggcctccacatctctcgcctcccaactctccggccctaaatccctgtcgcagccctactccggcctccgacgatcctgccccaaactcgaccagtctcactcctccctcttccaacacctcagcctctcctcctcctcccgcaaggcctccagagccgtcgtcgccatggccggcaccggaaagttctttgttggtggaaactggaaatgtaatggcacaaaagacttgatcagcaagctagtgtcagacttaaacagcgcaaagttggaacctgatgttgatgttgttgtagcaccaccatttctttacttggatcaggtgaaaagctcactaacagatcgcattgagatatccggccaaaattcttgggtcgccaaaggtggggctttcactggggaaatcagtgtggaacaattgaaggatattggccgcaaatgggttattcttgggcactctgaacggagacatgtaattggtgaagatgatcagtttataggaaagaaagctgcctatgccttgaatgagggtctgggagtaattgcttgcattggtgagaagttagaagaaagggaagcagggaaaacttttgacgtatgttatgagcaactgaaggcttttgcagatgctgtacctagctgggaaaatatagttgttgcttacgagcctgtatgggccattggaactggtaaggtggccagtccacaacaagctcaggaagtacatgtagcagttcgtgagtggctcaaaaagaatgtgtcagcagaggtggcatctaaaaccagaattatttatggaggatctgtaaacggaggcaactctgctgagcttgcaaaggaggaagatattgatgggtttctagttggtggtgcttccttgaagggacctgaatttgctaccattgtcaatgctgtaacatccaagaaagttgctgcttga

SEQ ID NO: 66959 - protein, 314 aa, Fragaria ananassa
MAVASTSLASQLSGPKSLSQPYSGLRRSCPKLDQSHSSLFQHLSLSSSSRKASRAVVAMAGTGKFFVGGNWKCNGTKDLISKLVSDLNSAKLEPDVDVVVAPPFLYLDQVKSSLTDRIEISGQNSWVAKGGAFTGEISVEQLKDIGRKWVILGHSERRHVIGEDDQFIGKKAAYALNEGLGVIACIGEKLEEREAGKTFDVCYEQLKAFADAVPSWENIVVAYEPVWAIGTGKVASPQQAQEVHVAVREWLKKNVSAEVASKTRIIYGGSVNGGNSAELAKEEDIDGFLVGGASLKGPEFATIVNAVTSKKVAA

SEQ ID NO: 66960 - DNA, 897 bp, Secale cereale
  CDS (1)..(897)
atggcggcgcgtcgtccctcgcctcctcccgcctcgccgccgccgccccggccccgcagcaccaccaccaccagaaccaccagctccgcctcggctgctcccgccgccgcgcagcgcctcgtcgccatggccggatccggaaagttcttcgtgggaggcaactggaagtgcaatggaacaaaggaatccattagcaagcttgtctctgatttgaatgctgccacactcgaaagcgatgtagatgttgtggtagcaccgccattcatctatatcgaccaggtcaagagttcactaactgaccgtattgaggtgtctgctcaaaacacatggattggaaaaggaggagctttcactggagagatcagtgcggagcagttggtggacattggctgccaatgggttattcttggtcactctgagcgcagacatgttatcggtgaagatgatgagtttattgggaagaaagctgcatatgcattgagtcaaaatcttaaggttatggcatgcattggagaattgttggaagagagggaagctgggaaaactttcgatgtctgttttaagcagatgaaggcttttgcagataatattacggactggacaaacgttgttattgcgtacgagcctgtgtgggctattggaaccggaaaggttgcttctcctgagcaagctcaagaagttcatgccgctgtccgtgattggttaaaaaccaatgtatcagctgatgttgcttctaccgttcgaattatatatggaggttctgtgaacgcagcaaactgtgcagagctagcaaagaaggaagatatcgatggcttccttgttggcggtgcctctttgaagggtccggactttgccaccatctgcaactcagtgacgtcgaagaaagttacagcctga

SEQ ID NO: 66961 - protein, 298 aa, Secale cereale
MAARRPSPPPASPPPPRPRSTTTTRTTSSASAAPAAAQRLVAMAGSGKFFVGGNWKCNGTKESISKLVSDLNAATLESDVDVVVAPPFIYIDQVKSSLTDRIEVSAQNTWIGKGGAFTGEISAEQLVDIGCQWVILGHSERRHVIGEDDEFIGKKAAYALSQNLKVMACIGELLEEREAGKTFDVCFKQMKAFADNITDWTNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 66962 - DNA, 969 bp, Spinacia oleracea
  CDS (1)..(969)
atggcggtggtatcgacatctctggcgtcgcaaattactaaccctaactcggctgtgtcgactcagttctctggtctccgacgatcgttcttgaagctcgaaaattctgtttcaactcagtcgtcgtttttccagaatgtggattctcatttgcgcctttcctcctcctctcgccgttgtccgagaggtgttgttgctatggctggctctggaaagttcttcgttggtggcaattggaaatgtaacgggaccaaggaatctatcactaagcttgtctcagacttgaacagtgcaacattggaggctgatgttgatgttgttgtggcacctccgtttgtttacattgatcaagtaaagagttcccttaccggccgagtagaaatatcagcacaaaactgttggattgggaaaggtggggcttttactggagaaatcagtgttgaacaattgaaggatcttggctgccagtgggttattctcgggcattctgagagaagacacgttattggtgaacaaaatgagtttatagggaaaaaggctgcatatgctctgaaccaaggtgtcggagtaatagcatgtattggggagttgttagaagaaagagaagcaggaaaaacgtttgatgtatgctaccagcaactgaaggcttttgcagatgccctgcctagctgggataatgttgttgttgcttatgaacctgtatgggctattggtactggtaaggtagcttctccagaccaggctcaggaagtgcatgttgctgttcgagattggcttaaaaagaatgtctcagaggaagttgcttctaagacacgcatcatatatggagggtctgtcaacggaggtaactgtgcagagcttgcaaaacaagaagatatagacggctttctcgtgggaggggcttctttgaagggtcctgagtttgccaccatcgttaattctgtaacagcaaagaaagttgctgcttga

SEQ ID NO: 66963 - protein, 322 aa, Spinacia oleracea
MAVVSTSLASQITNPNSAVSTQFSGLRRSFLKLENSVSTQSSFFQNVDSHLRLSSSSRRCPRGVVAMAGSGKFFVGGNWKCNGTKESITKLVSDLNSATLEADVDVVVAPPFVYIDQVKSSLTGRVEISAQNCWIGKGGAFTGEISVEQLKDLGCQWVILGHSERRHVIGEQNEFIGKKAAYALNQGVGVIACIGELLEEREAGKTFDVCYQQLKAFADALPSWDNVVVAYEPVWAIGTGKVASPDQAQEVHVAVRDWLKKNVSEEVASKTRIIYGGSVNGGNCAELAKQEDIDGFLVGGASLKGPEFATIVNSVTAKKVAA

SEQ ID NO: 66964 - DNA, 771 bp, Agrobacterium tumefaciens
  CDS (1)..(771): transl_table=11
atgacgccgaatgttcgaccgcttgttgccggaaactggaagatgaacggcacccgtgcctcgctcgatcagatcaaggccatggcagagggcgttaagggcgcgctgtccgagaaggtggatgcgctgatctgcccgccctcgacattgctctacgtagcaacggcgctctgcgatgacagcccgctgctgatcggcgcgcaggattgccaccagaatgataccggcgcccataccggcgatatttccgccgagatgattgccgattgcttcggcacccatgttatcgttggccattccgagcgccgcaccgaccacgccgagaccgatcacctggttcgcgccaaggcatccgctgcccatcaggtcgaccttatcgccatcgtctgcatcggcgagactgcggatgagcgcaaggcgggacagacgctggatattctcaagcgccagttggccggctccctgccggatgaagcgactgctgaaaacaccgtcatcgcctatgagcctgtgtgggcgattggcaccggtcttaccccgaccacgcaggacgtgcgcgaagcccatgccttcatgcgcgacgagctggtcaagcgcttcggtgacgccggcaagaccatgcgcattctctatggtggttcggtgaagcccgccaatgcgctggaactgatgggcgtcgagaatgtcgatggcgcgctgatcggcggcgccagcttgaaagccgcagacttcctttccatctatgcggcatatgagcaactgacggcctga

SEQ ID NO: 66965 - protein, 256 aa, Agrobacterium tumefaciens
MTPNVRPLVAGNWKMNGTRASLDQIKAMAEGVKGALSEKVDALICPPSTLLYVATALCDDSPLLIGAQDCHQNDTGAHTGDISAEMIADCFGTHVIVGHSERRTDHAETDHLVRAKASAAHQVDLIAIVCIGETADERKAGQTLDILKRQLAGSLPDEATAENTVIAYEPVWAIGTGLTPTTQDVREAHAFMRDELVKRFGDAGKTMRILYGGSVKPANALELMGVENVDGALIGGASLKAADFLSIYAAYEQLTA

SEQ ID NO: 66966 - DNA, 726 bp, Anabaena sp
  CDS (1)..(726)
atgcggaaaatagttattgccggtaactggaaaatgttcaaaacccaggcagagtctcaagagttcttaaaagaatttctgcctgcattagaggaaacacctcaagaacgggaagtgctgctttgcgttcctttcactgatctggccattttgtctcagagcttacatggtagccttgtacaactgggagcgcaaaatgtccactgggcagaaaatggagcatacactggtgaaatctctggcccaatgttgacagaaattggtgtccgttacgtcattgtcggtcatagcgaacgacgacaattttttggggaaacagacgagacagtgaatttacgtctccaagctgcccaaaagtatggtttaacaccaattctttgtgtaggcgaaaccaaacaacagcgagattctggggaaactgaatcactaattgtcagccaactcgacaaagacctcataaatgttgatcagacaaatttggtgattgcctacgaacccatttgggcaataggcactggtgatacttgtgaaacaacagaggctaatcgagttattggcttaattcgcagccaattgaagaattctgatgtgccgattcaatatggtggctcagtcaaaccaaataatattgacgagattatggctcaaccagaaatcgatggcgttctcgtgggcggagcaagtctagaagctgcaagtttcgctaggatagtcaactatctctaa

SEQ ID NO: 66967 - protein, 241 aa, Anabaena sp
MRKIVIAGNWKMFKTQAESQEFLKEFLPALEETPQEREVLLCVPFTDLAILSQSLHGSLVQLGAQNVHWAENGAYTGEISGPMLTEIGVRYVIVGHSERRQFFGETDETVNLRLQAAQKYGLTPILCVGETKQQRDSGETESLIVSQLDKDLINVDQTNLVIAYEPIWAIGTGDTCETTEANRVIGLIRSQLKNSDVPIQYGGSVKPNNIDEIMAQPEIDGVLVGGASLEAASFARIVNYL

SEQ ID NO: 66968 - DNA, 744 bp, Aquifex aeolicus
  CDS (1)..(744): transl_table=11
atgagaagattaatagccgcaaactggaagatgaacaaaacggtaaaggaaaccgaagagtacattaacaccttcctgaagttcgttgaacaccccgaaagcagggagatactcatatgtcctccttttacttccctctacgttgcgggtaaaatgcttcagggaacgggtgtaaagcttggagctcaaaactgtcactacgaaaagaggggagcctttacgggagagatatcaatacccatgctccaagaagttgggtgtgagtacgtgatagtgggacactcagagagaaggcacatattcggtgagagtgacgagttaattcacaagaagatagttgcgtgcttagagatgggaataagacccattttatgcgttggggaaaagaaagaagagagggaagctgggatgacctttaaggtcattgaaacacagataaaactcgcactcacaggtgtggaagagcatacggataaaatagacatagcgtacgaacccgtgtgggctatcggaaccggaacacccgcaacccccgaagatgctgttgaggttcacaccttcataaggaacttaataaaccagctcaatcccaaaaacgaagggaagacccgtatcctctacggaggaagtgtaaacccacagaacgcaaaagagttcatgaaacacgaagagataaacggactactcgtaggaactgcaagcctagaccctgaatcctttgcgaagatcgtatactccttttaa

SEQ ID NO: 66969 - protein, 247 aa, Aquifex aeolicus
MRRLIAANWKMNKTVKETEEYINTFLKFVEHPESREILICPPFTSLYVAGKMLQGTGVKLGAQNCHYEKRGAFTGEISIPMLQEVGCEYVIVGHSERRHIFGESDELIHKKIVACLEMGIRPILCVGEKKEEREAGMTFKVIETQIKLALTGVEEHTDKIDIAYEPVWAIGTGTPATPEDAVEVHTFIRNLINQLNPKNEGKTRILYGGSVNPQNAKEFMKHEEINGLLVGTASLDPESFAKIVYSF

SEQ ID NO: 66970 - DNA, 765 bp, Arabidopsis thaliana
  CDS (1)..(765)
atggccagaaagttcttcgtcggaggcaactggaaatgtaacggaactgctgaggaggtgaagaagattgtgaacactcttaatgaagctcaggttccttcacaggatgttgtagaggttgtggttagccctccatatgtttttcttcccctggttaagagcacattgaggtctgacttttttgttgcggcacaaaactgttgggttaagaaaggaggtgctttcactggtgaagtgagtgcggagatgcttgtgaacttggatattccatgggttatccttggtcactctgaaaggagggcaatccttaatgaatcaagcgagttcgtcggagacaaggttgcctatgcacttgctcaaggtttgaaagtgattgcttgtgttggtgagactcttgaggagcgggaagctggatcgaccatggatgttgtggctgcccagaccaaggctattgccgatcgggtgacaaactggtcaaatgttgtcatagcctatgaaccagtgtgggccattggaaccggaaaggtcgctagcccagcccaagctcaagaagtacacgatgagctgaggaaatggctggccaagaacgtgagtgctgatgtcgctgctacaacccgcatcatttatggaggatccgtcaatggtggtaactgcaaggagctaggtggacaggccgatgttgatggtttcttggtcggtggtgcttctctaaagcctgagtttatcgacatcattaaggccgcagaggtgaagaaaagtgcctaa

SEQ ID NO: 66971 - protein, 254 aa, Arabidopsis thaliana
MARKFFVGGNWKCNGTAEEVKKIVNTLNEAQVPSQDVVEVVVSPPYVFLPLVKSTLRSDFFVAAQNCWVKKGGAFTGEVSAEMLVNLDIPWVILGHSERRAILNESSEFVGDKVAYALAQGLKVIACVGETLEEREAGSTMDVVAAQTKAIADRVTNWSNVVIAYEPVWAIGTGKVASPAQAQEVHDELRKWLAKNVSADVAATTRIIYGGSVNGGNCKELGGQADVDGFLVGGASLKPEFIDIIKAAEVKKSA

SEQ ID NO: 66972 - DNA, 747 bp, Ashbya gossypii
  CDS (1)..(747)
atggccagaactttctttgtcggaggtaacttcaagcttaacggctccaagcagtctatcaaggagatcgtggagcgtcttaacaccgcggacctcgccgacaacgtcgaggtggtgatctgcccacccgccacgtacctagaccacgctgtttcgctggtgtcgcacccacaggtgactgtcggcgcacagaacgcctacaccaaggcctccggcgcctacaccggtgagaactcggtggaccagatcaaggacgtgggtgccaagtgggtcatcctgggccactccgagcgcagaacgtacttcaacgaggacgacgagcaggttgccgagaagaccgccttcgctctggagcgcggcgtgagcgtgatcctgtgcattggcgagacgttggacgagaagaaggctggtgtcaccttggacgttgtgaagcgccagttgacgcccgtcctcgaaaaggtcaaggactggaccaacgtcgtgatcgcttacgagcctgtctgggccatcggcactgggctagccgccaccgctgaggacgcgcaggacatccacgctgccatccgcgacttcctagccgagcgcacctcgcgtgatgtcgccgacgcagtgcgcatccttttcggtggttccgccaacggcgccaacgccgcctcgttccgtgacaaggccgacgtcgacggcttcctcgtcggcggggcgtcgctcaagcccgagttcgtggacatcatcaactcccggcgctaa

SEQ ID NO: 66973 - protein, 248 aa, Ashbya gossypii
MARTFFVGGNFKLNGSKQSIKEIVERLNTADLADNVEVVICPPATYLDHAVSLVSHPQVTVGAQNAYTKASGAYTGENSVDQIKDVGAKWVILGHSERRTYFNEDDEQVAEKTAFALERGVSVILCIGETLDEKKAGVTLDVVKRQLTPVLEKVKDWTNVVIAYEPVWAIGTGLAATAEDAQDIHAAIRDFLAERTSRDVADAVRILFGGSANGANAASFRDKADVDGFLVGGASLKPEFVDIINSRR

SEQ ID NO: 66974 - DNA, 756 bp, Aspergillus oryzae
  CDS (1)..(756)
atgcctcgccaattcttcgtcggtggtaacttcaagatgaacggtactgcggaaagcattaccgccatcatcaagaacctcaacgaggccaagctcgacgagaccaccgaggtcgtcgtctcccctcctgctctctacctgaccctcgcccaacaggtcgccgacgagaagaagaaggttgccgtttcctcccagaacgtcttcgacaagcccaacggtgctttcaccggtgagatctcggtttctcagctgcaggatgccaagatcccctggaccatcattggacacagcgagcgccgtgtcatcctgaaggagactgacgagttcattgctcgtaaggttaaggctgccattgacggtggcattagcgtcattttctgcatcggtgagactcttgaggagcgtgaggccgacaagaccatcgaggttgtcaccaagcagctcaacgctgccgctaaggagctcaccaaggagcagtggtctaaggtcgtcattgcctacgagcccgtctgggccatcggtaccggcaaggtcgctaccacccagcaggcccaggaggtccacgccgccatccgcaagtggctcgccgatgccatctcgcccgaggcctccgagaacacccgtatcatctacggtggctccgtcagcgagaagaactgccgcgagttggcccaggaacgcgatgtcgatggcttcctggttggcggtgccagcttgaagcctgctttcgttgatatcatcaatgctcgtttgtaa

SEQ ID NO: 66975 - protein, 251 aa, Aspergillus oryzae
MPRQFFVGGNFKMNGTAESITAIIKNLNEAKLDETTEVVVSPPALYLTLAQQVADEKKKVAVSSQNVFDKPNGAFTGEISVSQLQDAKIPWTIIGHSERRVILKETDEFIARKVKAAIDGGISVIFCIGETLEEREADKTIEVVTKQLNAAAKELTKEQWSKVVIAYEPVWAIGTGKVATTQQAQEVHAAIRKWLADAISPEASENTRIIYGGSVSEKNCRELAQERDVDGFLVGGASLKPAFVDIINARL

SEQ ID NO: 66976 - DNA, 756 bp, Bacillus megaterium
  CDS (1)..(756): transl_table=11
atgcgtaaaccaattattgcaggaaactggaaaatgaacaaagtactttctgaagcaactagctttgttgaagaagtaaaaggagcagtaccatctcctgaaagcgtagattcagtagtatgtgcacctgcactatttttagatcgtttagtagaagcgactaaaggcacagacttaaaaattggtgcacaaaacatgcactttgaagaaaacggtgcgttcactggagaagtgagccctgttgctttagcagacttaggtgtgaactatgtcattttaggacactctgagcgtcgtgaaatgtttgctgaaacggacgaaacagtaaaccaaaaaacaattgctgcattcaaacacggtttaacaccaatcgtttgctgcggtgaaacaaacgaagagtacgaacaagatcaaacaaaaacagttgtagctaatcaagtacaaaaagcattagctggtctaactgatgagcaagtaaagcaaacagttattgcatatgagccaatttgggcaatcggtacaggtaaatcttcaactgctgaaggtgcaaacgaagtttgtgcatacatccgtagtgttgttgcagaacaattctctcaagatgttgcagatgctgtacgtattcaatacggcggtagcgtaaaacctgctaatattaaagaatatatgtctcaatcagacattgacggagctttagtaggtggagcaagcttagaagcagattctttcttacagcttttggaggctggtaagtaa

SEQ ID NO: 66977 - protein, 251 aa, Bacillus megaterium
MRKPIIAGNWKMNKVLSEATSFVEEVKGAVPSPESVDSVVCAPALFLDRLVEATKGTDLKIGAQNMHFEENGAFTGEVSPVALADLGVNYVILGHSERREMFAETDETVNQKTIAAFKHGLTPIVCCGETNEEYEQDQTKTVVANQVQKALAGLTDEQVKQTVIAYEPIWAIGTGKSSTAEGANEVCAYIRSVVAEQFSQDVADAVRIQYGGSVKPANIKEYMSQSDIDGALVGGASLEADSFLQLLEAGK

SEQ ID NO: 66978 - DNA, 765 bp, Bartonella henselae
  CDS (1)..(765): transl_table=11
atgtctccaaatattcgaccttttattgcgggaaattggaaaatgaatggaactggtgaatctcttggagaattacgtgccattgccgctggcattagctctgatttaggtcgtttgtttgaagcgcttatttgtgttccagcaacgcttttatcccgtgcttttgatattctgggtggagaaaatattctcttaggagggcaaaattgtcattttgatgattatggtccttatactggagatatttcagcttttatgcttaaagaagcaggagcaagtcatgtcattattgggcattcagagcgtcgcacagtttatcaggaaagtgatgcaattgttcgtgctaaagtgcaagcggcatggcgagcaggtcttgttgctcttatttgtgttggagaaacattggaagaacgcaaaagtaataaagtgttggatgtgcttacgcggcaacttgaaggatctttaccagatggtgcaacagcagaaaatatcattatcgcttatgaacctgtatgggctgtagggacaggcaatacagcgacttcagcagatgttgcagaggtacatgcgtttattcaccataagatgcattctcgttttggtgatgagggggccaagatacgtttgctgtatggtggatcagtaaaaccatccaatgcattcgagcttctgagtactgctcatgtgaatggtgctctgataggtggagcaagtttaaaagcgattgattttttaactatttgcgatgtttatcgtaaattataa

SEQ ID NO: 66979 - protein, 254 aa, Bartonella henselae
MSPNIRPFIAGNWKMNGTGESLGELRAIAAGISSDLGRLFEALICVPATLLSRAFDILGGENILLGGQNCHFDDYGPYTGDISAFMLKEAGASHVIIGHSERRTVYQESDAIVRAKVQAAWRAGLVALICVGETLEERKSNKVLDVLTRQLEGSLPDGATAENIIIAYEPVWAVGTGNTATSADVAEVHAFIHHKMHSRFGDEGAKIRLLYGGSVKPSNAFELLSTAHVNGALIGGASLKAIDFLTICDVYRKL

SEQ ID NO: 66980 - DNA, 804 bp, Bifidobacterium longum
  CDS (1)..(804): transl_table=11
atggcgtccaaacgcattccgttggtggccggcaactggaagatgaatttcgaccatcttgaagccacttacttcgtgcagaagctggtatggctgttgcgtgacgctcacttcgactttaaacgctgcgaagtcgcgcttttcccctcgttcacgtcattgcgcagcgtgcaggtgctggtcgaagccgacaagctccatgtcgcctacggcgcacaatccgtttccgtgaccacccaaggtgccttcaccggcgatgtgtccgcggacatgatcgcccatctcggctgctcatacgtcatcgtcggccactccgaacgccgcaaataccatcctgaagatgacgccaatatcgtcgatcaggtacgtgctgtgctcgccgccggcatgcagccgattttgtgcgtcggcgaaagcttcgaggaacgacgtcaaggcattgaactcgatttcgccgtgggccaggtacgagacgtcacccgcgatctcaacgaagaacaagccgccaaactcatcgtggcctacgaacctgtctgggccattggcaccggcatggtggccactccgcaatccgcccaggatgccgcaaacgccatccgcaacgatttgaagaccacttttggcacgaaggtatccgatagcgtacgtatcctgtacggcggatcggtcacctcgaaaaatgcggcggaactcatttcccagcccgacgttgacggcttcctgatcggaggggcggccctggacgttgaggaactcgccaaaatcgctcgactggcactgaaatccacgaaatcacggaactaa

SEQ ID NO: 66981 - protein, 267 aa, Bifidobacterium longum
MASKRIPLVAGNWKMNFDHLEATYFVQKLVWLLRDAHFDFKRCEVALFPSFTSLRSVQVLVEADKLHVAYGAQSVSVTTQGAFTGDVSADMIAHLGCSYVIVGHSERRKYHPEDDANIVDQVRAVLAAGMQPILCVGESFEERRQGIELDFAVGQVRDVTRDLNEEQAAKLIVAYEPVWAIGTGMVATPQSAQDAANAIRNDLKTTFGTKVSDSVRILYGGSVTSKNAAELISQPDVDGFLIGGAALDVEELAKIARLALKSTKSRN

SEQ ID NO: 66982 - DNA, 747 bp, Bordetella bronchiseptica
  CDS (1)..(747): transl_table=11
atgaccacagctgagaatcgcgcccgcctggtgctgggcaactggaagatgcacggcaacctggccgagaacgccgccttgctggccgagttgcgcgccgccgatgccgccgcccattgcgaaatgggggtgtgcgtgccgtttccgtacctggcccagaccgctgccgccttgcagggcagcgccatcggctggggcgcgcaggatgtcagcgcgcacgccaagggcgcctacaccggcgaagtcgccgcccccatgctggccgaattcggctgccgctgggtgctggtgggccactccgagcggcgcacgctgcatgccgagagcgaccagctggtggccgacaaggcccgcgccgcgctcgaggcaggcctgaccccggtggtttgcgtcggcgaatcgctgcaagagcgcgaaggcggcaacaccctgggcgtgatcgagcgccagctcgaacccgtcctggccctgggccgcgatgccctggtccgcatggtcctcgcctacgaacccgtctgggccatcggcaccggccgtactgccagccccgagcaggcgcaggaagtgcacagcgccatccgcgtggcgctcgacggcctgcaagccagccaggtgcgcgtgctgtacggcggcagcgtcaagggggccaacgccgccagcctgttcgccatgcccgacatcgacggcggcctggtgggcggggcctcgctcgtcgctgaagaattcctgcgcatcgccgcagcttaa

SEQ ID NO: 66983 - protein, 248 aa, Bordetella bronchiseptica
MTTAENRARLVLGNWKMHGNLAENAALLAELRAADAAAHCEMGVCVPFPYLAQTAAALQGSAIGWGAQDVSAHAKGAYTGEVAAPMLAEFGCRWVLVGHSERRTLHAESDQLVADKARAALEAGLTPVVCVGESLQEREGGNTLGVIERQLEPVLALGRDALVRMVLAYEPVWAIGTGRTASPEQAQEVHSAIRVALDGLQASQVRVLYGGSVKGANAASLFAMPDIDGGLVGGASLVAEEFLRIAAA

SEQ ID NO: 66984 - DNA, 762 bp, Borrelia burgdorferi
  CDS (1)..(762): transl_table=11
atgagaaaaacatttttagcgggaaattggaaaatgcattatacaagtgcagaagcttctattgttgcaaaaaaaattgcaactgaggttaagaccttaaaagatgatgttgtaataatgataactcccccatttacggctttatctaaggtttcagaatgtattaagggtagtaacattctccttggtgctcaaaatatgtcttatatggaaagtggagcaaggacaagtgaaatttcaccttcaatgcttttagaatttggagtagaatatgttatacttggtcattctgaatgtaggttgtatttagcagaaacagatgaaataataaataaaaagattcttgcaggacttaagcatcctttcaaatacttaattctttgtgttggagaaactcttgatgaaagagattctggaaaaactttagaggttgttttaaatcaggttaaaaaggggttaaattgtgtttctgaatcagatattcaaaggataattttagcttacgaacctgtttgggcaattggaacgggtaaaaccgcaactaaagaagaggcagaagaggttcataaggcaattaggcttgagattacgaagctttattcaaagtcagcttcagacaatattataattcagtatggaggctctgttaattcaaacaatgtaaaagagcttatgaatgagcctaatattgatggtgcgctaataggtggagcatctttaaaggccgaatcttttttatctataattaacaatgttctttag

SEQ ID NO: 66985 - protein, 253 aa, Borrelia burgdorferi
MRKTFLAGNWKMHYTSAEASIVAKKIATEVKTLKDDVVIMITPPFTALSKVSECIKGSNILLGAQNMSYMESGARTSEISPSMLLEFGVEYVILGHSECRLYLAETDEIINKKILAGLKHPFKYLILCVGETLDERDSGKTLEVVLNQVKKGLNCVSESDIQRIILAYEPVWAIGTGKTATKEEAEEVHKAIRLEITKLYSKSASDNIIIQYGGSVNSNNVKELMNEPNIDGALIGGASLKAESFLSIINNVL

SEQ ID NO: 66986 - DNA, 756 bp, Bradyrhizobium japonicum
  CDS (1)..(756)
atgaccgacgccatccgaccgctgatcgccggcaactggaaaatgaacggcctgaaggcctccgctgccgaattcgacgccatgctcaatggcgcggcagacgtggccaccaaggccgatctgctggtctgcccgccggcgaccctgatcgcggcctttgccgacaaggcgcgcggcaagaaggtcgcggttggggcccaggattgccaccccaaggcctccggcgcccataccggcgatatcgccgccgaaatgctcgcgaatgcgggcgcgaccgccatcatcgtcggccattccgagcgccgcgccgaccatggcgagggcgatgctttggtgcggcagaaggcggaagccgcctggcgggccggggtgacggcgatcgtctgcatcggcgagacgcaagcccagcgcgatgccggccagaccctggacatcctgcgcggccagctcgacggctcgctgccggacggctctaccgcggccaacctggtcgtggcctatgagcccgtctgggcaatcggcaccggcctgacccccacagtccaggatgtcgagcagattcatgggtttatccgggagttcctgacctcccggtttagcgtggacggggcgaagatgcggatcctctatggcggttcggtcaagccctcgaacgcggccgagctgatggccgtgaagaacgtcaacggagctctggtcggcggcgccagcctcaaggcggccgatttccttgcgatcgccaagggctgcccctag

SEQ ID NO: 66987 - protein, 251 aa, Bradyrhizobium japonicum
MTDAIRPLIAGNWKMNGLKASAAEFDAMLNGAADVATKADLLVCPPATLIAAFADKARGKKVAVGAQDCHPKASGAHTGDIAAEMLANAGATAIIVGHSERRADHGEGDALVRQKAEAAWRAGVTAIVCIGETQAQRDAGQTLDILRGQLDGSLPDGSTAANLVVAYEPVWAIGTGLTPTVQDVEQIHGFIREFLTSRFSVDGAKMRILYGGSVKPSNAAELMAVKNVNGALVGGASLKAADFLAIAKGCP

SEQ ID NO: 66988 - DNA, 765 bp, Buchnera aphidicola
  CDS (1)..(765): transl_table=11
atgaaaaaaaaaattattgcagctaattggaaattaaatggtagtataaaaactatttcttattttttaacttttttaaaatcacaaatttcatcttttttaaaaaacaatattattataattgcacctccgactgtatttttagaaagagtatacaaagatataaatagtataaatattcatcttgctgcacaaaatatagatgtaaatctaacaggtgcatttactggtgagaactctgctttaatgatgaaagatattggtgttaaatatattattattggtcattctgaaagacgtttacttcataatgaaaacaatgaaatcattgcgaaaaaattttgtttagtaaaaaatttgaatttagtgcctattttatgtataggtgaaactgaagcagaaaaaaaatctaacaaaactgaaaaaattttaaaagaacaattaaattctatatttaattctttcggagaaaaagcatttagaaatgcagttattgcatatgaacctatttggtctattggaacaggtgtttcagcggatcctaaaaatgtacaactgatacataaatttataaaaaattatataaaaaaatatgacattgtcagtgcagaaaatttgattgtacaatatggaggttctgttacttcattaaatgcaggaaattttcttaaacaacctgatattgatggattattaatcggtagtgcatctttaaaacatgaagaatttttaaaaattataaaaatatcagatagttttttataa

SEQ ID NO: 66989 - protein, 254 aa, Buchnera aphidicola
MKKKIIAANWKLNGSIKTISYFLTFLKSQISSFLKNNIIIIAPPTVFLERVYKDINSINIHLAAQNIDVNLTGAFTGENSALMMKDIGVKYIIIGHSERRLLHNENNEIIAKKFCLVKNLNLVPILCIGETEAEKKSNKTEKILKEQLNSIFNSFGEKAFRNAVIAYEPIWSIGTGVSADPKNVQLIHKFIKNYIKKYDIVSAENLIVQYGGSVTSLNAGNFLKQPDIDGLLIGSASLKHEEFLKIIKISDSFL

SEQ ID NO: 66990 - DNA, 744 bp, Caenorhabditis elegans
  CDS (1)..(744)
atgactcgcaagttcttcgtcggaggaaactggaagatgaacggagactatgcctccgtcgatggtatcgtcaccttcctcaacgcctcagccgacaattcctccgttgatgtcgtcgttgctccaccagctccatatctggcctacgctaaatccaagcttaaagccggtgtgcttgtcgccgcacaaaactgctacaaagtgccaaagggagcattcaccggggaaatttcgccggcaatgatcaaggatcttggattggaatgggtgatcctcggacactcggaacgtcgtcatgtctttggagaaagcgatgctctgatcgctgagaagaccgtgcatgctctcgaggctggaattaaggtcgttttctgcattggggagaagctcgaggagcgtgaagccggacacaccaaggatgtaaacttccgtcaacttcaagccatcgtcgacaagggtgtcagctgggagaacattgtgatcgcctacgaaccagtttgggccatcggaaccggaaagactgcttctggagaacaagcccaggaggttcatgaatggatccgtgcattcctcaaagagaaggtctcaccagctgtcgccgatgccacgagaatcatttatggaggatctgtgactgctgacaatgcggctgagcttggaaagaagccggatatcgatggattcttggtcggtggagcatcgttgaaacccgattttgtcaagattatcaacgccagatcttaa

SEQ ID NO: 66991 - protein, 247 aa, Caenorhabditis elegans
MTRKFFVGGNWKMNGDYASVDGIVTFLNASADNSSVDVVVAPPAPYLAYAKSKLKAGVLVAAQNCYKVPKGAFTGEISPAMIKDLGLEWVILGHSERRHVFGESDALIAEKTVHALEAGIKVVFCIGEKLEEREAGHTKDVNFRQLQAIVDKGVSWENIVIAYEPVWAIGTGKTASGEQAQEVHEWIRAFLKEKVSPAVADATRIIYGGSVTADNAAELGKKPDIDGFLVGGASLKPDFVKIINARS

SEQ ID NO: 66992 - DNA, 747 bp, Candida albicans
  CDS (1)..(747)
atggctcgtcaatttttcgtaggtggtaacttcaaagctaacggtaccaaacaacaaatcacttcaatcatcgacaacttgaacaaggctgatttaccaaaggatgtcgaagttgtcatttgtccaccagccctttaccttggtttagctgttgagcaaaacaaacaaccaactgttgccattggtgctcaaaatgtttttgacaagtcatgtggtgctttcactggtgaaacctgtgcttctcaaatcttggatgttggtgccagctggactttaactggtcacagtgaaagaagaaccattatcaaagaatccgatgaattcattgctgaaaaaaccaagtttgccttggacactggtgtcaaagttattttatgtattggtgaaaccttagaggaaagaaaaggtggtgtcactttggatgtttgtgccagacaattggatgctgtttccaagattgtttctgattggtcaaacattgttgttgcttacgaacctgtttgggcaattggtactggtttagccgctaccccagaagatgctgaagaaacccacaaaggtattagagctcatttggccaagagcattggtgccgaacaagctgaaaaaaccagaatcttgtatggtggttcagtcaacggtaagaacgctaaggatttcaaagacaaagcaaatgttgatggtttcttagtcggtggtgcttcattaaaaccagaatttgttgatatcatcaaatctagattataa

SEQ ID NO: 66993 - protein, 248 aa, Candida albicans
MARQFFVGGNFKANGTKQQITSIIDNLNKADLPKDVEVVICPPALYLGLAVEQNKQPTVAIGAQNVFDKSCGAFTGETCASQILDVGASWTLTGHSERRTIIKESDEFIAEKTKFALDTGVKVILCIGETLEERKGGVTLDVCARQLDAVSKIVSDWSNIVVAYEPVWAIGTGLAATPEDAEETHKGIRAHLAKSIGAEQAEKTRILYGGSVNGKNAKDFKDKANVDGFLVGGASLKPEFVDIIKSRL

SEQ ID NO: 66994 - DNA, 789 bp, Candidatus Blochmannia floridanus
  CDS (1)..(789): transl_table=11
atgaaaaacctatccataattgctaattggaaattaaacggaaacaaaaatacaataacaaattcattaataaatttaaccactcaattaactaacataccccaatatattaaaatagctatagcacccccaatattatacattgacatggttaaaaaccatttaacatcatataataataaaacaatcgaattatgttctcaaaacgttgacatacacttatctggagcgtttacaggagatatctcagcatctatgttaaaagacttatctgtaaaatacgtattaataggccattctgaaagaagaatatatcataaagaaaataactcattaatagcccaaaaattctctataataaaacaaacagaacttattcctattctatgtatcggagaaaataaagaagaacgagattccgggtctacacaatcaatttgtatacaacaaattgattcaattatcaaattagtcggtataaaagcatttgaaaatacaattattgcctacgaacccgtatgggctattggcagcggatctagcgcatccccacgtaacgtacaatcaattcatcaatttattcgcaactacatcgctcaatatgataaaaccatagctaaccaaatatcaattcaatatggaggatctataaccaccgacaatgttttagaattcattactcaaaaagatatcgatggagtactagttggctctgcatctttagatataagaaatcttataaaaataataaatctatcatcaaatttaatcaaaaaaacataccaataa

SEQ ID NO: 66995 - protein, 262 aa, Candidatus Blochmannia floridanus
MKNLSIIANWKLNGNKNTITNSLINLTTQLTNIPQYIKIAIAPPILYIDMVKNHLTSYNNKTIELCSQNVDIHLSGAFTGDISASMLKDLSVKYVLIGHSERRIYHKENNSLIAQKFSIIKQTELIPILCIGENKEERDSGSTQSICIQQIDSIIKLVGIKAFENTIIAYEPVWAIGSGSSASPRNVQSIHQFIRNYIAQYDKTIANQISIQYGGSITTDNVLEFITQKDIDGVLVGSASLDIRNLIKIINLSSNLIKKTYQ

SEQ ID NO: 66996 - DNA, 747 bp, Candida glabrata
  CDS (1)..(747)
atggccagaactttctttgtcggtggtaacttcaagttgaacggtaccaagaagtctatcaaggaaattgttgacagattgaacactgcttctctaccagaaaacgtcgaagtcgttatctgcccaccagctacctacttggactacaccgtctctttggtctccaagaagcaagttactgtcggtggtcaaaacacctacaccaaggcttccggtgcttacactggtgaaaactccgtcgaccaattgaaggacgtcggtgccaagtgggttatcttgggtcactccgaaagaagaacttacttccacgaagatgacaagatcgtcgctgaaaagaccaagttcgctttggaccaaggtctaggtgttatcttgtgtatcggtgaaactttggaagaaaagaaggccggtgtcactttgaaggttgtcgaaagacaattggacgctgtcatcgctgaagtcaaggactggactaacgtcgttatcgcttacgaaccagtctgggctatcggtaccggtttggctgctactgctgaagatgctcaagacatccaccactctatcagatcttacttggctgaaaagctaggtaaggacaccgctgaaaagaccagaatcttgtacggtggttctgctaacggtgctaacgctggtactttcaaggacaaggctgacgtcgacggtttcttggtcggtggtgcttctttgaagccagaattcgttgacatcatcaactccagaaactaa

SEQ ID NO: 66997 - protein, 248 aa, Candida glabrata
MARTFFVGGNFKLNGTKKSIKEIVDRLNTASLPENVEVVICPPATYLDYTVSLVSKKQVTVGGQNTYTKASGAYTGENSVDQLKDVGAKWVILGHSERRTYFHEDDKIVAEKTKFALDQGLGVILCIGETLEEKKAGVTLKVVERQLDAVIAEVKDWTNVVIAYEPVWAIGTGLAATAEDAQDIHHSIRSYLAEKLGKDTAEKTRILYGGSANGANAGTFKDKADVDGFLVGGASLKPEFVDIINSRN

SEQ ID NO: 66998 - DNA, 762 bp, Caulobacter crescentus
  CDS (1)..(762): transl_table=11
atgaccctttcgagcacaacgccccggcctctgatcgccggaaactggaagatgaacggcctttcggtcgccctcgacgaggcccgagccgtcgccgccgccctggaggcgaaacctccggccgcccgcgtcgcgatcttcccgcccgccaccctgttgcatcgtctgagccaggcggtggaaggggcgcatctccttaccggcggtcaggattgccatggcaagtcgagcggcgcgcatacgggcgatgtctccgccgagatggtcgcggacgcaggcggatcgctggtgatctgcggccactccgagcggcgcactgaccacggtgaaacctcagcccaggtggccggaaaggctgaagccgccgccgcggcgggcctggagccgatcgtctgcgtcggcgagaccctggagacccgtgaagcgggccaggcggtaagctttgtcgtgagccaggtgcgggactcgctgccaacctcgctggccggcaaggcgttcagcgtggcctatgagcctctgtgggcgatcggcacgggccgaacggcttcggtcgacaacatcgtcgagatgcacgcggccatccgcgccgagctggtctcccgtttctgcgagcagggccggaccgtcctgatcctctatggtggctccgtgaagcccgaaaacgctcgcgagatcctcgccgcgcccgaggttggtggcgcgctggtcggcggcgcttcgctgaaggccaaggacttcctggcgatcatccaggcgctttaa

SEQ ID NO: 66999 - protein, 253 aa, Caulobacter crescentus
MTLSSTTPRPLIAGNWKMNGLSVALDEARAVAAALEAKPPAARVAIFPPATLLHRLSQAVEGAHLLTGGQDCHGKSSGAHTGDVSAEMVADAGGSLVICGHSERRTDHGETSAQVAGKAEAAAAAGLEPIVCVGETLETREAGQAVSFVVSQVRDSLPTSLAGKAFSVAYEPLWAIGTGRTASVDNIVEMHAAIRAELVSRFCEQGRTVLILYGGSVKPENAREILAAPEVGGALVGGASLKAKDFLAIIQAL

SEQ ID NO: 67000 - DNA, 765 bp, Chlamydophila caviae
  CDS (1)..(765): transl_table=11
atggaacgcaagagttatgtttttggtaattggaaaatgcataagacagctaaggaagctaaagactttttatcgattttttgccctttcgttaaagaaatttctcctgcatccctagtgggtatagctccagcatttacaacattaagtgcttgctgcgaatccataaaagagatggactcttctatttggttaggagcgcaaaatgtccatcaggactcttctggagccttcacaggggaagtgtccttgcccatgcttcaagaatttcatgtaaattttgttcttctagggcattcagaatgtcggcatatctttcatgaagaagacgctaccatagctcttaaagtgggggctgcagctcgttcgggagtggttccagttttatgtattggcgagactttagaagccagagaaaatggtacgactaaggaggttttgtctaaccaattgatgttgggactggctcagcttcccgaaacagcccccgtgattattgcctacgagcctgtatgggcaatcggtacgggaaaagttgcttcaaccgcagatgtgcaagaagttcacgctttttgtcgcgaggttctctctcgtatattctctaaagaaaaatctgagataatttctattctctacggcggatctgtaaaagctgacaacgcagaaggatttgctcgctgccccgatgtggatggtttattggtaggaggagcctctttagatcctcaaggttttgccaatgttttaagaaattttaatctttaa

SEQ ID NO: 67001 - protein, 254 aa, Chlamydophila caviae
MERKSYVFGNWKMHKTAKEAKDFLSIFCPFVKEISPASLVGIAPAFTTLSACCESIKEMDSSIWLGAQNVHQDSSGAFTGEVSLPMLQEFHVNFVLLGHSECRHIFHEEDATIALKVGAAARSGVVPVLCIGETLEARENGTTKEVLSNQLMLGLAQLPETAPVIIAYEPVWAIGTGKVASTADVQEVHAFCREVLSRIFSKEKSEIISILYGGSVKADNAEGFARCPDVDGLLVGGASLDPQGFANVLRNFNL

SEQ ID NO: 67002 - DNA, 738 bp, Chlorobium tepidum
  CDS (1)..(738): transl_table=11
gtggtgggcaactggaagatgaacaacaccatcgccgagtctgtcgatctggcaactgcgattgccgagaaggtcggagctgacggtgtgcagtgtgaagtgggcatcgcccccacatttccggcgttgtacgaggtttgcaaggtgatcgagtggagcggaatcaggctctgcgctcagaactgtcattacgagagtgatggcccattcaccggcgaggtctccacgcggatgcttgccgctgccggatgcagctatgttatcctcgggcactcggagcgccgtcaactgttcggcgaaaccaatgccacggtcaacctcaaggtcaaaaaggcgttggctgaagggttgagcgtcatcctctgcgttggtgagacgctcgacgagcgcgagcgcggcgtgacgggtcagatcgtcactgcccaagtggttgaggggctgattgatgttaccgacatcagcaagctggtgattgcctacgaaccggtatgggcaatcggcaccggcaaaaccgccaccaaagagcaggcgcaggaggttcacgcgctgattcgggcgaaagtcaccgaactctacggtcagaaagcggcggaccatctcaggatccagtacggcggcagcgtcaaaccctctaacgctgcggagcttttcgccatgccggatatcgacggtggcctgattggtggcgcgagcctcaatgccgacgacttcatggcgattgtcgaggcggcggggtaa

SEQ ID NO: 67003 - protein, 245 aa, Chlorobium tepidum
MVGNWKMNNTIAESVDLATAIAEKVGADGVQCEVGIAPTFPALYEVCKVIEWSGIRLCAQNCHYESDGPFTGEVSTRMLAAAGCSYVILGHSERRQLFGETNATVNLKVKKALAEGLSVILCVGETLDERERGVTGQIVTAQVVEGLIDVTDISKLVIAYEPVWAIGTGKTATKEQAQEVHALIRAKVTELYGQKAADHLRIQYGGSVKPSNAAELFAMPDIDGGLIGGASLNADDFMAIVEAAG

SEQ ID NO: 67004 - DNA, 825 bp, Chlamydia trachomatis
  CDS (1)..(825): transl_table=11
atgtttacagacaaagaaactcacagaaaaccatttccaacttgggcccaccttctccactctgagccatcaaagcaatttgttttcggtaattggaaaatgaacaaaacacttactgaagctcagacctttttaaaaagtttcatctctagtgacattctgtctaatccccaaatcattacaggaatcattcctcctttcacactgctgtcagcttgtcaacaagctgtaagcgattcccccatctttcttggagcccaaaccactcatgaagctgactcaggagcttttactggtgagatttcagccccaatgctcaaagatatcggagtcgattttgttctcatcggacattccgaaagacgtcatatctttcatgaacaaaatcctgtacttgctgaaaaagctgctgcagctatccatagtggaatgattccagttctgtgtattggagaaactctagaagaacaagaatctggagcaactcaagatattcttttaaatcaactgactacaggattatctaaactccctgagcaagcctctttcattctagcttatgaaccagtctgggctataggcaccggaaaagtagctcatcctgatctagttcaggaaacccatgctttctgtagaaaaacgattgcttctctcttttccaaagatattgcggaacgcacccccattctttacggaggatctgtgaaagccgataatgctcgctcactttccctctgccctgatgttaatggtcttttagttggaggagcctctttatcttcagagaatttcttatccattatacaacaaatcgatatcccataa

SEQ ID NO: 67005 - protein, 274 aa, Chlamydia trachomatis
MFTDKETHRKPFPTWAHLLHSEPSKQFVFGNWKMNKTLTEAQTFLKSFISSDILSNPQIITGIIPPFTLLSACQQAVSDSPIFLGAQTTHEADSGAFTGEISAPMLKDIGVDFVLIGHSERRHIFHEQNPVLAEKAAAAIHSGMIPVLCIGETLEEQESGATQDILLNQLTTGLSKLPEQASFILAYEPVWAIGTGKVAHPDLVQETHAFCRKTIASLFSKDIAERTPILYGGSVKADNARSLSLCPDVNGLLVGGASLSSENFLSIIQQIDIP

SEQ ID NO: 67006 - DNA, 747 bp, Chromobacterium violaceum
  CDS (1)..(747): transl_table=11
atgtccggcaaactggtgattggcaactggaagatgaacacccgcggcgacagcgcccgacagctggcggcggccctgctggccgacgggcagaccaatcgcgagggcgtcggcatcgccgctcccgccgtctatctggcggcgctggccgagcagctgaagggcggcaaaatcgccttgtcctcccaggacgtcagccgtttcgccgccgacggcgcgttcaccggcgaggtgagcgccgcgatgctggccgacgtcggctgccgctacgcgctggtcggccactccgagcgccgccagtatttccgcgaggacaacgcggcgctgctggccaagatgcgcaacgccatcgccgccggcgtgactccggtgctgtgcgtcggcgagacgctggcgcaacgggaggcgggcgattatctgaacgtggtgcgggaacagcttgccatcctgtccgatatcgccgatggtgaatacgtcgtcgcctacgaaccggtatgggccatcggcaccggcaaggtggcgtcgcttgagcagatcgcggagatccatgcattcatcaaaaattggtgcttgcaaaacgctggcggctccgctaagattcgcgtcctctacggcggcagtgtcaaagcagagaatgccgaagcgattctggcgacggaaaacgtcgacggagcactggtcggaggagcctctctggacgccgattcattcagagtgatttgccaagccgcaggaaaaatgatatag

SEQ ID NO: 67007 - protein, 248 aa, Chromobacterium violaceum
MSGKLVIGNWKMNTRGDSARQLAAALLADGQTNREGVGIAAPAVYLAALAEQLKGGKIALSSQDVSRFAADGAFTGEVSAAMLADVGCRYALVGHSERRQYFREDNAALLAKMRNAIAAGVTPVLCVGETLAQREAGDYLNVVREQLAILSDIADGEYVVAYEPVWAIGTGKVASLEQIAEIHAFIKNWCLQNAGGSAKIRVLYGGSVKAENAEAILATENVDGALVGGASLDADSFRVICQAAGKMI

SEQ ID NO: 67008 - DNA, 747 bp, Clostridium acetobutylicum
  CDS (1)..(747): transl_table=11
atgagaacaccaataatcgccggtaattggaaaatgaataacacaattagtgaatctttaaaattaattgaagaattaaagccacttgtaaaagatgcaaaggctgaagttgtagtagcacctacagctgtttctttagaaactgttgttaatgctacaaaaggaagtaacattaaggttgctgcacaaaatgcacactttgaagaaagtggagctttcactggagaaatatcactaaaagcacttgaagaattaggtgtaagttatgtaatattaggtcatagtgaaagaagacagtattttaatgaaacagattgtgctttgaataaaaaagtaaaagcagcatttgctcataatataactccaatattatgctgcggagaaactcttgaagaaagagaagcaaatgtaacaaatgaagttacaggaaagcaaataaagttagatttagcaggattaagtgctgaacaggcagctaaggttgttatagcttatgaaccaatttgggcaataggaacaggtaaaactgctacagatgaacaggcaaatgaaacaattggagcaatcagaaaaacagtagaagtaatgttcggaaaagaagttgcagaaaaagtaagaatacaatatggtggttctgtcaaaccaaatacaattaaagctcaaatggctaagccagaaatagatggagcattagttggaggagcaagccttaaagcagctgattttgcagcaatagttaatttctaa

SEQ ID NO: 67009 - protein, 248 aa, Clostridium acetobutylicum
MRTPIIAGNWKMNNTISESLKLIEELKPLVKDAKAEVVVAPTAVSLETVVNATKGSNIKVAAQNAHFEESGAFTGEISLKALEELGVSYVILGHSERRQYFNETDCALNKKVKAAFAHNITPILCCGETLEEREANVTNEVTGKQIKLDLAGLSAEQAAKVVIAYEPIWAIGTGKTATDEQANETIGAIRKTVEVMFGKEVAEKVRIQYGGSVKPNTIKAQMAKPEIDGALVGGASLKAADFAAIVNF

SEQ ID NO: 67010 - DNA, 747 bp, Clostridium perfringens
  CDS (1)..(747)
atgagaactccaataatcgcaggaaactggaaaatgcactatacaatagacgaggctgttaaattagttgaagaattaaagccattagttaaagatgctaaatgtgaagttgttgtttgcccaacttttgtttgcttagatgcagttaaaaaagctgttgaaggaacaaacataaaagtaggtgctcaaaacatgcactttgaagaaaaaggagcattcactggagaaatcgctccaagaatgttagaagctatgaacatagattacgttataattggacatagtgaaagaagagaatacttcaacgaaacagatgaaacttgcaacaaaaaagttaaagctgctttcgcacacaacttaactccaatcctttgctgtggagaaactttagagcaaagagaaaacggaactactaacgacgttataaaagctcaaatcactgctgatttagaaggattaactaaagagcaagctgagaaagttgttatagcttacgaaccaatctgggctatcggaactggaaaaactgctacttcagaccaagctaatgaaacaatagctgctataagagctatggttgctgaaatgttcggacaagaagttgctgataaagtaagaatccaatacggtggatcagttaagcctaacacaatagcagagcaaatggctaaatcagacatcgatggtgctttagttggtggagctagcttagttgcagctgactttgctcaaatcgtaaactactaa

SEQ ID NO: 67011 - protein, 248 aa, Clostridium perfringens
MRTPIIAGNWKMHYTIDEAVKLVEELKPLVKDAKCEVVVCPTFVCLDAVKKAVEGTNIKVGAQNMHFEEKGAFTGEIAPRMLEAMNIDYVIIGHSERREYFNETDETCNKKVKAAFAHNLTPILCCGETLEQRENGTTNDVIKAQITADLEGLTKEQAEKVVIAYEPIWAIGTGKTATSDQANETIAAIRAMVAEMFGQEVADKVRIQYGGSVKPNTIAEQMAKSDIDGALVGGASLVAADFAQIVNY

SEQ ID NO: 67012 - DNA, 768 bp, Clostridium tetani
  CDS (1)..(768): transl_table=11
ttgaaaggggtgtatggattgcgtaaagcaataatagcaggaaactggaaaatgcataatactatagatgaatcagtgaaattagttgaggaattaattccgaaagttaaagaagcagaatgtgaagtagtagtttgtccaccttttatatgccttccaaagattagagaaattacagaaggaacaaatataaaagttggagctcagaatatgtatttcgaagagaaaggagcttttacaggagaggtatctcccctaatgcttgaaaagttaaatatagattatgtaataataggtcatagtgaaagaagacaatattttaaagaaactgaccaaacagttaacaaaaagcttaaagcagcctttgaacacaatttaattccaatactttgtgtaggagaaactttagatgaaaaagaaaatggtgtaaccgaagaagttgtatcaaaacaagtaaaacttggtctttttgaattaaaagaagaacaagtagagaagctagtaatagcttatgaaccaatatgggctataggtacaggaaaaacagcaacctcagaggaggcaaatgaagttatagcacttataagaagtaccgtaaaaagcctatatggagacaaagtggcagaaagcctaagaatacaatatggtggttcagtaaaaccttcaactataaaagaacaaatgtctatgtcagatatagacggagctttagtaggaggagcaagtcttaaagcaaatgacttctcagctatagtaaactacaaatag

SEQ ID NO: 67013 - protein, 255 aa, Clostridium tetani
MKGVYGLRKAIIAGNWKMHNTIDESVKLVEELIPKVKEAECEVVVCPPFICLPKIREITEGTNIKVGAQNMYFEEKGAFTGEVSPLMLEKLNIDYVIIGHSERRQYFKETDQTVNKKLKAAFEHNLIPILCVGETLDEKENGVTEEVVSKQVKLGLFELKEEQVEKLVIAYEPIWAIGTGKTATSEEANEVIALIRSTVKSLYGDKVAESLRIQYGGSVKPSTIKEQMSMSDIDGALVGGASLKANDFSAIVNYK

SEQ ID NO: 67014 - DNA, 756 bp, Coprinus cinereus
  CDS (1)..(756)
atgactcgctctttcttcgtcggcggcaactggaagctcaaccctaccagcctttcggctgccaaagcccccgtcgaggctttgaacaaggctgatttggatccttccaccgaggtcgtcgttgcgccccctgctttgtacttgctccctatccaggagatcgccggcaaggctgtcaaggttgctgctcaaaacgcgtacttcaaggagtctggtgctttcactggagaaatcagccctaagcagatctctgatgctggtattccctacgtcatcctcggtcactctgaacgccgcaccctcttccacgagacctcggaagtcgtcgctttgaagacccgcgctgcgttggacaacgggttgaaggtcatcctctgtatcggcgagaccctcaaggagcgcgaggagggccgtaccgccgccgtctgcgaagagcaactcagcgctgtcgtcaagcagttgaaggaggaggactggagcaatatcgtcatcgcctacgaacccgtttgggcaattggaaccggcaaggtggccacgacctcccaagcgcaggagacgcacgttgatgtccgcaagtacctcgccaccgctgtctccccgaaggtcgcgtccgagacgcgcgtcatctacggtggaagcgtcaacgctgctaacagcaaggatctggcctcccagcaggacattgacggtttcctcgttggcggtgcatccctcaaacccgagtttgtcgatatcatcaatgctaggaaggcataa

SEQ ID NO: 67015 - protein, 251 aa, Coprinus cinereus
MTRSFFVGGNWKLNPTSLSAAKAPVEALNKADLDPSTEVVVAPPALYLLPIQEIAGKAVKVAAQNAYFKESGAFTGEISPKQISDAGIPYVILGHSERRTLFHETSEVVALKTRAALDNGLKVILCIGETLKEREEGRTAAVCEEQLSAVVKQLKEEDWSNIVIAYEPVWAIGTGKVATTSQAQETHVDVRKYLATAVSPKVASETRVIYGGSVNAANSKDLASQQDIDGFLVGGASLKPEFVDIINARKA

SEQ ID NO: 67016 - DNA, 762 bp, Coptis japonica
  CDS (1)..(762)
atgggccgaaagttcttcgttggtggtaactggaaatgtaatggaacaagtgaagaggtgaaaaagattgttacattattgaacgaagccgaagttccttctgaagatgttgttgaggtggtggtgagtcctccatatgtgtttcttccatttgtgaagaatttattgagggctgatttccatgttgctgctcagaattgttgggttaagaaaggtggtgctttcaccggtgaggttagtgcggagatgcttgtcaatttgggcattccttgggtgattcttggacattctgaaagaagagcattgctaaatgaatcaaatgagtttgttggggataaaactgcatatgcactttctcaaggcctgaaagtgattgcttgtgtcggtgagactcttgaacagcgagaagctggatctacaatctctgttgttgctgcgcaaacaaaagctattgcagagaaagtatccgattggaccaacattgttgtggcctatgagcccgtatgggctattggaacaggaaaggttgcaagtcctgcccaggctcaagaagtgcattttgaattgaggaaatggattaaagagaatgttggtgctgatgttgctgggtcagtcaggattatctatggaggttccgtaaatggtgcaaactccaaagaattggcaggacagcctgatattgacggtttccttgttggaggtgcttctttaaagcctgaattcgtggacattatcaagtctgccaccgtgaagagctcttaa

SEQ ID NO: 67017 - protein, 253 aa, Coptis japonica
MGRKFFVGGNWKCNGTSEEVKKIVTLLNEAEVPSEDVVEVVVSPPYVFLPFVKNLLRADFHVAAQNCWVKKGGAFTGEVSAEMLVNLGIPWVILGHSERRALLNESNEFVGDKTAYALSQGLKVIACVGETLEQREAGSTISVVAAQTKAIAEKVSDWTNIVVAYEPVWAIGTGKVASPAQAQEVHFELRKWIKENVGADVAGSVRIIYGGSVNGANSKELAGQPDIDGFLVGGASLKPEFVDIIKSATVKSS

SEQ ID NO: 67018 - DNA, 789 bp, Corynebacterium efficiens
  CDS (1)..(789)
atgtcacccatggcacgtaaaccactcatcgccggtaactggaagatgaacctggatcaccagcaggccatcggaacggtccagaagctcgcattcgccctgcacaaggactactacgagaaggtcgacgtggcggtgatcgtcccctttaccgatctgcgctccgtccagaccctggtggagggtgacaagctgcagatcacctacggtgcgcaggatgtctcccagcacgagtccggtgcctacaccggtgaggtgtccgcctccatgctggcgaagctgaactgttcctgggttgtcgtcgggcattccgagcgacgcgagtaccacaatgaaaccgatgagctcgtggcggcgaaggccaaggctgcgctcagcaagggcatcagcccgatcgtctgtgtcggcgagccacttgagatccgcgaggcgggaacccatgtggactacgtggtcgagcagacccgcgcatccctcgccggtctgagtgccgatgagctggccaacactgtcatcgcctacgagcccgtctgggccatcggaaccggtaaggtcgcctccgcagccgacgcgcaggaggtctgcaaggccatccgcggcctggtcaccgagctcgccggcgaggaggtcgcagaaggaatgcgcattctctacggtggctccgtgaaggcggagaccatcgccgagatcgtcagccagcccgatgtggatggtggcctcgtaggtggggcctccctcgatggtgaggctttcgccaaactcgccgcgaatgcggccaacgccgtctag

SEQ ID NO: 67019 - protein, 262 aa, Corynebacterium efficiens
MSPMARKPLIAGNWKMNLDHQQAIGTVQKLAFALHKDYYEKVDVAVIVPFTDLRSVQTLVEGDKLQITYGAQDVSQHESGAYTGEVSASMLAKLNCSWVVVGHSERREYHNETDELVAAKAKAALSKGISPIVCVGEPLEIREAGTHVDYVVEQTRASLAGLSADELANTVIAYEPVWAIGTGKVASAADAQEVCKAIRGLVTELAGEEVAEGMRILYGGSVKAETIAEIVSQPDVDGGLVGGASLDGEAFAKLAANAANAV

SEQ ID NO: 67020 - DNA, 780 bp, Corynebacterium glutamicum
  CDS (1)..(780): transl_table=11
atggcacgtaagccacttatcgctggtaactggaagatgaacctggatcaccagcaggcaatcggcactgttcagaagcttgcattcgcccttccaaaggaatacttcgagaaggttgacgttgcagtcaccgttcctttcactgacatccgctccgtccagactctcgttgagggcgacaagcttgaggtcactttcggtgctcaggacgtctcccagcacgagtccggtgcgtacaccggtgaagtttctgcaagcatgctggcaaagttgaactgctcttgggttgtcgttggacactccgagcgccgcgagtaccacaacgagtctgatgagttggttgctgcgaaggcaaaggcagctctgtccaacggcatcagcccgatcgtctgcgttggtgagccactggaaatccgtgaagctggcacccacgttgagtacgtcgtcgagcagacccgtaagtcccttgctggcctggatgctgctgagctggccaacaccgttatcgcgtatgagccagtgtgggctatcggcaccggtaaggttgcttccgcagctgacgctcaggaagtgtgcaaggctatccgcggtctgatcgtggagcttgcaggcgacgaggtcgctgagggcctgcgtattctttacggtggttctgttaaggcagaaaccgtcgctgagatcgtcggtcagcctgacgtcgacggcggacttgtcggtggcgcttccctcgacggtgaagcattcgccaagctggctgccaacgctgcgagcgttgcttaa

SEQ ID NO: 67021 - protein, 259 aa, Corynebacterium glutamicum
MARKPLIAGNWKMNLDHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDAAELANTVIAYEPVWAIGTGKVASAADAQEVCKAIRGLIVELAGDEVAEGLRILYGGSVKAETVAEIVGQPDVDGGLVGGASLDGEAFAKLAANAASVA

SEQ ID NO: 67022 - DNA, 768 bp, Coxiella burnetii
  CDS (1)..(768): transl_table=11
atgcagcgtcgaccgttagtggctggtaattggaaaatgcatggttcgcgcgaaagtgtgggtcaattattaagggcattaaaacacggttgcgagcgtctggaaacggcggagctcgctgttttccccccttttgtctttttgcagcaatgcgaagaggcgctgatgcgaacgcaaatctcttggggtgcgcaggacgtttccgaattcgaaagaggcgcttatacgggggaagtctctgctgccatgctgcgcgatttccattgccggtatgtaatcgtcggccactcggaaaggcgtcagcgtcacggagaaaccaatgagcaagtggctgcgaaggttagggcagccctccgttgcggcattcgtcctattatttgtgtaggggaaactgaaaagcagcgcaatgctaatcagacattatcagtgataaaagagcaacttgcagttgtattgcagatgaacgataatttggcgtcgttggaaggcatggtggtggcttatgagccgatatgggcgattggaaccggaaaaaatgcaacgccttcgcaagcagaagaagtgcacgcagcccttcgagatcaattacaccgtcaggatgcgacactagccgaaagcacgcggcttttatatgggggcagtgttaagccggataatgcagccgctttgtttgaaatgccaaatatagatggcgctttagtgggtggggcttctttggaagctgaacaatttctaaaaatagggcaacaatgcaatcaatcattttaa

SEQ ID NO: 67023 - protein, 255 aa, Coxiella burnetii
MQRRPLVAGNWKMHGSRESVGQLLRALKHGCERLETAELAVFPPFVFLQQCEEALMRTQISWGAQDVSEFERGAYTGEVSAAMLRDFHCRYVIVGHSERRQRHGETNEQVAAKVRAALRCGIRPIICVGETEKQRNANQTLSVIKEQLAVVLQMNDNLASLEGMVVAYEPIWAIGTGKNATPSQAEEVHAALRDQLHRQDATLAESTRLLYGGSVKPDNAAALFEMPNIDGALVGGASLEAEQFLKIGQQCNQSF

SEQ ID NO: 67024 - DNA, 744 bp, Culex tarsalis
  CDS (1)..(744)
atgggtcgtaagttctgcgttggaggcaactggaagatgaacggcgacaaggccagcatcgccgatctgtgcaaggtgctgacgaccggtccgctgaacgccgacaccgaggtcgtggtcggatgtccggccccgtacctgaccttggcccgcagccagctgccggacagcgtttgcgttgccgcccagaactgctacaaagtcccgaagggagccttcaccggtgaaatctcgccggccatgctgaaagatctgaacattggctgggtcatcctgggccactcggagcgtcgcgccatcttcggtgagtcggacgagctgatcgccgacaaggtcgcccacgctctggccgagggcctcaaggtcatcgcctgcatcggtgagacgctgcaggagcgcgaggctggccaaaccgaggccgtttgcttccgccagaccaaggccatcgccgacaaggtgaaggactggtccaacgttgtgatcgcgtacgagccggtgtgggccatcggaaccggcaagaccgcctcgccggaacaggcccaggaggtgcacgccgcgctcaggaagtggttcacggagaacgtgtccgccgatgtgtccgcggcgatccgcatccagtacggaggttccgttaccgctgccaactgccgcgagctggccgccaagcccgacattgacggattcctggtcggtggagcttcgctcaagccggagtttatccagattgtcaacgccagacagtaa

SEQ ID NO: 67025 - protein, 247 aa, Culex tarsalis
MGRKFCVGGNWKMNGDKASIADLCKVLTTGPLNADTEVVVGCPAPYLTLARSQLPDSVCVAAQNCYKVPKGAFTGEISPAMLKDLNIGWVILGHSERRAIFGESDELIADKVAHALAEGLKVIACIGETLQEREAGQTEAVCFRQTKAIADKVKDWSNVVIAYEPVWAIGTGKTASPEQAQEVHAALRKWFTENVSADVSAAIRIQYGGSVTAANCRELAAKPDIDGFLVGGASLKPEFIQIVNARQ

SEQ ID NO: 67026 - DNA, 747 bp, Debaryomyces hansenii
  CDS (1)..(747)
atggctcgtcaattctttgttggaggtaactttaaaatgaacggtactagagaatccgtttccaagatcgtggatggtttaaacaaggccgaattaccatcaaatgttgaagttgtcattgctccaccagcaccatacattgctttagctgtcaacgaaaacaagcaaaagactatcgaagtttctgctcaaaattgtttcgacaaggcttctggtgcttacactggtgaaatttccccagaacaaattaaagatttaggtgccacctggactttaactggtcactctgaaagaagaactatcatcaaggaatctgatgacttcattgcttcaaagaccaagttcgctttagatcaaggtttatctgtcatcttatgtattggtgaaaccttagaggaacgtaaggctaacgttaccttagatgtatgtgctagacaattagacgctgttgccagagttgtctctgactggtctaagattgttgttgcctacgaaccagtctgggctattggtactggtttagctgctactccagaagatgctcaagaaactcacaaggctatcagagaacacttatctaagtccattggtgctgatgctgctgaaaagaccagaatcttatacggtggttctgtcaacggtaagaatgctcctgaattcaaggacaaggctgatgtcgatggtttcttagtcggtggtgcttctttaaagccagaatttgttgacatcatcaagtcaagattgtaa

SEQ ID NO: 67027 - protein, 248 aa, Debaryomyces hansenii
MARQFFVGGNFKMNGTRESVSKIVDGLNKAELPSNVEVVIAPPAPYIALAVNENKQKTIEVSAQNCFDKASGAYTGEISPEQIKDLGATWTLTGHSERRTIIKESDDFIASKTKFALDQGLSVILCIGETLEERKANVTLDVCARQLDAVARVVSDWSKIVVAYEPVWAIGTGLAATPEDAQETHKAIREHLSKSIGADAAEKTRILYGGSVNGKNAPEFKDKADVDGFLVGGASLKPEFVDIIKSRL

SEQ ID NO: 67028 - DNA, 744 bp, Drosophila melanogaster
  CDS (1)..(744)
atgagccgaaagttctgcgtgggaggcaactggaagatgaacggcgaccagaagtccatcgccgagatcgccaagaccctgagctcggccgccctcgaccccaacacggaggtggtcatcggctgcccggccatctacctgatgtacgcccgcaacctgctgccctgcgagctgggtctggccggccagaatgcctacaaggtggccaagggcgcattcaccggcgagatctcccctgcgatgctgaaggacatcggcgccgactgggtgatcctgggacactcggagcgtcgcgccatcttcggcgaatcggacgccctgatcgccgagaaggccgagcacgccctggccgagggcctcaaggtcatcgcctgcattggtgagaccctggaggagcgcgaggccggcaagaccaacgaggtggtggcccgccaaatgtgcgcctacgcccaaaagatcaaggactggaagaacgtggtggtggcctacgaacccgtctgggccattggcaccggcaagaccgccacacccgatcaggctcaagaggtccacgcttccctgcgccagtggctgagcgacaacatctccaaggaggtgtccgccagcctgcgcatccagtacggtggatccgtgaccgccgccaacgccaaggagctggccaagaagcccgacatcgatggcttcctggtcggtggcgcctccctgaagcccgagttcttggacatcatcaacgcccggcagtaa

SEQ ID NO: 67029 - protein, 247 aa, Drosophila melanogaster
MSRKFCVGGNWKMNGDQKSIAEIAKTLSSAALDPNTEVVIGCPAIYLMYARNLLPCELGLAGQNAYKVAKGAFTGEISPAMLKDIGADWVILGHSERRAIFGESDALIAEKAEHALAEGLKVIACIGETLEEREAGKTNEVVARQMCAYAQKIKDWKNVVVAYEPVWAIGTGKTATPDQAQEVHASLRQWLSDNISKEVSASLRIQYGGSVTAANAKELAKKPDIDGFLVGGASLKPEFLDIINARQ

SEQ ID NO: 67030 - DNA, 750 bp, Emericella nidulans
  CDS (1)..(750)
atgcctcgcaaatttttcgttggcggtaacttcaagatgaacggtaatgccgagagcactacctccatcatcaagaacctcaactctgccaacctggataagtccgtcgaagttgtcgtctctcctcctgcgctctacctactccaggcccgcgaggtcgccaacaaggagattggagttgctgcccagaacgtcttcgacaagcccaatggtgctttcaccggtgagatcagcgtccagcagcttcgcgaggccaacatcgactggaccatccttggacacagtgagcgccgcgttatcctcaaggagactgatgagttcattgctcgcaagactaaggctgccattgagggtggcctgcaagtgattttctgcatcggtgagacgcttgaggagcgtgaggccaacaagaccatcgatgtagtcactcgtcagctcaacgcggcggctaaggagctctccaaggagcagtgggccaaggttgtcatcgcctacgagcccgtttgggccattggaaccggtaaggtcgctacaaccgagcaggcccaggaagtccactctgccatccgcaagtggctgaaggacgccatctccgctgaggccgctgagaacacccggatcatttatggcggctcagtgagtgagaagaactgcaaagatctcgcgaaggaggccgatatcgatggcttcctcgtcggcggcgccagccttaagcctgccttcgtcgatattgtcaatgcccgcctgtaa

SEQ ID NO: 67031 - protein, 249 aa, Emericella nidulans
MPRKFFVGGNFKMNGNAESTTSIIKNLNSANLDKSVEVVVSPPALYLLQAREVANKEIGVAAQNVFDKPNGAFTGEISVQQLREANIDWTILGHSERRVILKETDEFIARKTKAAIEGGLQVIFCIGETLEEREANKTIDVVTRQLNAAAKELSKEQWAKVVIAYEPVWAIGTGKVATTEQAQEVHSAIRKWLKDAISAEAAENTRIIYGGSVSEKNCKDLAKEADIDGFLVGGASLKPAFVDIVNARL

SEQ ID NO: 67032 - DNA, 768 bp, Enterobacter cloacae
  CDS (1)..(768): transl_table=11
atgcgacatcctttagtgatgggtaactggaaactgaacggcagccgccacatggtaaacgaactggttgcgaacctgcgtaaagagctggctggcgtgacgggctgcgcggttgctatcgctccgccggatatgtacctggatctggctaaacacgccgctgacggcagccacatcattctgggcgcgcagaacgttgacgttaacctgtctggcgcgttcaccggtgaaacctccgctgaaatgctgaaagatatcggcgcgaaatacatcatcatcggccactccgagcgtcgcacctatcacaaagaatccgacgagttcatcgcgaagaaatttgccgtgctgaaagagcagggtctgattccggttctgtgcatcggtgaaaccgaagcggaaaacgaagcgggcaaaaccgaagaagtgtgcgcacgtcagatcgacgcagtgctgaaaacccagggcgcggcagcgttcgaaggcgcagtaatcgcatacgagccagtctgggcgatcggtaccggcaaatctgcaacccctgcgcaggctcaggcggttcacaaattcattcgtgaccacattgctaaagcagacgcgaaggtcgctgagcaagtgattatccagtacggcggttccgtaaacgcctccaacgctgctgagctgttcacccagccagacatcgatggcgcgctggttggcggtgcatccctgaaagctgacgctttcgcggtgatcgttaaggcagcagaagcggctaaacaggcgtaa

SEQ ID NO: 67033 - protein, 255 aa, Enterobacter cloacae
MRHPLVMGNWKLNGSRHMVNELVANLRKELAGVTGCAVAIAPPDMYLDLAKHAADGSHIILGAQNVDVNLSGAFTGETSAEMLKDIGAKYIIIGHSERRTYHKESDEFIAKKFAVLKEQGLIPVLCIGETEAENEAGKTEEVCARQIDAVLKTQGAAAFEGAVIAYEPVWAIGTGKSATPAQAQAVHKFIRDHIAKADAKVAEQVIIQYGGSVNASNAAELFTQPDIDGALVGGASLKADAFAVIVKAAEAAKQA

SEQ ID NO: 67034 - DNA, 756 bp, Enterococcus faecalis
  CDS (1)..(756): transl_table=11
atgcgcaaaccaattatcgctggtaactggaaaatgaacaaaactttaagcgaagcacaaagctttgcagaagcagtaaaaaatgctgttccatcaaacgacgttgttgacgctgtgattggatctccagcattattcttagctcctttagcttggaacctaaaagattctgaagtgaaattagctgcacaaaactgctactgggaaaacgctggtgccttcactggtgaaaactcaccagctgcaattgcagatttaggtgtagactatgtgattatcggacactctgaacgtcgcgaatatttccacgaaacagatgaagatatcaataaaaaagccaaagcaatctttgcaaatggtatgacaccaatcttctgttgtggtgaaactttagaaacgtatgaagctggtaaaacagcggaatggatcgaaggtcaaatcactaaaggcttagttggtttatcaaacgaacaagttgcttcaatggttatcgcttacgaaccaatttgggcaatcggaactggtaaatctgcagatgctaatattgcagatgaaatctgtggtgttgttcgttcaacagttgaaaaattatacggcaaagaagtttctgaagctgttcgtattcaatacggtggttctgttaaaccagaaaacatcgctgaatatatggcaaaagaaaacgttgacggtgctttagtcggcggcgcaagcttagaagcagattcattcctagctttattagatgctgtaaaataa

SEQ ID NO: 67035 - protein, 251 aa, Enterococcus faecalis
MRKPIIAGNWKMNKTLSEAQSFAEAVKNAVPSNDVVDAVIGSPALFLAPLAWNLKDSEVKLAAQNCYWENAGAFTGENSPAAIADLGVDYVIIGHSERREYFHETDEDINKKAKAIFANGMTPIFCCGETLETYEAGKTAEWIEGQITKGLVGLSNEQVASMVIAYEPIWAIGTGKSADANIADEICGVVRSTVEKLYGKEVSEAVRIQYGGSVKPENIAEYMAKENVDGALVGGASLEADSFLALLDAVK

SEQ ID NO: 67036 - DNA, 756 bp, Fusobacterium nucleatum
  CDS (1)..(756): transl_table=11
ttgagaagattagttattgctggaaattggaaaatgtataaaaataataaagaggctgttgaaacattgacacaactaaaagatttaacaagggatgtaaaaaatgtagatatagttataggagcaccttttacttgtctttcagatgcagttaaaattgttgaaggaagtaatgtaaaaatagcagcagaaaatgtatatcctaaaatagaaggagcgtatacaggagaagtttctcctaaaatgcttaaagatattggagttacttatgtaattttaggacactctgaaagaagagaatattttaaagaaagtgatgaatttataaatcaaaaagttaaggcagttttagaaataggaatgaaacctatactttgtattggagaaaagttagaagatagagaaggaggaaaaactcttgaagttctagctaaacaaatcaaagaaggtcttgttgatttatctaaggaagatgcagaaaaaactatagttgcttatgaaccagtttgggcaataggaacaggaaaaacagcaactccagaaatggcacaagaaactcataaggaaattagaaatgtcttagcagaaatgtttggaaaagatgtggcagataagatgataattcaatatggtggttcaatgaaaccagaaaatgcaaaagatttattaagtcaagaagatattgatggtggtcttgttggaggagcttcattaaaggcagattcattttttgaaattataaaagcaggaaattaa

SEQ ID NO: 67037 - protein, 251 aa, Fusobacterium nucleatum
MRRLVIAGNWKMYKNNKEAVETLTQLKDLTRDVKNVDIVIGAPFTCLSDAVKIVEGSNVKIAAENVYPKIEGAYTGEVSPKMLKDIGVTYVILGHSERREYFKESDEFINQKVKAVLEIGMKPILCIGEKLEDREGGKTLEVLAKQIKEGLVDLSKEDAEKTIVAYEPVWAIGTGKTATPEMAQETHKEIRNVLAEMFGKDVADKMIIQYGGSMKPENAKDLLSQEDIDGGLVGGASLKADSFFEIIKAGN

SEQ ID NO: 67038 - DNA, 723 bp, Gloeobacter violaceus
  CDS (1)..(723)
atgcgacgaaaggttctggcgggcaactggaaaatgtataagacccgcggcgaagcgcgcgccttcctggaggcttttgtaccgctcatctccccgggcgccgagaaccgggaggtcattctctgcgggccgtttacctgcctcgacctattgagcgcccaggccggaccctatgccgtcggcgcacagaacgtgcactgggccgatcacggcgcctacaccggcgaaatcgctccccagatgctcgtcgaactgggtgtgcactacgtgattgtcggccattctgagcggcgcgaatacttcaacgagaccgacagcaccgtcaaccgacgcctcaacaacgcccaggatcacgacctcgtcccgattctctgcgtgggtgagaccgagagcgtgcgcaaggacggcatcaccgaagcccacatccgctcccagctcgatcgcgacctcgaactggtggacatgcgccgcctgatcattgcctacgaacccatctgggccatcggcaccggcaaaacctgcgaggcgaacgaagcgaaccgggtgtgcgccatgatccgcaaacacgtcaacttcgaaggggtgcccatcctctacggcggctcggtcaaacccgaaaatatcgacgagttgatggcccagagcgacatcgacggcgtgctggtgggcggcgccagcctcgaagcgaagagcttcgcgcggatcgtcaacttcgaagtgtga

SEQ ID NO: 67039 - protein, 240 aa, Gloeobacter violaceus
MRRKVLAGNWKMYKTRGEARAFLEAFVPLISPGAENREVILCGPFTCLDLLSAQAGPYAVGAQNVHWADHGAYTGEIAPQMLVELGVHYVIVGHSERREYFNETDSTVNRRLNNAQDHDLVPILCVGETESVRKDGITEAHIRSQLDRDLELVDMRRLIIAYEPIWAIGTGKTCEANEANRVCAMIRKHVNFEGVPILYGGSVKPENIDELMAQSDIDGVLVGGASLEAKSFARIVNFEV

SEQ ID NO: 67040 - DNA, 771 bp, Haemophilus ducreyi
  CDS (1)..(771): transl_table=11
atggcacgtcgtccacttgtaatgggtaactggaaattaaacggcagtaaagcatttacacaacaactaattgccgaattaaaaacagaattagctgaaataaccggttgtgatgtagcaattgcaccaccggtaatgtatttatcagaagcggaaatagctttagcagggcaatcgaccatccgcctaggcgcacagaatgttgatataaatacccaaggagcctttacaggcgatatttccaccgcaatgttacaagagttttgtgcgaaatacattattatcggccattcagaacgccggacttaccacgcagaaagcgatcaatttatcgcaaaaaaattcgctgcattaaaaacagcaggattaacacccgtattatgtattggcgaaacagaagcagagaatgaagccggccaaacacaacaagtgtgcgcacgccaaattgacgccataattaacagcttaggcgttgaagcatttaatcaagccgttatcgcttatgaacccatctgggctatcggcacaggaaaatccgcaacgccagcccaagcccaagccgtgcatgcctttatccgccaacatatcgcagaaaaatcgcaagccgtagcagaccaactaattatccaatatggcggatccgtaaacgacaccaatgccgcagaactatttagccaacctgatattgacggtgcattagtgggaggcgcatccttaaaagcgaccgcatttgcagagatcgtaaaagcggctgaaaaagccaaagcataa

SEQ ID NO: 67041 - protein, 256 aa, Haemophilus ducreyi
MARRPLVMGNWKLNGSKAFTQQLIAELKTELAEITGCDVAIAPPVMYLSEAEIALAGQSTIRLGAQNVDINTQGAFTGDISTAMLQEFCAKYIIIGHSERRTYHAESDQFIAKKFAALKTAGLTPVLCIGETEAENEAGQTQQVCARQIDAIINSLGVEAFNQAVIAYEPIWAIGTGKSATPAQAQAVHAFIRQHIAEKSQAVADQLIIQYGGSVNDTNAAELFSQPDIDGALVGGASLKATAFAEIVKAAEKAKA

SEQ ID NO: 67042 - DNA, 708 bp, Helicobacter hepaticus
  CDS (1)..(708): transl_table=11
atgactatcattgctggtaatttcaaggcaaatctcacacgcattcaagttgctacctttgcaaaagagctagattctatactcacagatatgcaaacatcatctcatcttcaagtagatatttttccttctcatacggcattacttacgaataattttaagcattttcatatcggcgcacaaaatgcgtattttgcacaaaatgggggattcacgggcgagattggactaagccaactccaagaatttaatattaatcgccttattattgggcatagcgaacgtaggacactttttggtgaaaatcaagattttattaataaaaaatttagattctatgcagaagcaggatttgaaatatattactgcattggtgagcccttgagtatgcgacaaaagggtaaaaatgcgctcaaagactttctaggtgcacaattagatggtattgacatcacttatcctaagcttattattgcatatgaacctatttgggctattggcacaggtgaaagtgcgactttagaacaaatagaatctactcactcgatgcttgctacatttacaagtgccccgctactttatggaggcagtgtgaatcccacaaatgcaagagagattctttgcactccttacgtaaatggtgtgcttgtaggctctgcaagcctcaatatacaaagctttacggatattattcgtgctagtaaatag

SEQ ID NO: 67043 - protein, 235 aa, Helicobacter hepaticus
MTIIAGNFKANLTRIQVATFAKELDSILTDMQTSSHLQVDIFPSHTALLTNNFKHFHIGAQNAYFAQNGGFTGEIGLSQLQEFNINRLIIGHSERRTLFGENQDFINKKFRFYAEAGFEIYYCIGEPLSMRQKGKNALKDFLGAQLDGIDITYPKLIIAYEPIWAIGTGESATLEQIESTHSMLATFTSAPLLYGGSVNPTNAREILCTPYVNGVLVGSASLNIQSFTDIIRASK

SEQ ID NO: 67044 - DNA, 705 bp, Helicobacter pylori J99
  CDS (1)..(705): transl_table=11
atgacaaaaattgccatggctaatttcaaatccgctatgcctgtttttaaaagccatgcgtatttaaaagaattggaaaaaactttaaagccgcagcattttgatagggtgtttgtattccctgattttttggggttattgcctaacgcgtttttgcatttcactttaggagcgcaaaacgcttaccctagagattgtggggcttttaccggtgaaatcacttccaaacatttagaagaactgaaaatccacacgcttttaatagggcatagcgagaggcgagtgcttttaaaggaaagccctagctttttgaaagaaaaatttgatttttttaaaggtaaaaattttaaaattgtctattgtattggcgaagatttaacgaccagagaaaagggttttagggctgtaaaggaatttttaagcgagcaattagaaaatattgatcttaattattccaatttaattgtggcttatgagcctatttgggcgattggcactaaaaaaagcgcgtctttagaagatatttacctcacgcatggttttttaaagcaaatcttaaatcaaaaaacgcccttattgtatggggggagcgtgaatgcgcaaaacgctaaagaaattttagggattgatagcgtggatggcttattgattgggagcgcgtctttggaattagaaaattttaaaacaatcatttcatttttataa

SEQ ID NO: 67045 - protein, 234 aa, Helicobacter pylori J99
MTKIAMANFKSAMPVFKSHAYLKELEKTLKPQHFDRVFVFPDFLGLLPNAFLHFTLGAQNAYPRDCGAFTGEITSKHLEELKIHTLLIGHSERRVLLKESPSFLKEKFDFFKGKNFKIVYCIGEDLTTREKGFRAVKEFLSEQLENIDLNYSNLIVAYEPIWAIGTKKSASLEDIYLTHGFLKQILNQKTPLLYGGSVNAQNAKEILGIDSVDGLLIGSASLELENFKTIISFL

SEQ ID NO: 67046 - DNA, 705 bp, Helicobacter pylori
  CDS (1)..(705): transl_table=11
atgacaaaaattgccatggctaattttaaatccgctatgcctatttttaaaagccatgcgtatttaaaagaattagaaaaaactttaaaaccgcagcattttgacagggtgtttgtattccctgatttttttgggttattgcctaattcgtttttgcatttcactttaggggtgcaaaacgcttaccctagagattgtggggcttttaccggtgaaatcacttcaaagcatttagaagaactcaaaatccacacgcttttaatagggcatagcgagaggcgaacgcttttaaaagaaagccctagctttttgaaagaaaagtttgatttttttaaaagtaaaaattttaaaattgtctattgtattggcgaagaattaacgaccagagaaaagggttttaaggctgtaaaggaatttttaagcgagcaattagaaaatattgatctcaattatcctaatttagtggtggcgtatgagcctatttgggcgattggcaccaaaaaaagcgcttctttagaagatatttatctcacgcatggttttttaaagcaaatcttaaatcaaaaaacgcccttgttgtatggggggagcgtgaacacacaaaacgctaaagaaattttagggattgatagcgtggatggcttgttgatcgggagcgcgtcttgggaattagaaaattttaaaacaatcatttcatttttataa

SEQ ID NO: 67047 - protein, 234 aa, Helicobacter pylori
MTKIAMANFKSAMPIFKSHAYLKELEKTLKPQHFDRVFVFPDFFGLLPNSFLHFTLGVQNAYPRDCGAFTGEITSKHLEELKIHTLLIGHSERRTLLKESPSFLKEKFDFFKSKNFKIVYCIGEELTTREKGFKAVKEFLSEQLENIDLNYPNLVVAYEPIWAIGTKKSASLEDIYLTHGFLKQILNQKTPLLYGGSVNTQNAKEILGIDSVDGLLIGSASWELENFKTIISFL

SEQ ID NO: 67048 - DNA, 762 bp, Hordeum vulgare
  CDS (1)..(762)
atgggccgcaagttcttcgtcggcggcaactggaaatgcaatggaaccgtcgagcaggtagaggcgatcgtccaaactctgaacgctggacagatcgtctctccggatgttgtcgaggttgttgtcagcccgccctatgtcttccttcccatcgtcaaggctaagctgcgcccagagatccaagttgctgctcagaactgctgggtgaagaagggcggtgctttcaccggtgaagtcagtgctgagatgcttgccaaccttggcgttccctgggtcattcttggacactctgagaggaggagcttgttgggagagtcaagtgagtttgttggcgagaaagttgcatatgcactcgctcagggcttgaaggtcattgcatgtgttggtgagactctcgagcagcgagaagctggatcaaccatggaagttgtcgctgaacagacaaaagcaattgctggcaagatcaaggactggtccaacggggtcgttgcttacgaaccagtgtgggccatcggcaccggtaaagttgcgacaccggctcaggcgcaggaagtccatgccaatctgagggactggctcaagaccaacgtgagccctgaggttgctgaatccacacgtatcatctatggaggatcggtgactggcgcaagctgcaaggagttggccgcgcaggccgacgtcgatggtttcctcgtcggtggagcttctttgaagccggagttcatcgacataatcaacgctgccgccgtgaagtccgcctaa

SEQ ID NO: 67049 - protein, 253 aa, Hordeum vulgare
MGRKFFVGGNWKCNGTVEQVEAIVQTLNAGQIVSPDVVEVVVSPPYVFLPIVKAKLRPEIQVAAQNCWVKKGGAFTGEVSAEMLANLGVPWVILGHSERRSLLGESSEFVGEKVAYALAQGLKVIACVGETLEQREAGSTMEVVAEQTKAIAGKIKDWSNGVVAYEPVWAIGTGKVATPAQAQEVHANLRDWLKTNVSPEVAESTRIIYGGSVTGASCKELAAQADVDGFLVGGASLKPEFIDIINAAAVKSA

SEQ ID NO: 67050 - DNA, 768 bp, Klebsiella pneumoniae
  CDS (1)..(768): transl_table=11
atgcgacatcctttagtgatgggtaactggaaactgaacggcagccgccacatggtaaacgaactggttgcgaacctgcgtaccgagctggctggcgtaagcggctgtgcagttgccatcgccccgccggaaatgtatctggacctggctaagcgcgcggcagaaggcagccacattcacctgggcgcgcagaacgttgacgtgaacctgtccggcgcattcaccggtgaaacctccgccgaaatgctgaaagatatcggcgcgcagtacatcatcatcggccactccgagcgtcgtacctaccacaaagaatccgacgagctgatcgcgaagaaattcgcggtgctgaaagagcagggtctgaccccggttctgtgcatcggtgaaaccgaagccgaaaacgaagcgggcaaaacggaagaagtttgcgcacgtcagatcgacgccgtgctgaaaacccagggcgctgccgttttcgaaggcgtggttatcgcttacgaaccagtatgggctatcggtaccggcaaatcagcgaccccggctcaggcgcaggcggtgcacaaattcatccgtgaccacattgctaaagctgacgccaaaatcgctgagcaagtgatcatccagtacggcggttccgttaacgctggcaacgccgcagagctgttcacccagccggacatcgacggcgcgctggttggcggcgcctccctgaaagctgacgctttcgcggtgatcgttaaagcagcagaagcagcgaaaaaagcgtaa

SEQ ID NO: 67051 - protein, 255 aa, Klebsiella pneumoniae
MRHPLVMGNWKLNGSRHMVNELVANLRTELAGVSGCAVAIAPPEMYLDLAKRAAEGSHIHLGAQNVDVNLSGAFTGETSAEMLKDIGAQYIIIGHSERRTYHKESDELIAKKFAVLKEQGLTPVLCIGETEAENEAGKTEEVCARQIDAVLKTQGAAVFEGVVIAYEPVWAIGTGKSATPAQAQAVHKFIRDHIAKADAKIAEQVIIQYGGSVNAGNAAELFTQPDIDGALVGGASLKADAFAVIVKAAEAAKKA

SEQ ID NO: 67052 - DNA, 747 bp, Kluyveromyces lactis
  CDS (1)..(747)
atggctagaacattcttcattggtggtaacttcaagatgaacggaagcaaggcttccatcaaggaaatcgttgacagattgaatggagcttccatcccatctaacgtcgaagtggttatcgctccaccagctatctacttggaccacgctgttgcattaaacaagagaaaggaagttaaaatctctgctcaaaatgcatactccaaggcttccggtgcttacactggtgaaaactccgttgaacaaatcaaggatgtcggtgctgaatgggttatcttgggtcactctgaaagaagaacttacttcaacgaaactgatgaaatcgtcgccgaaaaaaccaaatttgctttggacagcggtgtcaaggttatcctatgtatcggtgaaactttggaagaaaagcaacaaaacatcactctacaagtcgtccaaagacaattgcaagccgtattggaaaaggttcaagactggactaacgtagtcgttgcctacgaaccagtctgggctattggtaccggtttggctgctactgctgaagatgctcaagatatccaccactccatcagagaattcttggctgaaaagctatccagagatgtcgctgactctgttagaatcttgtacggtggttctgctaacggtaagaacgctgttaccttcaaggacaaggctgatgtcgatggtttcttggtcggtggtgcttctttgaagccagaattcgttgacatcatcaactccagagtttaa

SEQ ID NO: 67053 - protein, 248 aa, Kluyveromyces lactis
MARTFFIGGNFKMNGSKASIKEIVDRLNGASIPSNVEVVIAPPAIYLDHAVALNKRKEVKISAQNAYSKASGAYTGENSVEQIKDVGAEWVILGHSERRTYFNETDEIVAEKTKFALDSGVKVILCIGETLEEKQQNITLQVVQRQLQAVLEKVQDWTNVVVAYEPVWAIGTGLAATAEDAQDIHHSIREFLAEKLSRDVADSVRILYGGSANGKNAVTFKDKADVDGFLVGGASLKPEFVDIINSRV

SEQ ID NO: 67054 - DNA, 747 bp, Kluyveromyces marxianus
  CDS (1)..(747)
atggctagaacattctttattggtggtaacttcaagatgaacggtaccaaggcttccattaaggaaatcgttgagagattgaactctgcttcgattccatccaacgtggaagttgtgattgctcctccagctgcctacttggaccacgctgtttctttgaacaagaaggctcaagtcagtgttgctgcccaaaacgcatacttgaaggcttccggtgctttcactggtgaaaactctgtggaacaaatcaaggatgttggtgccgaatgggttatcttgggtcactccgaaagaagaacatacttccacgaaaccgatgaattcattgctgacaagaccaagtttgctttggacagcggtgtcaaggttatcctatgtatcggtgaaaccttggaagaaaagcaaaagggtatcactttggaagttgtccaaagacaattgcaagctgttttggacaaggtccaagactggaccaacgttgttgttgcttacgaaccagtctgggctattggtaccggtttggctgctacctctgacgatgctcaagccatccaccactccatcagagaattcttggccaagaagttgagcaaggacaccgctgaaaagatcagaatcctatacggtggttccgctaacggtaagaacgctgtcaccttcaaggacaaggccgacgttgacggtttcttggttggtggtgcttctttgaagccagaattcgttgacatcatcaactccagagtctaa

SEQ ID NO: 67055 - protein, 248 aa, Kluyveromyces marxianus
MARTFFIGGNFKMNGTKASIKEIVERLNSASIPSNVEVVIAPPAAYLDHAVSLNKKAQVSVAAQNAYLKASGAFTGENSVEQIKDVGAEWVILGHSERRTYFHETDEFIADKTKFALDSGVKVILCIGETLEEKQKGITLEVVQRQLQAVLDKVQDWTNVVVAYEPVWAIGTGLAATSDDAQAIHHSIREFLAKKLSKDTAEKIRILYGGSANGKNAVTFKDKADVDGFLVGGASLKPEFVDIINSRV

SEQ ID NO: 67056 - DNA, 759 bp, Lactobacillus delbrueckii
  CDS (1)..(759): transl_table=11
atgtcacgtaccccaattattgctggtaactggaagctgaacatgaacccaaaggaaactgttgagttcgtaaacgctgttaaggaccaattgccagacccatcaaaggttgaatcagtgatttgtgcaccagcagttgacttggacgccttgctgaaggctgccgaaggctcaaacctgcacgtcggtgcagaaaactgctactgggaaaactccggtgccttcactggtgaaacttctccagcagttttgaaggaaatgggcgtgcaatacgtcatcatcggccactcagaacgccgtgactacttccacgaaactgacgaagacatcaacaagaaggccaaggctatctttgccaacggcttgactccaatcctttgctgcggtgaatcactggaaacccgggaagccggcaaggaaaacgaatgggttgtcagccaaatcaaggctggcctggaaggcttgactagtgaacaagtttccaagctggtgatcgcttacgaaccaatctgggcgatcggcactggcaagactgcttcaagcgaccaagctgaagaaatgtgcaagactatccgggaaactgttaaggacttgtacaacgaagaaactgctgaaaacgtccgcatccaatacggcggttcagtaaagccagccaacgtcaaggaattgatggctaagccaaacatcgacggtggcttggttggtggtgcatcattggtaccagactcatacctggctttggtaaactaccaagactaa

SEQ ID NO: 67057 - protein, 252 aa, Lactobacillus delbrueckii
MSRTPIIAGNWKLNMNPKETVEFVNAVKDQLPDPSKVESVICAPAVDLDALLKAAEGSNLHVGAENCYWENSGAFTGETSPAVLKEMGVQYVIIGHSERRDYFHETDEDINKKAKAIFANGLTPILCCGESLETREAGKENEWVVSQIKAGLEGLTSEQVSKLVIAYEPIWAIGTGKTASSDQAEEMCKTIRETVKDLYNEETAENVRIQYGGSVKPANVKELMAKPNIDGGLVGGASLVPDSYLALVNYQD

SEQ ID NO: 67058 - DNA, 759 bp, Lactococcus lactis; identical to SEQ ID NO: 66672
  CDS (1)..(759)

SEQ ID NO: 67059 - protein, 252 aa, Lactococcus lactis; identical to SEQ ID NO: 66673

SEQ ID NO: 67060 - DNA, 756 bp, Leishmania mexicana
  CDS (1)..(756)
atgtccgccaagccccagccgattgctgccgcgaactggaagtgcaacggcaccactgcttccatcgaaaagctggtgcaggtgttcaacgagcacactatttcccatgacgtgcagtgcgttgtggcgccaacctttgtgcacatcccactggttcaggccaaactccgcaaccccaagtacgtcatcagcgctgagaacgcgatcgccaagagcggcgcattcacaggtgaagtctcgatgccgatcctgaaagacataggcgtccactgggtcattctgggccactcggagcgccgcacgtactacggcgagacggacgagatcgtggcgcagaaggtttcggaagcatgcaagcagggattcatggtaattgcttgcattggggaaacgctgcagcagcgtgaagcgaaccagacagcgaaggtggtgctgagccagacgtcagcgatcgccgcgaagctgacgaaggatgcgtggaaccaagtggtgttagcctacgagcccgtctgggccatcggcaccggcaaggtcgcaacccccgaacaggcgcaggaagtgcacctgctgctgcgcaagtgggtcagcgagaacatcggcaccgacgtcgccgcgaaactccgcatcctgtatggcggctccgtcaacgccgccaatgccgcgacgctctacgcaaagcctgatatcaacggtttcctggtcggcggcgcgtccctcaagccggagttccgagacatcattgatgccacccggtga

SEQ ID NO: 67061 - protein, 251 aa, Leishmania mexicana
MSAKPQPIAAANWKCNGTTASIEKLVQVFNEHTISHDVQCVVAPTFVHIPLVQAKLRNPKYVISAENAIAKSGAFTGEVSMPILKDIGVHWVILGHSERRTYYGETDEIVAQKVSEACKQGFMVIACIGETLQQREANQTAKVVLSQTSAIAAKLTKDAWNQVVLAYEPVWAIGTGKVATPEQAQEVHLLLRKWVSENIGTDVAAKLRILYGGSVNAANAATLYAKPDINGFLVGGASLKPEFRDIIDATR

SEQ ID NO: 67062 - DNA, 1141 bp, Zea mays
  CDS (83)..(844)
gctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgttgaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacagcctgatgtcgatggttttcttgtcggtggagcttctttgaagcctgagttcatcgacatcatcaacgcggccaccgtgaagtccgcttaagatgttacgctgaagacgaacatactttttttgctcaactgtgctatgtaagctagtagcttttgcgcaggagcagagactgttttgcctgcccccaacttttagcttgagcttgctaataatgtttacctctggacgtatcaataatggtgcttatgtaccccctttttttgtgccgaattacggtggatccgtcatctgaaccatgggtttggtgtatgtaattgcgtcacccgatgcctagggtgcgagactgaagtttttggacatttgggacaaggtagccttgtgccccac

SEQ ID NO: 67063 - protein, 253 aa, Zea mays
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMDVVAAQTKAIAEKIKDWSNVVVAYEPVWAIGTGKVATPAQAQEVHASLRDWLKTNASPEVAESTRIIYGGSVTAANCKELAAQPDVDGFLVGGASLKPEFIDIINAATVKSA

SEQ ID NO: 67064 - DNA, 810 bp, Moraxella sp
  CDS (1)..(810): transl_table=11
atgcaagcttgggtaattggaaattggaagcagaatccagcaacgagccatgatgtaaacgcactactggacgacttatgcgctgctattagtacaaccaagcaaatgagccacgataactccgcgcgttgtcaaataatggtagcaccaagcttgatacatttagcagcagtgaatggtcgcctaaaagacacctcaatactgtgtgcagctcaagacgttagtgggcatagtgccagtgttggtgcctatacaggtgaatgttcagcgcagcagatagtcgatgctggagcgacttggacaatccttggtcactcagagcgccgtcagtatcatcaagaatctaacgatgctttattgcaaaaaatgattcatgcgttgtcacaagatttaggcgtggtattttgcattggtgaaagccaagagcaatatgatactaagcaaactcttacagtcattgataatcagttagtagttatcaaagaattcattacacagcagccagaacttattgatgcattaccgactcgtctcattattgcttatgagccagtatgggcaataggtacaggtaaagtgccaacggtagcagaagtcagcgccactcataagcatatcaagcaaacattggcaggatttgccgactcattgtctaatatgacggttttgtatggcggtagtgtcaatgctgataatgctaatagctttgctgctgatcctatgattgatggcgctttagttggcggtgcttcattgaaagctgacagctttctgacgattgccaccgcttttagccaagccagtatctag

SEQ ID NO: 67065 - protein, 269 aa, Moraxella sp
MQAWVIGNWKQNPATSHDVNALLDDLCAAISTTKQMSHDNSARCQIMVAPSLIHLAAVNGRLKDTSILCAAQDVSGHSASVGAYTGECSAQQIVDAGATWTILGHSERRQYHQESNDALLQKMIHALSQDLGVVFCIGESQEQYDTKQTLTVIDNQLVVIKEFITQQPELIDALPTRLIIAYEPVWAIGTGKVPTVAEVSATHKHIKQTLAGFADSLSNMTVLYGGSVNADNANSFAADPMIDGALVGGASLKADSFLTIATAFSQASI

SEQ ID NO: 67066 - DNA, 735 bp, Mycoplasma genitalium
  CDS (1)..(735): transl_table=4
atgcgcacaaggtatttaattggcaattggaaaacaaataaaaatttaaaagacgcagttagttttgttgaacaatttcaacaaaataaacttaattacaatgccaaaattgggatagcacctgtttatgttcatctcactgaaataaaaaaaataattagtgatagtctccttttatttgcccaagacgctaactttattgaaagtggttcatatactggaactgtaagctttactcaacttcaagacattggtgttaacaacagtattattggtcattctgaaagaagaaaatactataacgaaaccagtgcagttattaatcaaaagctctttgcttgtctaaaagcatccatgcaagtagttttatgtattggtgaggctttaggacaagagattagctttcttaaaactgatcttactaattgcttagatacgattgacaaaagcttaattaaaaatttagttattgcttatgaacctttgtgagcaattgggacaggtaaaacagcaactcctgaagttgcaaatcaaaccattaaaaccattagggaatatattaatgacttatatgatgaaaatgttgctaacaatatctcaattctatatggcggatcagttgatcataataatatccaaaaactagcaataatggaacaaattgatggatttttagttggtaaagcatctttagaaattaaaaactttttagaaatggctagggtatatgcataa

SEQ ID NO: 67067 - protein, 244 aa, Mycoplasma genitalium
MRTRYLIGNWKTNKNLKDAVSFVEQFQQNKLNYNAKIGIAPVYVHLTEIKKIISDSLLLFAQDANFIESGSYTGTVSFTQLQDIGVNNSIIGHSERRKYYNETSAVINQKLFACLKASMQVVLCIGEALGQEISFLKTDLTNCLDTIDKSLIKNLVIAYEPLWAIGTGKTATPEVANQTIKTIREYINDLYDENVANNISILYGGSVDHNNIQKLAIMEQIDGFLVGKASLEIKNFLEMARVYA

SEQ ID NO: 67068 - DNA, 729 bp, Mycoplasma hyopneumoniae
  CDS (1)..(729): transl_table=4
atgaaaaaaattattattggaaattgaaaaatgaataaaaccgtaagtgaaacacgtgattttattcaaaaatttgacattttctatcaggaaaatgtgggcaaaatcaaagaagatttagattttgcaatagctccaagttttatatctttatcactaatttctaagtccttgactaaaaaattagaaattgctgctcaaaatcttagtcagtttgattcaggagcctttactggggaaatcagtggcaaaatgctgcaggatttagggacaaaatatgtaattattgggcattctgaaagaagagaaatttttaaagaaaaagatgaagaactaaaaaataaaattttacaagcacaaaaatatgatttaattcctgttttttgtgttggtgaaagtcttttagaatttgaagccggcctaactaaaaaagtgataatttcgcagataaatgctataaaatcagtgctaaattttcaaaaggcaattattgcatatgaaccaatttgggccattggaactggcaaaacagcaacggctgcaatagcagaaaaagtttgtggactgattaaggaaaattttgggaaaaatacaatggtaatttatggaggctctgttaattctaagaatattaacgagttagtatcccagaaaagcatcgatggcgcccttgtaggtggagcctctcttgatccagaagaatttggaaaaattttagttaatagttaa

SEQ ID NO: 67069 - protein, 242 aa, Mycoplasma hyopneumoniae
MKKIIIGNWKMNKTVSETRDFIQKFDIFYQENVGKIKEDLDFAIAPSFISLSLISKSLTKKLEIAAQNLSQFDSGAFTGEISGKMLQDLGTKYVIIGHSERREIFKEKDEELKNKILQAQKYDLIPVFCVGESLLEFEAGLTKKVIISQINAIKSVLNFQKAIIAYEPIWAIGTGKTATAAIAEKVCGLIKENFGKNTMVIYGGSVNSKNINELVSQKSIDGALVGGASLDPEEFGKILVNS

SEQ ID NO: 67070 - DNA, 786 bp, Mycobacterium leprae
  CDS (1)..(786): transl_table=11
gtgagccgcaagtcgctcatcgccggcaactggaagatgaacctgaatcatttcgaggcgattgcgttggtgcaaaaaatcgctttttcattgccggacaagtattatgacaaggttgatgtcacagttcttccgccattcactgacctgcgtagcgtgcaaaccctggtcgatggcgataagttgcgattgacctatggtgcccaggatctttcgcaacatgacctaggcgcctacactggagacatcagtggggccttcttggctaagttgggctgtagcttcgtgctggtggggcactctgagcggcgcacctaccacgacgaaggtgacgcgctggtggccgcgaagacggctgcggcgctcaaaaacagcttgactccgatcgtgtgcatcggcgagtacctcgagatccgagaggtgggtgaacacgtcagccactgccagaaccagctacgcggctcgctggctgggctgtcgcctgaacagatcggcaatgtcgtgatcgtttatgaaccggtctgggcgatcgggactgggcgggtggctagtgcagccgacgcccaagaggtgtgcgaggcgatccgaaaagagctgggtgcgctggcatcaccgcaggtggccgaaaccgttcgggtgctttatggtggctcgttgaacgccaaaaacattggcgatatcgtcgcccagcaagacgtcgatggtggtctggttgggggagcgtcgctggacggggcgcaattcgcgacgctcgcggtcatcgccgccggtgggcctcttccctag

SEQ ID NO: 67071 - protein, 261 aa, Mycobacterium leprae
MSRKSLIAGNWKMNLNHFEAIALVQKIAFSLPDKYYDKVDVTVLPPFTDLRSVQTLVDGDKLRLTYGAQDLSQHDLGAYTGDISGAFLAKLGCSFVLVGHSERRTYHDEGDALVAAKTAAALKNSLTPIVCIGEYLEIREVGEHVSHCQNQLRGSLAGLSPEQIGNVVIVYEPVWAIGTGRVASAADAQEVCEAIRKELGALASPQVAETVRVLYGGSLNAKNIGDIVAQQDVDGGLVGGASLDGAQFATLAVIAAGGPLP

SEQ ID NO: 67072 - DNA, 753 bp, Mycoplasma penetrans
  CDS (31)..(234)
atgaaaaagctaatcatagcaaattgaaaaatgtttaaaacattaaatgatataaaaacattcaaagaagaatttgataaaaatataaaaaatgtaaaagttaatgctgattatagtgttggtgttccaagcatttacttaaaccaagcaaaagaaattttaaaaggaattaaagtaattgctcaagatgcacactttaaaaatgaaggagcatacactggaaacatttcttgatctcaattaaaagattgtggaattgatggttcaattattggacactctgaaagaagacaaatgtttaatgaaactgatgaaactgtaaatttaaaaactatttcattagtagaaaataatatgcaagctgtagtttgtgttggtgaaactttagaagaatatgaagctaacaaatcttttgatgttgtatgaaaccaaactaaaaaagctttagcaaatgtaagtgaagcacaattaaaaaatgttgtaattgcgtatgaaccagtttgagcaatcggaactggaaaagtaccaactggaaaagaagtagatgatttaattcaaaaggtaagagatgaattaagcaaactatatagcaaacaagctgttgaatcattagtggttctatatggtggttcagtaaatgataaaaatgcagaagagttttttaaacaaaaaaacattaatggtgcattagtaggaagcttttgtttaaaagcagaaaactttgttaaattaattgaattaggtggaaactaa

SEQ ID NO: 67073 - protein, 67 aa, Mycoplasma penetrans
MFKTLNDIKTFKEEFDKNIKNVKVNADYSVGVPSIYLNQAKEILKGIKVIAQDAHFKNEGAYTGNIS

SEQ ID NO: 67074 - DNA, 747 bp, Mycoplasma pulmonis
  CDS (1)..(747): transl_table=4
atgaaaaaacttttaattataggtaattgaaaaatgaacaaaacttatgatgaggcacgtgattttatcaatgctttttctaatgcatatgcacttaatggagcaaaaatttctgaaaatattgaatatggaattgccccgtcttttacaaatatgtcactttttaacaaagaattacttgaaaaaactaacattaatttagtagctcaaaacataaatgaaaatcgaagtggagcttttactggtgaaattagtgcacaaatgcttaaatcaattaatgccaaatatgttattgtaggtcatagcgaaagaagacaaaactatcgagaaactaacaaaattgttaatcaaaaagccaaagctgccattgaaaatggacttattccaattatttgtgttggagagagcttagaagaatatgaagctggaaaaaccaaagctgttattaaaaaacaaattaaacaatctcttgaagctcttgatctttctaaaattgttgttgcatatgagccaatttgagcaataggaactggaaaagtagcaacagctgaagtagctcaacaaatttgtaagtttattagatcaattacctcaaaagatttaataattcaatatggaggaagtgttagtccatcaaatattgaaaatctaatgaaacaagaagatatagacggagctttagtaggaggagcttcattagaggttgatagtttttttgaactaataacctttaatgctttaaagtaa

SEQ ID NO: 67075 - protein, 248 aa, Mycoplasma pulmonis
MKKLLIIGNWKMNKTYDEARDFINAFSNAYALNGAKISENIEYGIAPSFTNMSLFNKELLEKTNINLVAQNINENRSGAFTGEISAQMLKSINAKYVIVGHSERRQNYRETNKIVNQKAKAAIENGLIPIICVGESLEEYEAGKTKAVIKKQIKQSLEALDLSKIVVAYEPIWAIGTGKVATAEVAQQICKFIRSITSKDLIIQYGGSVSPSNIENLMKQEDIDGALVGGASLEVDSFFELITFNALK

SEQ ID NO: 67076 - DNA, 756 bp, Neisseria meningitidis
  CDS (1)..(756): transl_table=11
atgtgggatcaaaaatgggtcatcggcaactggaaaatgaacggccggctccagaacaacaattcgctcatgcaccgcttccgcatcctccccaccgccgaacgcgtcctcatcggactcgccgccccgaccgtttacctgctgcaactgcacaacgccatgcaaatcgtcttaaacaaccgcatcctcacctgcgcccaagacgtgagccgcttccccgacaacggcgcgtacaccggcgaagtgtccgccgaaatgctcgccgacaccggcacagacatcgtcctcatcggacactccgaacgcagcctttatttcggcgaaaaaaacgaaatccaacgccgcaaaatggaaaacgtcctcaacgtcggactcatcccgttattgtgcgtcggcgaaagcctcgaagagcgcgaagccggcaaagaacacgaagtcatcgcccatcagctttccatcctgcaaggactggacaccaaaaacatcgccgtcgcctacgaacccgtctgggcgatcggcaccggcaaagtcgccaccgtcgaacagattgccgatatgcacgcattcatctacaaagaaatcttgtctttgtgcggaagcgatgttaaaatccgcgtcctttacggcggaagtgtgaaagcggacaacgcggccgacatcttcgcagtaccttatgtggacggcgcactcgtcggcggcgcgtcattgtcgtacgactcctttaccgccatcatcagtgccgcacaaaatgcgtag

SEQ ID NO: 67077 - protein, 251 aa, Neisseria meningitidis
MWDQKWVIGNWKMNGRLQNNNSLMHRFRILPTAERVLIGLAAPTVYLLQLHNAMQIVLNNRILTCAQDVSRFPDNGAYTGEVSAEMLADTGTDIVLIGHSERSLYFGEKNEIQRRKMENVLNVGLIPLLCVGESLEEREAGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 67078 - DNA, 747 bp, Neurospora crassa
  CDS (1)..(747)
atggctcgcaagttcttcgtcggcggcaacttcaagatgaacgggacccgtaaggatctcaaggccatcgttgacaaccttaacaacgcccaattggaccctaacgccgaggtcgtgatcgcccctcccgctctctaccttgacttcgtcaagcagaacctccagaagcccaacgttgaggttgccgctcagaacgtcttcaacaagcccaacggcgccttcaccggcgagatcagcgccacgcagctcctggatctcggcgtcaagtgggtcattctcggccactctgagcgccgcaacgagctcggcgagtcggacgagttcattgcctccaagaccaagtacgccctcgacaacggcatctcggtcatctggtgctgcggcgagtccaaggacacgcgccaggccggcgagaccatcaagttcgtcgagaaccagctcgccgctctcgccaaggagatcaacgactggaagaacgtcgttatcgcgtacgagcccatctgggccattggcaccggcctcgtcgccaccaaggagcaggcccaggaggtgcacgccgccatccgcagctggctcaagcagaacgtcagcgacaaggttgctgaggagacccgcatcctctacggtggctctgtcaacgccaagaactgcaaggaccttgccaaggagcaggacattgacggtttccttgttggcggtgccagcttgaagcccgagttcgtggacatcatcaacgccaacctgtaa

SEQ ID NO: 67079 - protein, 248 aa, Neurospora crassa
MARKFFVGGNFKMNGTRKDLKAIVDNLNNAQLDPNAEVVIAPPALYLDFVKQNLQKPNVEVAAQNVFNKPNGAFTGEISATQLLDLGVKWVILGHSERRNELGESDEFIASKTKYALDNGISVIWCCGESKDTRQAGETIKFVENQLAALAKEINDWKNVVIAYEPIWAIGTGLVATKEQAQEVHAAIRSWLKQNVSDKVAEETRILYGGSVNAKNCKDLAKEQDIDGFLVGGASLKPEFVDIINANL

SEQ ID NO: 67080 - DNA, 759 bp, Nitrosomonas europaea
  CDS (1)..(759): transl_table=11
atggggcgtgcagggtttgtggccgggaactggaaaatgcatggcagcctggttcggaatcaggagttgcttgatgcggttgtttcaggtactcgctcgttgcagaatgtatcctgtgtggtgtgtgtgccttacccctatatagcacagacacagtcagtgcttgagggctctcatgtgctatggggggggcagaatgtcagtcagtaccaccacggagcttataccggggaagtatcggcagatatgctggccgatttagggtgtcggtacgtgattgtgggtcattcagaacgacgaacactgttcggcgaagggaatcaggtcgtcgctgaaaaatttcgtgctgcacaagagcgttcgataacaccaatactttgtgtaggtgagaccctggctcagcgtgaatcggatgagactgaacaggtaatcgctatgcaactcgatgccgtgattgatctggcgggtatcgaagcgctcggacaatcagtcatagcttatgagccggtgtgggcaatcggtactggcaaaactgctactccccaacaggcgcaggatgtccataaatttataagaagtcggatagctgttcatagtggcgggattgctgagaatatccagatactttatggtggaagtgtaaaagcagataatgcacgtgaattgttcacaatgcctgatatagatggtgggctgatcggaggggcttcgctggttgctgcggagtttatttcgatttgtctggcagcacagaattaa

SEQ ID NO: 67081 - protein, 252 aa, Nitrosomonas europaea
MGRAGFVAGNWKMHGSLVRNQELLDAVVSGTRSLQNVSCVVCVPYPYIAQTQSVLEGSHVLWGGQNVSQYHHGAYTGEVSADMLADLGCRYVIVGHSERRTLFGEGNQVVAEKFRAAQERSITPILCVGETLAQRESDETEQVIAMQLDAVIDLAGIEALGQSVIAYEPVWAIGTGKTATPQQAQDVHKFIRSRIAVHSGGIAENIQILYGGSVKADNARELFTMPDIDGGLIGGASLVAAEFISICLAAQN

SEQ ID NO: 67082 - DNA, 759 bp, Oceanobacillus iheyensis
  CDS (1)..(759)
atgcgtaaaaaagtgatagctggtaactggaaaatgaataaagtactatctgaagcaggagaatttatgaattctgtagtaccaaaagctccgaaaggaaatgacgtagaagcaattgtgtgtgctccattccctttcctgtcaaaattagttgagcaagcgaagggatcagaagtaaaagtagcagcgcaaaacatgcattttgaagattctggtgcttttactggagaggttagccctgtgatgttgaaagatctaggtgtaacacatgttgtacttggacactcagaaagaagagagctatttgctgaaacgaacgaattagtaaataagaaaacgaaagcagcatttgctcatgatttaactccgattgtttgtgtaggagaaacactggatcaacgtgaagcaaacgaaacgatgaacattgttggcgaacaagtaaagcaagcagttgctggtcttaccaatgaacaagttgctgaaactattattgcctatgaaccagtatgggcaatcggtacaggaaaaacagctacaagtgaacaagcaaatgaagtttgcactgaaattcgcaaagtggtagctgaagttacgtcagcagatgtggctgaaaaagtaattattcaatatggcggtagtgtaaaacctgccaatgtggatgagttattagctcaatctgatattgacggagcattagttggtggggcaagtctcgatcctgaatcattcctacaactagtggaggcaggtacaaaatga

SEQ ID NO: 67083 - protein, 252 aa, Oceanobacillus iheyensis
MRKKVIAGNWKMNKVLSEAGEFMNSVVPKAPKGNDVEAIVCAPFPFLSKLVEQAKGSEVKVAAQNMHFEDSGAFTGEVSPVMLKDLGVTHVVLGHSERRELFAETNELVNKKTKAAFAHDLTPIVCVGETLDQREANETMNIVGEQVKQAVAGLTNEQVAETIIAYEPVWAIGTGKTATSEQANEVCTEIRKVVAEVTSADVAEKVIIQYGGSVKPANVDELLAQSDIDGALVGGASLDPESFLQLVEAGTK

SEQ ID NO: 67084 - DNA, 762 bp, Oryza sativa
  CDS (1)..(762)
atgggccgcaagttcttcgttggtggcaactggaaatgcaacgggaccactgatcaggtggacaaaattgtgaaaattctgaatgagggacagattgcttctacagatgttgttgaggtggttgtcagcccaccttatgtgttccttcccgtggtcaagagtcagctgcgcccggagatccaagttgctgctcagaattgttgggtgaagaagggcggggctttcaccggtgaggtcagcgctgagatgcttgtcaaccttagtattccctgggttattcttggacactctgaaaggaggagtttgttgggtgaatcaaatgagtttgttggagacaaagtggcatatgcgctctctcagggcttgaaggtcattgcatgtgttggtgagactctcgagcagcgggaatctggatcgaccatggatgttgttgctgcacaaacaaaagcaatttctgaaaggatcaaggattggactaatgtggttgttgcctatgaacctgtgtgggccattggaactggtaaagttgctacaccagatcaagcacaagaagtgcatgatggcctgaggaagtggctcgctgctaatgtcagtgcagaggttgctgaatcaacaaggatcatctatggaggttccgtaactggtgcgaactgcaaggagctggcagcaaagcctgatgttgatggttttctcgtcggtggtgcttcattgaagcctgaattcatcgacatcatcaactccgccaccgtgaagtccgcctaa

SEQ ID NO: 67085 - protein, 253 aa, Oryza sativa
MGRKFFVGGNWKCNGTTDQVDKIVKILNEGQIASTDVVEVVVSPPYVFLPVVKSQLRPEIQVAAQNCWVKKGGAFTGEVSAEMLVNLSIPWVILGHSERRSLLGESNEFVGDKVAYALSQGLKVIACVGETLEQRESGSTMDVVAAQTKAISERIKDWTNVVVAYEPVWAIGTGKVATPDQAQEVHDGLRKWLAANVSAEVAESTRIIYGGSVTGANCKELAAKPDVDGFLVGGASLKPEFIDIINSATVKSA

SEQ ID NO: 67086 - DNA, 750 bp, Paracoccidioides brasiliensis
  CDS (1)..(750)
atgcctcgtaaattctttgttggcggcaacttcaagatgaatggcaccgctaaatctatcacccatatcatcaccaacctcaactctgccaagcttgatccttccactgaaattgtcatcgccccgcctgcaatctacctggtgcttgcacgacaacttgcgaacggccaagtcgccgtttctgcacagaatgtgtttgataagcctaatggagcctttactggggagttgagcgtggaacagctcagagatgaaaaaatcacttggacgttggctggacatagcgaacgaagagttttactcagagaagatgatgagtttgtagcacggaaaacaaaggctgccattaacggtggtctcaatgtaattctttgcattggcgagtctcttgaggaacgcgaagctggaaagactatcgatgttgtaacaaggcaattggacgccgttgccgaggaagtctctcctgcagaatggaataaggtcgtcatcgcctatgagcccatctgggccatcggaacgggcaaggtcgccacaacagagcaagcacaagaagtgcatgcctccatccggaaatggctgaatgagaaaatctcccctgaagcggccgaaaacacccgcgttatttacggcggaagcgttacggagagcaactgtcgggatctcgccgcgcagcctgatgttgacgggtttttggtgggcggagctagtttaaaacctgcttttgtcgatatcatcaacgcccgtttatag

SEQ ID NO: 67087 - protein, 249 aa, Paracoccidioides brasiliensis
MPRKFFVGGNFKMNGTAKSITHIITNLNSAKLDPSTEIVIAPPAIYLVLARQLANGQVAVSAQNVFDKPNGAFTGELSVEQLRDEKITWTLAGHSERRVLLREDDEFVARKTKAAINGGLNVILCIGESLEEREAGKTIDVVTRQLDAVAEEVSPAEWNKVVIAYEPIWAIGTGKVATTEQAQEVHASIRKWLNEKISPEAAENTRVIYGGSVTESNCRDLAAQPDVDGFLVGGASLKPAFVDIINARL

SEQ ID NO: 67088 - DNA, 786 bp, Pasteurella multocida
  CDS (1)..(786): transl_table=11
atggctcgtcgtcctttagttatgggtaactggaaattaaacggtagcaaagcattcaccaaagcattaatcgaagacttaaaaacagaattagcgggtgttgaaggctgcgatgtggcaattgccccaccggtgatgtatttagcagaagcagaagctgccttaaaatgcagttgtagttgtggcggaaaagccattgcccttggtgcacaaaacgtcgatgtgaatgtacaaggtgcctttactggcgatatttcaacagaaatgctgaaagattttggtgcaaaatatatcattatcggtcactctgagcgtcgtacttatcataaagaaagcgatgaattcatcgcgaaaaaattcgcagcattaaaacaagcaggcttagtgccggtattgtgtatcggtgaaagtgaagccgaaaatgaagcgggcaaaacagaagaagtatgcgcacgccaaattgatgccgtattaaatacattaggcgctgaagcctttaatggtgccgttatcgcttatgagccaatttgggcaatcggtaccggtaaatcagcaacccctgctcaagcacaagcagttcatgcctttatccgcggtcatattgcgaaaaaagacaacgcggtagcagaacaagtgatcatccaatacggtggttcagttaatgatgcgaatgcggctgaattatttactcaacccgatatcgatggtgcattagttggtggtgcctcattaaaagctcctgcctttgcggtgatcgtcaaagccgcagcaaaagcaaaaaactaa

SEQ ID NO: 67089 - protein, 261 aa, Pasteurella multocida
MARRPLVMGNWKLNGSKAFTKALIEDLKTELAGVEGCDVAIAPPVMYLAEAEAALKCSCSCGGKAIALGAQNVDVNVQGAFTGDISTEMLKDFGAKYIIIGHSERRTYHKESDEFIAKKFAALKQAGLVPVLCIGESEAENEAGKTEEVCARQIDAVLNTLGAEAFNGAVIAYEPIWAIGTGKSATPAQAQAVHAFIRGHIAKKDNAVAEQVIIQYGGSVNDANAAELFTQPDIDGALVGGASLKAPAFAVIVKAAAKAKN

SEQ ID NO: 67090 - DNA, 765 bp, Petunia hybrida
  CDS (1)..(765)
atgggcagaaaattcttcgtcggcggcaactggaaatgcaacggaactgctgaagaggtcaagaagatattggcaacactcaatgctgctgacgtgccatcacaagatgttgttgaggttgttgtgagccctccatatgtattccttcctctggtcaagaatgagctgcgacctgattttcatgttgctgcccagaattgttgggttaagaaagggggtgctttcaccggtgaagttagtgctgagatgcttgttaatctaagcattccttgggtcattttgggtcactctgaaaggagagctcttttaggtgaatcaaatgagtttgttggtgacaaggtagcatatgctctttctcaaggtttgaaggtaattgcatgtgttggagagactcttgaggaaagagaatcaggatctaccatggatgttgttgcagcgcagacaaaggctattgcagatcgagtaaaggattggacaaatgtggttgtagcttatgagcctgtttgggctattggaactggaaaggttgcatcgcctgcacaagcccaggaagtacatgctgaattgaggaaatggctggcagcaaatgtcagccctgaagtggctgcttcaaccaggatcatctatggaggttctgtaaatggtgctaactgcaaggagttgggtggacagccagatgttgatggttttcttgtaggtggagcttctttgaagccggaattcattgacatcatcaaagctgctgaggtgaagagaaatgcctaa

SEQ ID NO: 67091 - protein, 254 aa, Petunia hybrida
MGRKFFVGGNWKCNGTAEEVKKILATLNAADVPSQDVVEVVVSPPYVFLPLVKNELRPDFHVAAQNCWVKKGGAFTGEVSAEMLVNLSIPWVILGHSERRALLGESNEFVGDKVAYALSQGLKVIACVGETLEERESGSTMDVVAAQTKAIADRVKDWTNVVVAYEPVWAIGTGKVASPAQAQEVHAELRKWLAANVSPEVAASTRIIYGGSVNGANCKELGGQPDVDGFLVGGASLKPEFIDIIKAAEVKRNA

SEQ ID NO: 67092 - DNA, 768 bp, Photorhabdus luminescens
  CDS (1)..(768): transl_table=11
atgcgacatccattagttatgggtaactggaaattgaatggcagcacccatatggttaacgaactcatcactggcctgcgtcaagaattaagcagtgttaccggctgtgacgtcgctatcgcgccaccagcgctttatctctctcaggctaaacaagcactggctggcagccgcattgctctaggtgcacaggacgttgacgttaacctgtctggtgcatttaccggtgaaacttccgccacaatgttgaaagacattggcgcagaatacattattatcggccactctgaacgccgtacttaccaccaagaaagtgacgaattcattgcgaaaaaatttgccattcttaaacaacaaggtctaatccctgttttgtgcatcggcgaaactgaacaggaaaatgaagccggccaaactgaaagtgtatgtgcaaggcaaattgatgcagttctgaacacattgggagtagcagccttccaaggtgcggtcatcgcttacgaacctgtttgggcaattggtacaggcaaatcagcaacaccggcacaagctcaagctgtgcataaattcatccgtgatcatattgcgcagaaagatgcagcaatcgcacaacaaatcattatccagtacggtggctctgtgaacgcagataatgccgctgagctattctctcagccagacattgacggtgcattagtcggcggtgcatctctaaaagctaacgctttcgctgttatcgtaaaagccgcagccgctgcgaaaaaagcctaa

SEQ ID NO: 67093 - protein, 255 aa, Photorhabdus luminescens
MRHPLVMGNWKLNGSTHMVNELITGLRQELSSVTGCDVAIAPPALYLSQAKQALAGSRIALGAQDVDVNLSGAFTGETSATMLKDIGAEYIIIGHSERRTYHQESDEFIAKKFAILKQQGLIPVLCIGETEQENEAGQTESVCARQIDAVLNTLGVAAFQGAVIAYEPVWAIGTGKSATPAQAQAVHKFIRDHIAQKDAAIAQQIIIQYGGSVNADNAAELFSQPDIDGALVGGASLKANAFAVIVKAAAAAKKA

SEQ ID NO: 67094 - DNA, 747 bp, Plasmodium falciparum
  CDS (1)..(747)
atggctagaaaatattttgtcgcagcaaactggaaatgtaatggaactttagaaagtattaaatctttaacaaacagttttaacaatttggattttgatccaagcaaattagacgttgttgtttttcctgtttccgtacattatgatcatacaaggaaattacttcagagtaagttttctactggtattcagaatgtatcaaaattcggaaatggatcatacacaggtgaagtaagtgcagaaattgccaaggatttaaatattgaatatgttattattggtcattttgaaagaagaaaatatttccatgaaaccgatgaagatgttcgtgaaaaattacaagcttcattaaaaaataatttaaaagccgttgtatgttttggtgaatctttagaacaaagagaacaaaataaaactatcgaagttattacaaaacaagttaaagcatttgttgatttaattgataattttgataatgttattttggcttatgaacctttatgggctattggtactggtaaaacagctacacctgaacaagctcaattagtacacaaagaaatcagaaaaattgtaaaagatacatgcggagaaaaacaagctaaccaaataagaatattatatggaggtagtgttaatactgaaaactgctcttcattaattcaacaagaagatattgatggtttcttagttggaaatgcttccttaaaagaatcttttgttgatataataaaaagtgctatgtaa

SEQ ID NO: 67095 - protein, 248 aa, Plasmodium falciparum
MARKYFVAANWKCNGTLESIKSLTNSFNNLDFDPSKLDVVVFPVSVHYDHTRKLLQSKFSTGIQNVSKFGNGSYTGEVSAEIAKDLNIEYVIIGHFERRKYFHETDEDVREKLQASLKNNLKAVVCFGESLEQREQNKTIEVITKQVKAFVDLIDNFDNVILAYEPLWAIGTGKTATPEQAQLVHKEIRKIVKDTCGEKQANQIRILYGGSVNTENCSSLIQQEDIDGFLVGNASLKESFVDIIKSAM

SEQ ID NO: 67096 - DNA, 756 bp, Porphyromonas gingivalis
  CDS (1)..(756): transl_table=11
atgagaaaaaacatcgtagcaggcaactggaaaatgaacaaaaccctccaagaggggcttgcattggcaaaggagttggacgcagctttgaaagggcgtacgatcaactgtgacgtgattatcggaaccccattcatccatttggcaagtattgcggcagccatcgataccacacgtatcggagttgcagctgaaaactgtgccgataaggagtcgggtgcatataccggagaggtctctgctgctatggtagccagtaccggtgctcggtatgtgattataggacatagcgaacgccgtgcttactatcatgaaacatccccaatcctgatggagaaggtgaagttggctttgtccaatggcttgacccccattttctgtgttggcgaagtcttggaagagcgcgaagcaggcaagcacttcgaggtagtcgctcgtcaggtggaagaagccctgtttactttggatcagaccgactttgccaaattgatccttgcttacgagcctgtgtgggccatcggtacgggtaagacggctacggcagaccaagctcaagagatgcatgcacatattcgtaagagtatagccgctaaatatggaaaagaggttgcgaacggttgttccattctctatggaggcagttgcaatgcagccaatgccaaagaactctttagccgtgcggatgtagatggtgggcttatcggaggggcttctctctcggtagacaaattcttgcctatcatcgaagcattctga

SEQ ID NO: 67097 - protein, 251 aa, Porphyromonas gingivalis
MRKNIVAGNWKMNKTLQEGLALAKELDAALKGRTINCDVIIGTPFIHLASIAAAIDTTRIGVAAENCADKESGAYTGEVSAAMVASTGARYVIIGHSERRAYYHETSPILMEKVKLALSNGLTPIFCVGEVLEEREAGKHFEVVARQVEEALFTLDQTDFAKLILAYEPVWAIGTGKTATADQAQEMHAHIRKSIAAKYGKEVANGCSILYGGSCNAANAKELFSRADVDGGLIGGASLSVDKFLPIIEAF

SEQ ID NO: 67098 - DNA, 732 bp, Prochlorococcus marinus
  CDS (1)..(732): transl_table=11
gtgcgtaaacccgtgatcgctggcaactggaagatgcatatgacctgtgctcaggcacgggagtacacggccatgttcctgccattaatcgaagccactcccaatgaccgtcatgtagtgattgccccaccattcaccgctatctcctcaatggcagagtccgttggcggcactcgtctggaattgtcaagccagaatgtgcattgggaggatgatggtgcttataccgcagaggtttcgccaacgatgcttctggagcatcaagtgcgatacgcgattgttgggcatagtgaaccacgcaaatacttcagtgagagcgatgaacagatcaaccgtcgtgctcgttcagcccaagcgcatggtctgatcccgattgtctgcgtgggtgaaagtgatgagcagcgtgaacgaggagaggctgagcgtgtgattcgacgacaggtggaacagggactcgaagacaccgatccagacaagcttgtggttgcttatgagcccatctgggccattggcacgggcaagacgtgcgaagcatcggaggcgaatcgtatctgtggcctcattcgtcgttgggtcggtgcttcagaactaatcattcagtacggcggttcggtcaaaccaggaaatattgatgagttgatggcaatgagtgatatcgacggagtgttggtgggtggtgcctcccttgacccagagagttttgcgcgcattgccaattatcaaaccagttaa

SEQ ID NO: 67099 - protein, 243 aa, Prochlorococcus marinus
MRKPVIAGNWKMHMTCAQAREYTAMFLPLIEATPNDRHVVIAPPFTAISSMAESVGGTRLELSSQNVHWEDDGAYTAEVSPTMLLEHQVRYAIVGHSEPRKYFSESDEQINRRARSAQAHGLIPIVCVGESDEQRERGEAERVIRRQVEQGLEDTDPDKLVVAYEPIWAIGTGKTCEASEANRICGLIRRWVGASELIIQYGGSVKPGNIDELMAMSDIDGVLVGGASLDPESFARIANYQTS

SEQ ID NO: 67100 - DNA, 756 bp, Pseudomonas aeruginosa
  CDS (1)..(756): transl_table=11
atgcgtcgacccttggtggccggtaactggaaaatgcacggtacgcattccagtgtggccgagttgatcaaaggcttgcgtcagctggcgttgccgagcggagtcgatgtggctgtgatgccgccttgcttgttcatcagccaggtcatccagggcctggccggcaaggcgatcgatgtaggtgcgcagaacagcgccgtcgagccgatgcaaggcgcgctgaccggtgagactgctcccagtcagttggcggatgtcggttgtagcatggtccttgtgggccactcggagcgtcgcctgattctcggcgagagtgacgaggttgtgagtcgcaagtttgccgcggctcagtcgtgcggcctggtgccggtgctgtgtgtcggggagacccgggcggagcgcgaggcgggcaagacgctggaggttgtcgcaaggcagctgggaagcgtgatcgacgagttgggtgttggagcttttgctcgcgcagtcgtggcttacgagccggtctgggcgatcgggaccgggttgaccgcgtcccccgcgcaagcccaggaagtgcacgcggcgatccgcgcgcaactggcagcggaaaatgccgaggtcgcaaaaggtgtgcgactcctttacggcggcagtgtaaaggcggcaagtgcagccgagttgttcggcatgccggatatcgatggggggctggtaggtggagcctccctcaatgcggatgagttcggcgcgatctgtcgtgccgcgggaagctga

SEQ ID NO: 67101 - protein, 251 aa, Pseudomonas aeruginosa
MRRPLVAGNWKMHGTHSSVAELIKGLRQLALPSGVDVAVMPPCLFISQVIQGLAGKAIDVGAQNSAVEPMQGALTGETAPSQLADVGCSMVLVGHSERRLILGESDEVVSRKFAAAQSCGLVPVLCVGETRAEREAGKTLEVVARQLGSVIDELGVGAFARAVVAYEPVWAIGTGLTASPAQAQEVHAAIRAQLAAENAEVAKGVRLLYGGSVKAASAAELFGMPDIDGGLVGGASLNADEFGAICRAAGS

SEQ ID NO: 67102 - DNA, 756 bp, Pseudomonas putida
  CDS (1)..(756): transl_table=11
atgcgtcgccctatggtagctggtaactggaaaatgcacggtacccgcgctagcgtcgctgagctgaccaaaggcttgagtaatctcgccttgccgagcggagtggaagtcgccgtatttccaccggccttgttcatcaatcaggtgattgatggcctggcaggtaaagaaattactgtcggcgcacagaattctgctgtacaacccgaacagggtgcgctgaccggggaagttgctcccgagcagctggttgaagcaggttgcaagttggtgttgattggccattcggagcgtcgccagattattggtgaaaccgacgaagtgctcaatcgcaagtttgcagcggcccaggccaaaggcttgaagccagtgctttgcataggggaaacccttgaggagcgcgaggctggcaagacgctcgaagttgtcgggcgtcaactaagcagtatcatcgaagcattcggtgttaaggcttttgccgatgcagtaattgcctatgagcctgtatgggccatcggtacgggccttacggccacgccacagcaggcccaggatgtgcacgccgccatccgcggccagttggcggcagaagatgctgaagtggctgcgaaggtgcagttgctatacggcggcagcgtgaaggcggccaatgcggccgaactgttcggcatgccggatatcgatgggggtctcattggtggggcttccctgaacgcagacgaattcggtgcaatttgtcgcgccgcaggaaactga

SEQ ID NO: 67103 - protein, 251 aa, Pseudomonas putida
MRRPMVAGNWKMHGTRASVAELTKGLSNLALPSGVEVAVFPPALFINQVIDGLAGKEITVGAQNSAVQPEQGALTGEVAPEQLVEAGCKLVLIGHSERRQIIGETDEVLNRKFAAAQAKGLKPVLCIGETLEEREAGKTLEVVGRQLSSIIEAFGVKAFADAVIAYEPVWAIGTGLTATPQQAQDVHAAIRGQLAAEDAEVAAKVQLLYGGSVKAANAAELFGMPDIDGGLIGGASLNADEFGAICRAAGN

SEQ ID NO: 67104 - DNA, 756 bp, Pseudomonas syringae
  CDS (1)..(756): transl_table=11
atgcgtcgcccaatggtagctggtaactggaaaatgcacggtacccgcgccagcgtcgctgagctgatcgagggtttggtcaagcaggcgttgcctggcagcgtcgatatcgccgtaatgcctgcaagcctgtttaccagtcgagtgatcgagggccttcagggtacgtcgatcattgtcggtgcgcaggatgcagccattcaggctgagcagggcgcactgaccggcgaaatcgcatcgagccaattggctgatgccggttgcaagctggtactcgtcgggcactcggagcgtcgtcagctgattggcgagcaggatgaggtgctcaacaagaagttcgcagcgatacaggcaagcggtcttacccctgtgctttgcataggcgagacgcttgaagagcgcaaggcagggcaaacgcttgaagttgtcgggcgtcagcttgacagcgtcattgcagagtttggtattggtgcgctggtcaatgcagtaattgcctacgagccagtctgggccatcggcaccggattgaccgcttcgcctcaagaggcgcaggaggtgcacgcagcaattcgtgcgcaactggcaaaagagaatgccgaagtcgcacaaggcgtgcgacttctctatggcggcagcgtgaaggcggccaatgcggtcgagcttttcagcatgccggatatcgatggggggctcattggtggagcgtccctgaatgcagatgagttcggtgcgatctgtcgcgccgcgggaaactga

SEQ ID NO: 67105 - protein, 251 aa, Pseudomonas syringae
MRRPMVAGNWKMHGTRASVAELIEGLVKQALPGSVDIAVMPASLFTSRVIEGLQGTSIIVGAQDAAIQAEQGALTGEIASSQLADAGCKLVLVGHSERRQLIGEQDEVLNKKFAAIQASGLTPVLCIGETLEERKAGQTLEVVGRQLDSVIAEFGIGALVNAVIAYEPVWAIGTGLTASPQEAQEVHAAIRAQLAKENAEVAQGVRLLYGGSVKAANAVELFSMPDIDGGLIGGASLNADEFGAICRAAGN

SEQ ID NO: 67106 - DNA, 756 bp, Pseudomonas syringae
  CDS (1)..(756): transl_table=11
atgcgtcgcccaatggtagctggtaactggaaaatgcacggtacccgcgccagcgtcgctgagctgatcgagggtttgtgcaagcagtcgttgccaggcagcgtcgatatcgccgtgatgcctgccagtctgtttacctgtcaggtggtcgatgggctcaaggccacgtcgatcatcgtcggtgcgcaggacgcagccattcaggctgagcagggcgcgctgacgggtgaagttgcatctagccagctggctgatgcaggttgcaagctggtacttgtcgggcactccgagcgtcgtcagttgattggcgaacaggatgatgttctgaacaaaaagtttgcggcaatccaggcgaaaggtctgacacctgtgctttgcgtaggtgaaaccctggaagagcgcaaggcggggcaaacgcttgaagtggtagggcgtcagctggacagtgttatcgccgagtttggcgtcaatgcactggtcaacgccgtcattgcctacgagccggtctgggccattggcaccggattgactgcttcgcctcaggaagcgcaggaagtgcacgcagccatccgtgcgcaactggcaaaagagaatgccgaagtcgcacaaggcgtgcgacttctctatggcggcagcgtgaaggcggccaatgcggtcgagctcttcagcatgccggatatcgatggggggctcattggtggagcttccctgaatgcagatgagttcggtgcgatctgtcgcgccgcgggaaactga

SEQ ID NO: 67107 - protein, 251 aa, Pseudomonas syringae
MRRPMVAGNWKMHGTRASVAELIEGLCKQSLPGSVDIAVMPASLFTCQVVDGLKATSIIVGAQDAAIQAEQGALTGEVASSQLADAGCKLVLVGHSERRQLIGEQDDVLNKKFAAIQAKGLTPVLCVGETLEERKAGQTLEVVGRQLDSVIAEFGVNALVNAVIAYEPVWAIGTGLTASPQEAQEVHAAIRAQLAKENAEVAQGVRLLYGGSVKAANAVELFSMPDIDGGLIGGASLNADEFGAICRAAGN

SEQ ID NO: 67108 - DNA, 765 bp, Rhodopirellula baltica
  CDS (1)..(765): transl_table=11
gtgagtcgtcgcattctgattgctggtaactggaaaatgaacatgcgtgccgagtccggcgcgtcgcttgccaaaggcattgtcgacgcggttggcaagtcgcccgctgtcgaagtcgttttgtgccccccgtcggtttacctgagtggcgtggcggacgcggtcgttgggactcccgtggaattgggggcacagaacctgtacgccgccgaagacggtgccttcaccggtgaagtcaacgcgtcgatgttgaccgacgtcggttgtcgatttgtgattctggggcacagcgagcgtcgccaattgatgggcgaaacggacgcttgtgtcgcgaaaaagctgcacgccgcgttggctggcaacttggttccgatcgtttgcgtgggcgaaaccctcgaacaacgcgaagcggacgacaccgaatcggtcatcgaaacgcaaattcgcgggtcgctggaaggtttggacgaagctcgcgccgcgaatattgtcatcgcctacgagcccgtttgggcgatcgggactggcaaaactgctagcaaagagcaagctgaagcggttcacgccttcattcgtgagcttttgggaaaaatgttctcgaccgaagtcgccgaacaaatccgaattcagtacggtggcagtgtgaaaccgggcaacgcagaagaattgttgtcccaacctaatatcgacggggctctcgtcggcgggtcaagcttgaaagtggatgatttcgctggaatcatcaaagcggctccctccgcctga

SEQ ID NO: 67109 - protein, 254 aa, Rhodopirellula baltica
MSRRILIAGNWKMNMRAESGASLAKGIVDAVGKSPAVEVVLCPPSVYLSGVADAVVGTPVELGAQNLYAAEDGAFTGEVNASMLTDVGCRFVILGHSERRQLMGETDACVAKKLHAALAGNLVPIVCVGETLEQREADDTESVIETQIRGSLEGLDEARAANIVIAYEPVWAIGTGKTASKEQAEAVHAFIRELLGKMFSTEVAEQIRIQYGGSVKPGNAEELLSQPNIDGALVGGSSLKVDDFAGIIKAAPSA

SEQ ID NO: 67110 - DNA, 768 bp, Salmonella typhimurium
  CDS (1)..(768): transl_table=11
atgcgacatcctttagtgatgggtaactggaaactgaacggcagccgccacatggtaaacgaactggtggctaacctgcgtaaagaactgacgggcgtagcaggctgcgacgtggcaatcgctccgccggaaatgtatatcgatctggcgaaacgcgctgctgccggcagccacatcatgctgggcgcgcagaacgttgatctgaatctgtctggcgcattcaccggtgaaacttcggctgaaatgctgaaggatatcggcgcgcagtacattattatcggccactccgagcgtcgtacttatcacaaagaatctgacgagctgatcgccaaaaaattcgccgtactgaaagaacaaggtctgacgccggtactgtgcatcggtgaaaccgaagcggaaaacgaagcgggcaaaacagaagaagtatgcgcacgccagatcgacgcggtactgaaaacgcagggcgcggcagcctttgaaggcgcggttatcgcttacgaacccgtatgggcgatcggtaccggtaaatctgcaactcctgcgcaggcgcaggcagtgcacaaattcatccgtgaccacattgctaaagctgacgcgaaaatcgctgaacaggttattatccagtacggcggttctgttaatgcctccaacgccgccgaactgttcgcgcagccggacatcgacggcgcactggtaggcggcgcttctctgaaagctgacgccttcgcggtgatcgtgaaagcagcagaagctgctaaacaggcttaa

SEQ ID NO: 67111 - protein, 255 aa, Salmonella typhimurium
MRHPLVMGNWKLNGSRHMVNELVANLRKELTGVAGCDVAIAPPEMYIDLAKRAAAGSHIMLGAQNVDLNLSGAFTGETSAEMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKADAKIAEQVIIQYGGSVNASNAAELFAQPDIDGALVGGASLKADAFAVIVKAAEAAKQA

SEQ ID NO: 67112 - DNA, 759 bp, Schistosoma japonicum
  CDS (1)..(759)
atgtctggttctcggaaattttttgttgggggtaattggaagatgaatggcagtagagccgacaacaaagttttgattcattctttgtctgaggctcatttttgtggagacactgaaattttaattgctgcacctttcgtttatctaaatgaagttcggcaaagcttagctaaagagatacacgtggctgctcaaaattgctataaggtaccaaagggtgcatttactggggaaatcagtccttcaatgataaaagatgttggttgtgattgggttatacttggtcattctgaacgaagaagtatatttaatgaatccgatgagcttgtagctgaaaaagttcaacatgcacttgcagaaggtctaagcgttgtagcatgtattggggaaacactatcagagcgtgaatctggtaaaacagaagaagtgtgtgtaagacaattaaatgctattgctaataagattaaatcaattgatgaatggaaacgagttgttgtagcatatgaacctgtatgggctattggaacaggtaaagttgcttcaccaggtcaagctcaagaagttcataattttcttcgtaaatggtttaaaacaaatacaccatctggagttgaccaacaaatacgtattatctatggtggatcagtaaccgcagcaaattgtaaagaattagctcaacaacatgatgtggatggatttttagttggtggtgcttcattaaaaccggaatttattgatatatgtaaagctagacaataa

SEQ ID NO: 67113 - protein, 252 aa, Schistosoma japonicum
MSGSRKFFVGGNWKMNGSRADNKVLIHSLSEAHFCGDTEILIAAPFVYLNEVRQSLAKEIHVAAQNCYKVPKGAFTGEISPSMIKDVGCDWVILGHSERRSIFNESDELVAEKVQHALAEGLSVVACIGETLSERESGKTEEVCVRQLNAIANKIKSIDEWKRVVVAYEPVWAIGTGKVASPGQAQEVHNFLRKWFKTNTPSGVDQQIRIIYGGSVTAANCKELAQQHDVDGFLVGGASLKPEFIDICKARQ

SEQ ID NO: 67114 - DNA, 762 bp, Schistosoma mansoni
  CDS (1)..(762)
atgtctggatctcgcaaattttttgttggggggaactggaaaatgaacggaagcagagatgacaacgataagttacttaagttactctcagaagctcattttgatgataacacggaagttttaattgctccaccttcagtctttttgcacgaaattcgaaaaagtttgaagaaagaaatacacgtggccgctcaaaattgctataaagtatcaaagggtgcattcaccggagaaatcagcccagcaatgataagagatattggttgtgattgggtcatacttggacattctgagcgtagaaacatttttggtgaatctgatgaacttattgctgaaaaagttcaacatgcacttgctgaaggtctaagcgttattgcatgtattggtgaaacattatcagagcgtgaatctaataaaacagaggaagtatgcgttagacagttaaaagctattgcaaataagattaaatcagctgatgaatggaaacgagtagtcgtagcatatgaaccagtttgggctattggaacaggtaaagttgctacaccacaacaagctcaagaagttcataatttccttcgtaaatggtttaaaacgaatgcaccaaatggagttgatgaaaaaatacgtattatctatggtggatctgtaactgctgccaattgtaaagaattagctcaacaacatgatgtcgatggatttttggttggtggagcttcattaaaaccggaattcactgagatatgtaaagccagacaacgttga

SEQ ID NO: 67115 - protein, 253 aa, Schistosoma mansoni
MSGSRKFFVGGNWKMNGSRDDNDKLLKLLSEAHFDDNTEVLIAPPSVFLHEIRKSLKKEIHVAAQNCYKVSKGAFTGEISPAMIRDIGCDWVILGHSERRNIFGESDELIAEKVQHALAEGLSVIACIGETLSERESNKTEEVCVRQLKAIANKIKSADEWKRVVVAYEPVWAIGTGKVATPQQAQEVHNFLRKWFKTNAPNGVDEKIRIIYGGSVTAANCKELAQQHDVDGFLVGGASLKPEFTEICKARQR

SEQ ID NO: 67116 - DNA, 1033 bp, Secale cereale
  CDS (55)..(816)
tgctccactctcgatctcccgtcccaacccaatccgatctcctcctccgtcgccatgggccgcaagttcttcgtcggcggcaactggaaatgcaatggaaccgtctctcaggtagagactatcgtcaatactctgaacgctggacagatcgcctctccggatgttgtggaggttgttgtcagcccgccctatgtcttccttcccaccgtcaaggataagctgcgtccagagatccaggttgctgctcagaactgctgggtgaagaagggcggtgctttcactggtgaagtcagtgctgagatgcttgtcaacctcggcattccctgggtcattcttggacactctgaaaggaggagcttgttggcagaatcgagtgagtttgttggagagaaggttgcatatgcactcgctcagggcttgaaggtcattgcatgtgttggtgagactctcgagcagcgagaagctggatcaaccatggaagttgtcgctgaacagacaaaggcaattgctgacaagatcaaggactggactaatgtggttgttgcctacgagccagtgtgggccattggcaccggtaaagttgcatcaccagctcaggcacaggaagtccatgccaacctgagggactggctcaagaccaatgtgagccccgaggttgctgaatccacgaggatcatctacggaggatctgtaactggagcaagctgcaaggagttggctgcgcagcccgacgtcgatggtttccttgttggtggagcttctttgaagcctgagttcatcgacatcatcaacgccgccaccgtgaagtctgcctaagaaaaaaaatctcgatgtggctcctctcggcgtggaggaagacagcgaagatgaagataccccttttttttctcctgtgtttattatatgtgtactatgctagtaattttgtggtggagcagctgctactgtgtttcctccccctgacttgagcttgcaagccaataatgataatgtttattactgaacatatatcagcaatgaccgtttaaaaaaa

SEQ ID NO: 67117 - protein, 253 aa, Secale cereale
MGRKFFVGGNWKCNGTVSQVETIVNTLNAGQIASPDVVEVVVSPPYVFLPTVKDKLRPEIQVAAQNCWVKKGGAFTGEVSAEMLVNLGIPWVILGHSERRSLLAESSEFVGEKVAYALAQGLKVIACVGETLEQREAGSTMEVVAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAATVKSA

SEQ ID NO: 67118 - DNA, 783 bp, Shewanella oneidensis
  CDS (1)..(783): transl_table=11
atggcactcagacgtcctatggtagctggcaattggaagatgaacggcagtgcggcattagcccaagagttgttcaagaaatttgcctcaaagctccaaaatgattcagctgaagtggttttatgcccgccttctatctatctagaaagcgtcaggcaactgctagaagcaaacaaggaagcgttagacggttcacttgttaggatgggcgcacagaatttaagtcagcatgactttggcgcttataccggagaagtttcgggtcagatgcttaaagattgcggatgtcgatatgttattatcgggcattcagaacgtcgccgtatgtacggagagacgagtaatattgtagcggagaaattcgctgcagcacaaaagcacggcttaacccctattttatgtgtgggagagtcgggtccagcacgagaagcaagacgtacttttgaggtgattgctgaagagttggacatagtgatccaaaaaaatggcactatggcttttgataacgccattatcgcttacgagccattatgggcagtaggaactggtaagagcgctacaccagagcaggcgcaagaagttcatgcgtttattcgcaaacgtctctctgaagtgtctccatttattggggaaaatatcaggattctctacggtggaagtgtgacaccgagtaacgcggcagatttatttgcccaacctgatgttgatggtggactgattggcggtgccagtttaaactctaccgagtttttaagtctgtgtaccatagcgatgagcgcataa

SEQ ID NO: 67119 - protein, 260 aa, Shewanella oneidensis
MALRRPMVAGNWKMNGSAALAQELFKKFASKLQNDSAEVVLCPPSIYLESVRQLLEANKEALDGSLVRMGAQNLSQHDFGAYTGEVSGQMLKDCGCRYVIIGHSERRRMYGETSNIVAEKFAAAQKHGLTPILCVGESGPAREARRTFEVIAEELDIVIQKNGTMAFDNAIIAYEPLWAVGTGKSATPEQAQEVHAFIRKRLSEVSPFIGENIRILYGGSVTPSNAADLFAQPDVDGGLIGGASLNSTEFLSLCTIAMSA

SEQ ID NO: 67120 - DNA, 762 bp, Staphylococcus aureus
  CDS (1)..(762): transl_table=11
atgagaacaccaattatagctggtaactggaaaatgaacaaaacagtacaagaagcaaaagacttcgtcaatgcattaccaacattaccagattcaaaagaagtagaatcagtaatttgtgcaccagcaattcaattagatgcattaactactgcagttaaagaaggaaaagcacaaggtttagaaatcggtgctcaaaatacgtatttcgaagataatggtgcgttcacaggtgaaacgtctccagttgcattagcagatttaggcgttaaatacgttgttatcggtcattctgaacgtcgtgaattattccacgaaacagatgaagaaattaacaaaaaagcgcacgctattttcaaacatggaatgactccaattatttgtgttggtgaaacagacgaagagcgtgaaagtggtaaagctaacgatgttgtaggtgagcaagttaagaaagctgttgcaggtttatctgaagatcaacttaaatcagttgtaattgcttatgagccaatctgggcaatcggaactggtaaatcatcaacatctgaagatgcaaatgaaatgtgtgcatttgtacgtcaaactattgctgacttatcaagcaaagaagtatcagaagcaactcgtattcaatatggtggtagtgttaaacctaacaacattaaagaatacatggcacaaactgatattgatggggcattagtaggtggcgcatcacttaaagttgaagatttcgtacaattgttagaaggtgcaaaataa

SEQ ID NO: 67121 - protein, 253 aa, Staphylococcus aureus
MRTPIIAGNWKMNKTVQEAKDFVNALPTLPDSKEVESVICAPAIQLDALTTAVKEGKAQGLEIGAQNTYFEDNGAFTGETSPVALADLGVKYVVIGHSERRELFHETDEEINKKAHAIFKHGMTPIICVGETDEERESGKANDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGASLKVEDFVQLLEGAK

SEQ ID NO: 67122 - DNA, 774 bp, Stellaria longipes
  CDS (1)..(774)
atgggccgtaagttcttcgtcggtggtaactggaaatgcaatggcacacaagaatcggtatcgaagatcgtggataccctgaatgaacctacgattgccgctaacgatgttgttactgtggttgtcagtcccccttatgtctttctacctgatgaaaatgccgagctgaagcacgagatccaagtggctgctcagaactgctgggtcaagaaagggggtgctttcactggtgaagtcagtgctcaaatgctggctaatttgggtatcacatgggttatcctgggacactcagaaaggagaactctattaggcgagtctaacgagttcgtcgggaaaaaggctgcatatgctcagagtgaaggccttggagttattgcttgtattggggagctgttagaagaaagagaagcggggaaaacctttgatgtttgcttcaagcaattgaagtcttttgccagatttcctgccaagccgtgggacaatgttgttgtcgcatacgagcctgtatgggctattggtactggtaaagtagcttcgcctgagcaagctcaggaagtgcatgttgctgttcgggattggcttaaaacgaatgtttctgaagaagttgcatccaagacccgcattatatatggaggttctgttaatggaggcaattctctagctcttgcagcacaagaggacgtcgacggttttctagttggaggtgcctccttgaagggaccagaatttgcgacgattattaattcagtgacagcaaaaaaggttgctgcctga

SEQ ID NO: 67123 - protein, 257 aa, Stellaria longipes
MGRKFFVGGNWKCNGTQESVSKIVDTLNEPTIAANDVVTVVVSPPYVFLPDENAELKHEIQVAAQNCWVKKGGAFTGEVSAQMLANLGITWVILGHSERRTLLGESNEFVGKKAAYAQSEGLGVIACIGELLEEREAGKTFDVCFKQLKSFARFPAKPWDNVVVAYEPVWAIGTGKVASPEQAQEVHVAVRDWLKTNVSEEVASKTRIIYGGSVNGGNSLALAAQEDVDGFLVGGASLKGPEFATIINSVTAKKVAA

SEQ ID NO: 67124 - DNA, 798 bp, Synechococcus elongatus
  CDS (1)..(798)
atgatcagggataacccgtgtggtacgcttgatcaggttaagtttcgcagaggaaagtcaagaggagtgcgcccaaaagttcttgctggcaactggaaaatgcacaaaacgcaacaggaggcagtggccttcctacaggagttcttaggggaattggtggacacccccagcgatcgcgaggtggtgctgtgtgttccctacacctgtttgagtgtattgtctaagagtctgcatggaacacgggtgaagctgggggcccaaaatgtccactgggcagatcagggggcgtttacgggggaaatttccccaccgatgttggtggagctgggggtgcgctacgtcattattggccacagtgagcggcggcagtattttggtgaaacggatgccacggttaaccagcggctcagggctgcccaaagccacggcctgacaccgattctctgtgtcggtgaaacgaaagcgcaacgggctgccggcgaaacagaaaaccacatctttcagcagttggccctggacttggtggatgtggatcaaaccaatttggtgattgcctacgagcctatttgggcgatcggtaccggtgatacctgtgaagaaacggaagcaaaccgcgtcattggtttgattcgcagtcagttgcacaatcccgatgtccccattcagtacggtggctcagtcaatgcaaacaatattgatgccatcatggcccagccagaaattgatggggtgctggtgggtggcgccagtttgcagccacagagttttgggcgcattgttaattacaagcccctttga

SEQ ID NO: 67125 - protein, 265 aa, Synechococcus elongatus
MIRDNPCGTLDQVKFRRGKSRGVRPKVLAGNWKMHKTQQEAVAFLQEFLGELVDTPSDREVVLCVPYTCLSVLSKSLHGTRVKLGAQNVHWADQGAFTGEISPPMLVELGVRYVIIGHSERRQYFGETDATVNQRLRAAQSHGLTPILCVGETKAQRAAGETENHIFQQLALDLVDVDQTNLVIAYEPIWAIGTGDTCEETEANRVIGLIRSQLHNPDVPIQYGGSVNANNIDAIMAQPEIDGVLVGGASLQPQSFGRIVNYKPL

SEQ ID NO: 67126 - DNA, 732 bp, Synechococcus sp
  CDS (1)..(732): transl_table=11
gtgcgtagaccggtgattgctggcaactggaagatgcacatgacctgtgcccaggccagggattacatggcagcattccttccgcaaattgaacgtgccccccaggaccgcgagatcgtcctggctccgcccttcactgcgctctccaccatggcggcagcagctgaacactccgttgtgggactcgccagtcagaacgtccattggcaggaccatggtgcattcacagccgaaatttcggccgagatgctgttagagcacggcgttgcatacacaatcgttgggcacagcgagccccgcaaatacttcagcgaaagtgatgagcagatcaaccacagggcccgctgctcccaggccaaggggttgatccccatcgtctgtgttggagaaagtgatgagcagcgcgaacggggtgaagcggagcgggtgatccgccgacagatcgagcagggacttgaagggttggacgccaacaaacttgttgtggcctatgaaccgatctgggccatcggcacgggtaaaacctgcgaagcagccgaagccaacaggatctgcggactgatccgaagctgggtgggagccaccgatctgatcattcagtacggcggatccgtgaagcccaccaacatcgatgaactcatggccatgagtgatatcgacggcgtcttggtcggtggtgcatcgctcaaacccgacagtttcgcccggattgccaactaccaggccatttga

SEQ ID NO: 67127 - protein, 243 aa, Synechococcus sp
MRRPVIAGNWKMHMTCAQARDYMAAFLPQIERAPQDREIVLAPPFTALSTMAAAAEHSVVGLASQNVHWQDHGAFTAEISAEMLLEHGVAYTIVGHSEPRKYFSESDEQINHRARCSQAKGLIPIVCVGESDEQRERGEAERVIRRQIEQGLEGLDANKLVVAYEPIWAIGTGKTCEAAEANRICGLIRSWVGATDLIIQYGGSVKPTNIDELMAMSDIDGVLVGGASLKPDSFARIANYQAI

SEQ ID NO: 67128 - DNA, 729 bp, Synechocystis sp
  CDS (1)..(729)
atgcgaaaaatcattattgcgggcaattggaaaatgcataagacgcaggcggaggcccaagcgtttttgcaggggtttaaacctttaatcgaagatgcggcggaaagtcgtgaggtggtgttgtgtgttcctttcaccgatttgagcggcatgtcccaacaactccatggcggtagggtccgcctaggggcacaaaatgtccattgggaagcgagtggggcctacacaggggaaatttcagcggctatgttgacggaaatcggtattcattatgtggttatcggccacagtgaacgacggcaatattttggggaaacggacgaaactgccaatttgagagtattggcggcccaaaaggcgggcttaattcccattctgtgtgtgggggaaagtaaggcgcaacgggatgccggagaaacggaacaggttatcgttgaccaagtgaaaaaaggcttggtgaatgtggatcaatctaacctagtcatcgcctacgagccgatttgggccattggtacaggggacacctgtgcggcaacggaagccaatcgggttattgggctgattcgggaacagttaactaattcccaggtcaccatccagtatggcggttcggtcaatgccaacaatgtggatgaaattatggcccaaccggaaattgatggagccttggtgggaggagctagtctggaaccccagagctttgcccgcattgttaattttcagccctga

SEQ ID NO: 67129 - protein, 242 aa, Synechocystis sp
MRKIIIAGNWKMHKTQAEAQAFLQGFKPLIEDAAESREVVLCVPFTDLSGMSQQLHGGRVRLGAQNVHWEASGAYTGEISAAMLTEIGIHYVVIGHSERRQYFGETDETANLRVLAAQKAGLIPILCVGESKAQRDAGETEQVIVDQVKKGLVNVDQSNLVIAYEPIWAIGTGDTCAATEANRVIGLIREQLTNSQVTIQYGGSVNANNVDEIMAQPEIDGALVGGASLEPQSFARIVNFQP

SEQ ID NO: 67130 - DNA, 753 bp, Taenia solium
  CDS (1)..(753)
atgacgcgtaagctgtttgtcggtggcaactggaagatgaatggcagttatagccacatcaacactttttttgatacccttcaaaaggctgatacagatcccaatgccgatatcgtaattggtgttcccgcttgctacctgaagtatgctcaggataaggctcccaaaggcattaaaattgctgcggaaaattgttacaaagttggctctggtgcattcacaggtgaaatcagtactgaaatgataaaagactgtggatgtgaatgggtcatacttggtcactctgagcgtcgccacattttcggcgagtctaacgagttgatcggggagaaggtaaaacatgctcttgattccggtcttaatgtcattccttgcattggcgaactgctctcggaacgtgaagctggtaaaaccaacgacgtttgcttcgctcaaatggatgccattgccaaaaacgttccttcaaaggaagcctgggacaaagttgtcattgcttatgagcccgtttgggccatcggtaccggcaagaccgcgacgccggctcaagctcaagaggttcacaaggttgttcgcgactggatccgcaagcatgtggacgccggaattgccgacaaagttagaattctctacggtggctctgtgacggcttccaacgccaaggacttgggtactcaacctgacgtggatggattccttgttggtggcgcctccttgaaacccgacttcattaccattataaacgcaagaagataa

SEQ ID NO: 67131 - protein, 250 aa, Taenia solium
MTRKLFVGGNWKMNGSYSHINTFFDTLQKADTDPNADIVIGVPACYLKYAQDKAPKGIKIAAENCYKVGSGAFTGEISTEMIKDCGCEWVILGHSERRHIFGESNELIGEKVKHALDSGLNVIPCIGELLSEREAGKTNDVCFAQMDAIAKNVPSKEAWDKVVIAYEPVWAIGTGKTATPAQAQEVHKVVRDWIRKHVDAGIADKVRILYGGSVTASNAKDLGTQPDVDGFLVGGASLKPDFITIINARR

SEQ ID NO: 67132 - DNA, 747 bp, Thermoanaerobacter tengcongensis
  CDS (1)..(747): transl_table=11
ttgagaaggcctataattgcaggaaattggaaaatgcataagaccccttcagaggcagtgaaattggtagaagagctgattcctctagtaaaagatgcaaaagccgaagtagtagtaattcccccttttgtagatttgacagaagttgctagagtcataaaaggtactaatatattgctgggagcacaaaacatgttctgggaagaaaagggggcttacacaggagaaatttcacctgtaatgctaaaagaaataggagtaacttatgtggtaattggccattctgaaagaaggcagtattttaaagagacagatgaaatggtgaataaaaaagtgttgtctgccctttcacacgatttaaaacctatcgtctgtgtaggagaatctctttctcaaagagaggaaggaaaaacttacgatgtagttttaactcagacaagggaagctttaaaaggcgtatctgaggaagatataacaaaagtagtcatcgcttatgagcctgtttgggcaatagggacgggtaaaaatgctactccacaggacgccaatgaggttataaaagctataaggaatacaatagcagaactttatgggaaagataaggctgaaatggtgagaatacagtacggaggaagtgtgaaacctgataacatctctggtttcatggcagaaagcgatatagacggagctttggttggcggtgccagccttgtggctgaggattttgcaaagattgtgaattactaa

SEQ ID NO: 67133 - protein, 248 aa, Thermoanaerobacter tengcongensis
MRRPIIAGNWKMHKTPSEAVKLVEELIPLVKDAKAEVVVIPPFVDLTEVARVIKGTNILLGAQNMFWEEKGAYTGEISPVMLKEIGVTYVVIGHSERRQYFKETDEMVNKKVLSALSHDLKPIVCVGESLSQREEGKTYDVVLTQTREALKGVSEEDITKVVIAYEPVWAIGTGKNATPQDANEVIKAIRNTIAELYGKDKAEMVRIQYGGSVKPDNISGFMAESDIDGALVGGASLVAEDFAKIVNY

SEQ ID NO: 67134 - DNA, 750 bp, Treponema pallidum
  CDS (1)..(750): transl_table=11
atgcgcggctattttatcgcggggaattggaagatgcataaaacgtgtgcggaggcggtggcgcttgcgcaggaactcgtgcgggaattacggggtggtccgcacacatacatgattgcgccgagttttaccgctttagacgcggtggggaaggtgctacggggaagtaacgtacttcttggcgcgcaggacgtgagtagtgaagagtggggggcgcatactggagaggtatccgtccttcaactcgaagacctgggggtacaggtagtcatcgtggggcattccgaacggcgtcatgggcgtggggagaatgataagcttatcaatcaaaaggtcagacgcgtgttagaaagcggtttgcgcgtcatcttatgcgtcggcgaacgactccaagagtatgaagcggggtgtaccaacgaggtagtgggaactcaagtgcgcgcagggatggcagacgtgtgtgggtcactcatgcataatgtaactgttgcgtatgagcctgtgtgggcaattggtacgggtaagactgccactccggcacaggcgaatgcggttcatgctcatattcggtcagtagtccgcgagatgtacggcgcggctatcgcagaggcactgtgtattcaatacggcggatccatgaaagcggagaacgcgcgggcactgttggctgaagagcacattgacgggggactcattggcggtgcttcgctggaggctgcgtcttttgttcctatcgcgcgcagcgtgtag

SEQ ID NO: 67135 - protein, 249 aa, Treponema pallidum
MRGYFIAGNWKMHKTCAEAVALAQELVRELRGGPHTYMIAPSFTALDAVGKVLRGSNVLLGAQDVSSEEWGAHTGEVSVLQLEDLGVQVVIVGHSERRHGRGENDKLINQKVRRVLESGLRVILCVGERLQEYEAGCTNEVVGTQVRAGMADVCGSLMHNVTVAYEPVWAIGTGKTATPAQANAVHAHIRSVVREMYGAAIAEALCIQYGGSMKAENARALLAEEHIDGGLIGGASLEAASFVPIARSV

SEQ ID NO: 67136 - DNA, 756 bp, Trypanosoma cruzi
  CDS (1)..(756)
atggcatcgaagcctcaacccatcgccgccgcaaactggaagtgcaacggctccgagagtttgcttgtaccactcatcgagacgctcaatgcagcgacttttgatcacgatgtgcaatgcgtggttgcgcccacctttctccacatcccaatgacgaaggcgaggctcaccaaccccaagttccagattgccgcacagaacgcgatcacaaggtcgggcgctttcacgggggaagtctctctgcagatcctcaaggactatggaatcagctgggttgtgttgggccattcggaacggcgtttgtactacggcgaaacgaacgaaatcgttgcggaaaaggtggcgcaggcctgcgctgccggcttccatgtcatcgtctgtgttggcgaaaccaacgaggagcgggaagctggccgcacggcagccgtcgtgttgacgcagctcgccgctgtcgcgcagaagcttagtaaggaggcgtggtctcgcgtcgttattgcctacgagcccgtgtgggcaatcggcaccggtaaagtggcaaccccgcagcaggcgcaggaggtccatgaattgctgcgccgttgggtgcggagcaaattgggcactgacatcgccgcgcaactgcgcatcttgtatggcgggtccgtgaccgccaaaaatgcacgcacgctatatcagatgcgcgacatcaacggcttccttgtgggcggtgcctcgctcaagccggagtttgttgaaatcattgaggccacgaagtag

SEQ ID NO: 67137 - protein, 251 aa, Trypanosoma cruzi
MASKPQPIAAANWKCNGSESLLVPLIETLNAATFDHDVQCVVAPTFLHIPMTKARLTNPKFQIAAQNAITRSGAFTGEVSLQILKDYGISWVVLGHSERRLYYGETNEIVAEKVAQACAAGFHVIVCVGETNEEREAGRTAAVVLTQLAAVAQKLSKEAWSRVVIAYEPVWAIGTGKVATPQQAQEVHELLRRWVRSKLGTDIAAQLRILYGGSVTAKNARTLYQMRDINGFLVGGASLKPEFVEIIEATK

SEQ ID NO: 67138 - DNA, 774 bp, Vibrio cholerae
  CDS (1)..(774)
atgcgtcgtcctgttgtgatgggtaactggaaactgaatggcagcaaagctatggtcactgacctgctaaacggtttgaatgcagaacttgaaggtgttgaaggtgttgatgttgtcgttgcgccaccagcaatgtatttggatctggctgagcgcctgatcaaagaaggcggcaacaagctgatcctgggtgcacaaaacaccgatactcacaacagtggtgcgtacacaggtgatatgtctcctgcgatgctgaaagatttcggtgcttcgcacatcatcatcggtcactctgagcgtcgtgattaccacaaagaatcagatgagttcgtcgctaagaaatttgcgttcctgaaagaaaacggcctaacgccagtcttctgtatcggtgaaactgaagcgcaaaacgaagcgggcgaaacagaagcggtatgtgctcgccaaatcaacgcagtgatcgatgcttacggcgttgaagcactgaacggcgcgatcatcgcttacgaaccaatctgggcaatcggtacgggtaaagccgcgacagcagatgatgcacagcgtatccacgcgtcaatccgtgcactgatcgctgcgaaagatgctgcagtggctgagcaagtgatcatccagtacggcggttccgtaaaaccagaaaacgcagcgtcttactttgcacaaccagacatcgatggtgcgctggttggcggtgcatcactggatgcgaaaggctttgccgcgatcgccaaagccgcagcagaagcgaaaaaagcgtaa

SEQ ID NO: 67139 - protein, 257 aa, Vibrio cholerae
MRRPVVMGNWKLNGSKAMVTDLLNGLNAELEGVEGVDVVVAPPAMYLDLAERLIKEGGNKLILGAQNTDTHNSGAYTGDMSPAMLKDFGASHIIIGHSERRDYHKESDEFVAKKFAFLKENGLTPVFCIGETEAQNEAGETEAVCARQINAVIDAYGVEALNGAIIAYEPIWAIGTGKAATADDAQRIHASIRALIAAKDAAVAEQVIIQYGGSVKPENAASYFAQPDIDGALVGGASLDAKGFAAIAKAAAEAKKA

SEQ ID NO: 67140 - DNA, 771 bp, Vibrio marinus
  CDS (1)..(771): transl_table=11
atgcgtcatcctgtagttatgggtaactggaaactaaacggcagcaaagaaatggttgttgatctactaaacggtcttaacgctgaacttgaaggcgttacaggcgtagacgttgcagttgctccaccagcacttttcgttgaccttgctgagcgtacgcttactgaagctggcagcgcaatcatcctaggtgctcaaaacactgacctaaacaacagcggtgcattcactggcgacatgtctccagcaatgcttaaagaatttggtgctactcacatcatcatcggtcactctgagcgtcgtgaataccacgctgagtctgacgagtttgttgctaagaaattcgcattcctaaaagaaaatggcctaactccagttctttgtatcggtgaatctgatgcacaaaacgaagctggcgaaacaatggctgtttgtgcacgtcaacttgacgctgttatcaacactcaaggcgttgaagctcttgaaggcgctatcatcgcttacgaaccaatctgggctatcggtactggtaaagcggctacagctgaagatgcacaacgcattcacgctcaaatccgtgctcacattgctgagaaatcagaagcagttgctaagaacgttgttatccaatacggcggttctgttaaacctgaaaacgcagcagcttacttcgcacaaccagacatcgatggtgctctagttggcggcgcagctcttgacgcgaaaagctttgcagctatcgctaaagcagcagctgaagcaaaagcttaa

SEQ ID NO: 67141 - protein, 256 aa, Vibrio marinus
MRHPVVMGNWKLNGSKEMVVDLLNGLNAELEGVTGVDVAVAPPALFVDLAERTLTEAGSAIILGAQNTDLNNSGAFTGDMSPAMLKEFGATHIIIGHSERREYHAESDEFVAKKFAFLKENGLTPVLCIGESDAQNEAGETMAVCARQLDAVINTQGVEALEGAIIAYEPIWAIGTGKAATAEDAQRIHAQIRAHIAEKSEAVAKNVVIQYGGSVKPENAAAYFAQPDIDGALVGGAALDAKSFAAIAKAAAEAKA

SEQ ID NO: 67142 - DNA, 771 bp, Wigglesworthia glossinidia brevipalpis
  CDS (1)..(771)
atgaaattgaaaccgttgatattatcaaattggaaattaaatggtaattgtttgttggtaaaaaagattttgcttaaattaaatgaaaaattgaaaaacaaaaataatttaaaagttgttattgctcctccagtaatatatttaagtgaatttaaaaaatatgttttaaaaaaaaatatttttttagctgcacaaaacgtggatgttaatttaacagggtcttttactggagaaatttctccaataatgttatatgaatttggcgtaaagtatgtaattataggtcattctgaaagaagattataccataatgaaagcattgaagatgtaactaaaaaattcttaatacttaaaaaatttaatttaattccagtattatgcattggagaaacaaaaaaaaacaaagatgataaatgtatagaaaatgaaatagttaaacaaattgattttatattgaaaaaaattgggatagaaggttttataaatacagttattgcatatgaacctacatgggctataggaaagaaagactctgctagtcctaaatatattcaaaaaattcataaattcattagaaactatttatcaaaatatgataatgatatttctaaaaaaattattttacaatatggaggatctgtaaattcaaaaaatgtaaaaaaaattatttctcaaaaagacgttaatggtgttttattagggagatcttctacaaatatagaagaatttttatatattttagatattatagaaaaaacaaaaaaatcataa

SEQ ID NO: 67143 - protein, 256 aa, Wigglesworthia glossinidia brevipalpis
MKLKPLILSNWKLNGNCLLVKKILLKLNEKLKNKNNLKVVIAPPVIYLSEFKKYVLKKNIFLAAQNVDVNLTGSFTGEISPIMLYEFGVKYVIIGHSERRLYHNESIEDVTKKFLILKKFNLIPVLCIGETKKNKDDKCIENEIVKQIDFILKKIGIEGFINTVIAYEPTWAIGKKDSASPKYIQKIHKFIRNYLSKYDNDISKKIILQYGGSVNSKNVKKIISQKDVNGVLLGRSSTNIEEFLYILDIIEKTKKS

SEQ ID NO: 67144 - DNA, 699 bp, Wolinella succinogenes
  CDS (1)..(699): transl_table=11
atgattttagccgccaatttcaaaacaaatcacacgcgaaaatcgactcgacactatctagagcgtctctccaatttcctctttgagacaagttgcgagcatgatatttttctcttcccgcctcccttggccctcgattttttcgatgatattggaggggtttgcattggaacacaaaacgcctaccccgcaccaagtggagccttcacgggcgaagtaggaagcgagcaattagaagagctggctatccaaacgatccttatcgggcatagcgaacgaagaggaatcctaggagaatcccaagccttctgtgcagaaaaatttcgctactacgcctccttgggctacacgatcttttactgcatcggcgagagcctagaggtgagaagggcaggaatcgaggcaacgattcgtcacaatctctcccagctagagggaatcgatctctcctatcccaagctcatcatagcctatgagcccatttgggcgattggcacgggagtgagcgcctccttagagcagatccaagagacccacgccgctctcaaagcgcatctctcttgccctctcctttatggcggaagcgtgaatctctccaatatcgccgagattctcgctctccctgaagtcgatggcgcgctcattggaagcgcttcgctcaaagtggaagatttttgccaaatgattcaaaaaatttaa

SEQ ID NO: 67145 - protein, 232 aa, Wolinella succinogenes
MILAANFKTNHTRKSTRHYLERLSNFLFETSCEHDIFLFPPPLALDFFDDIGGVCIGTQNAYPAPSGAFTGEVGSEQLEELAIQTILIGHSERRGILGESQAFCAEKFRYYASLGYTIFYCIGESLEVRRAGIEATIRHNLSQLEGIDLSYPKLIIAYEPIWAIGTGVSASLEQIQETHAALKAHLSCPLLYGGSVNLSNIAEILALPEVDGALIGSASLKVEDFCQMIQKI

SEQ ID NO: 67146 - DNA, 756 bp, Xanthomonas axonopodis
  CDS (1)..(756): transl_table=11
atgcgtcgaaagatcgttgccggaaattggaagctgcatggcagccgcgccttcgccaccgaactggtggccaaggtggccgcgcacatgcccctggagggtgtcgaagtcgtcatcctgccgccactgccttacctcggcgacctgatcgaggatttcgaggcccatcacctgtcgttcggagcccaggacgtcagcagtaacgagaagggcgcctacaccggcgaggtatcggcctcgatgctggtcgatgtcggtgctggctacgggctggtcggccactccgagcgccgccaataccatcaggagagtagcgaactggtagcgcgcaagttcgccgccgccctccatgccgggctgattccggtgctgtgcgtgggcgaatcgctggaacagcgtgaagccggtcagactgaggcaatcctacgtgcccagctcgacccggtcctggcgctggtgggcagtgccggttttgcgggcgcggtgctggcctacgaaccgatctgggccattggcaccggccgcaccgccaccccggagcaggcccaggcggtgcacgctttcctgcgtggcgaagtcgcgaaggcggatgctagaatcgccgattcgttgcccatcctgtacgggggcagtgtcaagcccgacaacgccggcgagctgttcgcacagcctgacgtcgatggcgggctggtcggaggcgcatcactggtcgccgaagatttcctggccatcgcacgcgcggcggccgcgtgctaa

SEQ ID NO: 67147 - protein, 251 aa, Xanthomonas axonopodis
MRRKIVAGNWKLHGSRAFATELVAKVAAHMPLEGVEVVILPPLPYLGDLIEDFEAHHLSFGAQDVSSNEKGAYTGEVSASMLVDVGAGYGLVGHSERRQYHQESSELVARKFAAALHAGLIPVLCVGESLEQREAGQTEAILRAQLDPVLALVGSAGFAGAVLAYEPIWAIGTGRTATPEQAQAVHAFLRGEVAKADARIADSLPILYGGSVKPDNAGELFAQPDVDGGLVGGASLVAEDFLAIARAAAAC

SEQ ID NO: 67148 - DNA, 750 bp, Xanthobacter flavus
  CDS (1)..(750): transl_table=11
atgacggccgaacgccgccccctgatcgcaggcaactggaagatgaacggcctgcgggcggccaagtccgagttgcggaccgtggcggccggccttgccggcctttcggcggaaaccatgatctgcccacccttcaccctcatcggcgccttcgccgcggacgtcgcgggcacccagctgatgatcggcggacaggactgccacccggccgagagcggcgcccataccggcgacatctccgccgagatgctgcgcgacgccggtgcggtggcggtgattctcggccattccgagcgccgcatcgaccatcaggagggcgatgccatcgtcaaggccaaggtcaaggctgcgtggcgggccgggctgctcccggtcgtctgcgtgggcgagacgctggtggagcgtgatgccggggaagccgctgccgtggtgacgcggcaggtgcgccagtccgtgcccgagggcgcgacggcggtgagcctcgtcatcgcctacgagcccatctgggccatcggcaccggccgcacccccaccaccgacgacgtggccgaggttcacggcgccatccgccacatcctcgccgagcgcttcggcgccgaggcgaacggcatccgcattctctatggcggctcggtgaagcccgacaacgccgctgccctgctcgccaccgccaacgtggacggcgcgctggtgggcggcgccagcctcaaggcggccgatttcctcgccatcgcccgggcggtgggctga

SEQ ID NO: 67149 - protein, 249 aa, Xanthobacter flavus
MTAERRPLIAGNWKMNGLRAAKSELRTVAAGLAGLSAETMICPPFTLIGAFAADVAGTQLMIGGQDCHPAESGAHTGDISAEMLRDAGAVAVILGHSERRIDHQEGDAIVKAKVKAAWRAGLLPVVCVGETLVERDAGEAAAVVTRQVRQSVPEGATAVSLVIAYEPIWAIGTGRTPTTDDVAEVHGAIRHILAERFGAEANGIRILYGGSVKPDNAAALLATANVDGALVGGASLKAADFLAIARAVG

SEQ ID NO: 67150 - DNA, 744 bp, Yarrowia lipolytica
  CDS (1)..(744)
atgtctcgaaccttttttgttggcggaaacttcaagatgaacggctctctggagtccatcaaggccattgttgagcgactcaacgcctccgagctcgaccccaagaccgaggtggtcatctcgccccccttcccctacctcctgctcgccaaggagtctctgaagaagcccaccgtgtctgtggctggccagaactctttcgacaagggagacggtgccttcaccggtgaggtgtctgtggcccagctcaaggacgttggagccaagtgggtcattctcggccactccgagcgacgaaccatcaacaaggagtcctccgagtggattgccgacaagaccaagtacgctcttgacaacggtctcgacgtcatcctctgtatcggagagaccattgacgagaagaaggctggcaagaccctggacgttgtccgatcccagctcgaccccgtcatcgccaagatcaaggactggtccaacgtggtcattgcctacgagcccgtctgggccatcggtaccggtctcgctgccaccgccgaggacgcccagcagatccaccacgagatccgagcctacctcaaggacaagattggcgcccaggccgacaaggtccgaatcatctacggtggttccgtcaacggcaagaactctggtaccttcaaggacaagtctgatgtcgacggtttcctcgtcggtggtgcttctctcaagcccgagtttgttgacatcatcaactctcgactttaa

SEQ ID NO: 67151 - protein, 247 aa, Yarrowia lipolytica
MSRTFFVGGNFKMNGSLESIKAIVERLNASELDPKTEVVISPPFPYLLLAKESLKKPTVSVAGQNSFDKGDGAFTGEVSVAQLKDVGAKWVILGHSERRTINKESSEWIADKTKYALDNGLDVILCIGETIDEKKAGKTLDVVRSQLDPVIAKIKDWSNVVIAYEPVWAIGTGLAATAEDAQQIHHEIRAYLKDKIGAQADKVRIIYGGSVNGKNSGTFKDKSDVDGFLVGGASLKPEFVDIINSRL

SEQ ID NO: 67152 - DNA, 768 bp, Yersinia pestis
  CDS (1)..(768): transl_table=11
atgcgacatccattagttatgggtaactggaagctgaacggtagtactcatatggttaacgagcttatcgctggcctgcgtaaagaattgagcaccgttgatggttgtggcgttgccattgccccaccggcgatctatctaaatcaggcaaaacatgagcttgctggtagccgtattgctctgggtgctcaaaacgtcgatgtgaacctctccggcgcatttaccggtgaaacatctgctgaaatgctgaaagatatcggtgcgcaatacattattatcggccactctgagcgccgtacttatcaccaagaaagtgatgaattgatcgcgaagaaatttggcgtactgaaagagatcggcttgatcccagtattgtgtatcggtgagtccgaagcagaaaacgaagcgggccaaactgaagcagtatgcgccaaacaactggacgccgtgctgaataccctaggcgtgaaagcgttcgaaggtgcggttatcgcttatgagccaatctgggctatcggtaccggtaaatcagcaactccagcgcaggctcaggctgttcacaaatttatccgtgaccatatcgccaagcaagacgcagcagttgcagcacaagtgatcattcagtacggcggttctgttaacgataaaaacgcagcagaattgttcactcagccagatattgatggcgcactggttggcggtgcatcactgaaagcagacgctttcgcagttatcgtgaaagcagccgctaaagctaaaaaagcctaa

SEQ ID NO: 67153 - protein, 255 aa, Yersinia pestis
MRHPLVMGNWKLNGSTHMVNELIAGLRKELSTVDGCGVAIAPPAIYLNQAKHELAGSRIALGAQNVDVNLSGAFTGETSAEMLKDIGAQYIIIGHSERRTYHQESDELIAKKFGVLKEIGLIPVLCIGESEAENEAGQTEAVCAKQLDAVLNTLGVKAFEGAVIAYEPIWAIGTGKSATPAQAQAVHKFIRDHIAKQDAAVAAQVIIQYGGSVNDKNAAELFTQPDIDGALVGGASLKADAFAVIVKAAAKAKKA

SEQ ID NO: 67154 - DNA, 747 bp, Zygosaccharomyces bailii
  CDS (1)..(747)
atggctagaacttttttcgtcggcggtaacttcaaactaaacggtaccaagtccagcatcaaggagattgttgagagactaaacaacgctaagttggaccctaaggtcgaggtggtgttgtgtcctccagccccatacttggactacaccgtctcccttgtcaagaagtctcaggtttccgtcggtgcccagaacgcttacttgaaggcttccggtgccttcactggtgagaactctgttgaccagatcaaggatgttggtgctaagtgggtcattctaggtcactccgagagaagacagtatttcagggaagacgaccaattgatcgccgagaagactgcctttgctctttctcagggtgttggtgtcatcttgtgtattggtgagactcttgaccaaaagaaggctggtaccactcttcaggttgtcgagagacaactacaggctgtcattgacaaggtcaaggactggtccaacgttgttattgcttacgagcctgtgtgggctattggtactggtctagctgctaccccagaggatgctcaggaaatccaccactccatcagagaattcttggctaagaagctgggtgagaagaccgctcaggagactagaatcctatacggtggtagtgccaacggtaagaacgctgtcactttcaaggacaagccagacgttgacggtttcttggttggtggtgcctctttgaagccagagttcgttgacatcatcaactctagatcttga

SEQ ID NO: 67155 - protein, 248 aa, Zygosaccharomyces bailii
MARTFFVGGNFKLNGTKSSIKEIVERLNNAKLDPKVEVVLCPPAPYLDYTVSLVKKSQVSVGAQNAYLKASGAFTGENSVDQIKDVGAKWVILGHSERRQYFREDDQLIAEKTAFALSQGVGVILCIGETLDQKKAGTTLQVVERQLQAVIDKVKDWSNVVIAYEPVWAIGTGLAATPEDAQEIHHSIREFLAKKLGEKTAQETRILYGGSANGKNAVTFKDKPDVDGFLVGGASLKPEFVDIINSRS

SEQ ID NO: 67156 - DNA, 23 bp, Primer
atgcgacatcctttagtgatggg

SEQ ID NO: 67157 - DNA, 23 bp, Primer
ttaagcctgtttagccgcttctg

SEQ ID NO: 67158 - protein, 264 aa, consensus
  MISC_FEATURE (1)..(264): consensus for the disclosure of xaa see table XV
GNWKXXXXXXXXXXXXXXXXXXXXXXXXXXXXXXXXXXXXXXXXPXXXXXXXXXXXXXXXXXXXXXXXXXXXAQXXXXXXXXXGAXTGEXSXXXXXXXGXXXXXXGHSERRXXXXXXXEXXXXXXXKXXXXXXXGXXXXXXCXGEXXXXXXXGXXXXXXXXQXXXXXXXXXXXXXXXXXXXXXXXXAYEPXWAIGTGXXXAXXXXXXXXXXXXRXXXXXXXXXXXXXXXXXXXXYGGSVXXXNXXXXXXXXXXXDGXLXGGASL

SEQ ID NO: 67159 - protein, 138 aa, consensus
  MISC_FEATURE (1)..(138): consensus for the disclosure of xaa see table XV
XXXXXXXXXXXXXXXXXXXXXXXXXXXXXXXXXXXXXXXXXXXXXXXXXXXXXXXXXXXXXXXXXXXXXXXXXXXXXXGXXTXXXXXXXXXXXXXXXXXXGHXEXXXXXXXXEXXXXXXXXXXXXXXXXXXXXXCXGX

SEQ ID NO: 67160 - protein, 79 aa, consensus
  MISC_FEATURE (1)..(79): consensus for the disclosure of xaa see table XV
XXAYEPXWXXGXXXXXXXXXXXXXXXXXXXXXXXXXXXXXXXXXXXXXXXYGGXXXXXXXXXXXXXXXXXGXXXGXXXX

SEQ ID NO: 67161 - DNA, 213 bp, Escherichia coli
  CDS (1)..(213)
atgaaaaaagatattcacccgaaatacgaagaaattactgctagctgctcttgcggtaacgtaatgaaaatccgctccaccgttggtcatgacctgaacctcgacgtgtgcagcaagtgccacccgttcttcactggcaaacagcgtgatgttgctaccggtggccgtgttgaccgcttcaacaagcgtttcaacatcccgggcagcaaataa

SEQ ID NO: 67162 - protein, 70 aa, Escherichia coli
MKKDIHPKYEEITASCSCGNVMKIRSTVGHDLNLDVCSKCHPFFTGKQRDVATGGRVDRFNKRFNIPGSK

SEQ ID NO: 67163 - DNA, 228 bp, Gluconobacter oxydans 621H
  CDS (1)..(228)
atgagatccggcatccatcccgactaccacgagatcaccgtcatcatgaccgacggaaccgaatacaagacccgttcgtgctatggcgaaccgggcgctacgctgcgtcttgacgttgatccgaagtcccatccggcctggacgggcgtccagcgcatgatggataccggaggccaggttgcaaagttcaacaagcgctttgctggcatcggtacgcgcacgaagtaa

SEQ ID NO: 67164 - protein, 75 aa, Gluconobacter oxydans 621H
MRSGIHPDYHEITVIMTDGTEYKTRSCYGEPGATLRLDVDPKSHPAWTGVQRMMDTGGQVAKFNKRFAGIGTRTK

SEQ ID NO: 67165 - DNA, 246 bp, Lactobacillus acidophilus NCFM
  CDS (1)..(246)
atgaaacaaggtattcatccagattttcaaaaggtagttttcatggactcagcaactggtgctaagttcgtagctggttcaactatgaagccagaagaaactatcgaatacgaaggcgaaacttacccattagtacgtgttgaagtttcatcagattcacacccattctacacaggcaagcaaaagtttgctcaagcagatggtcgaatcgaaaagttcaacaagaagtacggcttgaagaagtaa

SEQ ID NO: 67166 - protein, 81 aa, Lactobacillus acidophilus NCFM
MKQGIHPDFQKVVFMDSATGAKFVAGSTMKPEETIEYEGETYPLVRVEVSSDSHPFYTGKQKFAQADGRIEKFNKKYGLKK

SEQ ID NO: 67167 - DNA, 324 bp, Yersinia pestis KIM
  CDS (1)..(324): transl_table=11
ttgaaactggaaacagtaaaacgcataatgatgttacattataacatactaaaaggaatcattatgaagcccaatatccaccctccgtatcggactgtggtatttcacgataccagtgcggatgcttattttactgtaggttcaaccattgccactgagcgaacaatcgaacgcgatggccagacgtacccctacgtcacattagatatctcttcagcctcgcatccgtactacaccggtaagcaaaaagagtttgctaaagaaggcagtaccgcacgcttccaccaacgtttcggtagtttcttaacaaagaaaaccaactaa

SEQ ID NO: 67168 - protein, 107 aa, Yersinia pestis KIM
MKLETVKRIMMLHYNILKGIIMKPNIHPPYRTVVFHDTSADAYFTVGSTIATERTIERDGQTYPYVTLDISSASHPYYTGKQKEFAKEGSTARFHQRFGSFLTKKTN

SEQ ID NO: 67169 - DNA, 303 bp, Pseudomonas putida KT2440
  CDS (1)..(303): transl_table=11
gtgtgctctggtattattcgccgcctaattacgtgcggtattcaacaattggtgttgggtggcggcacgcagctcgaggaagtgaccatgaaagaaggtatccacccgaactacgaagtagttgcagtcacctgcagctgcggtaacaagttcgaaactcgttcgaccctgggcaacgtcctgtcgatcgacgtttgcaacctgtgccacccgttctacaccggtaagcagaaagttctggacaccggtggtcgcgtacagaagttcgccgatcgcttcggcatgttcggtgccaagaagtaa

SEQ ID NO: 67170 - protein, 100 aa, Pseudomonas putida KT2440
MCSGIIRRLITCGIQQLVLGGGTQLEEVTMKEGIHPNYEVVAVTCSCGNKFETRSTLGNVLSIDVCNLCHPFYTGKQKVLDTGGRVQKFADRFGMFGAKK

SEQ ID NO: 67171 - DNA, 294 bp, Mycoplasma penetrans HF-2
  CDS (1)..(294): transl_table=4
atgattatgaagaaagaaacacatatgaaattgaatgaagttagcttcaactgtgcttcatgtaatagtacttttgttgttaaatctacattaaatactaaagaaacgtcaattgatgtttgtagttcttgccatcctttctatattggtacttctatgagccaacaagttaaaggaagagctgaaaaatttaacaaaaaagttgttgctgtaaaacaagaaccaactaaatcagaaaacaaaaatactaaaaaacaaagcaaaaaagttgttcattctctaaatagtttataa

SEQ ID NO: 67172 - protein, 97 aa, Mycoplasma penetrans HF-2
MIMKKETHMKLNEVSFNCASCNSTFVVKSTLNTKETSIDVCSSCHPFYIGTSMSQQVKGRAEKFNKKVVAVKQEPTKSENKNTKKQSKKVVHSLNSL

SEQ ID NO: 67173 - DNA, 270 bp, Enterococcus faecalis V583
  CDS (1)..(270): transl_table=11
atgaaacaagatatccatccaaattaccaaccagtagtattcatggattcaacaacaggtttcaaattcctttcaggttcaactaaaggatcttcagaaactgttgaatgggaagatggcaacacttatccattattacgtgttgaggttacttcagactcacacccattctacactggtcgtcaaaaattcacacaagccgacggacgtgtggaccgtttcaacaaaaaatacggtctcaaagacgaaaacgcaaatccagacgcatag

SEQ ID NO: 67174 - protein, 89 aa, Enterococcus faecalis V583
MKQDIHPNYQPVVFMDSTTGFKFLSGSTKGSSETVEWEDGNTYPLLRVEVTSDSHPFYTGRQKFTQADGRVDRFNKKYGLKDENANPDA

SEQ ID NO: 67175 - DNA, 240 bp, Coxiella burnetii RSA 493
  CDS (1)..(240): transl_table=11
atgaaggaaaacatacatcctccttataaacaaattaaagtaacttgcagttgcggcaacacgtttatgaccgggtcgactttggaccgtgagctccaccttgaaatctgctccgcctgccatcccttctacacgggtcaacaaaaaatggtggacacggctggccgcgtcgagcgattccgcaagaaatacgcgaaacgccgtgcagctaatgcttcgcctgaagacgagaaaaaataa

SEQ ID NO: 67176 - protein, 79 aa, Coxiella burnetii RSA 493
MKENIHPPYKQIKVTCSCGNTFMTGSTLDRELHLEICSACHPFYTGQQKMVDTAGRVERFRKKYAKRRAANASPEDEKK

SEQ ID NO: 67177 - DNA, 222 bp, Streptomyces avermitilis MA-4680
  CDS (1)..(222)
ttgaagcgcgacatccaccccgagtacgtcgagacgcaggtcagctgcacctgtggcgcgtcgttcaccacccgtagcacgatctccagcggcaccgtccgcgccgaggtctgctccgagtgccacccgttctacacgggcaagcagaagatcctcgacaccggtggccgtgtggcccgcttcgaggcccgcttcggcaaggctgccgctgccaagaagtag

SEQ ID NO: 67178 - protein, 73 aa, Streptomyces avermitilis MA-4680
MKRDIHPEYVETQVSCTCGASFTTRSTISSGTVRAEVCSECHPFYTGKQKILDTGGRVARFEARFGKAAAAKK

SEQ ID NO: 67179 - DNA, 255 bp, Bacillus cereus ATCC 14579
  CDS (1)..(255): transl_table=11
atgaaaagaatgaaagcaggaattcacccagattacaagaaagttgtattcatggacacaaacacaggcttcaaattcttaagcggatctactaaaggatctaacgaaactgttgagtgggaagatggtaacacttatccattactaaaagttgagatcagttctgattctcacccattctacactggacgtcagaagtttgctactgcagacggacgcgttgaccgcttcaataagaaatacggtcttaagtaa

SEQ ID NO: 67180 - protein, 84 aa, Bacillus cereus ATCC 14579
MKRMKAGIHPDYKKVVFMDTNTGFKFLSGSTKGSNETVEWEDGNTYPLLKVEISSDSHPFYTGRQKFATADGRVDRFNKKYGLK

SEQ ID NO: 67181 - DNA, 225 bp, Nitrosomonas europaea ATCC 19718
  CDS (1)..(225): transl_table=11
atgaaggaaggtattcatccggagtatcacgagatcaccgtaacatgcagttgcggcaatgagttcaaaacccgctccgttttgagcaaacccctgcatatcgaagtatgctcatcctgtcatccgttttatacaggtaaacagaaaattgtggataccgcaggaagggtagagaaattcaaccaaaaatatggcagacatctccagaaacaagcccagacttaa

SEQ ID NO: 67182 - protein, 74 aa, Nitrosomonas europaea ATCC 19718
MKEGIHPEYHEITVTCSCGNEFKTRSVLSKPLHIEVCSSCHPFYTGKQKIVDTAGRVEKFNQKYGRHLQKQAQT

SEQ ID NO: 67183 - DNA, 204 bp, Cyanidioschyzon merolae strain 10D
  CDS (1)..(204): transl_table=11
atgaagaagaatattcatccgaaatggtataaacatagtattgtgtatggtaatggccaacaaattttgacagtgggttccactaagccggagttacatgtagaagtgtggtcaagtatacatcccttttatacaggttcacaaaaacaactagatacagaaggtagaatcgagaaatttatgcgtaaatacggtatgaaatga

SEQ ID NO: 67184 - protein, 67 aa, Cyanidioschyzon merolae strain 10D
MKKNIHPKWYKHSIVYGNGQQILTVGSTKPELHVEVWSSIHPFYTGSQKQLDTEGRIEKFMRKYGMK

SEQ ID NO: 67185 - DNA, 207 bp, Helicobacter hepaticus ATCC 51449
  CDS (1)..(207): transl_table=11
ttgatgaaaaaaggtattcacccagaatatataccctgcaaagtaacttgcgtaacaagtggcaaacaacttgaggttttgagcactaaaagcgagcttcgtattgatatttcaagcttttgtcatcctttttatacaggaagtgataaaatcacagatattacaggacgtgttgagaaattccgacaaaaatataatatgaaataa

SEQ ID NO: 67186 - protein, 68 aa, Helicobacter hepaticus ATCC 51449
MMKKGIHPEYIPCKVTCVTSGKQLEVLSTKSELRIDISSFCHPFYTGSDKITDITGRVEKFRQKYNMK

SEQ ID NO: 67187 - DNA, 246 bp, Rhodopirellula baltica SH 1
  CDS (1)..(246): transl_table=11
atgcaagacggcattcaccccaactaccaagaaacgtccgtcacctgcggttgcggcaacactttcaccacccgcagcacgcgtcccgagctgaaaatcgacatttgcagcgagtgccatccgttctacaccggcaaactgaaatacgttgacaccgccggtcgtatcgacaagttccagaagaaatttgctgctggtacctacggatcgttgcaaaagaagaaggctaagaaagccaccaaatga

SEQ ID NO: 67188 - protein, 81 aa, Rhodopirellula baltica SH 1
MQDGIHPNYQETSVTCGCGNTFTTRSTRPELKIDICSECHPFYTGKLKYVDTAGRIDKFQKKFAAGTYGSLQKKKAKKATK

SEQ ID NO: 67189 - DNA, 285 bp, Prochlorococcus marinus subsp. marinus str. CCMP1375
  CDS (1)..(285): transl_table=11
atgcccaaaaaagatatacaccctaattggtatccagatgcaaaggttatttgcaatggagaggtcgttatgactactggctcgactcaacctgagattcatgttgatgtttggagtggaaatcatccattctttaccggcactcaaaaaattcttgatactgaaggtagggtggatcgctttatgcgtaaatatggcatggctaatcccgatgaagatagcactaagaatacaaagtcatctaaaaaagaaacttctgaggattcatcatcaaaggggtcctaa

SEQ ID NO: 67190 - protein, 94 aa, Prochlorococcus marinus subsp. marinus str. CCMP1375
MPKKDIHPNWYPDAKVICNGEVVMTTGSTQPEIHVDVWSGNHPFFTGTQKILDTEGRVDRFMRKYGMANPDEDSTKNTKSSKKETSEDSSSKGS

SEQ ID NO: 67191 - DNA, 222 bp, Candidatus Blochmannia floridanus
  CDS (1)..(222): transl_table=11
atgaagaaaaatattcatccgcagtataatgttatatctgcatcctgttcttgtgggaatgttattcatgtaagatctacattaaaacataacattaatttagatgtttgtgatgcttgtcatcctttttataccggaacacaacgtattattgatactagaggtcgggtgaatttattcaataaacgttttaataaaaataacaaaaaccctttcatctga

SEQ ID NO: 67192 - protein, 73 aa, Candidatus Blochmannia floridanus
MKKNIHPQYNVISASCSCGNVIHVRSTLKHNINLDVCDACHPFYTGTQRIIDTRGRVNLFNKRFNKNNKNPFI

SEQ ID NO: 67193 - DNA, 261 bp, Prochlorococcus marinus subsp. pastoris str. CCMP1986
  CDS (1)..(261): transl_table=11
atgcctaaatcagaaattcatcctaaatggtatccagatgcaaaagttatttgtaatggagaagtcgtaatgacaacaggttcaactaagcctgaattacatgttgatgtttggagtgggaatcatcctttctttactggcactcaaaaaatacttgatactgagggtagagttgataggttcatgaaaaagtatggaatgggttcagccgattcagctacttcaaaagaaacaaaagaatctaaaaaatcagataaataa

SEQ ID NO: 67194 - protein, 86 aa, Prochlorococcus marinus subsp. pastoris str. CCMP1986
MPKSEIHPKWYPDAKVICNGEVVMTTGSTKPELHVDVWSGNHPFFTGTQKILDTEGRVDRFMKKYGMGSADSATSKETKESKKSDK

SEQ ID NO: 67195 - DNA, 261 bp, Synechococcus sp. WH 8102
  CDS (1)..(261): transl_table=11
atgcccaagcccgatatccaccccacctggtatcccgacgccaaggtgatctgcaatggcgaagtcgtgatgaccaccggctccacccagccggagattcacgtcgacgtctggagtggcaaccaccccttcttcacaggaacccagaagattctcgacaccgagggtcgcgtcgatcgcttcatgaagaagtacggcatgggccagaagaaatccggcgacaaagccaaggctgaggccaaggcggacgccaaatcctga

SEQ ID NO: 67196 - protein, 86 aa, Synechococcus sp. WH 8102
MPKPDIHPTWYPDAKVICNGEVVMTTGSTQPEIHVDVWSGNHPFFTGTQKILDTEGRVDRFMKKYGMGQKKSGDKAKAEAKADAKS

SEQ ID NO: 67197 - DNA, 216 bp, Chromobacterium violaceum ATCC 12472
  CDS (1)..(216): transl_table=11
atgaaaaacgatattcacccgaactacaaagaactgtccgtgacctgctcctgcggtcaacagttcgtgaccaagtccaccatgggcaaagacgctttctcgatcgaagtgtgctccagctgccacccgttctacactggcaagcagaagatcgtggacaccgccggtcgcgtggacaagttcaaccagaagttcggcagcttcttcaagcgctaa

SEQ ID NO: 67198 - protein, 71 aa, Chromobacterium violaceum ATCC 12472
MKNDIHPNYKELSVTCSCGQQFVTKSTMGKDAFSIEVCSSCHPFYTGKQKIVDTAGRVDKFNQKFGSFFKR

SEQ ID NO: 67199 - DNA, 204 bp, Wolinella succinogenes DSM 1740
  CDS (1)..(204): transl_table=11
atgaaaaaaggtatccaccccaattatgtcccctgcaaagtgacttgcgtcaccagcggcaaagagtttgaagtgctcagcaccaagcctgagctaagaattgacatctcctctttctgccaccccttctatactggctctgataaagtggtcgataccgctggacgcgttgagaagttcaaacaaaaatacaatatgaaataa

SEQ ID NO: 67200 - protein, 67 aa, Wolinella succinogenes DSM 1740
MKKGIHPNYVPCKVTCVTSGKEFEVLSTKPELRIDISSFCHPFYTGSDKVVDTAGRVEKFKQKYNMK

SEQ ID NO: 67201 - DNA, 225 bp, Gloeobacter violaceus PCC 7421
  CDS (1)..(225): transl_table=11
atgcccaaggccggtattcatcctcgctacgaggaggcccgcatcgtctgtggttgcggtgccatttacgagacccgttccaccaaacccggcgtcaccaacgtcgagatttgcgccaactgccatcccttttttaccgggcagcagaaaatcgtcgacgccgagggccgcgtcgatcgcttcctcaagaagtacggcaatgtccagccccgcaccaagcgctaa

SEQ ID NO: 67202 - protein, 74 aa, Gloeobacter violaceus PCC 7421
MPKAGIHPRYEEARIVCGCGAIYETRSTKPGVTNVEICANCHPFFTGQQKIVDAEGRVDRFLKKYGNVQPRTKR

SEQ ID NO: 67203 - DNA, 216 bp, Photorhabdus luminescens subsp. laumondii TTO1
  CDS (1)..(216): transl_table=11
atgaaaaaaggtattcatcctaaatatgaagaaattactgcaacctgctcttgcggtagtgtaatacaagtcagatctaccgctggtcacgctctgaacctggacgtatgcggccaatgccacccattctatacgggtaaacaacgtgatgttgctactggtggtcgtgttgatcgcttcaagaaacgtttcaacgttccaggtgtcagcaagtaa

SEQ ID NO: 67204 - protein, 71 aa, Photorhabdus luminescens subsp. laumondii TTO1
MKKGIHPKYEEITATCSCGSVIQVRSTAGHALNLDVCGQCHPFYTGKQRDVATGGRVDRFKKRFNVPGVSK

SEQ ID NO: 67205 - DNA, 267 bp, Corynebacterium diphtheriae NCTC 13129
  CDS (1)..(267): transl_table=11
atgaagaaagatatccaccctgattaccacccagtggtattccaggatgcaggcactggccaccagttcctgaccaagtcaaccgctaccagtgaccgcacggttgcatgggaagatggcaacgagtacccattgatcgtcgttgacgtgaccagtgagtctcacccattctggaccggtgcacagcgtgtcatggacaccgcaggccgtgttgagaagttcaaccagcgttacggtgcactcgctcgccgtaagaagaacaagtaa

SEQ ID NO: 67206 - protein, 88 aa, Corynebacterium diphtheriae NCTC 13129
MKKDIHPDYHPVVFQDAGTGHQFLTKSTATSDRTVAWEDGNEYPLIVVDVTSESHPFWTGAQRVMDTAGRVEKFNQRYGALARRKKNK

SEQ ID NO: 67207 - DNA, 228 bp, Rhodopseudomonas palustris CGA009
  CDS (1)..(228): transl_table=11
atgaagaccgaaattcacccggactatcataccattaccgtcgtcatgaccgacgggaccgagtaccagacgcggtcgacctggggcaaagaaggcgacaagctgaacctcgacatcgacccgaagtcgcacccggcgtggaccggcggcacccagcaggtgctggaccgcggcggccgcgtgtcgcgcttccagaagaagttctcgggcttcctcaagaaggattga

SEQ ID NO: 67208 - protein, 75 aa, Rhodopseudomonas palustris CGA009
MKTEIHPDYHTITVVMTDGTEYQTRSTWGKEGDKLNLDIDPKSHPAWTGGTQQVLDRGGRVSRFQKKFSGFLKKD

SEQ ID NO: 67209 - DNA, 243 bp, Mycobacterium avium subsp. paratuberculosis str. k10
  CDS (1)..(243): transl_table=11
atgaaagctgacattcaccccacctacgcggagaccacggtgctctgtgggtgcggcaacacgttccagacccgcagcaccaaggacggtggccgcatcgtcgtcgaggtgtgctcgcagtgccacccgttctacaccggcaagcagaagatcctggacagcggcggccgggtggcccgtttcgagaagcgctacggcaagcgcaaggccggcgccgagaaagccgaaagcgccgacaaatag

SEQ ID NO: 67210 - protein, 80 aa, Mycobacterium avium subsp. paratuberculosis str. k10
MKADIHPTYAETTVLCGCGNTFQTRSTKDGGRIVVEVCSQCHPFYTGKQKILDSGGRVARFEKRYGKRKAGAEKAESADK

SEQ ID NO: 67211 - DNA, 252 bp, Lactobacillus johnsonii NCC 533
  CDS (1)..(252): transl_table=11
atgagaaaagggattcatccagattaccaagaagttgttttcatggactcagcaactggtgctaagttcgtagctggttctactttaaaaccagaagaaacaattgaattcgaaggtaagacttacccattagttcgtgttgaaatttcttcagattctcacccattctacactggcaagcaaaagtttgcacaagcagatggtcgtatcgaaaaattcaacaagaagtacggtatgtcttcaaagaactaa

SEQ ID NO: 67212 - protein, 83 aa, Lactobacillus johnsonii NCC 533
MRKGIHPDYQEVVFMDSATGAKFVAGSTLKPEETIEFEGKTYPLVRVEISSDSHPFYTGKQKFAQADGRIEKFNKKYGMSSKN

SEQ ID NO: 67213 - DNA, 246 bp, Bdellovibrio bacteriovorus HD100
  CDS (1)..(246): transl_table=11
atgaaacaaaacctacacccaaaagtaaatactgttgtatttaaagatatctcttgcgacttcagtttcttgggaacatctactctgcactcttccgaaactgttaaatgggaagatggtaaagaatatccactaatcaaagttgagatctcttctgcatctcacccgttcttcactggtaagcaacgtgtgatggatactgaaggtcgtatcgatcgtttcaaaaaacgttacggcaagaagtaa

SEQ ID NO: 67214 - protein, 81 aa, Bdellovibrio bacteriovorus HD100
MKQNLHPKVNTVVFKDISCDFSFLGTSTLHSSETVKWEDGKEYPLIKVEISSASHPFFTGKQRVMDTEGRIDRFKKRYGKK

SEQ ID NO: 67215 - DNA, 204 bp, Treponema denticola ATCC 35405
  CDS (1)..(204): transl_table=11
atgaaaaaagatattcatccgaaatacgaagaaacaaccgttacttgcgcttgcggaaacgtaataaatacgcgttctacagtaaaagatatcaaggttgaaatctgctctcagtgtcatcctttttttacgggaaaacaaaagcttgttgacactgcaggacgaattgatcgctttaagaaacgatacaatattaaagactaa

SEQ ID NO: 67216 - protein, 67 aa, Treponema denticola ATCC 35405
MKKDIHPKYEETTVTCACGNVINTRSTVKDIKVEICSQCHPFFTGKQKLVDTAGRIDRFKKRYNIKD

SEQ ID NO: 67217 - DNA, 279 bp, Mycoplasma mycoides subsp. mycoides SC str. PG1
  CDS (1)..(279): transl_table=4
atgccaaaaattgatattcaaccaaagtactttgatcaagctaaatttatttgtacaacatgtgcaagtgaatgagtttgtggaacttctaaaggtgaagaagtaagagttgatgtttgttcaaattgtcatcctttttatactggggctcaaacttatacaaacgttgctggtcgtgttgaacagtttaaatcaaaatttgctaaaagagatacaattaaagcacaagttgaaaaacaatctcaagttcaaaaagcaaaaaataaagaaaacaaataa

SEQ ID NO: 67218 - protein, 92 aa, Mycoplasma mycoides subsp. mycoides SC str. PG1
MPKIDIQPKYFDQAKFICTTCASEWVCGTSKGEEVRVDVCSNCHPFYTGAQTYTNVAGRVEQFKSKFAKRDTIKAQVEKQSQVQKAKNKENK

SEQ ID NO: 67219 - DNA, 216 bp, Desulfovibrio vulgaris subsp. vulgaris str. Hildenborough
  CDS (1)..(216): transl_table=11
atgaaggacaatatccatcctaccgtctacaaggccaccatgaactgcgcctgtggctatcaggccgaagtgctttccaccaagggcgagaacgtccacgtggaaatctgctccaactgccaccccttctacaccggcaagcagcgcctcatcgacaccgctggccgcatcgaccgcttccgcaagaagtacgccaagtttggcgaagagaaatag

SEQ ID NO: 67220 - protein, 71 aa, Desulfovibrio vulgaris subsp. vulgaris str. Hildenborough
MKDNIHPTVYKATMNCACGYQAEVLSTKGENVHVEICSNCHPFYTGKQRLIDTAGRIDRFRKKYAKFGEEK

SEQ ID NO: 67221 - DNA, 213 bp, Mycoplasma mobile 163K
  CDS (1)..(213): transl_table=4
atgaaaccaaatatccatccagaatataaaaatattactttaacatgttcaacgtgtgaaaaaaagcatatttttggttctacagcaaaaaaatctagtgttgatgtttgctctaattgtcatcctttctttacaggtgatcgttcaatccaaagaacaacaggaagagttgatcgtttcaatcgtcgtttaacaaaatctgctgaaaaataa

SEQ ID NO: 67222 - protein, 70 aa, Mycoplasma mobile 163K
MKPNIHPEYKNITLTCSTCEKKHIFGSTAKKSSVDVCSNCHPFFTGDRSIQRTTGRVDRFNRRLTKSAEK

SEQ ID NO: 67223 - DNA, 222 bp, Bartonella henselae str. Houston-1
  CDS (1)..(222): transl_table=11
atgaaagccaatattcatcccgactatcacaagattaccgttgttatgacggatggctcccaatatacgacacgttctacctggggaaaagaaggggatgttcttaatttggacattgatccaagaacgcatccagcttggacaggtggatctcaaacattggttgaccatggtggtcgtatttctaaatttaaaaatcgttttggtaatttgggcatgtaa

SEQ ID NO: 67224 - protein, 73 aa, Bartonella henselae str. Houston-1
MKANIHPDYHKITVVMTDGSQYTTRSTWGKEGDVLNLDIDPRTHPAWTGGSQTLVDHGGRISKFKNRFGNLGM

SEQ ID NO: 67225 - DNA, 249 bp, Acinetobacter sp. ADP1
  CDS (1)..(249): transl_table=11
atgagacaaggtatccatccagagtatcaacaagttttgttccacgataccaatgcagacgcgtattttattattggtagtaccatccaaaccaaacaaacacgtgaatacgaaggtaaggtttatccttacgtcacacttgatatctcaagtgcatcgcatccgttttacactggtgaagtacgtcaagcaagcaatgaaggtcgtgttgccacattcaataaacgctttagccgtttcaaacgttaa

SEQ ID NO: 67226 - protein, 82 aa, Acinetobacter sp. ADP1
MRQGIHPEYQQVLFHDTNADAYFIIGSTIQTKQTREYEGKVYPYVTLDISSASHPFYTGEVRQASNEGRVATFNKRFSRFKR

SEQ ID NO: 67227 - DNA, 225 bp, Acinetobacter sp. ADP1
  CDS (1)..(225): transl_table=11
atgcgcgccgatattcacccaaaatatcaaactttagttgctacttgctcatgcggcaacgtaatcgaaactcgctctgctttaggtaaagaaactctttatcttgacgtatgttcagcttgccacccattctatactggtaaacaaaagaatgtagatactggtggtcgtatcgacaaattcaagcaacgcttttctggtatgtcacgttctatcaaacgttaa

SEQ ID NO: 67228 - protein, 74 aa, Acinetobacter sp. ADP1
MRADIHPKYQTLVATCSCGNVIETRSALGKETLYLDVCSACHPFYTGKQKNVDTGGRIDKFKQRFSGMSRSIKR

SEQ ID NO: 67229 - DNA, 216 bp, Erwinia carotovora subsp. atroseptica SCRI1043
  CDS (1)..(216)
atgaaaaaaggtattcacccgaattattctgaagttactgtaacttgctcttgcggtaacgtgatcaaaacccattctaccgtgggtcgtgacctgaacctggacgtttgtggcgaatgccacccgttctacaccggcaaacaacgtgatgttgcaagcggtggccgtgttgaccgcttcaacaagcgtttctccgtaccaggcgctaaaaaataa

SEQ ID NO: 67230 - protein, 71 aa, Erwinia carotovora subsp. atroseptica SCRI1043
MKKGIHPNYSEVTVTCSCGNVIKTHSTVGRDLNLDVCGECHPFYTGKQRDVASGGRVDRFNKRFSVPGAKK

SEQ ID NO: 67231 - DNA, 279 bp, Mesoplasma florum L1
  CDS (1)..(279): transl_table=4
atgccaaaaaaagatattcaaccaaaatacttcgaggaagcaaaatttatttgtacaacatgtgctaatgaattcatttgtggaactacaaaaagagaagaaatgagaattgacgtttgttcaaattgtcacccattcttttcaggtgcacaaaactttgcaaacactacaggtcgtgttgaacaatttaaatcaaaatttgctagaaaagaagctattaacgcaactgctcaaaaaaattctgaagatcaaaaatcaaaaaacaaagaaaataaataa

SEQ ID NO: 67232 - protein, 92 aa, Mesoplasma florum L1
MPKKDIQPKYFEEAKFICTTCANEFICGTTKREEMRIDVCSNCHPFFSGAQNFANTTGRVEQFKSKFARKEAINATAQKNSEDQKSKNKENK

SEQ ID NO: 67233 - DNA, 210 bp, Propionibacterium acnes KPA171202
  CDS (1)..(210): transl_table=11
atgaagcagggaatccatcccgattaccgcgagacgaccgtggtgtgcacctgtgggaacaccttcactacccgcagcacttcgcagtctggcacccttaatgctgacgtctgctcgaagtgccacccgttttataccggcaagcagaagattcttgacgctggtggccgcgttgcccggttcgagcgccgctatggcaaaaagaactga

SEQ ID NO: 67234 - protein, 69 aa, Propionibacterium acnes KPA171202
MKQGIHPDYRETTVVCTCGNTFTTRSTSQSGTLNADVCSKCHPFYTGKQKILDAGGRVARFERRYGKKN

SEQ ID NO: 67235 - DNA, 246 bp, Propionibacterium acnes KPA171202
  CDS (1)..(246): transl_table=11
atgaagcaaggcatccaccccgactaccacccggtggtcttcagagacatctcggcggacacggcttttctgacgaggtcaacggtcaccagttccaccgagatcaagtggcaggacggcaatacttaccccgtcatcgacgtcgacatcacctcggccagccacccgttctatacaggcaaggccaagattgtcgacaccgccggacgagttgagaagttcaaccggcgttacggcaagaaatga

SEQ ID NO: 67236 - protein, 81 aa, Propionibacterium acnes KPA171202
MKQGIHPDYHPVVFRDISADTAFLTRSTVTSSTEIKWQDGNTYPVIDVDITSASHPFYTGKAKIVDTAGRVEKFNRRYGKK

SEQ ID NO: 67237 - DNA, 252 bp, Leifsonia xyli subsp. xyli str. CTCB07
  CDS (1)..(252): transl_table=11
atgaagactggcatccaccccgactacgcccccgtggttttccgcgacctggcctcgggcgcgaccttcctcacccgttcgaccgtttccagccagaagacgatcgagtgggaggacggcagcacatacccggtcatcgacgtcgagatctcctccgagtcgcacccgttctacaccggtaagcagcgcatcctcgactccgctggccgggtcgagaaattcaacacccgctacaagaacttcggcaaataa

SEQ ID NO: 67238 - protein, 83 aa, Leifsonia xyli subsp. xyli str. CTCB07
MKTGIHPDYAPVVFRDLASGATFLTRSTVSSQKTIEWEDGSTYPVIDVEISSESHPFYTGKQRILDSAGRVEKFNTRYKNFGK

SEQ ID NO: 67239 - DNA, 240 bp, Gracilaria tenuistipitata var. liui
  CDS (1)..(240): transl_table=11
atgactcaaaaaagtatacatccaaagtggtttaatgatactaaagtgtattgcgatggaaaacatgtaatgacagtaggttcaactcaagccgaactacatgtagatatatggtcaggaaatcatccctttttcacaggatcacaaagaattatagatactgaaggaagagtagaaaaattcatgcgtaaatacaatttacaatccaataatgacaagcaatctaaattagaggtttaa

SEQ ID NO: 67240 - protein, 79 aa, Gracilaria tenuistipitata var. liui
MTQKSIHPKWFNDTKVYCDGKHVMTVGSTQAELHVDIWSGNHPFFTGSQRIIDTEGRVEKFMRKYNLQSNNDKQSKLEV

SEQ ID NO: 67241 - DNA, 222 bp, Desulfotalea psychrophila LSv54
  CDS (1)..(222): transl_table=11
atgagaaaagatatacatccagaatatcacaagattaacgcggtttgtgcctgtggcaacgaagtagaacttggttctgttgagacagagatgaaggtagagatttgttctgcttgtcaccctttcttcaccggaaagcaaaagcttattgatacagcaggacgtatcgagaagttcaagcaacgttatgcaaagcatttcgagaagaaagccgaagcataa

SEQ ID NO: 67242 - protein, 73 aa, Desulfotalea psychrophila LSv54
MRKDIHPEYHKINAVCACGNEVELGSVETEMKVEICSACHPFFTGKQKLIDTAGRIEKFKQRYAKHFEKKAEA

SEQ ID NO: 67243 - DNA, 246 bp, Borrelia garinii PBi
  CDS (1)..(246): transl_table=11
atgagaaaaggtgtacatcctaaaaataacttagttgtatttaaagacggatcaaatggagcaatgtttttaaccaggtctactttgaattcaaaggaaactattaaatatactgatggaaaggaatatccattgattactgtggagattacaagtagatcacatcctttttatactggtcaacaaaagtttgttgatgcagcaggaagaattgataaatttaataaaaggtataaaaagtcctaa

SEQ ID NO: 67244 - protein, 81 aa, Borrelia garinii PBi
MRKGVHPKNNLVVFKDGSNGAMFLTRSTLNSKETIKYTDGKEYPLITVEITSRSHPFYTGQQKFVDAAGRIDKFNKRYKKS

SEQ ID NO: 67245 - DNA, 210 bp, Symbiobacterium thermophilum IAM 14863
  CDS (1)..(210): transl_table=11
ttgctgatgaaggctggcatccatccgaagacccagaagaccaccatcacctgcggttgcggggcgacctacgaggtcctctcgaccaaggagaacatccgcgtggagatctgcgcgaactgccatccgttctacacgggttcccgcggggccacgcgcgtggaggccggttcccggatcgaccggttccgcaagaagtacggtcggtag

SEQ ID NO: 67246 - protein, 69 aa, Symbiobacterium thermophilum IAM 14863
MLMKAGIHPKTQKTTITCGCGATYEVLSTKENIRVEICANCHPFYTGSRGATRVEAGSRIDRFRKKYGR

SEQ ID NO: 67247 - DNA, 228 bp, Mannheimia succiniciproducens MBEL55E
  CDS (1)..(228): transl_table=11
ttgaggttttctatgaaacaaggtattcatcctgaatataaagaaattactgttacttgttcttgcggtaacgtaatcaaaacccgctctacagcaggtcacgatatcaacctagacgtgtgcggcaactgccacccgttctacactggtaaacaacgtgttgttgataccggtggtcgtgttgaacgtttcaacaaacgtttctctattccaggttcaaaaaaataa

SEQ ID NO: 67248 - protein, 75 aa, Mannheimia succiniciproducens MBEL55E
MRFSMKQGIHPEYKEITVTCSCGNVIKTRSTAGHDINLDVCGNCHPFYTGKQRVVDTGGRVERFNKRFSIPGSKK

SEQ ID NO: 67249 - DNA, 201 bp, Bacillus licheniformis ATCC 14580
  CDS (1)..(201): transl_table=11
atgaaagcaggaattcatcctgagttcaaaaaagcaacagtcaaatgcgcttgtggaaacgaatttgaaacaggttcagtaaaagaagaggtacgcgttgagatttgttctgaatgccatccgttctacactggccgccaaaaattcgcttctgctgatggtcgtgttgatcgctttaacaaaaaatacggtcttaagtaa

SEQ ID NO: 67250 - protein, 66 aa, Bacillus licheniformis ATCC 14580
MKAGIHPEFKKATVKCACGNEFETGSVKEEVRVEICSECHPFYTGRQKFASADGRVDRFNKKYGLK

SEQ ID NO: 67251 - DNA, 228 bp, Legionella pneumophila subsp. pneumophila str. Philadelphia 1
  CDS (1)..(228): transl_table=11
atgaaagcatcagttcatcctgattatcaaacagttaaagtaacatgcagctgtggtgaagtatttgaaactcgttctactttgtgtaaagatttgaacatagaagtttgttcaatgtgccatcctttttatacaggaaaacaaaagttggttgatactggtggccgtgttcagaaattccgtgacaggtataatatgcgtactgggcaagccaaatcaaaagaataa

SEQ ID NO: 67252 - protein, 75 aa, Legionella pneumophila subsp. pneumophila str. Philadelphia 1
MKASVHPDYQTVKVTCSCGEVFETRSTLCKDLNIEVCSMCHPFYTGKQKLVDTGGRVQKFRDRYNMRTGQAKSKE

SEQ ID NO: 67253 - DNA, 204 bp, Methylococcus capsulatus str. Bath
  CDS (1)..(204): transl_table=11
atgaagccagacattcatcccgactatacgacggtgaccgtaagctgcagttgcggaaacacctttgaaacccgatctacgatcggcaaggatttccacgtcgaagtctgctcggcctgtcacccattctatacgggtaagcagaagatcgtcgataccgcgggccgcgtcgacaaattccgccgcaaatacggccgcggctga

SEQ ID NO: 67254 - protein, 67 aa, Methylococcus capsulatus str. Bath
MKPDIHPDYTTVTVSCSCGNTFETRSTIGKDFHVEVCSACHPFYTGKQKIVDTAGRVDKFRRKYGRG

SEQ ID NO: 67255 - DNA, 231 bp, Nocardia farcinica IFM 10152
  CDS (1)..(231): transl_table=11
atgaaggcaggaatccacccggcctacgtcgacaccaccgtcgtctgtggctgcggcaacaccttccagactcgcagcaccaaggagtccggccacatcaccgtcgaggtctgctcgcagtgccacccgttctacacgggcaagcagaagatcctggacaccggtggtcgcgtggcccgcttcgaggcccgctacggcaagcgtgccggcaagaaggccgacgccaagtag

SEQ ID NO: 67256 - protein, 76 aa, Nocardia farcinica IFM 10152
MKAGIHPAYVDTTVVCGCGNTFQTRSTKESGHITVEVCSQCHPFYTGKQKILDTGGRVARFEARYGKRAGKKADAK

SEQ ID NO: 67257 - DNA, 213 bp, Photobacterium profundum SS9
  CDS (1)..(213): transl_table=11
atgaaacaaggtatccacccagattacagtgcaacgaacgctcgttgttcttgcggcaacacatttatttttcagtctactatgactaaagatgtaaaccttgacgtgtgtgacaaatgtcacccattttacactggtaagcaacgtcaagctagctctggtggtcgtgttgataagttcaacaaacgtttcggtgctcttggtagcaagtaa

SEQ ID NO: 67258 - protein, 70 aa, Photobacterium profundum SS9
MKQGIHPDYSATNARCSCGNTFIFQSTMTKDVNLDVCDKCHPFYTGKQRQASSGGRVDKFNKRFGALGSK

SEQ ID NO: 67259 - DNA, 216 bp, Thermus thermophilus HB8
  CDS (1)..(216): transl_table=11
gtgaaggaaggcatccatcccaagttggttcccgcccgcatcatctgcggttgcggcaacgtcattgagacctactccaccaagcccgagatctacgtggaggtctgctccaagtgccaccccttctacacggggcagcagcgcttcgtggacaccgaggggcgggtggagcggttccagcggcgctacggcgactcttaccgcaaggggcgctag

SEQ ID NO: 67260 - protein, 71 aa, Thermus thermophilus HB8
MKEGIHPKLVPARIICGCGNVIETYSTKPEIYVEVCSKCHPFYTGQQRFVDTEGRVERFQRRYGDSYRKGR

SEQ ID NO: 67261 - DNA, 261 bp, Salmonella enterica subsp. enterica serovar Paratypi A str. ATCC
  CDS (1)..(261): transl_table=11
atgaaacctgatattcatcctgtataccgcaccgtcgtatttcacgacaccagcgcaaatgaatatgtgaaagtgggatcaactatcaaaactgaacgtgaaatcgaactgggcggcgtgacatatccgtatgtcactattgatgtgtcatcaaaatcgcatcctttttataccggtagacagaaaacgtttgatagcgaaagtagcgccgcacgcttccagaaacgttttggtcattttatcggcgctaaacgggggtaa

SEQ ID NO: 67262 - protein, 86 aa, Salmonella enterica subsp. enterica serovar Paratypi A str. ATCC
MKPDIHPVYRTVVFHDTSANEYVKVGSTIKTEREIELGGVTYPYVTIDVSSKSHPFYTGRQKTFDSESSAARFQKRFGHFIGAKRG

SEQ ID NO: 67263 - DNA, 219 bp, Idiomarina loihiensis L2TR
  CDS (1)..(219): transl_table=11
atgaaacaaggtattcatcctaagtacgagactttaaaagtcagctgttcttgcggtcacacgttcgaaacgcgttcaacccgctcagaagatcttcacctggacgtctgttcagagtgccacccgttctacactggtaagcaacgtgtaatggacactggtggtcgtgttgataaatttaagaagcgttttggtgctctgggcaagaaagactcctaa

SEQ ID NO: 67264 - protein, 72 aa, Idiomarina loihiensis L2TR
MKQGIHPKYETLKVSCSCGHTFETRSTRSEDLHLDVCSECHPFYTGKQRVMDTGGRVDKFKKRFGALGKKDS

SEQ ID NO: 67265 - DNA, 219 bp, Azoarcus sp. EbN1
  CDS (1)..(219): transl_table=11
atgaaagcggacatccatcccaaatacgccgaagtccaggtgacctgctcctgcggcaacaccttcgagacgcgctcgacgctcggcaagcctgcgctgcacgtcgaagtgtgtgcggcctgccacccgttctacacgggcaagcagaagatcgtcgacaccgccggtcgtgtcgaacgtttccgccaaaaatacggcaacgttcagcgcctcggctga

SEQ ID NO: 67266 - protein, 72 aa, Azoarcus sp. EbN1
MKADIHPKYAEVQVTCSCGNTFETRSTLGKPALHVEVCAACHPFYTGKQKIVDTAGRVERFRQKYGNVQRLG

SEQ ID NO: 67267 - DNA, 228 bp, Zymomonas mobilis subsp. mobilis ZM4
  CDS (1)..(228): transl_table=11
atgaagcagaatattcatcctgattatcactttatcaaggttcagttgacggacggtaccgtattcgaaacccgttctacctggggtaaagaaggcgacaccatgaagctggatattgatccgcgcgttcatccggcatggactggtggtcgttcacagttggttgatgctggtggccaggttgcccgctttaacaagcgtttcggcgctctgttgaaaaagaaataa

SEQ ID NO: 67268 - protein, 75 aa, Zymomonas mobilis subsp. mobilis ZM4
MKQNIHPDYHFIKVQLTDGTVFETRSTWGKEGDTMKLDIDPRVHPAWTGGRSQLVDAGGQVARFNKRFGALLKKK

SEQ ID NO: 67269 - DNA, 216 bp, Francisella tularensis subsp. tularensis Schu 4
  CDS (1)..(216): transl_table=11
atgagacaagaaattcaccctaaatatacagaagtaactgtaacttgtagctgtggcaatactttcgttacaagatcaacagctggaaaaaaagaaatgaacatcgatatctgttcagaatgtcacccattctatactggtaagcaaagaatcgttgacactgctggacgtgttgataagttcaagaagagatttggcggcatgaaaaaaatataa

SEQ ID NO: 67270 - protein, 71 aa, Francisella tularensis subsp. tularensis Schu 4
MRQEIHPKYTEVTVTCSCGNTFVTRSTAGKKEMNIDICSECHPFYTGKQRIVDTAGRVDKFKKRFGGMKKI

SEQ ID NO: 67271 - DNA, 234 bp, Synechococcus elongatus PCC 6301
  CDS (1)..(234): transl_table=11
atgccaaaagctgatattcatccgcagtggtatcccgaagccaaggtctactgcaacggtgaagaagtgatgaccgtgggctcgacccaaccagaactccatgtggatgtctggtcgggcaaccaccccttctacaccggcacgcaaaagatcatcgacaccgaaggtcgggtcgaacgcttcttgcgcaaatacggcatgctcgaaggcgaccaagccaagagcgaagcttaa

SEQ ID NO: 67272 - protein, 77 aa, Synechococcus elongatus PCC 6301
MPKADIHPQWYPEAKVYCNGEEVMTVGSTQPELHVDVWSGNHPFYTGTQKIIDTEGRVERFLRKYGMLEGDQAKSEA

SEQ ID NO: 67273 - DNA, 243 bp, Bacillus clausii KSM-K16
  CDS (1)..(243): transl_table=11
atgaaaccagaaatccatccaacttaccaaaaagttgtatttatggatacaagcacgggctttaaatttttgactggttcgactcgcggttctagcgaaacgatcgaatgggaagacggcaatacgtatccgttgattaaagtcgaaatttcttctgattcccacccattctatacaggcaaacaaaaacttgccgatgcaggtggccgtgtcgatcgcttcaaaaagaaatacaatctttaa

SEQ ID NO: 67274 - protein, 80 aa, Bacillus clausii KSM-K16
MKPEIHPTYQKVVFMDTSTGFKFLTGSTRGSSETIEWEDGNTYPLIKVEISSDSHPFYTGKQKLADAGGRVDRFKKKYNL

SEQ ID NO: 67275 - DNA, 207 bp, Dehalococcoides ethenogenes 195
  CDS (1)..(207): transl_table=11
atgaaggaaaaaatacaccctaaatataataccgccaccaacgtaagctgtgcctgcggcaacacttttacagtgggttctaccaaagacagcatcaaggtagagctttgtgcccagtgccaccccttctacaccggtgagaaaagaatggttgacaccgccggacgggtggagaaattccgccagcgttacggcaacaaaacctaa

SEQ ID NO: 67276 - protein, 68 aa, Dehalococcoides ethenogenes 195
MKEKIHPKYNTATNVSCACGNTFTVGSTKDSIKVELCAQCHPFYTGEKRMVDTAGRVEKFRQRYGNKT

SEQ ID NO: 67277 - DNA, 222 bp, Rhodobacter sphaeroides 2.4.1
  CDS (1)..(222)
atgaaaaagggcatccaccccgactaccacatgatcgacgtcaagatgacggacggcaccgtgttccagatccgctccacctggggcaaggaaggcgaacagatggcgctcgagatcgacccgctcgcccacccggcctggaccggcggcaccgccaagctgatggacaccgggggccgcgtgtcgaagttcaagaacaaatacgcgggcctcggcttctga

SEQ ID NO: 67278 - protein, 73 aa, Rhodobacter sphaeroides 2.4.1
MKKGIHPDYHMIDVKMTDGTVFQIRSTWGKEGEQMALEIDPLAHPAWTGGTAKLMDTGGRVSKFKNKYAGLGF

SEQ ID NO: 67279 - DNA, 255 bp, Magnetospirillum magnetotacticum MS-1
  CDS (1)..(255)
atggcaaagaacgagtccgccaaggccaaggggaccgagcaccccgactaccacttcatcaaggtcgtgatgaccgatggcaccgagtacaagacccggtcgacctacggcaaggaaggcgacgtcctgaacctggacatcgacccgacgacccacccggcctggaccggcggcgagcagaagatgctcgatcgcggcggtcgcgtctcgcgcttcaacagccgcttcggtggtctgggcttcggcaagaagtaa

SEQ ID NO: 67280 - protein, 84 aa, Magnetospirillum magnetotacticum MS-1
MAKNESAKAKGTEHPDYHFIKVVMTDGTEYKTRSTYGKEGDVLNLDIDPTTHPAWTGGEQKMLDRGGRVSRFNSRFGGLGFGKK

SEQ ID NO: 67281 - DNA, 234 bp, Magnetospirillum magnetotacticum MS-1
  CDS (1)..(234)
atgaaggacaacattcatcccgactaccacgagatcaacgtggtgatgacggacggcaccgagtacaagacccggtccaccctgggtaaggctggcgacaccctgcgcctggacatcgaccccaagtcgcacccggcctggaccggcgtgcaccgtatggtcgatacggccggtcagcttgccaagttcaagaagcgcttcgacggtttcggcatcaagtccgacaattcctaa

SEQ ID NO: 67282 - protein, 77 aa, Magnetospirillum magnetotacticum MS-1
MKDNIHPDYHEINVVMTDGTEYKTRSTLGKAGDTLRLDIDPKSHPAWTGVHRMVDTAGQLAKFKKRFDGFGIKSDNS

SEQ ID NO: 67283 - DNA, 267 bp, Leuconostoc mesenteroides subsp. mesenteroides ATCC 8293
  CDS (1)..(267)
atgcaagcagaaatccacccagattatcgtcaagttgttttcattgatgcttcaacaggaaagaagttcttgtcagcttcaactgtaacatcaaatgacacaactgattttgaaggtaaagaatatccagcaattcgtatggatattacatctgattcacacccattctacacaggtaagcaaaagtttacgcaagccgatggtgcggtcgacaagttcaacaagaagtttgctggatttggtttcaagaacaacgaagacaagtaa

SEQ ID NO: 67284 - protein, 88 aa, Leuconostoc mesenteroides subsp. mesenteroides ATCC 8293
MQAEIHPDYRQVVFIDASTGKKFLSASTVTSNDTTDFEGKEYPAIRMDITSDSHPFYTGKQKFTQADGAVDKFNKKFAGFGFKNNEDK

SEQ ID NO: 67285 - DNA, 213 bp, Azotobacter vinelandii
  CDS (1)..(213)
atgaaagccgatatccatccgaattacgtcgagatcgaggcgacctgcagctgcgggaacgtgatcaagacccgttccaccctgggcaagaacatcagcatcgatgtgtgctccgagtgccacccgttctataccggcaagcagaaggtgctcgacaccggcggccgtatcgaccgcttcaagcagcgtttcggtgtgttcggctccaagtga

SEQ ID NO: 67286 - protein, 70 aa, Azotobacter vinelandii
MKADIHPNYVEIEATCSCGNVIKTRSTLGKNISIDVCSECHPFYTGKQKVLDTGGRIDRFKQRFGVFGSK

SEQ ID NO: 67287 - DNA, 222 bp, Pseudomonas syringae pv. syringae B728a
  CDS (1)..(222)
atgaaagctgatatccatccagtttacgaagccattgacgctacctgcagctgcggcaatgtcatcaagacccgttccaccctggccgctcctctgagcctggacgtgtgcaacgagtgccacccgttctacactggcaagcagaagatgcttgacgttggcggccgtgtcgacaagttcaaatcccgtttcggtgcgttcggcgcaaccaaagcgaagtaa

SEQ ID NO: 67288 - protein, 73 aa, Pseudomonas syringae pv. syringae B728a
MKADIHPVYEAIDATCSCGNVIKTRSTLAAPLSLDVCNECHPFYTGKQKMLDVGGRVDKFKSRFGAFGATKAK

SEQ ID NO: 67289 - DNA, 327 bp, Pseudomonas syringae pv. syringae B728a
  CDS (1)..(327)
atgttactgtataactattccagtcaactcaccggagagatcacgatgaaacccgatatccatcctcaataccgcaccgtgctgttccacgacaccgctgccgacgcctactttcttatcggctcgaccgtagacacggaccgcacgcaacagcacaccgacggcactacctatccttatgttgcgctcgacgtttccagtgcctcgcacccgatgtacaccgggcagcagcgcaaggccaccaccgaaggccggatcgcgggtttcaacaagcgtttcgccacctttggctctgctggcaagaaagaaaccgcagccgctcaatga

SEQ ID NO: 67290 - protein, 108 aa, Pseudomonas syringae pv. syringae B728a
MLLYNYSSQLTGEITMKPDIHPQYRTVLFHDTAADAYFLIGSTVDTDRTQQHTDGTTYPYVALDVSSASHPMYTGQQRKATTEGRIAGFNKRFATFGSAGKKETAAAQ

SEQ ID NO: 67291 - DNA, 210 bp, Desulfovibrio desulfuricans G20
  CDS (1)..(210)
atgaaagacaatatccatcccaccgtgtacaaggccaaactcgtatgcgcctgcggcaacgaaatcgacaccacctccaccaagggtgaagtggtaaacgtggaaatctgctccagctgccacccgttctacaccggcaagcagcgctttgtggacaccgccggccgtattgaccgtttccgcaaaaaatacgccaagttcagcaagtag

SEQ ID NO: 67292 - protein, 69 aa, Desulfovibrio desulfuricans G20
MKDNIHPTVYKAKLVCACGNEIDTTSTKGEVVNVEICSSCHPFYTGKQRFVDTAGRIDRFRKKYAKFSK

SEQ ID NO: 67293 - DNA, 213 bp, Haemophilus somnus 2336
  CDS (1)..(213)
atgaaacaaggtattcaccctgaatataaagaaattactgcgacgtgttcttgcggtaacgtaattaaaactcgttcaacagtgggtaaaaatttgaacttggacgtatgtagcaactgccatcctttctatactggtaaacaacgtgttgttgataccggcggtcgtgtagaacgtttcaacaagcgtttcagcattccaagctcaaaataa

SEQ ID NO: 67294 - protein, 70 aa, Haemophilus somnus 2336
MKQGIHPEYKEITATCSCGNVIKTRSTVGKNLNLDVCSNCHPFYTGKQRVVDTGGRVERFNKRFSIPSSK

SEQ ID NO: 67295 - DNA, 213 bp, Actinobacillus pleuropneumoniae serovar 1 str. 4074
  CDS (1)..(213)
atgaaacaaggtattcacccagaatatacagaaattactgcaacatgttcatgcggtaacgtaatcaaaactcgctcaacagtgggtaaaaacttaaatcttgatgtgtgcggcaactgccacccattctatactggtaaacaacgtgttgttgataccggtggtcgtgttgaacgtttcaataaacgtttctcaatcccaagcacaaaataa

SEQ ID NO: 67296 - protein, 70 aa, Actinobacillus pleuropneumoniae serovar 1 str. 4074
MKQGIHPEYTEITATCSCGNVIKTRSTVGKNLNLDVCGNCHPFYTGKQRVVDTGGRVERFNKRFSIPSTK

SEQ ID NO: 67297 - DNA, 387 bp, Psychrobacter sp. 273-4
  CDS (1)..(387)
atgtccttagtgcctcagttacgtatgtcatcgtttgctgaacgcatcgttaaaaatgctgttttgcaaaggcgttatacatacatcggacatagagagtttattatgcgtaaagatatccatcctaattaccaagaagttttgtttcacgacactaacgctgacgtgttcttcttgactcgttcaactgttaaaaccaaaaccactcgtgaatacgaaggttcagaatatccatactacccacttgatatctcaagtgcgtcgcatccattctatactggcgagcaacgtaaaacttctactgaaggccgtgttgcaagcttcaacaaacgctttggtgcgtttggtggccgtaagaaagctgctgatactgacgctgcagaataa

SEQ ID NO: 67298 - protein, 128 aa, Psychrobacter sp. 273-4
MSLVPQLRMSSFAERIVKNAVLQRRYTYIGHREFIMRKDIHPNYQEVLFHDTNADVFFLTRSTVKTKTTREYEGSEYPYYPLDISSASHPFYTGEQRKTSTEGRVASFNKRFGAFGGRKKAADTDAAE

SEQ ID NO: 67299 - DNA, 240 bp, Anabaena variabilis ATCC 29413
  CDS (1)..(240)
atggctaaatctgatattcatcccaagtggtatccagaagcaaaagtctactgcaatggtcaagttgtgatgaccgttggttctacaaaaccagaattacacgtagatgtttggtctggcaaccacccattttatactggtactcagaaaattattgataccgagggtcgcgtagaacgcttcctgcgtaagtatggcatgagcagcactcaaacttctggcgaacaaaataaaaagtag

SEQ ID NO: 67300 - protein, 79 aa, Anabaena variabilis ATCC 29413
MAKSDIHPKWYPEAKVYCNGQVVMTVGSTKPELHVDVWSGNHPFYTGTQKIIDTEGRVERFLRKYGMSSTQTSGEQNKK

SEQ ID NO: 67301 - DNA, 261 bp, Ralstonia eutropha JMP134
  CDS (1)..(261)
atgaaagaaggcatccacccgaattaccgcgaagtcgtgttccaggacatgtcctgcgacttcagcttcattacgcgttcgaccatccagaccaaagacacgatcgtgaaggacggcaaggaatacccgctggccaagatcgaagtctcgtcggaatcgcacccgttctacaccggcacccagaagatcatggacacggccggccgcgtcgagaagttccgccagaagttcggcagcaagctgggcaaggttgcgaagtaa

SEQ ID NO: 67302 - protein, 86 aa, Ralstonia eutropha JMP134
MKEGIHPNYREVVFQDMSCDFSFITRSTIQTKDTIVKDGKEYPLAKIEVSSESHPFYTGTQKIMDTAGRVEKFRQKFGSKLGKVAK

SEQ ID NO: 67303 - DNA, 255 bp, Crocosphaera watsonii WH 8501
  CDS (1)..(255)
atggcaaaagctgagattcatccgacttggtatcctgaagcaaaggttatttgtaacggagaagtagttctgactgtgggatcgactcaacctgagattcatgttgaagtttggtctggtaatcatcctttctacaccggaacccagaagattattgatacagagggacgggttgatcgtttccaaaaacgttacgctatgattggcaaaaaaagcaagaaaaaagcagccgaaacagatgcttccgaaaaatag

SEQ ID NO: 67304 - protein, 84 aa, Crocosphaera watsonii WH 8501
MAKAEIHPTWYPEAKVICNGEVVLTVGSTQPEIHVEVWSGNHPFYTGTQKIIDTEGRVDRFQKRYAMIGKKSKKKAAETDASEK

SEQ ID NO: 67305 - DNA, 222 bp, Mesorhizobium sp. BNC1
  CDS (1)..(222)
atgaaagccgacatccatcccgactatcacatgatcaaggtcgtcatgacggacggcaccgaatacgagacgcgctcgacctggggcaaggaaggcgacacgctcaacctcgacatcgaccccaattcgcatccggcatggaccggcggccagcagacgctcgttgaccgcggcggccggttgtcgaagttcaagaagcgttacgaaggcttgggcatctaa

SEQ ID NO: 67306 - protein, 73 aa, Mesorhizobium sp. BNC1
MKADIHPDYHMIKVVMTDGTEYETRSTWGKEGDTLNLDIDPNSHPAWTGGQQTLVDRGGRLSKFKKRYEGLGI

SEQ ID NO: 67307 - DNA, 270 bp, Rubrobacter xylanophilus DSM 9941
  CDS (1)..(270)
atgaagaagggcatacatcccgagtaccggccggtggtcttccgggacgccggcgcggatttcgccttcctgacccgctcgacggtggagacgaacaagaccatcgagtgggaggacggcaacacctacccgctggtggagctggacatctccagcgccagccacccgttctacaccgggaggcagcggatcgtggacaccggcggccgggtgcagaggttcgagagccgccggcgccggcggcagcagcagagcggcgagcagggctag

SEQ ID NO: 67308 - protein, 89 aa, Rubrobacter xylanophilus DSM 9941
MKKGIHPEYRPVVFRDAGADFAFLTRSTVETNKTIEWEDGNTYPLVELDISSASHPFYTGRQRIVDTGGRVQRFESRRRRRQQQSGEQG

SEQ ID NO: 67309 - DNA, 264 bp, Burkholderia cepacia R1808
  CDS (1)..(264)
atgaaacctggcattcacccggactaccgcgaagtcgtcttccaagacatgtcgaacggcttcaagttcatcacgcgctcgacgatccagacgcgtgaaaccatcgaccacgaaggcaagacctacccgctcgccaagatcgaagtgtcgtcggaatcgcactcgttctacaccggccagcagaagatcatggacacggcaggtcgtgtcgagaagttcaagaacaagttcggcgcacgcgccagcggcaaggtcgcgaagtaa

SEQ ID NO: 67310 - protein, 87 aa, Burkholderia cepacia R1808
MKPGIHPDYREVVFQDMSNGFKFITRSTIQTRETIDHEGKTYPLAKIEVSSESHSFYTGQQKIMDTAGRVEKFKNKFGARASGKVAK

SEQ ID NO: 67311 - DNA, 219 bp, Rhodospirillum rubrum
  CDS (1)..(219)
atgaagaaagacattcacccggactatcacgacatcaccgtcgtgatgaccgatggcagcgagttcgttactcgctccacctacaagggcgagagcctgcgtcttgacatcgatccgaagtcccatccggcttggaccggtgtgcaccgcctgatcgacagcggtgggcagcttgccaagttcaacaagaagttcgccggtttcggcctgaagaagtaa

SEQ ID NO: 67312 - protein, 72 aa, Rhodospirillum rubrum
MKKDIHPDYHDITVVMTDGSEFVTRSTYKGESLRLDIDPKSHPAWTGVHRLIDSGGQLAKFNKKFAGFGLKK

SEQ ID NO: 67313 - DNA, 210 bp, Magnetococcus sp. MC-1
  CDS (1)..(210)
atgaaagaaggcatccaccccaagtatgaagaggccacttttacgtgtgccagctgctctaacgaaatcaagacccgctccacagccggcgacctcaccctgggtatctgctcagagtgtcatccgttttataccggtaagcataagttggtggataccgccggtcgtgttgagcgcttccgccgtaaatatggtatgcaagaccagtaa

SEQ ID NO: 67314 - protein, 69 aa, Magnetococcus sp. MC-1
MKEGIHPKYEEATFTCASCSNEIKTRSTAGDLTLGICSECHPFYTGKHKLVDTAGRVERFRRKYGMQDQ

SEQ ID NO: 67315 - DNA, 201 bp, Geobacter metallireducens GS-15
  CDS (1)..(201)
atgaaagaagggattcatcccaagtacaacgaggttaccgtgaagtgcgcctgcggcaacagcttccagacccgttccaccagaaccgagatctccaccgaaatctgctctgcctgccatccgttcttcaccggcaagcagaagctcgtggacaccgccggccgcgtcgagcgcttccggaaaaagtacggcatgcagtaa

SEQ ID NO: 67316 - protein, 66 aa, Geobacter metallireducens GS-15
MKEGIHPKYNEVTVKCACGNSFQTRSTRTEISTEICSACHPFFTGKQKLVDTAGRVERFRKKYGMQ

SEQ ID NO: 67317 - DNA, 225 bp, Novosphingobium aromaticivorans DSM 12444
  CDS (1)..(225)
atgaagactggcattcaccccgactaccacatgatcaaggtgcagatgaccgacggcaccgttttcgagacgcgctccacctggggcaaggaaggcgaaacgctcgctctcgaaatcgacccgacttcgcacccggcatggaccggcggtacgcgccagcttgaccagggtggccgtgttgcccagttcaacaagcgcttcggcggcctttcgctcaagcgctga

SEQ ID NO: 67318 - protein, 74 aa, Novosphingobium aromaticivorans DSM 12444
MKTGIHPDYHMIKVQMTDGTVFETRSTWGKEGETLALEIDPTSHPAWTGGTRQLDQGGRVAQFNKRFGGLSLKR

SEQ ID NO: 67319 - DNA, 243 bp, Cytophaga hutchinsonii
  CDS (1)..(243)
atgaaacaaggtattcacccagattatagagaagttgtatttcacgacatgtctgcggatgtaaaattcatcagccgttctactatcaaaactggcgatacaatcacaatggaagatggtaaatcttacccattagttaaattggaagttagttctgcttctcaccctttctacactggtcagaaaatgttcttggatactgcaggacgtgttgaaaaattcaacaaacgttacaaaaaataa

SEQ ID NO: 67320 - protein, 80 aa, Cytophaga hutchinsonii
MKQGIHPDYREVVFHDMSADVKFISRSTIKTGDTITMEDGKSYPLVKLEVSSASHPFYTGQKMFLDTAGRVEKFNKRYKK

SEQ ID NO: 67321 - DNA, 213 bp, Clostridium thermocellum ATCC 27405
  CDS (1)..(213)
atgaaagagttgaaagaaggaattcatccaaaatattatcagacggttataaaatgcgcttgtggagcaacttatgaaacaggttccacaaaggaaaagattaatgttgaaatttgttcaaactgccatcctttcttcacaggaaagcagaagcttgtagacaccggtggacgtgttgacagattcaagaagagatttggcattagtgactaa

SEQ ID NO: 67322 - protein, 70 aa, Clostridium thermocellum ATCC 27405
MKELKEGIHPKYYQTVIKCACGATYETGSTKEKINVEICSNCHPFFTGKQKLVDTGGRVDRFKKRFGISD

SEQ ID NO: 67323 - DNA, 213 bp, Microbulbifer degradans 2-40
  CDS (1)..(213)
atgcaagcagatattcaaccaaactacggcgatatgaatgcaacgtgcagttgcggtaatgttgttaaaactcgttcaactttagctaaagatattcatattgacgtgtgttcagaatgccacccattctacaccggtaagcagaagactgccgatactggcggccgtatcgatcgcttcaacaagcgttttggtgctatcaaatctaaataa

SEQ ID NO: 67324 - protein, 70 aa, Microbulbifer degradans 2-40
MQADIQPNYGDMNATCSCGNVVKTRSTLAKDIHIDVCSECHPFYTGKQKTADTGGRIDRFNKRFGAIKSK

SEQ ID NO: 67325 - DNA, 243 bp, Oenococcus oeni PSU-1
  CDS (1)..(243)
atgaaagcagatattcatccagattatcgccaggttgttttcgttgattcaacaactggtgctaaattcttatcaggttcaaccgctaaagctcaaggcgaggttgaatacgaaggccagacttatccaatggttcgtgttgaagttacctcggattcacatcctttctatactggcaagcagaaaatcaatcaggccgatggtgctgttgataagttcaacaaaaagtatggacttaactag

SEQ ID NO: 67326 - protein, 80 aa, Oenococcus oeni PSU-1
MKADIHPDYRQVVFVDSTTGAKFLSGSTAKAQGEVEYEGQTYPMVRVEVTSDSHPFYTGKQKINQADGAVDKFNKKYGLN

SEQ ID NO: 67327 - DNA, 273 bp, Trichodesmium erythraeum IMS101
  CDS (1)..(273)
atgcctaaagctgatattcatcctgaatggtatccagaagctaaagtttattgcaatggtgaagttgtaatgacagttggttctacacaacctgaaattcatgttgatgtttggtcgggaaatcatccctattttaccggtactcagaaaattattgatactgaaggaagggttgaaaggtttatgcgtaaatatagtaaacaagagggtagtggatctaaatctaataaatctaaatctactaaatctaaaaagggtaaaggcaaaaaatag

SEQ ID NO: 67328 - protein, 90 aa, Trichodesmium erythraeum IMS101
MPKADIHPEWYPEAKVYCNGEVVMTVGSTQPEIHVDVWSGNHPYFTGTQKIIDTEGRVERFMRKYSKQEGSGSKSNKSKSTKSKKGKGKK

SEQ ID NO: 67329 - DNA, 207 bp, Thiobacillus denitrificans ATCC 25259
  CDS (1)..(207)
atgaaagccggcatccaccccgactacaacgaagtgaccgtgacctgctcgtgcggcaacaccttcgtcacccgctcgacgctcggcaaacccgccctgcacgtggaagtctgcgcgtcctgccatccgttctacaccggcaagcaaaagatcgtcgacaccgccggccgcgtcgagaagttccgccagcgctacggcatgaagtaa

SEQ ID NO: 67330 - protein, 68 aa, Thiobacillus denitrificans ATCC 25259
MKAGIHPDYNEVTVTCSCGNTFVTRSTLGKPALHVEVCASCHPFYTGKQKIVDTAGRVEKFRQRYGMK

SEQ ID NO: 67331 - DNA, 222 bp, Silicibacter sp. TM1040
  CDS (1)..(222)
atgaaaaaagacatccatcccgattaccacttcatcgacgtcaaaatgaccgacggtaccgttgtcaaaatgcgctccacctggggcaacgaaggcgaccagctggctctggacatcgacccttccgcgcaccccgcgtggaccggtggctcctcgcgcctgatggacaccggcggccgcgtgtccaagttcaagaaaaaatacgaaggtctgggtttctaa

SEQ ID NO: 67332 - protein, 73 aa, Silicibacter sp. TM1040
MKKDIHPDYHFIDVKMTDGTVVKMRSTWGNEGDQLALDIDPSAHPAWTGGSSRLMDTGGRVSKFKKKYEGLGF

SEQ ID NO: 67333 - DNA, 300 bp, Chloroflexus aurantiacus
  CDS (1)..(300)
atgaaacagggtattcatcccaagtattacactgatggcattgtgtgcggaacctgtgggacggtctggaagattggttccactcgtcccaatctgcgagttgagatttgcgccaattgccatccgttctacaccggcgagcagcggattgtcgatactgccggccaggttgaccgctttatgcggcggttgaatgtggcgcaagaacgccagaatgagcgcgagagccggcgggcagctcgtactcagccggaaaagaagagcctgcttaaagagatttatggtgaagatgccgagtag

SEQ ID NO: 67334 - protein, 99 aa, Chloroflexus aurantiacus
MKQGIHPKYYTDGIVCGTCGTVWKIGSTRPNLRVEICANCHPFYTGEQRIVDTAGQVDRFMRRLNVAQERQNERESRRAARTQPEKKSLLKEIYGEDAE

SEQ ID NO: 67335 - DNA, 282 bp, Polaromonas sp. JS666
  CDS (1)..(282)
atgaaagaaggcattcaccccaactaccgcgaagtttgcttcctggacttgtccaacaacttcaagtttgtgacccgctcctgcgtgaacaccaaagaaatggtgaaaatggaagacggccgcgagctgcccctgtacaagctcgatacgtccagcgaatcgcaccccttctacaccggtacgcaaaagtccgtggacaacatgggtggtcgcgttgagaaattccgcaaccgcttcggcaaaaccgctgcgaaagaggccactccaccagctgccgagtaa

SEQ ID NO: 67336 - protein, 93 aa, Polaromonas sp. JS666
MKEGIHPNYREVCFLDLSNNFKFVTRSCVNTKEMVKMEDGRELPLYKLDTSSESHPFYTGTQKSVDNMGGRVEKFRNRFGKTAAKEATPPAAE

SEQ ID NO: 67337 - DNA, 222 bp, Palmaria palmata
  CDS (1)..(222): transl_table=11
atgccacaaatagatattcacccagaatggtacaatgactctaaagtatattgtgatggaaaacatataatgacaataggttccacgaaacctgaattacacgtagatatttggtctggaaatcatccattttttacaggatctcagagaattattgatacagaaggtcgtgtagaaaggtttatgcgtaagtataacgttcaaaagactgcagatacttaa

SEQ ID NO: 67338 - protein, 73 aa, Palmaria palmata
MPQIDIHPEWYNDSKVYCDGKHIMTIGSTKPELHVDIWSGNHPFFTGSQRIIDTEGRVERFMRKYNVQKTADT

SEQ ID NO: 67339 - DNA, 264 bp, Escherichia coli
  CDS (1)..(264): transl_table=11
atgaagcccaatatccatcctgagtatcgtactgtggtgttccacgacaccagtgttgatgagtactttaaaatcggctcgactatcaaaacagaccgtgagattgagctggatggcgtaacgtatccatacgtgacaattgatgtctcttctaaatcgcacccgttctatacagggaagctgagaacagtggcatcagaaggaaatgttgcacgattcacccaacgttttggtcgttttgttagcacgaaaaagggggcgtga

SEQ ID NO: 67340 - protein, 87 aa, Escherichia coli
MKPNIHPEYRTVVFHDTSVDEYFKIGSTIKTDREIELDGVTYPYVTIDVSSKSHPFYTGKLRTVASEGNVARFTQRFGRFVSTKKGA

SEQ ID NO: 67341 - DNA, 228 bp, Cyanidium caldarium
  CDS (1)..(228): transl_table=11
atggccaaaaaaaacatccatccacaatggtatgaagaagccaagttttattgcaatggtgaaatagtgaaaattattgggtcaacaagaatggaaattaatgctgacatttggtccggaaaccacccattttatattgggacacagaaaattgtggacacagaaggtcgtattgacaagtttataaggaaatataaccttaacagtgaaaattcagaatcattgtag

SEQ ID NO: 67342 - protein, 75 aa, Cyanidium caldarium
MAKKNIHPQWYEEAKFYCNGEIVKIIGSTRMEINADIWSGNHPFYIGTQKIVDTEGRIDKFIRKYNLNSENSESL

SEQ ID NO: 67343 - DNA, 219 bp, Guillardia theta
  CDS (1)..(219)
atgccaaaacaaaatttacatcctaagtggtacgctgaagctaaagtatattgtgatggtcaattaataatgactattggttctacaaaatcagaattaaatgttgatatttggtctggtaatcatccattttacaccggctcacaaaaaatgttggatacagaaggtagagtagaacgtttcatgcgtaaatatggtttaaaagaaaataattcataa

SEQ ID NO: 67344 - protein, 72 aa, Guillardia theta
MPKQNLHPKWYAEAKVYCDGQLIMTIGSTKSELNVDIWSGNHPFYTGSQKMLDTEGRVERFMRKYGLKENNS

SEQ ID NO: 67345 - DNA, 213 bp, Porphyra purpurea
  CDS (1)..(213)
atggcaaaagttgatatacatcctatctggtatcctgatgcaaaagtttactgtgacggtcaattaattatgacaattggttcaacaaaaccggaattacatgttgatatttggtcaggtaaccatccattttttactggttcccaaagaattattgatactgagggtagagtagaaagatttatgcgtaaatataaaatggagaaagattag

SEQ ID NO: 67346 - protein, 70 aa, Porphyra purpurea
MAKVDIHPIWYPDAKVYCDGQLIMTIGSTKPELHVDIWSGNHPFFTGSQRIIDTEGRVERFMRKYKMEKD

SEQ ID NO: 67347 - DNA, 267 bp, Bordetella bronchiseptica
  CDS (1)..(267): transl_table=11
atgaaagaaggcattcaccccgaataccgcgaagtggtgttcatggacgttcagacgggcaacaagttcatcacccgctcgaccatccacacccgcgaaaccgtcgaaatggacggcaagacgtacccgctcttcaagtgcgacgtgacgtccgaatcgcacccgttctacaccggcgcgcagacgcgtatcgtcgagaccggccgcgtggaaaaattccgcgcccgcttcgcccgcaccgccgggacggtcaagtcggcgtcctga

SEQ ID NO: 67348 - protein, 88 aa, Bordetella bronchiseptica
MKEGIHPEYREVVFMDVQTGNKFITRSTIHTRETVEMDGKTYPLFKCDVTSESHPFYTGAQTRIVETGRVEKFRARFARTAGTVKSAS

SEQ ID NO: 67349 - DNA, 246 bp, Borrelia burgdorferi
  CDS (1)..(246): transl_table=11
atgagaaaagatatacatcctaaaaataatttagtggtatttaaagacggatcaaatggagcaatgtttttaaccaagtctactttgaattcaaaggaaactattaaatatattgatggaaaggaatatccattggttactgttgagattacaagcaaatcccatcctttttataccggtcagcaaaagtttgttgatgcagcaggaagaattgataaatttaataaaaggtataaaaagtcctaa

SEQ ID NO: 67350 - protein, 81 aa, Borrelia burgdorferi
MRKDIHPKNNLVVFKDGSNGAMFLTKSTLNSKETIKYIDGKEYPLVTVEITSKSHPFYTGQQKFVDAAGRIDKFNKRYKKS

SEQ ID NO: 67351 - DNA, 327 bp, Chlamydophila caviae
  CDS (1)..(327): transl_table=11
atgaaaaagaacactcatcccgaatataacaaagttttattcgtagattcttctacaggatataaatttgtttgcggatctacataccaaagcgataagacggaagtttatgaaggacaagagtatcctgtatgctacgtcagcgtatcctcttcctcacatcctttcttcactggaagtaagagattagtcgatgccgaaggtcgggtagataagttcttaaaacgttacagcaatgcaaagcctgcgcaacctgttcaagctcctgcagaagaaggacctgtggttaaaggtaagaaaaaagctcctgcaaagaaaaagaaatag

SEQ ID NO: 67352 - protein, 108 aa, Chlamydophila caviae
MKKNTHPEYNKVLFVDSSTGYKFVCGSTYQSDKTEVYEGQEYPVCYVSVSSSSHPFFTGSKRLVDAEGRVDKFLKRYSNAKPAQPVQAPAEEGPVVKGKKKAPAKKKK

SEQ ID NO: 67353 - DNA, 330 bp, Chlamydia pneumoniae
  CDS (1)..(330): transl_table=11
atgaaaaaaaatacccaccctgaatatagacaggttttatttgtagattcttcaacagggtataaatttgtttgtggatctacctatcaaagtgaaaaaactgaagtttttgaaggtaaagagtatcctgtatgttatgtcagcgtatcctcttcttctcatccttttttcactggaagtaagaagtttgttgatgctgaaggtagggtagataagttcttaaaacgttatagtaatgtaagacagcctgcacagcaacctcagcctgaagaagacgcactacctgctgctaaaggaaagaaaaaagttgtaactaagaaaaagaaataa

SEQ ID NO: 67354 - protein, 109 aa, Chlamydia pneumoniae
MKKNTHPEYRQVLFVDSSTGYKFVCGSTYQSEKTEVFEGKEYPVCYVSVSSSSHPFFTGSKKFVDAEGRVDKFLKRYSNVRQPAQQPQPEEDALPAAKGKKKVVTKKKK

SEQ ID NO: 67355 - DNA, 267 bp, Corynebacterium efficiens
  CDS (1)..(267)
atgaagaacgaaatccaccccgactaccacccggtggtcttccaggacgcaggtactggtttccagttcctgacccgctccaccgctaccagcgatcgcaccatcgcctgggaagacggtaatgagtacccgctgatcgttgttgacgtcaccagcgaatcccacccgttctggaccggcgcacagcgtgtcatggacaccgccggccgagtcgagaagttcgagcgtcgcttcggcggcatggctcgccgtaagaagaaggcatag

SEQ ID NO: 67356 - protein, 88 aa, Corynebacterium efficiens
MKNEIHPDYHPVVFQDAGTGFQFLTRSTATSDRTIAWEDGNEYPLIVVDVTSESHPFWTGAQRVMDTAGRVEKFERRFGGMARRKKKA

SEQ ID NO: 67357 - DNA, 267 bp, Corynebacterium glutamicum
  CDS (1)..(267): transl_table=11
atgaaaaaggatatccaccctgactaccatgcggtagtcttccaggacgcaggtactggcttccagttcctgaccaagtccaccgcttccagcgaccgcaccgtgtcctgggaagatggtaacgagtacccactgatcgtcgttgacgtcaccagcgagtctcacccattctggaccggcgctcagcgtgtcatggacaccgctggtcgtgttgagaagttcgagcgtcgcttcggtggcatggctcgccgcaagaagaaggcatag

SEQ ID NO: 67358 - protein, 88 aa, Corynebacterium glutamicum
MKKDIHPDYHAVVFQDAGTGFQFLTKSTASSDRTVSWEDGNEYPLIVVDVTSESHPFWTGAQRVMDTAGRVEKFERRFGGMARRKKKA

SEQ ID NO: 67359 - DNA, 270 bp, Haemophilus ducreyi
  CDS (1)..(270): transl_table=11
atgaaaaaagggattcatcctgaaaattatcgtgaagtattattttatgatgcttctgcccaaatgggttgggttattcgttcttgtgtcgcaactaataaatcaatgatgtgggaagatggtaaagaatatccattttacccattagatacttcatctgcgtcacaccctgtttatacaggtaaacgccgtgaagcaaatacggaaggtcgcgcaagtaaatttaatgaacgctttaaaggtatggcaagtttagcggctaaaaaataa

SEQ ID NO: 67360 - protein, 89 aa, Haemophilus ducreyi
MKKGIHPENYREVLFYDASAQMGWVIRSCVATNKSMMWEDGKEYPFYPLDTSSASHPVYTGKRREANTEGRASKFNERFKGMASLAAKK

SEQ ID NO: 67361 - DNA, 246 bp, Listeria monocytogenes
  CDS (1)..(246): transl_table=11
atgaaaactggaattcatcctgagtaccgtccagtggtatttgttgatactagtactgatttcaaatttttgtcaggttctactaagagctcaagcgaaacaattaaatgggaagatggcaacgagtatccattacttcgtgtcgaaatctcttctgattcgcacccgttctatactggtaaacaaaaacatgcgactgcagacggccgtgtggaccgcttcaacaaaaaatacggtctcaaataa

SEQ ID NO: 67362 - protein, 81 aa, Listeria monocytogenes
MKTGIHPEYRPVVFVDTSTDFKFLSGSTKSSSETIKWEDGNEYPLLRVEISSDSHPFYTGKQKHATADGRVDRFNKKYGLK

SEQ ID NO: 67363 - DNA, 246 bp, Oceanobacillus iheyensis
  CDS (1)..(246)
atgaaaaaggatatccatccagagtacaaaaaagtagtatttctagatactagtacgaatttcaaattcttaagtggttctactaaaggatctgacgaaacaattgagtgggaagatggaaacacatacccattaattaaagtggaaatcagttctgattctcacccgttctacactggtaagcaaaaagctgacaaagttggcggacgtgtggatcgctttaagaaaaaatataatcttcaataa

SEQ ID NO: 67364 - protein, 81 aa, Oceanobacillus iheyensis
MKKDIHPEYKKVVFLDTSTNFKFLSGSTKGSDETIEWEDGNTYPLIKVEISSDSHPFYTGKQKADKVGGRVDRFKKKYNLQ

SEQ ID NO: 67365 - DNA, 255 bp, Photorhabdus luminescens
  CDS (1)..(255): transl_table=11
atgaaaccagatatccatccaaactatcgggtagttgtatttcacgataccagtgctaatgcctattttacaattggctccacgattcgcacagaacggacaattactctgaatggggaagagtatccatatgtcactgttgatgtgtcatcggaatcacaccctttctatacgggtaagcagaaaactttatctcaggaaggcagtactgcgcgattccagaaaaaattcgggcgttttattggtaataaataa

SEQ ID NO: 67366 - protein, 84 aa, Photorhabdus luminescens
MKPDIHPNYRVVVFHDTSANAYFTIGSTIRTERTITLNGEEYPYVTVDVSSESHPFYTGKQKTLSQEGSTARFQKKFGRFIGNK

SEQ ID NO: 67367 - DNA, 261 bp, Streptococcus agalactiae
  CDS (1)..(261): transl_table=11
atgaaaaaagacatccatccagattatcgtccagttgttttcttagatacaactacaggttacaaattccttagtggttcaactaaatcaactaaagaaacagtagaattcgaaggtgaaacttacccacttattcgtgtggaaatctcatcagattcacatccattctatacaggacgtcaaaaattcactcaagcagatggacgtgtggaccgtttcaacaaaaaatatggtctcaaagacgcaaacgctgctcaataa

SEQ ID NO: 67368 - protein, 86 aa, Streptococcus agalactiae
MKKDIHPDYRPVVFLDTTTGYKFLSGSTKSTKETVEFEGETYPLIRVEISSDSHPFYTGRQKFTQADGRVDRFNKKYGLKDANAAQ

SEQ ID NO: 67369 - DNA, 261 bp, Vibrio vulnificus
  CDS (1)..(261): transl_table=11
atgaaaccaggaatccatcctgaatatcgcaaagtcgtgttccacgacaccagtgtcgatcactattttgtggttggttcgaccttgcaaactgaccgcaccatagaatgggaagatggccaaacctacccttacttcaccattgaagtctcctcggaatcacatccgttttacaccggtaagcaaagagtggtgcaaaaagagggtcgcgtggcgaacttcaatcgtcgttttgctcagtttggttcgagagaaggttaa

SEQ ID NO: 67370 - protein, 86 aa, Vibrio vulnificus
MKPGIHPEYRKVVFHDTSVDHYFVVGSTLQTDRTIEWEDGQTYPYFTIEVSSESHPFYTGKQRVVQKEGRVANFNRRFAQFGSREG

SEQ ID NO: 67371 - DNA, 261 bp, Vibrio vulnificus
  CDS (1)..(261)
atgaaaccgggaatccatcctgaatatcgcaaagtcgtgttccacgacaccagtgtcgatcactattttgtggttggttcgaccttgcaaactgaccgcaccatagaatgggaagatggccaaacctacccttacttcaccattgaagtctcctcggaatcacatccgttttacaccggtaaacaaagagtggtgcaaaaagagggtcgagtggcgaacttcaatcgtcgttttgctcagtttggttcgaaagaaggttaa

SEQ ID NO: 67372 - protein, 86 aa, Vibrio vulnificus
MKPGIHPEYRKVVFHDTSVDHYFVVGSTLQTDRTIEWEDGQTYPYFTIEVSSESHPFYTGKQRVVQKEGRVANFNRRFAQFGSKEG

SEQ ID NO: 67373 - DNA, 243 bp, Xanthomonas campestris
  CDS (1)..(243): transl_table=11
atgaaagataacgttcatcccagctacaacgacgtcgtcttccacgacgtgacctcggatttcaagatcctgacccgttccaccatgagctcgaaagagaccgtgaagtgggaagacggccaggactatccgctgatcaaggtggaaatctcctccgcatcgcacccgttctataccggcaagcacaaggtgatcgacaccggcggccgtatcgacaagttccagaagcgctacgcgcgctga

SEQ ID NO: 67374 - protein, 80 aa, Xanthomonas campestris
MKDNVHPSYNDVVFHDVTSDFKILTRSTMSSKETVKWEDGQDYPLIKVEISSASHPFYTGKHKVIDTGGRIDKFQKRYAR

SEQ ID NO: 67375 - DNA, 243 bp, Xylella fastidiosa
  CDS (1)..(243): transl_table=11
atgaagcccgaaattcatccaatttatcgtgaagttgtctttcacgatgtgacttccaatttcaagtttctcacccgttccaccatggggactaaggaaactactttgtgggaagacggactggagtatccgttggtcaaggttgaaatatcctcggcctcgcatcccttttatacaggtaagcataaacttgtggacacgagtggtcgtattgataagtttaaaaagcgttacgcacgttaa

SEQ ID NO: 67376 - protein, 80 aa, Xylella fastidiosa
MKPEIHPIYREVVFHDVTSNFKFLTRSTMGTKETTLWEDGLEYPLVKVEISSASHPFYTGKHKLVDTSGRIDKFKKRYAR

SEQ ID NO: 67377 - DNA, 222 bp, Agrobacterium tumefaciens
  CDS (1)..(222): transl_table=11
atgaaggctgatatccatcccgcttatcacacgatcaaggtcgtcatgaccgatggcaccgaatacgaaacccgctctacctggggttcggaaggcgcagtcatgaaccttgaaatcgaccccaagtcccatccggcatggacgggcggcaaccagcagcttatggaccgtggtggtcgcgtttccaagttcaacaagcgtttcggcggcctcggcctctga

SEQ ID NO: 67378 - protein, 73 aa, Agrobacterium tumefaciens
MKADIHPAYHTIKVVMTDGTEYETRSTWGSEGAVMNLEIDPKSHPAWTGGNQQLMDRGGRVSKFNKRFGGLGL

SEQ ID NO: 67379 - DNA, 207 bp, Aquifex aeolicus
  CDS (1)..(207)
atgaagaagggtattcaccccgaactaaaacccacaactttcgtatgcggttgcggaaacacctttacgcttctctccacaaaaggaggaactgtttacttagaagtttgcaaccagtgtcaccccttttacgcgggcaaactgaagataaagcccgcttactacgaaatgcttgcggaatttgaaggaggtaagaaagaagagtaa

SEQ ID NO: 67380 - protein, 68 aa, Aquifex aeolicus
MKKGIHPELKPTTFVCGCGNTFTLLSTKGGTVYLEVCNQCHPFYAGKLKIKPAYYEMLAEFEGGKKEE

SEQ ID NO: 67381 - DNA, 213 bp, Bifidobacterium longum
  CDS (1)..(213): transl_table=11
atgcagcagggtatccatcctgattatcaccccgttgaggtgacgtgctcgtgcggcaacaccttcgtgacccgcaccgctggcaaggaagatcacatgttcgttgacgtgtgctctcagtgccacccgttctacaccggcaagcagaagattcttgacaccggtggccgcgttgctcgcttcgagaagcgctacggcaagaagagcaagtag

SEQ ID NO: 67382 - protein, 70 aa, Bifidobacterium longum
MQQGIHPDYHPVEVTCSCGNTFVTRTAGKEDHMFVDVCSQCHPFYTGKQKILDTGGRVARFEKRYGKKSK

SEQ ID NO: 67383 - DNA, 228 bp, Bradyrhizobium japonicum
  CDS (1)..(228)
atgaaagccgaaattcatccagattatcatacgattaaggtcgtgatgaccgacggaaccgagtacctgacccgctccacctggggcaaggaaggcgacacgctgaacctcgacatcgacccgaagtcgcacccggcctggaccggcggcaacgcccagatcatggatcgcggcggccgcgtctcgcgcttccagaagaagttctcgggcttcctcaagaaggattga

SEQ ID NO: 67384 - protein, 75 aa, Bradyrhizobium japonicum
MKAEIHPDYHTIKVVMTDGTEYLTRSTWGKEGDTLNLDIDPKSHPAWTGGNAQIMDRGGRVSRFQKKFSGFLKKD

SEQ ID NO: 67385 - DNA, 222 bp, Brucella melitensis
  CDS (1)..(222): transl_table=11
atgaaagccaatatccatcccgactaccacaccatcaaggtcgtgatgaccgatggcaccgaatacatgacccgctcgacctggggcaaggaaggcgatacgatgaacctcgatatcgacccgaccacgcacccggcctggacgggcggctcgcagaccctgcttgatcgcggcggccgtgtcaccaagttcaagaaccgtttcggcaatctcggcatctga

SEQ ID NO: 67386 - protein, 73 aa, Brucella melitensis
MKANIHPDYHTIKVVMTDGTEYMTRSTWGKEGDTMNLDIDPTTHPAWTGGSQTLLDRGGRVTKFKNRFGNLGI

SEQ ID NO: 67387 - DNA, 219 bp, Buchnera aphidicola
  CDS (1)..(219)
atgaaaaaaaaaattcaccctcgttattccaagataacagctacttgctcttgtggaaatataattgaaattttttctactatcaatcacaatctaaatttagatatatgtgcaaaatgtcatccattctatacaggtaaacaaagagtcattgatactggaggtcgtgttgaaagatttaaaaaacgctttaagtttactaagcaagaattaaattaa

SEQ ID NO: 67388 - protein, 72 aa, Buchnera aphidicola
MKKKIHPRYSKITATCSCGNIIEIFSTINHNLNLDICAKCHPFYTGKQRVIDTGGRVERFKKRFKFTKQELN

SEQ ID NO: 67389 - DNA, 219 bp, Buchnera aphidicola
  CDS (1)..(219): transl_table=11
atgaaaaaaaaaatacatccagcttattctcaaataatagctacttgctcatgtggaaatataattgaaattttctcaaccgttaatgtcaatctaaatttagatatatgtgcaaaatgtcatccattttatactggaaaacaaagaattattgatactggaggacgagttgaaagatttaaaaaacgttttaaactgattaagaaagatacggtataa

SEQ ID NO: 67390 - protein, 72 aa, Buchnera aphidicola
MKKKIHPAYSQIIATCSCGNIIEIFSTVNVNLNLDICAKCHPFYTGKQRIIDTGGRVERFKKRFKLIKKDTV

SEQ ID NO: 67391 - DNA, 201 bp, Campylobacter jejuni
  CDS (1)..(201): transl_table=11
atgaaaaaagaaattcacccagaatatgtagaatgcaaagtaagttgtgcttgtggaaatacttttacaacaaagtcaaacaaagcagaattaagagtagatatttgttcaaattgccatcctttttttacaggcagtgaaaaaattgtagatgctgcaggtcgtgtagagaaatttaagaaaaaatacgcaatgcaataa

SEQ ID NO: 67392 - protein, 66 aa, Campylobacter jejuni
MKKEIHPEYVECKVSCACGNTFTTKSNKAELRVDICSNCHPFFTGSEKIVDAAGRVEKFKKKYAMQ

SEQ ID NO: 67393 - DNA, 231 bp, Caulobacter crescentus
  CDS (1)..(231): transl_table=11
atgaaacaagacattcaccccgactaccacttcatcaccgtcaccctgaccgacggttcgagctacaagacccgctcgacctacggcaaggaaggcgcgaatctggcgctcgacatcgatccgcgcacccatccggcgtggaccggcggcaacgcccagctgatggaccgcggcggtcgcgtctcgcgcttcaacgccaagttcgccggcttcaccggcaagaaggcctaa

SEQ ID NO: 67394 - protein, 76 aa, Caulobacter crescentus
MKQDIHPDYHFITVTLTDGSSYKTRSTYGKEGANLALDIDPRTHPAWTGGNAQLMDRGGRVSRFNAKFAGFTGKKA

SEQ ID NO: 67395 - DNA, 228 bp, Chlorobium tepidum
  CDS (1)..(228): transl_table=11
atgaaaccagagattcacccgaagtatacgaaagttaccgtcaactgcgcgaactgcggcaccaccttcgaaacccgctccaccaggaataacaacatcaaggtcgatatttgcagcaagtgccatcctttctacaccggcaagcaggtgctcgtcgataccgctggccgcgtcgatcgcttcaacaagcgcttcgccaaagctgctcccaaagccagcgcccagtaa

SEQ ID NO: 67396 - protein, 75 aa, Chlorobium tepidum
MKPEIHPKYTKVTVNCANCGTTFETRSTRNNNIKVDICSKCHPFYTGKQVLVDTAGRVDRFNKRFAKAAPKASAQ

SEQ ID NO: 67397 - DNA, 213 bp, Clostridium acetobutylicum
  CDS (1)..(213): transl_table=11
atgcaaaaggatatacaacctgaataccatcaagatgcagttgttaaatgtgcgtgcggaaatactttcacaacaggctcaactaaaaaagaattaaaagttgatatttgctcaaaatgtcatccattctttacaggacagcaaaaaattgttgatgttggtggaagagttgagaagttcagaaaaaaatacaacttgtcagcagacaaataa

SEQ ID NO: 67398 - protein, 70 aa, Clostridium acetobutylicum
MQKDIQPEYHQDAVVKCACGNTFTTGSTKKELKVDICSKCHPFFTGQQKIVDVGGRVEKFRKKYNLSADK

SEQ ID NO: 67399 - DNA, 207 bp, Clostridium perfringens
  CDS (1)..(207)
atgagacaaggcatacatccagaataccatcacgatacagtggttaagtgtgcatgtggaaacactttcacaactggttcagttaaaccagaacttaaagttgaaatatgctctaagtgccacccattcttcacaggaaaacaaaaaatcgttgatgttggcggaagagttgataaattcaacaagagatttaatcttaataaataa

SEQ ID NO: 67400 - protein, 68 aa, Clostridium perfringens
MRQGIHPEYHHDTVVKCACGNTFTTGSVKPELKVEICSKCHPFFTGKQKIVDVGGRVDKFNKRFNLNK

SEQ ID NO: 67401 - DNA, 222 bp, Deinococcus radiodurans
  CDS (1)..(222): transl_table=11
atgcaaaaagacctgcaccccaaggccgtgccctgcaagatcatctaccagggtcaagtcgtgatggaaaccatgagcacccgccccgaaatccacgtggacgtgtggagcggcgtgcaccccttctggaccggcgaagaacgcttcctcgacaccgaaggccgcgtggacaagttcaacaagcgcttcggcgacagctaccgccgcggcagcaagaagtaa

SEQ ID NO: 67402 - protein, 73 aa, Deinococcus radiodurans
MQKDLHPKAVPCKIIYQGQVVMETMSTRPEIHVDVWSGVHPFWTGEERFLDTEGRVDKFNKRFGDSYRRGSKK

SEQ ID NO: 67403 - DNA, 246 bp, Fusobacterium nucleatum
  CDS (1)..(246): transl_table=11
atgaaaaaaggaatacatcctgaattcgatcttgttgtttttgaagatatggctggtaaccaatttttaactagatctacaaaaataccaaaagaaacaacaacttttgaaggaaaagaatatccagtaataaaagtagctgttagctcaaaatcacacccattctatactggagaacaaagatttgttgatactgcaggaagagttgacaaatttaataagaaattcaacttgggtaaaaaataa

SEQ ID NO: 67404 - protein, 81 aa, Fusobacterium nucleatum
MKKGIHPEFDLVVFEDMAGNQFLTRSTKIPKETTTFEGKEYPVIKVAVSSKSHPFYTGEQRFVDTAGRVDKFNKKFNLGKK

SEQ ID NO: 67405 - DNA, 204 bp, Helicobacter pylori J99
  CDS (1)..(204): transl_table=11
atgaaaaaaggcattcaccccgaatatatcccatgcaaagttacttgcgtaacgagcgggaaagaaattgaggttttaagcaccaaacctgaaatgcgtattgatatttctagcttttgccaccctttctataccggtagcgataaaatcgctgacactgcagggagagtagagaaattcaagcaacgctacaatttgaagtaa

SEQ ID NO: 67406 - protein, 67 aa, Helicobacter pylori J99
MKKGIHPEYIPCKVTCVTSGKEIEVLSTKPEMRIDISSFCHPFYTGSDKIADTAGRVEKFKQRYNLK

SEQ ID NO: 67407 - DNA, 204 bp, Leptospira interrogans
  CDS (1)..(204): transl_table=11
atgaaaactgaaattcatccaaactataaggcggctaaaatcagctgtgcatcctgtggaaccgtatacgaaaccagaacttctatcggcgatattaatattgagatctgttccgcttgtcatcctttctttactggaaagtctaaactagtggatactaccggtcgggtagataagttcaagaaaaaatataaaatgcagtga

SEQ ID NO: 67408 - protein, 67 aa, Leptospira interrogans
MKTEIHPNYKAAKISCASCGTVYETRTSIGDINIEICSACHPFFTGKSKLVDTTGRVDKFKKKYKMQ

SEQ ID NO: 67409 - DNA, 255 bp, Mycobacterium leprae
  CDS (1)..(255): transl_table=11
atgaaagctaatattcatcccgcctacgcggagaccaccgtggtctgcggatgcggcaacaccttccaaacacgcagcaccaagccgggaggccgcattgtggtcgaggtttgctcgcagtgccacccgttctacacgggcaagcagaagattttggacagcggcggccgggttgcccgcttcgaaaagcgctatggcaaacgcaaggttggggtggaccaggtggctgcgtacccggagcagaacaataaatag

SEQ ID NO: 67410 - protein, 84 aa, Mycobacterium leprae
MKANIHPAYAETTVVCGCGNTFQTRSTKPGGRIVVEVCSQCHPFYTGKQKILDSGGRVARFEKRYGKRKVGVDQVAAYPEQNNK

SEQ ID NO: 67411 - DNA, 210 bp, Mycoplasma pulmonis
  CDS (1)..(210): transl_table=4
atgcaaaaggacattcatttaaaaatggaaccactgaagattacatgttcaacatgttttacttcatttgacattgtttcgtcaagaaaaacaatagctattgacatttgttcaaaatgtcacccattctatacaggagatagaacattggctaaagcaactggtcaaatcgataagttccaaaaaagattgcaaaaaaagcaaaaataa

SEQ ID NO: 67412 - protein, 69 aa, Mycoplasma pulmonis
MQKDIHLKMEPLKITCSTCFTSFDIVSSRKTIAIDICSKCHPFYTGDRTLAKATGQIDKFQKRLQKKQK

SEQ ID NO: 67413 - DNA, 216 bp, Neisseria meningitidis
  CDS (1)..(216): transl_table=11
atgaaacaaggtattcacccgaactaccacgaagtcaacgttacctgctcttgcggcaacaaattcgcaaccaaatccgcgatggaaaaagaaaacttcaatatcgaggtttgctccctgtgccacccgttctataccggcacccaaaaaatcgtcgataccaccggccgcgtggacaaattcaacaacaaattcggcaacctgttcaaacgctga

SEQ ID NO: 67414 - protein, 71 aa, Neisseria meningitidis
MKQGIHPNYHEVNVTCSCGNKFATKSAMEKENFNIEVCSLCHPFYTGTQKIVDTTGRVDKFNNKFGNLFKR

SEQ ID NO: 67415 - DNA, 213 bp, Pasteurella multocida
  CDS (1)..(213): transl_table=11
atgaaacaaggtattcatcctaattatgtagaagttacagcaacatgttcttgcggtaatgtcattaaaactcgctcaactgtgggtaaagatttaaacttagacgtctgtggcaactgccacccattctatacaggtaaacaacgtgttgttgataccggtggtcgtgtagaacgctttaacaaacgttttagtattccaagtacgaaataa

SEQ ID NO: 67416 - protein, 70 aa, Pasteurella multocida
MKQGIHPNYVEVTATCSCGNVIKTRSTVGKDLNLDVCGNCHPFYTGKQRVVDTGGRVERFNKRFSIPSTK

SEQ ID NO: 67417 - DNA, 216 bp, Pseudomonas aeruginosa
  CDS (1)..(216): transl_table=11
atgaaagcggacatccatccgacttacgaagctatcgaagctacctgcagctgcggtaacgtcatcaagacccgttccaccctgtgcaagccgatccacttggacgtgtgctccgaatgccacccgttctacaccggcaagcagaaggtgctggacaccggcggccgtatcgaccgcttcaagcagcgtttcggcgtattcggcgccaccaagtaa

SEQ ID NO: 67418 - protein, 71 aa, Pseudomonas aeruginosa
MKADIHPTYEAIEATCSCGNVIKTRSTLCKPIHLDVCSECHPFYTGKQKVLDTGGRIDRFKQRFGVFGATK

SEQ ID NO: 67419 - DNA, 228 bp, Pseudomonas syringae
  CDS (1)..(228): transl_table=11
atgaaagctgatatccatccagtttacgaagccattgacgcgacctgcagctgcggcaatgtcatcaaaacccgttccaccctgaccggccctttgagcctggacgtgtgcaacgaatgtcacccgttctacaccggcaagcaaaaaacgcttgatatcggcggccgtgttgacaagttcaagtcccgtttcggtgcgttcggcgcaaccaaagcgaagcaggactga

SEQ ID NO: 67420 - protein, 75 aa, Pseudomonas syringae
MKADIHPVYEAIDATCSCGNVIKTRSTLTGPLSLDVCNECHPFYTGKQKTLDIGGRVDKFKSRFGAFGATKAKQD

SEQ ID NO: 67421 - DNA, 222 bp, Rhizobium loti
  CDS (1)..(222)
atgaagagcgctattcatcccgactaccacaccatcaaggtcgtcatgaccgacggcaccgaatacacgacccgttcgacctggggcaaggaaggcgatacgatgaacctcgatatcgatccgaccacccacccggcctggaccggcggccagcagaccctgctcgaccgcggcggccgcctgtcgaagttcaagaagcgtttcgaaggcttcggcctctaa

SEQ ID NO: 67422 - protein, 73 aa, Rhizobium loti
MKSAIHPDYHTIKVVMTDGTEYTTRSTWGKEGDTMNLDIDPTTHPAWTGGQQTLLDRGGRLSKFKKRFEGFGL

SEQ ID NO: 67423 - DNA, 213 bp, Salmonella typhi
  CDS (1)..(213): transl_table=11
atgaaaaaaggtattcacccgaattacgtagaaattactgcaacctgttcttgcggtaatgttatcaaaacccactctaccgtgggtcacgacctgaacctggacgtgtgcggcaaatgccacccgttcttcactggtaagcagcgtgttgttgataccggtggtcgtgttgagcgcttcaacaagcgcttcagcatccctggcagcaaataa

SEQ ID NO: 67424 - protein, 70 aa, Salmonella typhi
MKKGIHPNYVEITATCSCGNVIKTHSTVGHDLNLDVCGKCHPFFTGKQRVVDTGGRVERFNKRFSIPGSK

SEQ ID NO: 67425 - DNA, 213 bp, Shewanella oneidensis
  CDS (1)..(213): transl_table=11
atgaaaccaggtatccacccagaatacgcagaaatcactgcaaactgtacttgtggcaacgtaattaaagtgaactctactgtaggtaaagacctgcacttagacgtttgtggtgcatgtcacccattctacactggtacacaaaaagttgttgatacaggcggtcgtatcgacaaattcaacaagcgtttcggtatgcttggcaagaaataa

SEQ ID NO: 67426 - protein, 70 aa, Shewanella oneidensis
MKPGIHPEYAEITANCTCGNVIKVNSTVGKDLHLDVCGACHPFYTGTQKVVDTGGRIDKFNKRFGMLGKK

SEQ ID NO: 67427 - DNA, 276 bp, Synechococcus elongatus
  CDS (1)..(276)
atgccaaaaccaaacattcatccccagtggtatcccgaagccaaagtctattgcgatggtgaagtgattatgacggttggttccacgaaaccagaactgcacgtagacatctggtcaggcaaccaccccttcttcaccggtactcagaaaattgttgacgccgaagggcgggtggaacgcttccgccgtaaatacagcggtactaaacctcagcaaaccgctaaagggaaaaaagccgcccctaaatctacgcctaagacgaacaaaaagggctaa

SEQ ID NO: 67428 - protein, 91 aa, Synechococcus elongatus
MPKPNIHPQWYPEAKVYCDGEVIMTVGSTKPELHVDIWSGNHPFFTGTQKIVDAEGRVERFRRKYSGTKPQQTAKGKKAAPKSTPKTNKKG

SEQ ID NO: 67429 - DNA, 216 bp, Thermotoga maritima
  CDS (1)..(216): transl_table=11
gtgaaaaagggaatacatccagagatgaagctcgtaactgttaagtgtgcgtgtggtgctgagcacactttttacacgacggttgacaatataagaatcgacgtgtgttctaactgccatccgttctacacctccggtggaaaaggtggcgttctcatagtggatacggagggtagagtggagaagttcagaaggaagtacggagacaactattga

SEQ ID NO: 67430 - protein, 71 aa, Thermotoga maritima
MKKGIHPEMKLVTVKCACGAEHTFYTTVDNIRIDVCSNCHPFYTSGGKGGVLIVDTEGRVEKFRRKYGDNY

SEQ ID NO: 67431 - DNA, 210 bp, Thermoanaerobacter tengcongensis
  CDS (1)..(210): transl_table=11
atgaaaccaggtatacatcccacctattatcacgatgctgttgtgaaatgtgcttgtggaaatacctttataaccggttctacaaagaaagaaattagagtagagatatgttcaaaatgccatcctttcttcacaggtcaacagaagattgtagatacaggtggaagagtcgagagattcagaaagagatttaatttagaggaaaaataa

SEQ ID NO: 67432 - protein, 69 aa, Thermoanaerobacter tengcongensis
MKPGIHPTYYHDAVVKCACGNTFITGSTKKEIRVEICSKCHPFFTGQQKIVDTGGRVERFRKRFNLEEK

SEQ ID NO: 67433 - DNA, 204 bp, Treponema pallidum
  CDS (1)..(204): transl_table=11
atgaaaaagggactgcatcctcggtacgaggagacgaaggtggtgtgtgcgtgtggtaacgtcatcgtgactgcttctaccgtgaaggacttgcgggtagagatttgttctgcgtgccatccgttttttaccggtaaacagaaactggtagattcagcaggacgcattgacaggttcaataggcgatacaaaattcgaggctag

SEQ ID NO: 67434 - protein, 67 aa, Treponema pallidum
MKKGLHPRYEETKVVCACGNVIVTASTVKDLRVEICSACHPFFTGKQKLVDSAGRIDRFNRRYKIRG

SEQ ID NO: 67435 - DNA, 222 bp, Vibrio parahaemolyticus
  CDS (1)..(222)
atgaaagctggtatccacccagaatacaaagcagtaaacgctacttgttcttgcggcaactctttcgagttcaactctactctaggtaaagagtctatccacctagacgtatgtgacaagtgtcacccattctacactggtaagcaacgtatcgttgatacaggcggccgtgttgatcgcttcaacaagcgtttcggtgcactatcaagcggtaagaaataa

SEQ ID NO: 67436 - protein, 73 aa, Vibrio parahaemolyticus
MKAGIHPEYKAVNATCSCGNSFEFNSTLGKESIHLDVCDKCHPFYTGKQRIVDTGGRVDRFNKRFGALSSGKK

SEQ ID NO: 67437 - DNA, 222 bp, Vibrio vulnificus
  CDS (1)..(222): transl_table=11
atgaaagctggtatccatccagaatacaaagcagtaaacgcaacttgttcttgcggcaactctttcgttttcaactctactctagataaagaatctatccacctagacgtatgtgacaagtgccacccattctacactggtaagcaacgtatcgttgatacaggcggccgtgttgatcgcttcaacaagcgtttcggtgctctatcaagcggtaagaaataa

SEQ ID NO: 67438 - protein, 73 aa, Vibrio vulnificus
MKAGIHPEYKAVNATCSCGNSFVFNSTLDKESIHLDVCDKCHPFYTGKQRIVDTGGRVDRFNKRFGALSSGKK

SEQ ID NO: 67439 - DNA, 216 bp, Wigglesworthia glossinidia brevipalpis
  CDS (1)..(216)
atgaaaaaaaaaattcatcctatgtctttagatatactagctacatgttcttgtggaaactctttgaaaataaaatctacaataaaaaaggatatattgttagatgtatgtaataaatgtcatccattttatactggaactcaaaaaaaattgaatataggaggaagagttagtaagtttaaaaaaagatttgataatatagtgtataaaaaataa

SEQ ID NO: 67440 - protein, 71 aa, Wigglesworthia glossinidia brevipalpis
MKKKIHPMSLDILATCSCGNSLKIKSTIKKDILLDVCNKCHPFYTGTQKKLNIGGRVSKFKKRFDNIVYKK

SEQ ID NO: 67441 - DNA, 216 bp, Yersinia pestis
  CDS (1)..(216): transl_table=11
atgaaacaaggtatccaccctaaatacgaacaagttactgcttcttgctcttgcggtaacgttatcaagatcaactctactgttggtcatgatctgaacctggacgtgtgcggcgaatgccacccgttctacactggcaagcagcgtgatgttgcttctggtggccgtgttgaccgctttaacaaacgtttcagcgtgccgggtgcgaagaagtaa

SEQ ID NO: 67442 - protein, 71 aa, Yersinia pestis
MKQGIHPKYEQVTASCSCGNVIKINSTVGHDLNLDVCGECHPFYTGKQRDVASGGRVDRFNKRFSVPGAKK

SEQ ID NO: 67443 - DNA, 23 bp, Primer
atgaaaaaagatattcacccgaa

SEQ ID NO: 67444 - DNA, 23 bp, Primer
ttatttgctgcccgggatgttga

SEQ ID NO: 67445 - protein, 79 aa, consensus
  MISC_FEATURE (1)..(79): consensus for the disclosure of xaa see table XV
MKXXIHPXXXXXXXXXXXXXXXXXXXXSTXXXXXXXXXXXXXXXXXXXXXXXXXXHPFXTGXXXXXXXXXXXXGRXXXF

SEQ ID NO: 67446 - protein, 83 aa, consensus
  MISC_FEATURE (1)..(83): consensus for the disclosure of xaa see table XV
XXXXXXPXXXXXXXXXXXXXXXXXXXXXXXXXXXXXXXXXXXXXXXXXXXXXXXXHPXXTGXXXXXXXXXXXXGXXXXFXXXX

SEQ ID NO: 67447 - DNA, 1326 bp, Escherichia coli; identical to SEQ ID NO: 43779
  CDS (1)..(1326)

SEQ ID NO: 67448 - protein, 441 aa, Escherichia coli; identical to SEQ ID NO: 43780

SEQ ID NO: 67449 - DNA, 1347 bp, Xanthomonas oryzae pv. oryzae KACC10331; identical to SEQ ID NO: 43781
  CDS (1)..(1347)

SEQ ID NO: 67450 - protein, 448 aa, Xanthomonas oryzae pv. oryzae KACC10331; identical to SEQ ID NO: 43782

SEQ ID NO: 67451 - DNA, 1431 bp, Vibrio fischeri ES114; identical to SEQ ID NO: 43783
  CDS (1)..(1431)

SEQ ID NO: 67452 - protein, 476 aa, Vibrio fischeri ES114; identical to SEQ ID NO: 43784

SEQ ID NO: 67453 - DNA, 1461 bp, Mesorhizobium loti MAFF303099; identical to SEQ ID NO: 43785
  CDS (1)..(1461): transl_table=11

SEQ ID NO: 67454 - protein, 486 aa, Mesorhizobium loti MAFF303099; identical to SEQ ID NO: 43786

SEQ ID NO: 67455 - DNA, 1536 bp, Mesorhizobium loti MAFF303099; identical to SEQ ID NO: 43787
  CDS (1)..(1536): transl_table=11

SEQ ID NO: 67456 - protein, 511 aa, Mesorhizobium loti MAFF303099; identical to SEQ ID NO: 43788

SEQ ID NO: 67457 - DNA, 1368 bp, Mesorhizobium loti MAFF303099; identical to SEQ ID NO: 43789
  CDS (1)..(1368): transl_table=11

SEQ ID NO: 67458 - protein, 455 aa, Mesorhizobium loti MAFF303099; identical to SEQ ID NO: 43790

SEQ ID NO: 67459 - DNA, 1362 bp, Borrelia burgdorferi B31; identical to SEQ ID NO: 43791
  CDS (1)..(1362): n means a or g or c or t/u

SEQ ID NO: 67460 - protein, 453 aa, Borrelia burgdorferi B31; identical to SEQ ID NO: 43792
  misc_feature (406)..(406): Xaa can be Ile or Met

SEQ ID NO: 67461 - DNA, 1320 bp, Aquifex aeolicus VF5; identical to SEQ ID NO: 43793
  CDS (1)..(1320): transl_table=11

SEQ ID NO: 67462 - protein, 439 aa, Aquifex aeolicus VF5; identical to SEQ ID NO: 43794

SEQ ID NO: 67463 - DNA, 1377 bp, Treponema pallidum subsp. pallidum str. Nichols; identical to SEQ ID NO: 43795
  CDS (1)..(1377): transl_table=11

SEQ ID NO: 67464 - protein, 458 aa, Treponema pallidum subsp. pallidum str. Nichols; identical to SEQ ID NO: 43796

SEQ ID NO: 67465 - DNA, 1161 bp, Chlamydophila pneumoniae CWL029; identical to SEQ ID NO: 43797
  CDS (1)..(1161): transl_table=11

SEQ ID NO: 67466 - protein, 386 aa, Chlamydophila pneumoniae CWL029; identical to SEQ ID NO: 43798

SEQ ID NO: 67467 - DNA, 1407 bp, Vibrio cholerae O1 biovar eltor str. N16961; identical to SEQ ID NO: 43799
  CDS (1)..(1407): transl_table=11

SEQ ID NO: 67468 - protein, 468 aa, Vibrio cholerae O1 biovar eltor str. N16961; identical to SEQ ID NO: 43800

SEQ ID NO: 67469 - DNA, 1452 bp, Bacillus halodurans C-125; identical to SEQ ID NO: 43801
  CDS (1)..(1452): transl_table=11

SEQ ID NO: 67470 - protein, 483 aa, Bacillus halodurans C-125; identical to SEQ ID NO: 43802

SEQ ID NO: 67471 - DNA, 1362 bp, Bacillus halodurans C-125; identical to SEQ ID NO: 43803
  CDS (1)..(1362): transl_table=11

SEQ ID NO: 67472 - protein, 453 aa, Bacillus halodurans C-125; identical to SEQ ID NO: 43804

SEQ ID NO: 67473 - DNA, 1422 bp, Pseudomonas aeruginosa PAO1; identical to SEQ ID NO: 43805
  CDS (1)..(1422): transl_table=11

SEQ ID NO: 67474 - protein, 473 aa, Pseudomonas aeruginosa PAO1; identical to SEQ ID NO: 43806

SEQ ID NO: 67475 - DNA, 1437 bp, Pseudomonas aeruginosa PAO1; identical to SEQ ID NO: 43807
  CDS (1)..(1437): transl_table=11

SEQ ID NO: 67476 - protein, 478 aa, Pseudomonas aeruginosa PAO1; identical to SEQ ID NO: 43808

SEQ ID NO: 67477 - DNA, 1431 bp, Pseudomonas aeruginosa PAO1; identical to SEQ ID NO: 43809
  CDS (1)..(1431): transl_table=11

SEQ ID NO: 67478 - protein, 476 aa, Pseudomonas aeruginosa PAO1; identical to SEQ ID NO: 43810

SEQ ID NO: 67479 - DNA, 1389 bp, Pseudomonas aeruginosa PAO1; identical to SEQ ID NO: 43811
  CDS (1)..(1389): transl_table=11

SEQ ID NO: 67480 - protein, 462 aa, Pseudomonas aeruginosa PAO1; identical to SEQ ID NO: 43812

SEQ ID NO: 67481 - DNA, 1428 bp, Xylella fastidiosa 9a5c; identical to SEQ ID NO: 43813
  CDS (1)..(1428): transl_table=11

SEQ ID NO: 67482 - protein, 475 aa, Xylella fastidiosa 9a5c; identical to SEQ ID NO: 43814

SEQ ID NO: 67483 - DNA, 1494 bp, Xylella fastidiosa 9a5c; identical to SEQ ID NO: 43815
  CDS (1)..(1494): transl_table=11

SEQ ID NO: 67484 - protein, 497 aa, Xylella fastidiosa 9a5c; identical to SEQ ID NO: 43816

SEQ ID NO: 67485 - DNA, 1542 bp, Sinorhizobium meliloti 1021; identical to SEQ ID NO: 43817
  CDS (1)..(1542): transl_table=11

SEQ ID NO: 67486 - protein, 513 aa, Sinorhizobium meliloti 1021; identical to SEQ ID NO: 43818

SEQ ID NO: 67487 - DNA, 1413 bp, Yersinia pestis CO92; identical to SEQ ID NO: 43819
  CDS (1)..(1413)

SEQ ID NO: 67488 - protein, 470 aa, Yersinia pestis CO92; identical to SEQ ID NO: 43820

SEQ ID NO: 67489 - DNA, 1338 bp, Yersinia pestis CO92; identical to SEQ ID NO: 43821
  CDS (1)..(1338)

SEQ ID NO: 67490 - protein, 445 aa, Yersinia pestis CO92; identical to SEQ ID NO: 43822

SEQ ID NO: 67491 - DNA, 1467 bp, Caulobacter crescentus CB15; identical to SEQ ID NO: 43823
  CDS (1)..(1467): transl_table=11

SEQ ID NO: 67492 - protein, 488 aa, Caulobacter crescentus CB15; identical to SEQ ID NO: 43824

SEQ ID NO: 67493 - DNA, 1713 bp, Ralstonia solanacearum GMI1000; identical to SEQ ID NO: 43825
  CDS (1)..(1713): transl_table=11

SEQ ID NO: 67494 - protein, 570 aa, Ralstonia solanacearum GMI1000; identical to SEQ ID NO: 43826

SEQ ID NO: 67495 - DNA, 1365 bp, Ralstonia solanacearum GMI1000; identical to SEQ ID NO: 43827
  CDS (1)..(1365): transl_table=11

SEQ ID NO: 67496 - protein, 454 aa, Ralstonia solanacearum GMI1000; identical to SEQ ID NO: 43828

SEQ ID NO: 67497 - DNA, 1476 bp, Ralstonia solanacearum GMI1000; identical to SEQ ID NO: 43829
  CDS (1)..(1476): transl_table=11

SEQ ID NO: 67498 - protein, 491 aa, Ralstonia solanacearum GMI1000; identical to SEQ ID NO: 43830

SEQ ID NO: 67499 - DNA, 1452 bp, Agrobacterium tumefaciens str. C58; identical to SEQ ID NO: 43831
  CDS (1)..(1452): transl_table=11

SEQ ID NO: 67500 - protein, 483 aa, Agrobacterium tumefaciens str. C58; identical to SEQ ID NO: 43832

SEQ ID NO: 67501 - DNA, 1542 bp, Agrobacterium tumefaciens str. C58; identical to SEQ ID NO: 43833
  CDS (1)..(1542): transl_table=11

SEQ ID NO: 67502 - protein, 513 aa, Agrobacterium tumefaciens str. C58; identical to SEQ ID NO: 43834

SEQ ID NO: 67503 - DNA, 1431 bp, Xanthomonas campestris pv. campestris str. ATCC 33913; identical to SEQ ID NO: 43835
  CDS (1)..(1431): transl_table=11

SEQ ID NO: 67504 - protein, 476 aa, Xanthomonas campestris pv. campestris str. ATCC 33913; identical to SEQ ID NO: 43836

SEQ ID NO: 67505 - DNA, 1428 bp, Xanthomonas axonopodis pv. citri str. 306; identical to SEQ ID NO: 43837
  CDS (1)..(1428): transl_table=11

SEQ ID NO: 67506 - protein, 475 aa, Xanthomonas axonopodis pv. citri str. 306; identical to SEQ ID NO: 43838

SEQ ID NO: 67507 - DNA, 1347 bp, Xanthomonas axonopodis pv. citri str. 306; identical to SEQ ID NO: 43839
  CDS (1)..(1347): transl_table=11

SEQ ID NO: 67508 - protein, 448 aa, Xanthomonas axonopodis pv. citri str. 306; identical to SEQ ID NO: 43840

SEQ ID NO: 67509 - DNA, 1476 bp, Brucella suis 1330; identical to SEQ ID NO: 43841
  CDS (1)..(1476): transl_table=11

SEQ ID NO: 67510 - protein, 491 aa, Brucella suis 1330; identical to SEQ ID NO: 43842

SEQ ID NO: 67511 - DNA, 1410 bp, Shigella flexneri 2a str. 301; identical to SEQ ID NO: 43843
  CDS (1)..(1410): transl_table=11

SEQ ID NO: 67512 - protein, 469 aa, Shigella flexneri 2a str. 301; identical to SEQ ID NO: 43844

SEQ ID NO: 67513 - DNA, 1347 bp, Leptospira interrogans serovar Lai str. 56601; identical to SEQ ID NO: 43845
  CDS (1)..(1347): transl_table=11

SEQ ID NO: 67514 - protein, 448 aa, Leptospira interrogans serovar Lai str. 56601; identical to SEQ ID NO: 43846

SEQ ID NO: 67515 - DNA, 1416 bp, Shewanella oneidensis MR-1; identical to SEQ ID NO: 43847
  CDS (1)..(1416): transl_table=11

SEQ ID NO: 67516 - protein, 471 aa, Shewanella oneidensis MR-1; identical to SEQ ID NO: 43848

SEQ ID NO: 67517 - DNA, 1407 bp, Pseudomonas putida KT2440; identical to SEQ ID NO: 43849
  CDS (1)..(1407): transl_table=11

SEQ ID NO: 67518 - protein, 468 aa, Pseudomonas putida KT2440; identical to SEQ ID NO: 43850

SEQ ID NO: 67519 - DNA, 1428 bp, Pseudomonas putida KT2440; identical to SEQ ID NO: 43851
  CDS (1)..(1428): transl_table=11

SEQ ID NO: 67520 - protein, 475 aa, Pseudomonas putida KT2440; identical to SEQ ID NO: 43852

SEQ ID NO: 67521 - DNA, 1356 bp, Pseudomonas putida KT2440; identical to SEQ ID NO: 43853
  CDS (1)..(1356): transl_table=11

SEQ ID NO: 67522 - protein, 451 aa, Pseudomonas putida KT2440; identical to SEQ ID NO: 43854

SEQ ID NO: 67523 - DNA, 1443 bp, Pseudomonas putida KT2440; identical to SEQ ID NO: 43855
  CDS (1)..(1443): transl_table=11

SEQ ID NO: 67524 - protein, 480 aa, Pseudomonas putida KT2440; identical to SEQ ID NO: 43856

SEQ ID NO: 67525 - DNA, 1500 bp, Bradyrhizobium japonicum USDA 110; identical to SEQ ID NO: 43857
  CDS (1)..(1500)

SEQ ID NO: 67526 - protein, 499 aa, Bradyrhizobium japonicum USDA 110; identical to SEQ ID NO: 43858

SEQ ID NO: 67527 - DNA, 1428 bp, Xylella fastidiosa Temecula1; identical to SEQ ID NO: 43859
  CDS (1)..(1428): transl_table=11

SEQ ID NO: 67528 - protein, 475 aa, Xylella fastidiosa Temecula1; identical to SEQ ID NO: 43860

SEQ ID NO: 67529 - DNA, 1356 bp, Clostridium tetani E88; identical to SEQ ID NO: 43861
  CDS (1)..(1356): transl_table=11

SEQ ID NO: 67530 - protein, 451 aa, Clostridium tetani E88; identical to SEQ ID NO: 43862

SEQ ID NO: 67531 - DNA, 1341 bp, Pseudomonas syringae pv. tomato str. DC3000; identical to SEQ ID NO: 43863
  CDS (1)..(1341): transl_table=11

SEQ ID NO: 67532 - protein, 446 aa, Pseudomonas syringae pv. tomato str. DC3000; identical to SEQ ID NO: 43864

SEQ ID NO: 67533 - DNA, 1437 bp, Pseudomonas syringae pv. tomato str. DC3000; identical to SEQ ID NO: 43865
  CDS (1)..(1437): transl_table=11

SEQ ID NO: 67534 - protein, 478 aa, Pseudomonas syringae pv. tomato str. DC3000; identical to SEQ ID NO: 43866

SEQ ID NO: 67535 - DNA, 1404 bp, Vibrio parahaemolyticus RIMD 2210633; identical to SEQ ID NO: 43867
  CDS (1)..(1404): transl_table=11

SEQ ID NO: 67536 - protein, 467 aa, Vibrio parahaemolyticus RIMD 2210633; identical to SEQ ID NO: 43868

SEQ ID NO: 67537 - DNA, 1338 bp, Salmonella enterica subsp. enterica serovar Typhi Ty2; identical to SEQ ID NO: 43869
  CDS (1)..(1338): transl_table=11

SEQ ID NO: 67538 - protein, 445 aa, Salmonella enterica subsp. enterica serovar Typhi Ty2; identical to SEQ ID NO: 43870

SEQ ID NO: 67539 - DNA, 1410 bp, Salmonella enterica subsp. enterica serovar Typhi Ty2; identical to SEQ ID NO: 43871
  CDS (1)..(1410): transl_table=11

SEQ ID NO: 67540 - protein, 469 aa, Salmonella enterica subsp. enterica serovar Typhi Ty2; identical to SEQ ID NO: 43872

SEQ ID NO: 67541 - DNA, 1362 bp, Bacteroides thetaiotaomicron VPI-5482; identical to SEQ ID NO: 43873
  CDS (1)..(1362): transl_table=11

SEQ ID NO: 67542 - protein, 453 aa, Bacteroides thetaiotaomicron VPI-5482; identical to SEQ ID NO: 43874

SEQ ID NO: 67543 - DNA, 1350 bp, Bacteroides thetaiotaomicron VPI-5482; identical to SEQ ID NO: 43875
  CDS (1)..(1350): transl_table=11

SEQ ID NO: 67544 - protein, 449 aa, Bacteroides thetaiotaomicron VPI-5482; identical to SEQ ID NO: 43876

SEQ ID NO: 67545 - DNA, 1374 bp, Bacteroides thetaiotaomicron VPI-5482; identical to SEQ ID NO: 43877
  CDS (1)..(1374): transl_table=11

SEQ ID NO: 67546 - protein, 457 aa, Bacteroides thetaiotaomicron VPI-5482; identical to SEQ ID NO: 43878

SEQ ID NO: 67547 - DNA, 1161 bp, Chlamydophila caviae GPIC; identical to SEQ ID NO: 43879
  CDS (1)..(1161): transl_table=11

SEQ ID NO: 67548 - protein, 386 aa, Chlamydophila caviae GPIC; identical to SEQ ID NO: 43880

SEQ ID NO: 67549 - DNA, 1368 bp, Nitrosomonas europaea ATCC 19718; identical to SEQ ID NO: 43881
  CDS (1)..(1368): transl_table=11

SEQ ID NO: 67550 - protein, 455 aa, Nitrosomonas europaea ATCC 19718; identical to SEQ ID NO: 43882

SEQ ID NO: 67551 - DNA, 1359 bp, Nitrosomonas europaea ATCC 19718; identical to SEQ ID NO: 43883
  CDS (1)..(1359): transl_table=11

SEQ ID NO: 67552 - protein, 452 aa, Nitrosomonas europaea ATCC 19718; identical to SEQ ID NO: 43884

SEQ ID NO: 67553 - DNA, 1314 bp, Nitrosomonas europaea ATCC 19718; identical to SEQ ID NO: 43885
  CDS (1)..(1314): transl_table=11

SEQ ID NO: 67554 - protein, 437 aa, Nitrosomonas europaea ATCC 19718; identical to SEQ ID NO: 43886

SEQ ID NO: 67555 - DNA, 1458 bp, Rhodopirellula baltica SH 1; identical to SEQ ID NO: 43887
  CDS (1)..(1458): transl_table=11

SEQ ID NO: 67556 - protein, 485 aa, Rhodopirellula baltica SH 1; identical to SEQ ID NO: 43888

SEQ ID NO: 67557 - DNA, 1368 bp, Rhodopirellula baltica SH 1; identical to SEQ ID NO: 43889
  CDS (1)..(1368): transl_table=11

SEQ ID NO: 67558 - protein, 455 aa, Rhodopirellula baltica SH 1; identical to SEQ ID NO: 43890

SEQ ID NO: 67559 - DNA, 1476 bp, Rhodopirellula baltica SH 1; identical to SEQ ID NO: 43891
  CDS (1)..(1476): transl_table=11

SEQ ID NO: 67560 - protein, 491 aa, Rhodopirellula baltica SH 1; identical to SEQ ID NO: 43892

SEQ ID NO: 67561 - DNA, 1458 bp, Rhodopirellula baltica SH 1; identical to SEQ ID NO: 43893
  CDS (1)..(1458): transl_table=11

SEQ ID NO: 67562 - protein, 485 aa, Rhodopirellula baltica SH 1; identical to SEQ ID NO: 43894

SEQ ID NO: 67563 - DNA, 1488 bp, Bordetella pertussis Tohama I; identical to SEQ ID NO: 43895
  CDS (1)..(1488): transl_table=11

SEQ ID NO: 67564 - protein, 495 aa, Bordetella pertussis Tohama I; identical to SEQ ID NO: 43896

SEQ ID NO: 67565 - DNA, 1407 bp, Bordetella parapertussis 12822; identical to SEQ ID NO: 43897
  CDS (1)..(1407): transl_table=11

SEQ ID NO: 67566 - protein, 468 aa, Bordetella parapertussis 12822; identical to SEQ ID NO: 43898

SEQ ID NO: 67567 - DNA, 1389 bp, Bordetella bronchiseptica RB50; identical to SEQ ID NO: 43899
  CDS (1)..(1389): transl_table=11

SEQ ID NO: 67568 - protein, 462 aa, Bordetella bronchiseptica RB50; identical to SEQ ID NO: 43900

SEQ ID NO: 67569 - DNA, 1314 bp, Chromobacterium violaceum ATCC 12472; identical to SEQ ID NO: 43901
  CDS (1)..(1314): transl_table=11

SEQ ID NO: 67570 - protein, 437 aa, Chromobacterium violaceum ATCC 12472; identical to SEQ ID NO: 43902

SEQ ID NO: 67571 - DNA, 1377 bp, Chromobacterium violaceum ATCC 12472; identical to SEQ ID NO: 43903
  CDS (1)..(1377): transl_table=11

SEQ ID NO: 67572 - protein, 458 aa, Chromobacterium violaceum ATCC 12472; identical to SEQ ID NO: 43904

SEQ ID NO: 67573 - DNA, 1413 bp, Chromobacterium violaceum ATCC 12472; identical to SEQ ID NO: 43905
  CDS (1)..(1413): transl_table=11

SEQ ID NO: 67574 - protein, 470 aa, Chromobacterium violaceum ATCC 12472; identical to SEQ ID NO: 43906

SEQ ID NO: 67575 - DNA, 1341 bp, Chromobacterium violaceum ATCC 12472; identical to SEQ ID NO: 43907
  CDS (1)..(1341): transl_table=11

SEQ ID NO: 67576 - protein, 446 aa, Chromobacterium violaceum ATCC 12472; identical to SEQ ID NO: 43908

SEQ ID NO: 67577 - DNA, 1350 bp, Porphyromonas gingivalis W83; identical to SEQ ID NO: 43909
  CDS (1)..(1350): transl_table=11

SEQ ID NO: 67578 - protein, 449 aa, Porphyromonas gingivalis W83; identical to SEQ ID NO: 43910

SEQ ID NO: 67579 - DNA, 1473 bp, Photorhabdus luminescens subsp. laumondii TTO1; identical to SEQ ID NO: 43911
  CDS (1)..(1473): transl_table=11

SEQ ID NO: 67580 - protein, 490 aa, Photorhabdus luminescens subsp. laumondii TTO1; identical to SEQ ID NO: 43912

SEQ ID NO: 67581 - DNA, 1338 bp, Photorhabdus luminescens subsp. laumondii TTO1; identical to SEQ ID NO: 43913
  CDS (1)..(1338): transl_table=11

SEQ ID NO: 67582 - protein, 445 aa, Photorhabdus luminescens subsp. laumondii TTO1; identical to SEQ ID NO: 43914

SEQ ID NO: 67583 - DNA, 1410 bp, Vibrio vulnificus YJ016; identical to SEQ ID NO: 43915
  CDS (1)..(1410): transl_table=11

SEQ ID NO: 67584 - protein, 469 aa, Vibrio vulnificus YJ016; identical to SEQ ID NO: 43916

SEQ ID NO: 67585 - DNA, 1401 bp, Vibrio vulnificus YJ016; identical to SEQ ID NO: 43917
  CDS (1)..(1401): transl_table=11

SEQ ID NO: 67586 - protein, 466 aa, Vibrio vulnificus YJ016; identical to SEQ ID NO: 43918

SEQ ID NO: 67587 - DNA, 1488 bp, Rhodopseudomonas palustris CGA009; identical to SEQ ID NO: 43919
  CDS (1)..(1488): transl_table=11

SEQ ID NO: 67588 - protein, 495 aa, Rhodopseudomonas palustris CGA009; identical to SEQ ID NO: 43920

SEQ ID NO: 67589 - DNA, 1386 bp, Geobacter sulfurreducens PCA; identical to SEQ ID NO: 43921
  CDS (1)..(1386): transl_table=11

SEQ ID NO: 67590 - protein, 461 aa, Geobacter sulfurreducens PCA; identical to SEQ ID NO: 43922

SEQ ID NO: 67591 - DNA, 1362 bp, Geobacter sulfurreducens PCA; identical to SEQ ID NO: 43923
  CDS (1)..(1362): transl_table=11

SEQ ID NO: 67592 - protein, 453 aa, Geobacter sulfurreducens PCA; identical to SEQ ID NO: 43924

SEQ ID NO: 67593 - DNA, 1413 bp, Geobacter sulfurreducens PCA; identical to SEQ ID NO: 43925
  CDS (1)..(1413): transl_table=11

SEQ ID NO: 67594 - protein, 470 aa, Geobacter sulfurreducens PCA; identical to SEQ ID NO: 43926

SEQ ID NO: 67595 - DNA, 1398 bp, Geobacter sulfurreducens PCA; identical to SEQ ID NO: 43927
  CDS (1)..(1398): transl_table=11

SEQ ID NO: 67596 - protein, 465 aa, Geobacter sulfurreducens PCA; identical to SEQ ID NO: 43928

SEQ ID NO: 67597 - DNA, 1371 bp, Geobacter sulfurreducens PCA; identical to SEQ ID NO: 43929
  CDS (1)..(1371): transl_table=11

SEQ ID NO: 67598 - protein, 456 aa, Geobacter sulfurreducens PCA; identical to SEQ ID NO: 43930

SEQ ID NO: 67599 - DNA, 1404 bp, Geobacter sulfurreducens PCA; identical to SEQ ID NO: 43931
  CDS (1)..(1404): transl_table=11

SEQ ID NO: 67600 - protein, 467 aa, Geobacter sulfurreducens PCA; identical to SEQ ID NO: 43932

SEQ ID NO: 67601 - DNA, 1362 bp, Geobacter sulfurreducens PCA; identical to SEQ ID NO: 43933
  CDS (1)..(1362): transl_table=11

SEQ ID NO: 67602 - protein, 453 aa, Geobacter sulfurreducens PCA; identical to SEQ ID NO: 43934

SEQ ID NO: 67603 - DNA, 1383 bp, Geobacter sulfurreducens PCA; identical to SEQ ID NO: 43935
  CDS (1)..(1383): transl_table=11

SEQ ID NO: 67604 - protein, 460 aa, Geobacter sulfurreducens PCA; identical to SEQ ID NO: 43936

SEQ ID NO: 67605 - DNA, 1377 bp, Geobacter sulfurreducens PCA; identical to SEQ ID NO: 43937
  CDS (1)..(1377): transl_table=11

SEQ ID NO: 67606 - protein, 458 aa, Geobacter sulfurreducens PCA; identical to SEQ ID NO: 43938

SEQ ID NO: 67607 - DNA, 1437 bp, Geobacter sulfurreducens PCA; identical to SEQ ID NO: 43939
  CDS (1)..(1437): transl_table=11

SEQ ID NO: 67608 - protein, 478 aa, Geobacter sulfurreducens PCA; identical to SEQ ID NO: 43940

SEQ ID NO: 67609 - DNA, 1335 bp, Geobacter sulfurreducens PCA; identical to SEQ ID NO: 43941
  CDS (1)..(1335): transl_table=11

SEQ ID NO: 67610 - protein, 444 aa, Geobacter sulfurreducens PCA; identical to SEQ ID NO: 43942

SEQ ID NO: 67611 - DNA, 1368 bp, Geobacter sulfurreducens PCA; identical to SEQ ID NO: 43943
  CDS (1)..(1368): transl_table=11

SEQ ID NO: 67612 - protein, 455 aa, Geobacter sulfurreducens PCA; identical to SEQ ID NO: 43944

SEQ ID NO: 67613 - DNA, 1395 bp, Geobacter sulfurreducens PCA; identical to SEQ ID NO: 43945
  CDS (1)..(1395): transl_table=11

SEQ ID NO: 67614 - protein, 464 aa, Geobacter sulfurreducens PCA; identical to SEQ ID NO: 43946

SEQ ID NO: 67615 - DNA, 1371 bp, Geobacter sulfurreducens PCA; identical to SEQ ID NO: 43947
  CDS (1)..(1371): transl_table=11

SEQ ID NO: 67616 - protein, 456 aa, Geobacter sulfurreducens PCA; identical to SEQ ID NO: 43948

SEQ ID NO: 67617 - DNA, 1374 bp, Geobacter sulfurreducens PCA; identical to SEQ ID NO: 43949
  CDS (1)..(1374): transl_table=11

SEQ ID NO: 67618 - protein, 457 aa, Geobacter sulfurreducens PCA; identical to SEQ ID NO: 43950

SEQ ID NO: 67619 - DNA, 1413 bp, Bdellovibrio bacteriovorus HD100; identical to SEQ ID NO: 43951
  CDS (1)..(1413): transl_table=11

SEQ ID NO: 67620 - protein, 470 aa, Bdellovibrio bacteriovorus HD100; identical to SEQ ID NO: 43952

SEQ ID NO: 67621 - DNA, 1407 bp, Bdellovibrio bacteriovorus HD100; identical to SEQ ID NO: 43953
  CDS (1)..(1407): transl_table=11

SEQ ID NO: 67622 - protein, 468 aa, Bdellovibrio bacteriovorus HD100; identical to SEQ ID NO: 43954

SEQ ID NO: 67623 - DNA, 1512 bp, Bdellovibrio bacteriovorus HD100; identical to SEQ ID NO: 43955
  CDS (1)..(1512): transl_table=11

SEQ ID NO: 67624 - protein, 503 aa, Bdellovibrio bacteriovorus HD100; identical to SEQ ID NO: 43956

SEQ ID NO: 67625 - DNA, 1404 bp, Bdellovibrio bacteriovorus HD100; identical to SEQ ID NO: 43957
  CDS (1)..(1404): transl_table=11

SEQ ID NO: 67626 - protein, 467 aa, Bdellovibrio bacteriovorus HD100; identical to SEQ ID NO: 43958

SEQ ID NO: 67627 - DNA, 1422 bp, Treponema denticola ATCC 35405; identical to SEQ ID NO: 43959
  CDS (1)..(1422): transl_table=11

SEQ ID NO: 67628 - protein, 473 aa, Treponema denticola ATCC 35405; identical to SEQ ID NO: 43960

SEQ ID NO: 67629 - DNA, 1293 bp, Yersinia pestis biovar Medievalis str. 91001; identical to SEQ ID NO: 43961
  CDS (1)..(1293): transl_table=11

SEQ ID NO: 67630 - protein, 430 aa, Yersinia pestis biovar Medievalis str. 91001; identical to SEQ ID NO: 43962

SEQ ID NO: 67631 - DNA, 1326 bp, Parachlamydia sp. UWE25; identical to SEQ ID NO: 43963
  CDS (1)..(1326): transl_table=11

SEQ ID NO: 67632 - protein, 441 aa, Parachlamydia sp. UWE25; identical to SEQ ID NO: 43964

SEQ ID NO: 67633 - DNA, 1431 bp, Desulfovibrio vulgaris subsp. vulgaris str. Hildenborough; identical to SEQ ID NO: 43965
  CDS (1)..(1431): transl_table=11

SEQ ID NO: 67634 - protein, 476 aa, Desulfovibrio vulgaris subsp. vulgaris str. Hildenborough; identical to SEQ ID NO: 43966

SEQ ID NO: 67635 - DNA, 1365 bp, Desulfovibrio vulgaris subsp. vulgaris str. Hildenborough; identical to SEQ ID NO: 43967
  CDS (1)..(1365): transl_table=11

SEQ ID NO: 67636 - protein, 454 aa, Desulfovibrio vulgaris subsp. vulgaris str. Hildenborough; identical to SEQ ID NO: 43968

SEQ ID NO: 67637 - DNA, 1404 bp, Desulfovibrio vulgaris subsp. vulgaris str. Hildenborough; identical to SEQ ID NO: 43969
  CDS (1)..(1404): transl_table=11

SEQ ID NO: 67638 - protein, 467 aa, Desulfovibrio vulgaris subsp. vulgaris str. Hildenborough; identical to SEQ ID NO: 43970

SEQ ID NO: 67639 - DNA, 1431 bp, Desulfovibrio vulgaris subsp. vulgaris str. Hildenborough; identical to SEQ ID NO: 43971
  CDS (1)..(1431): transl_table=11

SEQ ID NO: 67640 - protein, 476 aa, Desulfovibrio vulgaris subsp. vulgaris str. Hildenborough; identical to SEQ ID NO: 43972

SEQ ID NO: 67641 - DNA, 1380 bp, Desulfovibrio vulgaris subsp. vulgaris str. Hildenborough; identical to SEQ ID NO: 43973
  CDS (1)..(1380): transl_table=11

SEQ ID NO: 67642 - protein, 459 aa, Desulfovibrio vulgaris subsp. vulgaris str. Hildenborough; identical to SEQ ID NO: 43974

SEQ ID NO: 67643 - DNA, 1389 bp, Desulfovibrio vulgaris subsp. vulgaris str. Hildenborough; identical to SEQ ID NO: 43975
  CDS (1)..(1389): transl_table=11

SEQ ID NO: 67644 - protein, 462 aa, Desulfovibrio vulgaris subsp. vulgaris str. Hildenborough; identical to SEQ ID NO: 43976

SEQ ID NO: 67645 - DNA, 1392 bp, Desulfovibrio vulgaris subsp. vulgaris str. Hildenborough; identical to SEQ ID NO: 43977
  CDS (1)..(1392): transl_table=11

SEQ ID NO: 67646 - protein, 463 aa, Desulfovibrio vulgaris subsp. vulgaris str. Hildenborough; identical to SEQ ID NO: 43978

SEQ ID NO: 67647 - DNA, 1419 bp, Desulfovibrio vulgaris subsp. vulgaris str. Hildenborough; identical to SEQ ID NO: 43979
  CDS (1)..(1419): transl_table=11

SEQ ID NO: 67648 - protein, 472 aa, Desulfovibrio vulgaris subsp. vulgaris str. Hildenborough; identical to SEQ ID NO: 43980

SEQ ID NO: 67649 - DNA, 1380 bp, Desulfovibrio vulgaris subsp. vulgaris str. Hildenborough; identical to SEQ ID NO: 43981
  CDS (1)..(1380): transl_table=11

SEQ ID NO: 67650 - protein, 459 aa, Desulfovibrio vulgaris subsp. vulgaris str. Hildenborough; identical to SEQ ID NO: 43982

SEQ ID NO: 67651 - DNA, 1356 bp, Desulfovibrio vulgaris subsp. vulgaris str. Hildenborough; identical to SEQ ID NO: 43983
  CDS (1)..(1356): transl_table=11

SEQ ID NO: 67652 - protein, 451 aa, Desulfovibrio vulgaris subsp. vulgaris str. Hildenborough; identical to SEQ ID NO: 43984

SEQ ID NO: 67653 - DNA, 1380 bp, Desulfovibrio vulgaris subsp. vulgaris str. Hildenborough; identical to SEQ ID NO: 43985
  CDS (1)..(1380): transl_table=11

SEQ ID NO: 67654 - protein, 459 aa, Desulfovibrio vulgaris subsp. vulgaris str. Hildenborough; identical to SEQ ID NO: 43986

SEQ ID NO: 67655 - DNA, 1416 bp, Acinetobacter sp. ADP1; identical to SEQ ID NO: 43987
  CDS (1)..(1416): transl_table=11

SEQ ID NO: 67656 - protein, 471 aa, Acinetobacter sp. ADP1; identical to SEQ ID NO: 43988

SEQ ID NO: 67657 - DNA, 1476 bp, Acinetobacter sp. ADP1; identical to SEQ ID NO: 43989
  CDS (1)..(1476): transl_table=11

SEQ ID NO: 67658 - protein, 491 aa, Acinetobacter sp. ADP1; identical to SEQ ID NO: 43990

SEQ ID NO: 67659 - DNA, 1413 bp, Erwinia carotovora subsp. atroseptica SCRI1043; identical to SEQ ID NO: 43991
  CDS (1)..(1413)

SEQ ID NO: 67660 - protein, 470 aa, Erwinia carotovora subsp. atroseptica SCRI1043; identical to SEQ ID NO: 43992

SEQ ID NO: 67661 - DNA, 1332 bp, Desulfotalea psychrophila LSv54; identical to SEQ ID NO: 43993
  CDS (1)..(1332): transl_table=11

SEQ ID NO: 67662 - protein, 443 aa, Desulfotalea psychrophila LSv54; identical to SEQ ID NO: 43994

SEQ ID NO: 67663 - DNA, 1365 bp, Desulfotalea psychrophila LSv54; identical to SEQ ID NO: 43995
  CDS (1)..(1365): transl_table=11

SEQ ID NO: 67664 - protein, 454 aa, Desulfotalea psychrophila LSv54; identical to SEQ ID NO: 43996

SEQ ID NO: 67665 - DNA, 1437 bp, Desulfotalea psychrophila LSv54; identical to SEQ ID NO: 43997
  CDS (1)..(1437): transl_table=11

SEQ ID NO: 67666 - protein, 478 aa, Desulfotalea psychrophila LSv54; identical to SEQ ID NO: 43998

SEQ ID NO: 67667 - DNA, 1383 bp, Desulfotalea psychrophila LSv54; identical to SEQ ID NO: 43999
  CDS (1)..(1383): transl_table=11

SEQ ID NO: 67668 - protein, 460 aa, Desulfotalea psychrophila LSv54; identical to SEQ ID NO: 44000

SEQ ID NO: 67669 - DNA, 1365 bp, Desulfotalea psychrophila LSv54; identical to SEQ ID NO: 44001
  CDS (1)..(1365): transl_table=11

SEQ ID NO: 67670 - protein, 454 aa, Desulfotalea psychrophila LSv54; identical to SEQ ID NO: 44002

SEQ ID NO: 67671 - DNA, 1413 bp, Yersinia pseudotuberculosis IP 32953; identical to SEQ ID NO: 44003
  CDS (1)..(1413): transl_table=11

SEQ ID NO: 67672 - protein, 470 aa, Yersinia pseudotuberculosis IP 32953; identical to SEQ ID NO: 44004

SEQ ID NO: 67673 - DNA, 1365 bp, Yersinia pseudotuberculosis IP 32953; identical to SEQ ID NO: 44005
  CDS (1)..(1365): transl_table=11

SEQ ID NO: 67674 - protein, 454 aa, Yersinia pseudotuberculosis IP 32953; identical to SEQ ID NO: 44006

SEQ ID NO: 67675 - DNA, 1359 bp, Borrelia garinii PBi; identical to SEQ ID NO: 44007
  CDS (1)..(1359): transl_table=11

SEQ ID NO: 67676 - protein, 452 aa, Borrelia garinii PBi; identical to SEQ ID NO: 44008

SEQ ID NO: 67677 - DNA, 1395 bp, Symbiobacterium thermophilum IAM 14863; identical to SEQ ID NO: 44009
  CDS (1)..(1395): transl_table=11

SEQ ID NO: 67678 - protein, 464 aa, Symbiobacterium thermophilum IAM 14863; identical to SEQ ID NO: 44010

SEQ ID NO: 67679 - DNA, 1329 bp, Legionella pneumophila subsp. pneumophila str. Philadelphia 1; identical to SEQ ID NO: 44011
  CDS (1)..(1329): transl_table=11

SEQ ID NO: 67680 - protein, 442 aa, Legionella pneumophila subsp. pneumophila str. Philadelphia 1; identical to SEQ ID NO: 44012

SEQ ID NO: 67681 - DNA, 1362 bp, Legionella pneumophila subsp. pneumophila str. Philadelphia 1; identical to SEQ ID NO: 44013
  CDS (1)..(1362): transl_table=11

SEQ ID NO: 67682 - protein, 453 aa, Legionella pneumophila subsp. pneumophila str. Philadelphia 1; identical to SEQ ID NO: 44014

SEQ ID NO: 67683 - DNA, 1350 bp, Bacteroides fragilis YCH46; identical to SEQ ID NO: 44015
  CDS (1)..(1350): transl_table=11

SEQ ID NO: 67684 - protein, 449 aa, Bacteroides fragilis YCH46; identical to SEQ ID NO: 44016

SEQ ID NO: 67685 - DNA, 1338 bp, Bacteroides fragilis YCH46; identical to SEQ ID NO: 44017
  CDS (1)..(1338): transl_table=11

SEQ ID NO: 67686 - protein, 445 aa, Bacteroides fragilis YCH46; identical to SEQ ID NO: 44018

SEQ ID NO: 67687 - DNA, 1332 bp, Bacteroides fragilis YCH46; identical to SEQ ID NO: 44019
  CDS (1)..(1332): transl_table=11

SEQ ID NO: 67688 - protein, 443 aa, Bacteroides fragilis YCH46; identical to SEQ ID NO: 44020

SEQ ID NO: 67689 - DNA, 1344 bp, Bacteroides fragilis YCH46; identical to SEQ ID NO: 44021
  CDS (1)..(1344): transl_table=11

SEQ ID NO: 67690 - protein, 447 aa, Bacteroides fragilis YCH46; identical to SEQ ID NO: 44022

SEQ ID NO: 67691 - DNA, 1383 bp, Methylococcus capsulatus str. Bath; identical to SEQ ID NO: 44023
  CDS (1)..(1383): transl_table=11

SEQ ID NO: 67692 - protein, 460 aa, Methylococcus capsulatus str. Bath; identical to SEQ ID NO: 44024

SEQ ID NO: 67693 - DNA, 1413 bp, Methylococcus capsulatus str. Bath; identical to SEQ ID NO: 44025
  CDS (1)..(1413): transl_table=11

SEQ ID NO: 67694 - protein, 470 aa, Methylococcus capsulatus str. Bath; identical to SEQ ID NO: 44026

SEQ ID NO: 67695 - DNA, 1314 bp, Legionella pneumophila str. Paris; identical to SEQ ID NO: 44027
  CDS (1)..(1314): transl_table=11

SEQ ID NO: 67696 - protein, 437 aa, Legionella pneumophila str. Paris; identical to SEQ ID NO: 44028

SEQ ID NO: 67697 - DNA, 1329 bp, Legionella pneumophila str. Lens; identical to SEQ ID NO: 44029
  CDS (1)..(1329): transl_table=11

SEQ ID NO: 67698 - protein, 442 aa, Legionella pneumophila str. Lens; identical to SEQ ID NO: 44030

SEQ ID NO: 67699 - DNA, 1458 bp, Photobacterium profundum SS9; identical to SEQ ID NO: 44031
  CDS (1)..(1458): transl_table=11

SEQ ID NO: 67700 - protein, 485 aa, Photobacterium profundum SS9; identical to SEQ ID NO: 44032

SEQ ID NO: 67701 - DNA, 1416 bp, Photobacterium profundum SS9; identical to SEQ ID NO: 44033
  CDS (1)..(1416): transl_table=11

SEQ ID NO: 67702 - protein, 471 aa, Photobacterium profundum SS9; identical to SEQ ID NO: 44034

SEQ ID NO: 67703 - DNA, 1410 bp, Salmonella enterica subsp. enterica serovar Paratypi A str. ATCC; identical to SEQ ID NO: 44035
  CDS (1)..(1410): transl_table=11

SEQ ID NO: 67704 - protein, 469 aa, Salmonella enterica subsp. enterica serovar Paratypi A str. ATCC; identical to SEQ ID NO: 44036

SEQ ID NO: 67705 - DNA, 1407 bp, Idiomarina loihiensis L2TR; identical to SEQ ID NO: 44037
  CDS (1)..(1407): transl_table=11

SEQ ID NO: 67706 - protein, 468 aa, Idiomarina loihiensis L2TR; identical to SEQ ID NO: 44038

SEQ ID NO: 67707 - DNA, 1341 bp, Idiomarina loihiensis L2TR; identical to SEQ ID NO: 44039
  CDS (1)..(1341): transl_table=11

SEQ ID NO: 67708 - protein, 446 aa, Idiomarina loihiensis L2TR; identical to SEQ ID NO: 44040

SEQ ID NO: 67709 - DNA, 1404 bp, Azoarcus sp. EbN1; identical to SEQ ID NO: 44041
  CDS (1)..(1404): transl_table=11

SEQ ID NO: 67710 - protein, 467 aa, Azoarcus sp. EbN1; identical to SEQ ID NO: 44042

SEQ ID NO: 67711 - DNA, 1392 bp, Azoarcus sp. EbN1; identical to SEQ ID NO: 44043
  CDS (1)..(1392): transl_table=11

SEQ ID NO: 67712 - protein, 463 aa, Azoarcus sp. EbN1; identical to SEQ ID NO: 44044

SEQ ID NO: 67713 - DNA, 1371 bp, Azoarcus sp. EbN1; identical to SEQ ID NO: 44045
  CDS (1)..(1371): transl_table=11

SEQ ID NO: 67714 - protein, 456 aa, Azoarcus sp. EbN1; identical to SEQ ID NO: 44046

SEQ ID NO: 67715 - DNA, 1428 bp, Azoarcus sp. EbN1; identical to SEQ ID NO: 44047
  CDS (1)..(1428): transl_table=11

SEQ ID NO: 67716 - protein, 475 aa, Azoarcus sp. EbN1; identical to SEQ ID NO: 44048

SEQ ID NO: 67717 - DNA, 1395 bp, Azoarcus sp. EbN1; identical to SEQ ID NO: 44049
  CDS (1)..(1395): transl_table=11

SEQ ID NO: 67718 - protein, 464 aa, Azoarcus sp. EbN1; identical to SEQ ID NO: 44050

SEQ ID NO: 67719 - DNA, 1428 bp, Xylella fastidiosa Ann-1; identical to SEQ ID NO: 44051
  CDS (1)..(1428)

SEQ ID NO: 67720 - protein, 475 aa, Xylella fastidiosa Ann-1; identical to SEQ ID NO: 44052

SEQ ID NO: 67721 - DNA, 1413 bp, Xylella fastidiosa Ann-1; identical to SEQ ID NO: 44053
  CDS (1)..(1413)

SEQ ID NO: 67722 - protein, 470 aa, Xylella fastidiosa Ann-1; identical to SEQ ID NO: 44054

SEQ ID NO: 67723 - DNA, 1464 bp, Magnetospirillum magnetotacticum MS-1; identical to SEQ ID NO: 44055
  CDS (1)..(1464)

SEQ ID NO: 67724 - protein, 487 aa, Magnetospirillum magnetotacticum MS-1; identical to SEQ ID NO: 44056

SEQ ID NO: 67725 - DNA, 1374 bp, Magnetospirillum magnetotacticum MS-1; identical to SEQ ID NO: 44057
  CDS (1)..(1374)

SEQ ID NO: 67726 - protein, 457 aa, Magnetospirillum magnetotacticum MS-1; identical to SEQ ID NO: 44058

SEQ ID NO: 67727 - DNA, 1437 bp, Azotobacter vinelandii; identical to SEQ ID NO: 44059
  CDS (1)..(1437)

SEQ ID NO: 67728 - protein, 478 aa, Azotobacter vinelandii; identical to SEQ ID NO: 44060

SEQ ID NO: 67729 - DNA, 1401 bp, Azotobacter vinelandii; identical to SEQ ID NO: 44061
  CDS (1)..(1401)

SEQ ID NO: 67730 - protein, 466 aa, Azotobacter vinelandii; identical to SEQ ID NO: 44062

SEQ ID NO: 67731 - DNA, 1341 bp, Azotobacter vinelandii; identical to SEQ ID NO: 44063
  CDS (1)..(1341)

SEQ ID NO: 67732 - protein, 446 aa, Azotobacter vinelandii; identical to SEQ ID NO: 44064

SEQ ID NO: 67733 - DNA, 1386 bp, Desulfitobacterium hafniense DCB-2; identical to SEQ ID NO: 44065
  CDS (1)..(1386)

SEQ ID NO: 67734 - protein, 461 aa, Desulfitobacterium hafniense DCB-2; identical to SEQ ID NO: 44066

SEQ ID NO: 67735 - DNA, 1338 bp, Pseudomonas syringae pv. syringae B728a; identical to SEQ ID NO: 44067
  CDS (1)..(1338)

SEQ ID NO: 67736 - protein, 445 aa, Pseudomonas syringae pv. syringae B728a; identical to SEQ ID NO: 44068

SEQ ID NO: 67737 - DNA, 1401 bp, Desulfovibrio desulfuricans G20; identical to SEQ ID NO: 44069
  CDS (1)..(1401)

SEQ ID NO: 67738 - protein, 466 aa, Desulfovibrio desulfuricans G20; identical to SEQ ID NO: 44070

SEQ ID NO: 67739 - DNA, 1380 bp, Desulfovibrio desulfuricans G20; identical to SEQ ID NO: 44071
  CDS (1)..(1380)

SEQ ID NO: 67740 - protein, 459 aa, Desulfovibrio desulfuricans G20; identical to SEQ ID NO: 44072

SEQ ID NO: 67741 - DNA, 1344 bp, Desulfovibrio desulfuricans G20; identical to SEQ ID NO: 44073
  CDS (1)..(1344)

SEQ ID NO: 67742 - protein, 447 aa, Desulfovibrio desulfuricans G20; identical to SEQ ID NO: 44074

SEQ ID NO: 67743 - DNA, 1398 bp, Desulfovibrio desulfuricans G20; identical to SEQ ID NO: 44075
  CDS (1)..(1398)

SEQ ID NO: 67744 - protein, 465 aa, Desulfovibrio desulfuricans G20; identical to SEQ ID NO: 44076

SEQ ID NO: 67745 - DNA, 1398 bp, Desulfovibrio desulfuricans G20; identical to SEQ ID NO: 44077
  CDS (1)..(1398)

SEQ ID NO: 67746 - protein, 465 aa, Desulfovibrio desulfuricans G20; identical to SEQ ID NO: 44078

SEQ ID NO: 67747 - DNA, 1374 bp, Desulfovibrio desulfuricans G20; identical to SEQ ID NO: 44079
  CDS (1)..(1374)

SEQ ID NO: 67748 - protein, 457 aa, Desulfovibrio desulfuricans G20; identical to SEQ ID NO: 44080

SEQ ID NO: 67749 - DNA, 1350 bp, Pseudomonas aeruginosa UCBPP-PA14; identical to SEQ ID NO: 44081
  CDS (1)..(1350)

SEQ ID NO: 67750 - protein, 449 aa, Pseudomonas aeruginosa UCBPP-PA14; identical to SEQ ID NO: 44082

SEQ ID NO: 67751 - DNA, 1389 bp, Pseudomonas aeruginosa UCBPP-PA14; identical to SEQ ID NO: 44083
  CDS (1)..(1389)

SEQ ID NO: 67752 - protein, 462 aa, Pseudomonas aeruginosa UCBPP-PA14; identical to SEQ ID NO: 44084

SEQ ID NO: 67753 - DNA, 1353 bp, Dechloromonas aromatica RCB; identical to SEQ ID NO: 44085
  CDS (1)..(1353)

SEQ ID NO: 67754 - protein, 450 aa, Dechloromonas aromatica RCB; identical to SEQ ID NO: 44086

SEQ ID NO: 67755 - DNA, 1413 bp, Dechloromonas aromatica RCB; identical to SEQ ID NO: 44087
  CDS (1)..(1413)

SEQ ID NO: 67756 - protein, 470 aa, Dechloromonas aromatica RCB; identical to SEQ ID NO: 44088

SEQ ID NO: 67757 - DNA, 1410 bp, Dechloromonas aromatica RCB; identical to SEQ ID NO: 44089
  CDS (1)..(1410)

SEQ ID NO: 67758 - protein, 469 aa, Dechloromonas aromatica RCB; identical to SEQ ID NO: 44090

SEQ ID NO: 67759 - DNA, 1359 bp, Dechloromonas aromatica RCB; identical to SEQ ID NO: 44091
  CDS (1)..(1359)

SEQ ID NO: 67760 - protein, 452 aa, Dechloromonas aromatica RCB; identical to SEQ ID NO: 44092

SEQ ID NO: 67761 - DNA, 1320 bp, Ralstonia eutropha JMP134; identical to SEQ ID NO: 44093
  CDS (1)..(1320)

SEQ ID NO: 67762 - protein, 439 aa, Ralstonia eutropha JMP134; identical to SEQ ID NO: 44094

SEQ ID NO: 67763 - DNA, 1404 bp, Ralstonia eutropha JMP134; identical to SEQ ID NO: 44095
  CDS (1)..(1404)

SEQ ID NO: 67764 - protein, 467 aa, Ralstonia eutropha JMP134; identical to SEQ ID NO: 44096

SEQ ID NO: 67765 - DNA, 1518 bp, Mesorhizobium sp. BNC1; identical to SEQ ID NO: 44097
  CDS (1)..(1518)

SEQ ID NO: 67766 - protein, 505 aa, Mesorhizobium sp. BNC1; identical to SEQ ID NO: 44098

SEQ ID NO: 67767 - DNA, 1461 bp, Mesorhizobium sp. BNC1; identical to SEQ ID NO: 44099
  CDS (1)..(1461)

SEQ ID NO: 67768 - protein, 486 aa, Mesorhizobium sp. BNC1; identical to SEQ ID NO: 44100

SEQ ID NO: 67769 - DNA, 1488 bp, Dechloromonas aromatica RCB; identical to SEQ ID NO: 44101
  CDS (1)..(1488)

SEQ ID NO: 67770 - protein, 495 aa, Dechloromonas aromatica RCB; identical to SEQ ID NO: 44102

SEQ ID NO: 67771 - DNA, 1383 bp, Rubrivivax gelatinosus PM1; identical to SEQ ID NO: 44103
  CDS (1)..(1383)

SEQ ID NO: 67772 - protein, 460 aa, Rubrivivax gelatinosus PM1; identical to SEQ ID NO: 44104

SEQ ID NO: 67773 - DNA, 1449 bp, Rubrivivax gelatinosus PM1; identical to SEQ ID NO: 44105
  CDS (1)..(1449)

SEQ ID NO: 67774 - protein, 482 aa, Rubrivivax gelatinosus PM1; identical to SEQ ID NO: 44106

SEQ ID NO: 67775 - DNA, 1437 bp, Pseudomonas fluorescens PfO-1; identical to SEQ ID NO: 44107
  CDS (1)..(1437)

SEQ ID NO: 67776 - protein, 478 aa, Pseudomonas fluorescens PfO-1; identical to SEQ ID NO: 44108

SEQ ID NO: 67777 - DNA, 1392 bp, Pseudomonas fluorescens PfO-1; identical to SEQ ID NO: 44109
  CDS (1)..(1392)

SEQ ID NO: 67778 - protein, 463 aa, Pseudomonas fluorescens PfO-1; identical to SEQ ID NO: 44110

SEQ ID NO: 67779 - DNA, 1329 bp, Pseudomonas fluorescens PfO-1; identical to SEQ ID NO: 44111
  CDS (1)..(1329)

SEQ ID NO: 67780 - protein, 442 aa, Pseudomonas fluorescens PfO-1; identical to SEQ ID NO: 44112

SEQ ID NO: 67781 - DNA, 1347 bp, Pseudomonas fluorescens PfO-1; identical to SEQ ID NO: 44113
  CDS (1)..(1347)

SEQ ID NO: 67782 - protein, 448 aa, Pseudomonas fluorescens PfO-1; identical to SEQ ID NO: 44114

SEQ ID NO: 67783 - DNA, 1383 bp, Rhodospirillum rubrum; identical to SEQ ID NO: 44115
  CDS (1)..(1383)

SEQ ID NO: 67784 - protein, 460 aa, Rhodospirillum rubrum; identical to SEQ ID NO: 44116

SEQ ID NO: 67785 - DNA, 1377 bp, Ralstonia metallidurans CH34; identical to SEQ ID NO: 44117
  CDS (1)..(1377)

SEQ ID NO: 67786 - protein, 458 aa, Ralstonia metallidurans CH34; identical to SEQ ID NO: 44118

SEQ ID NO: 67787 - DNA, 1410 bp, Magnetococcus sp. MC-1; identical to SEQ ID NO: 44119
  CDS (1)..(1410)

SEQ ID NO: 67788 - protein, 469 aa, Magnetococcus sp. MC-1; identical to SEQ ID NO: 44120

SEQ ID NO: 67789 - DNA, 1515 bp, Magnetococcus sp. MC-1; identical to SEQ ID NO: 44121
  CDS (1)..(1515)

SEQ ID NO: 67790 - protein, 504 aa, Magnetococcus sp. MC-1; identical to SEQ ID NO: 44122

SEQ ID NO: 67791 - DNA, 1527 bp, Geobacter metallireducens GS-15; identical to SEQ ID NO: 44123
  CDS (1)..(1527)

SEQ ID NO: 67792 - protein, 508 aa, Geobacter metallireducens GS-15; identical to SEQ ID NO: 44124

SEQ ID NO: 67793 - DNA, 1389 bp, Geobacter metallireducens GS-15; identical to SEQ ID NO: 44125
  CDS (1)..(1389)

SEQ ID NO: 67794 - protein, 462 aa, Geobacter metallireducens GS-15; identical to SEQ ID NO: 44126

SEQ ID NO: 67795 - DNA, 1383 bp, Geobacter metallireducens GS-15; identical to SEQ ID NO: 44127
  CDS (1)..(1383)

SEQ ID NO: 67796 - protein, 460 aa, Geobacter metallireducens GS-15; identical to SEQ ID NO: 44128

SEQ ID NO: 67797 - DNA, 1413 bp, Geobacter metallireducens GS-15; identical to SEQ ID NO: 44129
  CDS (1)..(1413)

SEQ ID NO: 67798 - protein, 470 aa, Geobacter metallireducens GS-15; identical to SEQ ID NO: 44130

SEQ ID NO: 67799 - DNA, 1341 bp, Geobacter metallireducens GS-15; identical to SEQ ID NO: 44131
  CDS (1)..(1341)

SEQ ID NO: 67800 - protein, 446 aa, Geobacter metallireducens GS-15; identical to SEQ ID NO: 44132

SEQ ID NO: 67801 - DNA, 1386 bp, Geobacter metallireducens GS-15; identical to SEQ ID NO: 44133
  CDS (1)..(1386)

SEQ ID NO: 67802 - protein, 461 aa, Geobacter metallireducens GS-15; identical to SEQ ID NO: 44134

SEQ ID NO: 67803 - DNA, 1395 bp, Geobacter metallireducens GS-15; identical to SEQ ID NO: 44135
  CDS (1)..(1395)

SEQ ID NO: 67804 - protein, 464 aa, Geobacter metallireducens GS-15; identical to SEQ ID NO: 44136

SEQ ID NO: 67805 - DNA, 1365 bp, Geobacter metallireducens GS-15; identical to SEQ ID NO: 44137
  CDS (1)..(1365)

SEQ ID NO: 67806 - protein, 454 aa, Geobacter metallireducens GS-15; identical to SEQ ID NO: 44138

SEQ ID NO: 67807 - DNA, 1338 bp, Geobacter metallireducens GS-15; identical to SEQ ID NO: 44139
  CDS (1)..(1338)

SEQ ID NO: 67808 - protein, 445 aa, Geobacter metallireducens GS-15; identical to SEQ ID NO: 44140

SEQ ID NO: 67809 - DNA, 1365 bp, Geobacter metallireducens GS-15; identical to SEQ ID NO: 44141
  CDS (1)..(1365)

SEQ ID NO: 67810 - protein, 454 aa, Geobacter metallireducens GS-15; identical to SEQ ID NO: 44142

SEQ ID NO: 67811 - DNA, 1362 bp, Geobacter metallireducens GS-15; identical to SEQ ID NO: 44143
  CDS (1)..(1362)

SEQ ID NO: 67812 - protein, 453 aa, Geobacter metallireducens GS-15; identical to SEQ ID NO: 44144

SEQ ID NO: 67813 - DNA, 1374 bp, Geobacter metallireducens GS-15; identical to SEQ ID NO: 44145
  CDS (1)..(1374)

SEQ ID NO: 67814 - protein, 457 aa, Geobacter metallireducens GS-15; identical to SEQ ID NO: 44146

SEQ ID NO: 67815 - DNA, 1368 bp, Geobacter metallireducens GS-15; identical to SEQ ID NO: 44147
  CDS (1)..(1368)

SEQ ID NO: 67816 - protein, 455 aa, Geobacter metallireducens GS-15; identical to SEQ ID NO: 44148

SEQ ID NO: 67817 - DNA, 1362 bp, Geobacter metallireducens GS-15; identical to SEQ ID NO: 44149
  CDS (1)..(1362)

SEQ ID NO: 67818 - protein, 453 aa, Geobacter metallireducens GS-15; identical to SEQ ID NO: 44150

SEQ ID NO: 67819 - DNA, 1389 bp, Geobacter metallireducens GS-15; identical to SEQ ID NO: 44151
  CDS (1)..(1389)

SEQ ID NO: 67820 - protein, 462 aa, Geobacter metallireducens GS-15; identical to SEQ ID NO: 44152

SEQ ID NO: 67821 - DNA, 1311 bp, Cytophaga hutchinsonii; identical to SEQ ID NO: 44153
  CDS (1)..(1311)

SEQ ID NO: 67822 - protein, 436 aa, Cytophaga hutchinsonii; identical to SEQ ID NO: 44154

SEQ ID NO: 67823 - DNA, 1380 bp, Microbulbifer degradans 2-40; identical to SEQ ID NO: 44155
  CDS (1)..(1380)

SEQ ID NO: 67824 - protein, 459 aa, Microbulbifer degradans 2-40; identical to SEQ ID NO: 44156

SEQ ID NO: 67825 - DNA, 1422 bp, Microbulbifer degradans 2-40; identical to SEQ ID NO: 44157
  CDS (1)..(1422)

SEQ ID NO: 67826 - protein, 473 aa, Microbulbifer degradans 2-40; identical to SEQ ID NO: 44158

SEQ ID NO: 67827 - DNA, 1419 bp, Microbulbifer degradans 2-40; identical to SEQ ID NO: 44159
  CDS (1)..(1419)

SEQ ID NO: 67828 - protein, 472 aa, Microbulbifer degradans 2-40; identical to SEQ ID NO: 44160

SEQ ID NO: 67829 - DNA, 1323 bp, Thiobacillus denitrificans ATCC 25259; identical to SEQ ID NO: 44161
  CDS (1)..(1323)

SEQ ID NO: 67830 - protein, 440 aa, Thiobacillus denitrificans ATCC 25259; identical to SEQ ID NO: 44162

SEQ ID NO: 67831 - DNA, 1350 bp, Thiobacillus denitrificans ATCC 25259; identical to SEQ ID NO: 44163
  CDS (1)..(1350)

SEQ ID NO: 67832 - protein, 449 aa, Thiobacillus denitrificans ATCC 25259; identical to SEQ ID NO: 44164

SEQ ID NO: 67833 - DNA, 1350 bp, Thiobacillus denitrificans ATCC 25259; identical to SEQ ID NO: 44165
  CDS (1)..(1350)

SEQ ID NO: 67834 - protein, 449 aa, Thiobacillus denitrificans ATCC 25259; identical to SEQ ID NO: 44166

SEQ ID NO: 67835 - DNA, 1434 bp, Pseudomonas syringae pv. syringae B728a; identical to SEQ ID NO: 44167
  CDS (1)..(1434)

SEQ ID NO: 67836 - protein, 477 aa, Pseudomonas syringae pv. syringae B728a; identical to SEQ ID NO: 44168

SEQ ID NO: 67837 - DNA, 1374 bp, Dechloromonas aromatica RCB; identical to SEQ ID NO: 44169
  CDS (1)..(1374)

SEQ ID NO: 67838 - protein, 457 aa, Dechloromonas aromatica RCB; identical to SEQ ID NO: 44170

SEQ ID NO: 67839 - DNA, 1368 bp, Methylobacillus flagellatus KT; identical to SEQ ID NO: 44171
  CDS (1)..(1368)

SEQ ID NO: 67840 - protein, 455 aa, Methylobacillus flagellatus KT; identical to SEQ ID NO: 44172

SEQ ID NO: 67841 - DNA, 1401 bp, Polaromonas sp. JS666; identical to SEQ ID NO: 44173
  CDS (1)..(1401)

SEQ ID NO: 67842 - protein, 466 aa, Polaromonas sp. JS666; identical to SEQ ID NO: 44174

SEQ ID NO: 67843 - DNA, 1443 bp, Polaromonas sp. JS666; identical to SEQ ID NO: 44175
  CDS (1)..(1443)

SEQ ID NO: 67844 - protein, 480 aa, Polaromonas sp. JS666; identical to SEQ ID NO: 44176

SEQ ID NO: 67845 - DNA, 1680 bp, Ralstonia solanacearum; identical to SEQ ID NO: 44177
  CDS (1)..(1680): transl_table=11

SEQ ID NO: 67846 - protein, 559 aa, Ralstonia solanacearum; identical to SEQ ID NO: 44178

SEQ ID NO: 67847 - DNA, 1467 bp, Caulobacter crescentus; identical to SEQ ID NO: 44179
  CDS (1)..(1467): transl_table=11

SEQ ID NO: 67848 - protein, 488 aa, Caulobacter crescentus; identical to SEQ ID NO: 44180

SEQ ID NO: 67849 - DNA, 1530 bp, Myxococcus xanthus; identical to SEQ ID NO: 44181
  CDS (1)..(1530): transl_table=11

SEQ ID NO: 67850 - protein, 509 aa, Myxococcus xanthus; identical to SEQ ID NO: 44182

SEQ ID NO: 67851 - DNA, 1503 bp, Herbaspirillum seropedicae; identical to SEQ ID NO: 44183
  CDS (1)..(1503): transl_table=11

SEQ ID NO: 67852 - protein, 500 aa, Herbaspirillum seropedicae; identical to SEQ ID NO: 44184

SEQ ID NO: 67853 - DNA, 1386 bp, Eubacterium acidaminophilum; identical to SEQ ID NO: 44185
  CDS (1)..(1386): transl_table=11

SEQ ID NO: 67854 - protein, 461 aa, Eubacterium acidaminophilum; identical to SEQ ID NO: 44186

SEQ ID NO: 67855 - DNA, 1446 bp, Azospirillum brasilense; identical to SEQ ID NO: 44187
  CDS (1)..(1446): transl_table=11

SEQ ID NO: 67856 - protein, 481 aa, Azospirillum brasilense; identical to SEQ ID NO: 44188

SEQ ID NO: 67857 - DNA, 1413 bp, Myxococcus xanthus; identical to SEQ ID NO: 44189
  CDS (1)..(1413): transl_table=11

SEQ ID NO: 67858 - protein, 470 aa, Myxococcus xanthus; identical to SEQ ID NO: 44190

SEQ ID NO: 67859 - DNA, 1422 bp, Pseudomonas aeruginosa; identical to SEQ ID NO: 44191
  CDS (1)..(1422): transl_table=11

SEQ ID NO: 67860 - protein, 473 aa, Pseudomonas aeruginosa; identical to SEQ ID NO: 44192

SEQ ID NO: 67861 - DNA, 1401 bp, Thiobacillus ferrooxidans; identical to SEQ ID NO: 44193
  CDS (1)..(1401): transl_table=11

SEQ ID NO: 67862 - protein, 466 aa, Thiobacillus ferrooxidans; identical to SEQ ID NO: 44194

SEQ ID NO: 67863 - DNA, 1461 bp, Vibrio anguillarum; identical to SEQ ID NO: 44195
  CDS (1)..(1461): transl_table=11

SEQ ID NO: 67864 - protein, 486 aa, Vibrio anguillarum; identical to SEQ ID NO: 44196

SEQ ID NO: 67865 - DNA, 1446 bp, Azospirillum brasilense; identical to SEQ ID NO: 44197
  CDS (1)..(1446): transl_table=11

SEQ ID NO: 67866 - protein, 481 aa, Azospirillum brasilense; identical to SEQ ID NO: 44198

SEQ ID NO: 67867 - DNA, 1395 bp, Xanthomonas campestris; identical to SEQ ID NO: 44199
  CDS (1)..(1395): transl_table=11

SEQ ID NO: 67868 - protein, 464 aa, Xanthomonas campestris; identical to SEQ ID NO: 44200

SEQ ID NO: 67869 - DNA, 1359 bp, Borrelia burgdorferi; identical to SEQ ID NO: 44201
  CDS (1)..(1359): transl_table=11

SEQ ID NO: 67870 - protein, 452 aa, Borrelia burgdorferi; identical to SEQ ID NO: 44202

SEQ ID NO: 67871 - DNA, 1338 bp, Pseudomonas aeruginosa; identical to SEQ ID NO: 44203
  CDS (1)..(1338): transl_table=11

SEQ ID NO: 67872 - protein, 445 aa, Pseudomonas aeruginosa; identical to SEQ ID NO: 44204

SEQ ID NO: 67873 - DNA, 1395 bp, Xanthomonas axonopodis; identical to SEQ ID NO: 44205
  CDS (1)..(1395): transl_table=11

SEQ ID NO: 67874 - protein, 464 aa, Xanthomonas axonopodis; identical to SEQ ID NO: 44206

SEQ ID NO: 67875 - DNA, 1497 bp, Myxococcus xanthus; identical to SEQ ID NO: 44207
  CDS (1)..(1497): transl_table=11

SEQ ID NO: 67876 - protein, 498 aa, Myxococcus xanthus; identical to SEQ ID NO: 44208

SEQ ID NO: 67877 - DNA, 1437 bp, Pseudomonas stutzeri; identical to SEQ ID NO: 44209
  CDS (1)..(1437): transl_table=11

SEQ ID NO: 67878 - protein, 478 aa, Pseudomonas stutzeri; identical to SEQ ID NO: 44210

SEQ ID NO: 67879 - DNA, 1449 bp, Acetobacter diazotrophicus; identical to SEQ ID NO: 44211
  CDS (1)..(1449): transl_table=11

SEQ ID NO: 67880 - protein, 482 aa, Acetobacter diazotrophicus; identical to SEQ ID NO: 44212

SEQ ID NO: 67881 - DNA, 1458 bp, Myxococcus xanthus; identical to SEQ ID NO: 44213
  CDS (1)..(1458): transl_table=11

SEQ ID NO: 67882 - protein, 485 aa, Myxococcus xanthus; identical to SEQ ID NO: 44214

SEQ ID NO: 67883 - DNA, 1434 bp, Myxococcus xanthus; identical to SEQ ID NO: 44215
  CDS (1)..(1434): transl_table=11

SEQ ID NO: 67884 - protein, 477 aa, Myxococcus xanthus; identical to SEQ ID NO: 44216

SEQ ID NO: 67885 - DNA, 1476 bp, Myxococcus xanthus; identical to SEQ ID NO: 44217
  CDS (1)..(1476): transl_table=11

SEQ ID NO: 67886 - protein, 491 aa, Myxococcus xanthus; identical to SEQ ID NO: 44218

SEQ ID NO: 67887 - DNA, 1689 bp, Myxococcus xanthus; identical to SEQ ID NO: 44219
  CDS (1)..(1689): transl_table=11

SEQ ID NO: 67888 - protein, 562 aa, Myxococcus xanthus; identical to SEQ ID NO: 44220

SEQ ID NO: 67889 - DNA, 1407 bp, Vibrio fischeri; identical to SEQ ID NO: 44221
  CDS (1)..(1407): transl_table=11

SEQ ID NO: 67890 - protein, 468 aa, Vibrio fischeri; identical to SEQ ID NO: 44222

SEQ ID NO: 67891 - DNA, 1401 bp, Myxococcus xanthus; identical to SEQ ID NO: 44223
  CDS (1)..(1401): transl_table=11

SEQ ID NO: 67892 - protein, 466 aa, Myxococcus xanthus; identical to SEQ ID NO: 44224

SEQ ID NO: 67893 - DNA, 1341 bp, Pseudomonas stutzeri; identical to SEQ ID NO: 44225
  CDS (1)..(1341): transl_table=11

SEQ ID NO: 67894 - protein, 446 aa, Pseudomonas stutzeri; identical to SEQ ID NO: 44226

SEQ ID NO: 67895 - DNA, 1410 bp, Shewanella violacea; identical to SEQ ID NO: 44227
  CDS (1)..(1410): transl_table=11

SEQ ID NO: 67896 - protein, 469 aa, Shewanella violacea; identical to SEQ ID NO: 44228

SEQ ID NO: 67897 - DNA, 1350 bp, Pseudomonas aeruginosa; identical to SEQ ID NO: 44229
  CDS (1)..(1350): transl_table=11

SEQ ID NO: 67898 - protein, 449 aa, Pseudomonas aeruginosa; identical to SEQ ID NO: 44230

SEQ ID NO: 67899 - DNA, 1347 bp, Pseudomonas syringae; identical to SEQ ID NO: 44231
  CDS (1)..(1347): transl_table=11

SEQ ID NO: 67900 - protein, 448 aa, Pseudomonas syringae; identical to SEQ ID NO: 44232

SEQ ID NO: 67901 - DNA, 1386 bp, Escherichia coli; identical to SEQ ID NO: 44233
  CDS (1)..(1386): transl_table=11

SEQ ID NO: 67902 - protein, 461 aa, Escherichia coli; identical to SEQ ID NO: 44234

SEQ ID NO: 67903 - DNA, 1368 bp, Vibrio cholerae; identical to SEQ ID NO: 44235
  CDS (1)..(1368): transl_table=11

SEQ ID NO: 67904 - protein, 455 aa, Vibrio cholerae; identical to SEQ ID NO: 44236

SEQ ID NO: 67905 - DNA, 1362 bp, Vibrio parahaemolyticus; identical to SEQ ID NO: 44237
  CDS (1)..(1362)

SEQ ID NO: 67906 - protein, 453 aa, Vibrio parahaemolyticus; identical to SEQ ID NO: 44238

SEQ ID NO: 67907 - DNA, 1362 bp, Vibrio vulnificus; identical to SEQ ID NO: 44239
  CDS (1)..(1362)

SEQ ID NO: 67908 - protein, 453 aa, Vibrio vulnificus; identical to SEQ ID NO: 44240

SEQ ID NO: 67909 - DNA, 1410 bp, Escherichia coli; identical to SEQ ID NO: 44241
  CDS (1)..(1410): transl_table=11

SEQ ID NO: 67910 - protein, 469 aa, Escherichia coli; identical to SEQ ID NO: 44242

SEQ ID NO: 67911 - DNA, 1410 bp, Klebsiella pneumoniae; identical to SEQ ID NO: 44243
  CDS (1)..(1410)

SEQ ID NO: 67912 - protein, 469 aa, Klebsiella pneumoniae; identical to SEQ ID NO: 44244

SEQ ID NO: 67913 - DNA, 1422 bp, Proteus vulgaris; identical to SEQ ID NO: 44245
  CDS (1)..(1422): transl_table=11

SEQ ID NO: 67914 - protein, 473 aa, Proteus vulgaris; identical to SEQ ID NO: 44246

SEQ ID NO: 67915 - DNA, 1455 bp, Rhizobium meliloti; identical to SEQ ID NO: 44247
  CDS (1)..(1455): transl_table=11

SEQ ID NO: 67916 - protein, 484 aa, Rhizobium meliloti; identical to SEQ ID NO: 44248

SEQ ID NO: 67917 - DNA, 1410 bp, Salmonella typhimurium; identical to SEQ ID NO: 44249
  CDS (1)..(1410): transl_table=11

SEQ ID NO: 67918 - protein, 469 aa, Salmonella typhimurium; identical to SEQ ID NO: 44250

SEQ ID NO: 67919 - DNA, 1338 bp, Pseudomonas aeruginosa; identical to SEQ ID NO: 44251
  CDS (1)..(1338): transl_table=11

SEQ ID NO: 67920 - protein, 445 aa, Pseudomonas aeruginosa; identical to SEQ ID NO: 44252

SEQ ID NO: 67921 - DNA, 1335 bp, Escherichia coli; identical to SEQ ID NO: 44253
  CDS (1)..(1335): transl_table=11

SEQ ID NO: 67922 - protein, 444 aa, Escherichia coli; identical to SEQ ID NO: 44254

SEQ ID NO: 67923 - DNA, 1332 bp, Klebsiella oxytoca; identical to SEQ ID NO: 44255
  CDS (1)..(1332): transl_table=11

SEQ ID NO: 67924 - protein, 443 aa, Klebsiella oxytoca; identical to SEQ ID NO: 44256

SEQ ID NO: 67925 - DNA, 1326 bp, Salmonella typhi; identical to SEQ ID NO: 44257
  CDS (1)..(1326): transl_table=11

SEQ ID NO: 67926 - protein, 441 aa, Salmonella typhi; identical to SEQ ID NO: 44258

SEQ ID NO: 67927 - DNA, 25 bp, Primer
atgacgcacgataatatcgatattc

SEQ ID NO: 67928 - DNA, 25 bp, Primer
ttaacgcgacagttttgccaatagc

SEQ ID NO: 67929 - protein, 548 aa, consensus; identical to SEQ ID NO: 44261
  MISC_FEATURE (1)..(548): consensus for the disclosure of xaa see table XV

SEQ ID NO: 67930 - protein, 59 aa, consensus; identical to SEQ ID NO: 44262
  MISC_FEATURE (1)..(59): consensus for the disclosure of xaa see table XV

SEQ ID NO: 67931 - protein, 200 aa, consensus; identical to SEQ ID NO: 44263
  MISC_FEATURE (1)..(200): consensus for the disclosure of xaa see table XV

SEQ ID NO: 67932 - DNA, 1659 bp, Escherichia coli
  CDS (1)..(1659)
atgttgaccccgttgacggccttcgcgggagtgcggttgcgctggcctgccatgatgcgactcacttgcatcggcattctggcgcagttcgcgctcctgctgctcgcctttggcgtactgacgtattgttttctcatcagcgatttctcggtcatttatgtcgcgcaacatagctatagcctgctgtcgtgggaactcaagctggcagcggtgtggggcggccatgaaggttcgctgctgctttgggtgctgctgctttccgcctggagcgcgctgtttgcctggcattatcggcagcaaaccgatccgctatttccgctgacgttagccgttttatctctcatgctcgccgcactgctactgtttgtggtgctgtggtccgatcccttcgtgcggatatttccaccagcaatcgaaggccgcgatctcaatccgatgctgcaacatcccggtcttatctttcatccaccgctgctttaccttggctatggcggtttgatggtagcggcgagcgtggcgctggcgagtctactgcgcggcgagtttgatggtgcctgcgcccgaatttgctggcgctgggcgttacctggctggagtgcattaacggcggggatcatcctcggttcctggtgggcctactgcgaactcggctggggcggctggtggttctgggatccggtggaaaacgcctctttattaccctggctttctgccactgcgctgctgcacagtttgtccctgacacgccagcgggggattttttgccactggtcgctgttgctggcgatagttactctgatgctgtcgctgctgggcaccttaattgtccgttctggcattctggtttcggttcatgcgttcgcgctggataacgtccgcgccgtgccgttgttcagcctgtttgcactgattagccttgcgtctctggctctgtatggctggcgagcgcgggacggtggcccggcggtgcatttttcggggttatcgcgggaaatgttaatcctcgctacgctgttgctgttttgcgcagtgctactgatcgtgctggtgggaacgctttatccgatgatttacggcctgctgggctggggacgcctctccgttggcgcgccgtattttaaccgcgcgacgttaccgtttggtctgttgatgctggtggtgattgtgctggcgacgtttgtctctggcaaacgcgtgcagcttccggcgctggtagctcatgcgggcgtgctgttatttgccgctggggtcgtggtctccagcgtcagccgtcaggagatcagcctgaatttacagccgggtcagcaggtgacgctggcaggatacaccttccgttttgagtgcctcgatctacaagccaaaggcaattacaccagcgaaaaagcgatagtggcactgtttgaccatcagcaacgcattggtgaactgacgccggagcggcgtttttatgaagcacgccgtcaacaaatgatggaaccgtcaattcgctggaacggcatccatgactggtatgcggtcatgggggagaaaactgggccggatcgttacgcttttcgtttgtatgtacaaagcggtgtgcgctggatctgggggggaggattgttgatgattgcgggcgcattgttaagcggatggcgggggaagaagcgcgatgaataa

SEQ ID NO: 67933 - protein, 552 aa, Escherichia coli
MLTPLTAFAGVRLRWPAMMRLTCIGILAQFALLLLAFGVLTYCFLISDFSVIYVAQHSYSLLSWELKLAAVWGGHEGSLLLWVLLLSAWSALFAWHYRQQTDPLFPLTLAVLSLMLAALLLFVVLWSDPFVRIFPPAIEGRDLNPMLQHPGLIFHPPLLYLGYGGLMVAASVALASLLRGEFDGACARICWRWALPGWSALTAGIILGSWWAYCELGWGGWWFWDPVENASLLPWLSATALLHSLSLTRQRGIFCHWSLLLAIVTLMLSLLGTLIVRSGILVSVHAFALDNVRAVPLFSLFALISLASLALYGWRARDGGPAVHFSGLSREMLILATLLLFCAVLLIVLVGTLYPMIYGLLGWGRLSVGAPYFNRATLPFGLLMLVVIVLATFVSGKRVQLPALVAHAGVLLFAAGVVVSSVSRQEISLNLQPGQQVTLAGYTFRFECLDLQAKGNYTSEKAIVALFDHQQRIGELTPERRFYEARRQQMMEPSIRWNGIHDWYAVMGEKTGPDRYAFRLYVQSGVRWIWGGGLLMIAGALLSGWRGKKRDE

SEQ ID NO: 67934 - DNA, 1980 bp, Gluconobacter oxydans 621H
  CDS (1)..(1980)
atgttcggacctgaacagggccatttcgccctggccctcgcctgcgtgctcgccctcgtgcagttcgccgtcccgctctggggcgcaaaccgccgcgatgcccgcctcgtggggctcgcgccctatctcgcggtctcgcagcttatcgcgctgggctattcgttcctgtgcctcgtgatgtgcgccgtcagcgacgatttctcggtccagaacgttgcagcaaactctgccgtctccaagccgctcctgtataaaatcacgggcgtctggggaaaccacgaaggctcggtcctgctctggacgctgatccttgccgtctgcggcggtgcggtctcgctgttcggccgtaacctgccagacatcctgcgcggacgcgttctggccattctcggcggtgtctccgccgggttccagatgttctgcctcctgacctccgatccgttcgaccgcgtcttcccggcaccgatggacggtcagggcatgaacccgctcctgcaggatccgggtctcgccttccacccccccattctctacaccggctatgtcggtttcgccgtccccttcgccttcgccgtcgcggctctgatcgaaggccgcgtcgatgccgcatggggccgctgggtccgtccctgggccgtggcggcctggtgcttcctgacctgcggcatcgcgctgggctcctggtggtcctattatgtgctgggctggggcgggtactggttctgggatccggtggaaaacgcctccctcattccctggctgacgggcacggccctcgtgcattccgccatcgtcgtggaaaagcgcgaaggcctgaaaatctggacggtcctgctggctatcgcgaccttctcgttctcactgtccggcaccttcctcgtccgctcgggcatcctgaactcggtccacgccttcgccaacgatcccgcacgcggcgtgttcatcctggccctgctcgccatcgtcatcggcggttcgcttgccctatttgcttggcgcgccccgtccctcacctcgaccggcctgttttcgccgatctcccgtgaaggctcgttggtcctgaacaacatcctgctgtgctcgatctgcgccgtggtcgtgacgggcacgatgtatccgcccttcatgcagcttctggccggccgtaccatttccgtcggcaagccgttctttgacgccgccacgatcccgctgaccctgccgctcctgctggccatgggtgttggcaccgccctgccgtggaaacgcgcacagctcgcccggaccttctcgcatctctatgccgccgccggcatcgccgcgatcgggctggtcctgtgcttctggaagctctccggtgtcctgcccatcgcctgcggcgcgctggccatctgggtcatcgcggcttccgcttccgacgtcctgcgccggatcggcattggccacacctccgcacagggcgtgtgggagcgcatgaagcacctgccgcgttcaagctggggcgcggctctcgcccatatcggcgcaggcatcaccgtgcttggtctgtgtggcatgtcgcaggcgcagcacgccatcgtcgaagtccatattggcgagacccgctcgctggccggcgacgactggaccctgctcgacgtgcacgactatatcggcccgaactacaaggccatgcaggctgacatcgccatccgccacaacggcaagctggtcaccatcctgcaccccgaaaagcgcgacttcacgacgcagagccagaccacgaccgaagtcgccatccacaccaatttcatcaccgatctgtacggcgtggtcggtgaccggcacggcacgggcaaggacacgacctatgtcctgcgcctgcaccgcaatccgctcgcaccctggatgtggctgggcggactggtcatggccatcggcggcgcgttctcgctgtctgaccgccggatgcgaattggcgcccccaagcgcgccgccgcccgcaacatggcgcgtgcctga

SEQ ID NO: 67935 - protein, 659 aa, Gluconobacter oxydans 621H
MFGPEQGHFALALACVLALVQFAVPLWGANRRDARLVGLAPYLAVSQLIALGYSFLCLVMCAVSDDFSVQNVAANSAVSKPLLYKITGVWGNHEGSVLLWTLILAVCGGAVSLFGRNLPDILRGRVLAILGGVSAGFQMFCLLTSDPFDRVFPAPMDGQGMNPLLQDPGLAFHPPILYTGYVGFAVPFAFAVAALIEGRVDAAWGRWVRPWAVAAWCFLTCGIALGSWWSYYVLGWGGYWFWDPVENASLIPWLTGTALVHSAIVVEKREGLKIWTVLLAIATFSFSLSGTFLVRSGILNSVHAFANDPARGVFILALLAIVIGGSLALFAWRAPSLTSTGLFSPISREGSLVLNNILLCSICAVVVTGTMYPPFMQLLAGRTISVGKPFFDAATIPLTLPLLLAMGVGTALPWKRAQLARTFSHLYAAAGIAAIGLVLCFWKLSGVLPIACGALAIWVIAASASDVLRRIGIGHTSAQGVWERMKHLPRSSWGAALAHIGAGITVLGLCGMSQAQHAIVEVHIGETRSLAGDDWTLLDVHDYIGPNYKAMQADIAIRHNGKLVTILHPEKRDFTTQSQTTTEVAIHTNFITDLYGVVGDRHGTGKDTTYVLRLHRNPLAPWMWLGGLVMAIGGAFSLSDRRMRIGAPKRAAARNMARA

SEQ ID NO: 67936 - DNA, 1989 bp, Wolbachia endosymbiont strain TRS of Brugia malayi
  CDS (1)..(1989)
atgcctgagcttgggaatatattactactgttgtcctgcttattgtccttaacatatctatttctaccgttcaattcttaccgattcattaccactgccatattcttctgtatatcagtatcaatggctattttgatctactgccacattataaacgatttctcactcgaaaacgtatattaccactctcatacgacaaaacctttgatctataaaatctgtggcgtttggggaaataaagaagggtctatgttgctttggaccttagtgcttactttttacctatttctaatggatatttttattggtgataacagtgaattaaagaaagtatccttgatcactcaaggcttaatctgcttttgtttttcgctgtttactttacttaagtccgatccttttactaaaatgccaagcatagaaacagatggccttggttttcatccgatattgcaggacataggccttgccattcatccaccaatattatatttggggtaccttggatttagcgttcccttttcgctctctatagctgggttaattataaacatcgaaggagacatttgggctaaaattgtcaggccatgggtacttgtttcttggtcgctacttaccttgggtattagccttggcagttggtgggcataccgcgaacttgggtggggtggattttggttttgggatccagtagaaaacgtttctttaatgccatggttaattgcagtagcactgacgcatctgttactcgtggtacgaaatttcaatattttaaggaactttgccattttgcttacgctcacaactttcatattgagtgtaactggaacatttttagtccgctctggaatactttcttcagttcacacgtttgcagatgatccaggatatgggctgtatatactggctttacttggtgtaattacagccagtagcttagcaatatttgtggcatttacgaaaaagagtggatctcttattacattaccatctatcatccaattagctgatattgggatccagggaaaaagtatgcagtcacatgctggcatgacaccaaagaatacaccaaagcaaaactttcctattttgtcccgctttacaatgatactgatgaacaatttattattaattactgcctttttcatcgtgtttattggcactttataccctacaatgcttaaatatttaaccggtgaactcatttcagttggagcaccgtactacaattccttatttaatcctattgcactggctactctagtgcttaccatggtaggacaatactgccgttggcaggggaatagcttgttaccaatattccatgaatatagactctcattctgtagtgctgcagccatcttaccgtttatctttcatatggagctaatgattgtgctatcaattacaatctccatggcactattagcctttgttttagaagcatatagcaaaagaattcgtttatttaaagtggcatttagtgaatcaatttcattagtaagaggagtttccaagtcttactatgctatgatgttagctcatgctggggtagcaattctagtacttggtatagcctattcagtcggttggcaagaaaaaaaagaaaattacctaaaaataggagatagcataacagtcaacaaattcaaagttactttacgaaatactgaatttataaaaaagaagaatttccatgcagtgagaggcacaatggatattagaaatttgttgaacaacaagatactaggtgaagtaacccctgaatatagattttatcttgtggagggtcagaaaaatattgaaagcagtatttaccacaatttattttctgatatttatattgtaattggcgagattgataaaaataaaaacaagatcgccactaaagtacactacaaacctggaatgcctataatctggtttggatcctgccttatcgcttttggttcgctccttgttgctttgcccttattgagaagattttga

SEQ ID NO: 67937 - protein, 662 aa, Wolbachia endosymbiont strain TRS of Brugia malayi
MPELGNILLLLSCLLSLTYLFLPFNSYRFITTAIFFCISVSMAILIYCHIINDFSLENVYYHSHTTKPLIYKICGVWGNKEGSMLLWTLVLTFYLFLMDIFIGDNSELKKVSLITQGLICFCFSLFTLLKSDPFTKMPSIETDGLGFHPILQDIGLAIHPPILYLGYLGFSVPFSLSIAGLIINIEGDIWAKIVRPWVLVSWSLLTLGISLGSWWAYRELGWGGFWFWDPVENVSLMPWLIAVALTHLLLVVRNFNILRNFAILLTLTTFILSVTGTFLVRSGILSSVHTFADDPGYGLYILALLGVITASSLAIFVAFTKKSGSLITLPSIIQLADIGIQGKSMQSHAGMTPKNTPKQNFPILSRFTMILMNNLLLITAFFIVFIGTLYPTMLKYLTGELISVGAPYYNSLFNPIALATLVLTMVGQYCRWQGNSLLPIFHEYRLSFCSAAAILPFIFHMELMIVLSITISMALLAFVLEAYSKRIRLFKVAFSESISLVRGVSKSYYAMMLAHAGVAILVLGIAYSVGWQEKKENYLKIGDSITVNKFKVTLRNTEFIKKKNFHAVRGTMDIRNLLNNKILGEVTPEYRFYLVEGQKNIESSIYHNLFSDIYIVIGEIDKNKNKIATKVHYKPGMPIIWFGSCLIAFGSLLVALPLLRRF

SEQ ID NO: 67938 - DNA, 1914 bp, Reclinomonas americana
  CDS (1)..(1914)
atgtcttctttttttggacattttttaataattatagctatttttttacttataattattttttttaaatcatttttttataacaaacaaaataaaattatatacaaaaatcaaatacaaatacttatctcaatatatttttttatcttaacattatcttttttttctttattagaatcacacttgttttctaatatttctattattaatattttaaatagtacacattcaaaacaaccacttatttataaaatttgtgcactttggagtaatcatgaaggatctatgttactttggtgctggattctttcaatatatacctacagtttactttttttaagaaaattaactattgatttttttcgtagtactattctaatacaatctttaattaatttattttttcttttttttattctttttacatcaaatccatttttacaaattattgaccgctttcttgatgggaaacaactaaatccaatacttcaagacattgttttatcaatacatccacctcttgtatatttaggatacttaggattttcaataccattttcactaactatcgcatatttatttaatcattctaaagaaacacaagcatggttattttatatacaaaaatataatctaatttcatggtgttttcttacatttggtatttttttaggaagttggtgggcttactatgaattgggatggggtggttggtggttttgggaccctgttgaaaatgcttctttaatgccttggattcttagtacagctcttttacattctattcttaatactaagaaatcaaataccttaactaaaacaacgatatatttatcttttttttgtttttattcaagtttattgggtactttttttgtacgttctggacttatcgattctgttcacagtttcgcatctgattctaatcgcggacaatttattttttgttttcttttctttttatttttaatctttatttatcttattttaaaatataataaatatattttttctaaagatattcgtaatcttttttcaaaagaaggtcttatttctttaaatcaatttttttttatttctttctatattattattttaattggtactttttatccaacaatacattattttttttttaaacaatccataaccattggaccttctttttacaatcaaatgataataccaattctcgtacctttttttatttttatgatttcttcattatattttcattgggaatctattaaaattaaaaaaatttttttttctactaaagaacttctttttattttttgtttttcaactgctattttcagttttcttttttttgaaaattatcaacgtttttatattttatatctttttataccatttttagtatggtctattttgaaacatttctattctttttttatttttaaaaaatataattctttttcaatgttaatttctcattttggtgttactatttttatactttctgttttattatggtattgtttttacaaagaaagtcatcaaattatgtatccaggagatagacattttttcaatcattatgaatatatttttaaaggtattaatcttattaaaggtcctaattacgatgctttttatggatcttttttaattcttaaaaataatacaattaatggaacattatttccagaaaaacgacattattatattcaagatttttatgcttctaaagttgatattcatagtaatttttttgatgatgtccatgctattattggagacggtaatttatatactggatggtcaacaagtttttatgtttatccatttttatcttggatatggtttgctggttttttacttgttttaggaggtcttgtttctatttttaaaaaaaaacaaagaatacatattttacaacaatctctataa

SEQ ID NO: 67939 - protein, 637 aa, Reclinomonas americana
MSSFFGHFLIIIAIFLLIIIFFKSFFYNKQNKIIYKNQIQILISIYFFILTLSFFSLLESHLFSNISIINILNSTHSKQPLIYKICALWSNHEGSMLLWCWILSIYTYSLLFLRKLTIDFFRSTILIQSLINLFFLFFILFTSNPFLQIIDRFLDGKQLNPILQDIVLSIHPPLVYLGYLGFSIPFSLTIAYLFNHSKETQAWLFYIQKYNLISWCFLTFGIFLGSWWAYYELGWGGWWFWDPVENASLMPWILSTALLHSILNTKKSNTLTKTTIYLSFFCFYSSLLGTFFVRSGLIDSVHSFASDSNRGQFIFCFLFFLFLIFIYLILKYNKYIFSKDIRNLFSKEGLISLNQFFFISFYIIILIGTFYPTIHYFFFKQSITIGPSFYNQMIIPILVPFFIFMISSLYFHWESIKIKKIFFSTKELLFIFCFSTAIFSFLFFENYQRFYILYLFIPFLVWSILKHFYSFFIFKKYNSFSMLISHFGVTIFILSVLLWYCFYKESHQIMYPGDRHFFNHYEYIFKGINLIKGPNYDAFYGSFLILKNNTINGTLFPEKRHYYIQDFYASKVDIHSNFFDDVHAIIGDGNLYTGWSTSFYVYPFLSWIWFAGFLLVLGGLVSIFKKKQRIHILQQSL

SEQ ID NO: 67940 - DNA, 1863 bp, Cyanidioschyzon merolae
  CDS (1)..(1863)
atgtttggttacgtattgcattttttattaatttttatctttatttattcatgtaactttttttttttagattcattttacaaatacaagaaagttactaccctattagaaatagtacatcattattatttttattttaattacatatacaatattattattatcattatttggttaattggtataatattactattgtcggatttttctatattgtttgtggtggaattatcttctgtaaaccaaccaagtctttataaattaataactttatggtccaataatgaaggatcattattcttaggatatttcttgcaattcattatttattttacttttatcaattattttattaacaaattaacactgattgttaaactaacttttttttataatgtctattttattctatttaatataagttttctaagtctaacattattgctaatatttttgcgctttgatttttttttcaatttcactgttttggaaggtaatgaactaaattttttattacaagatataaatatattaattcatccaccattaatatatataagttatgcttcgtactctattattttttctatttcttttaccattttaataataaaatgtaaattttatgtgctttatattttaagatttttaaatctaattggttggtttattgcatcttttagtattttattaggaagtagatgggcttatacagaattaggttggggtggtttctggttttgggattccgtagagattatttctctattaccatggttattaagccttgctttattacatagtttgttgctaaacttgaagttttgcattatccgtttagattctttatttctgggaatggctatctattttgttattattattggaataattctagttcgttccggtttgctgcaatcagtacatacttttgtcaattcgccaaattttttaataattttcttgtatttctttttggtattcatttttattctaatagttatacttttaaagaaatatacttattttactagtatttttgacttaaataatcattataattttgtttattatatatttttattagtaattttatatttcttatacttattatttgttttatatttcccttttttaattaaatgttataatgataatgcgttattatttagtttcggttttttcaataaaatattattattatttataggaattttattaacattaataattatatttttaataaattcttggaaattaatttttatttttctaggcattatcataataggcggaattaggggatttcctgaaatttttttagccttatatttttttatttatttattgttatttactctaattttaattataaaacaaaaattttcctttattgtttatcattttaacttttttttcataatgttaagtttattattaataacaatttatggagaagaatttattttaaatttttctattggtaaaacattgctattaaatgataattttatcataatttttcgtgatttaaatcacatatggtcgactaattatttatccacttacggaaacttcttaattacagattttcataatcctatgtgttatgaaaacattcagaacgtattattttctgaaaaacgtttttatttatatcaaagtttaataaatacaaaatcaattatttacacgaatttaatgagtgatgtatacatcttattgggtgatggaaattttgaaaatggttggtatagtagaattttatttatgccatttatatcctggttttggttaggtggaatattcttattagacagtattattttttctttatttcggtgtataaaaaattttcaataa

SEQ ID NO: 67941 - protein, 620 aa, Cyanidioschyzon merolae
MFGYVLHFLLIFIFIYSCNFFFLDSFYKYKKVTTLLEIVHHYYFYFNYIYNIIIIIIWLIGIILLLSDFSILFVVELSSVNQPSLYKLITLWSNNEGSLFLGYFLQFIIYFTFINYFINKLTLIVKLTFFYNVYFILFNISFLSLTLLLIFLRFDFFFNFTVLEGNELNFLLQDINILIHPPLIYISYASYSIIFSISFTILIIKCKFYVLYILRFLNLIGWFIASFSILLGSRWAYTELGWGGFWFWDSVEIISLLPWLLSLALLHSLLLNLKFCIIRLDSLFLGMAIYFVIIIGIILVRSGLLQSVHTFVNSPNFLIIFLYFFLVFIFILIVILLKKYTYFTSIFDLNNHYNFVYYIFLLVILYFLYLLFVLYFPFLIKCYNDNALLFSFGFFNKILLLFIGILLTLIIIFLINSWKLIFIFLGIIIIGGIRGFPEIFLALYFFIYLLLFTLILIIKQKFSFIVYHFNFFFIMLSLLLITIYGEEFILNFSIGKTLLLNDNFIIIFRDLNHIWSTNYLSTYGNFLITDFHNPMCYENIQNVLFSEKRFYLYQSLINTKSIIYTNLMSDVYILLGDGNFENGWYSRILFMPFISWFWLGGIFLLDSIIFSLFRCIKNFQ

SEQ ID NO: 67942 - DNA, 1851 bp, Malawimonas jakobiformis
  CDS (1)..(1851)
atgattgcgaatttaggacattattctttaatttttttattgatttttgctatttttcttctatttattaaaaaaagtattattagtaagaaaatacttataaatgttttttcaataaaaataatcttaataacaattgttttaactactttagaatattcatatataatttcagattttagtattctaaatattaaagaaaattctcacatttcattaccattattatataaaataactgcgttatggggtaaccatgaaggatcaatattactttggtcctttatattaattgttttaactttcctaataatttttattttcagaaatttatctattatttatttgtataaaacagtttatatccaaaacgtattcattatcttttttattatatatacaatatttacaagtaatccatttatatatacatatatatatagccttaatggttctgaactgaatccgatactacaagatactgttttagcaattcatccacctttaatatacattggatatattaatagttctattaatttatctttggtgtcaatcagtttgatagaaaagaattataatgaaatattaaaaaaatatcttaatatatcaggattaataacatggattttcttaacaataggtattttattaggaagttggtggtcatattatgaattaggttggggaggatggtggttttgggaccctgtcgaaaattctgcattattaccttggttattaacattaatactaattcattccattaaatatgaatatttaattcgatggactattttagttaatattagtattttcattttttcaattttaggcacattttttgtaagatcaggaatattggtatctgtacattcatttgctgttgattattcacgcggtattttgatctttgtgtttttaataattcttttaatattaacaggtattttatattttaaaaatataaagtatttatataaacatacgtattattcatataaagccatagataatataattacaataaataatattattattttaattatttttacaacaatattattaggaacagttcttcctacgatttactctatgtttctaaataaaaatatatccattggtatatcattttataataaaacgataatacctatgataattccgatattaataataatgtcaatgattacatatataaataagataaaagaaataaataattatattttttcgattggaactttattatttatattatttataatatttatttataaaattgacttctcttattaccacttaataatactaatgttattattatggctaataacatctttaatcaaatatgtatctctatataaaataataaatccaatgattcttgcacatttaggattctttgtttttattacaggtattataatatcaagtgtttctcaattggattctgtacaaatagtttttccgggagaagaaatcaatttagaaaatcatatttttaattttagggatattaattatattacaggattaaactattattctatttatggtaatattgccgtaattaataagggagattatataaatatactttttccagaaaaacgttactattttataaaaggaatctatattacaaaatcggttatatatagtaattattttgcagatatatatgcaataattggagatggtaattttaaatctggttggtatactaaatactattatcgacctctaatgtcatttatatggataggtcctatgttttttatttttagtgccttaatctcaataaaaaaaataattagtaaaaaaaaaataataaattggttataa

SEQ ID NO: 67943 - protein, 616 aa, Malawimonas jakobiformis
MIANLGHYSLIFLLIFAIFLLFIKKSIISKKILINVFSIKIILITIVLTTLEYSYIISDFSILNIKENSHISLPLLYKITALWGNHEGSILLWSFILIVLTFLIIFIFRNLSIIYLYKTVYIQNVFIIFFIIYTIFTSNPFIYTYIYSLNGSELNPILQDTVLAIHPPLIYIGYINSSINLSLVSISLIEKNYNEILKKYLNISGLITWIFLTIGILLGSWWSYYELGWGGWWFWDPVENSALLPWLLTLILIHSIKYEYLIRWTILVNISIFIFSILGTFFVRSGILVSVHSFAVDYSRGILIFVFLIILLILTGILYFKNIKYLYKHTYYSYKAIDNIITINNIIILIIFTTILLGTVLPTIYSMFLNKNISIGISFYNKTIIPMIIPILIIMSMITYINKIKEINNYIFSIGTLLFILFIIFIYKIDFSYYHLIILMLLLWLITSLIKYVSLYKIINPMILAHLGFFVFITGIIISSVSQLDSVQIVFPGEEINLENHIFNFRDINYITGLNYYSIYGNIAVINKGDYINILFPEKRYYFIKGIYITKSVIYSNYFADIYAIIGDGNFKSGWYTKYYYRPLMSFIWIGPMFFIFSALISIKKIISKKKIINWL

SEQ ID NO: 67944 - DNA, 1512 bp, Archaeoglobus fulgidus DSM 4304
  CDS (1)..(1512): transl_table=11
ttggagccaggcttcctgctgctggcaacttcttttgtagctacattttcggcattttcactgtttctcgcgaaaaaagaaagtctgggtgagttctcactttaccttgcaacctccacgacttttgctgccctgctgctgcttgtaaactactttgttaccgacacgttttcgatatggtacgtttatgctaactccaatgccgaaatgccgctggcctacaaaataagcgcggtttgggccgggaaggaaggcagcctcctcttgtgggttgtgctcaatctgatggtgacctcactctacattaactggggggttaaggacagaaagaaagccaaggtggctgctgtaatgactcttttcacgtcttacctcctccttaaccttttgattttctcaaatccctttacggtcttaccttacacacccccagatggagcaggactgaatcctctgctgagaactgtggagatgatactccaccctccagtggtattcctcgcctactcgcttgccgctctgctgtactccgtaatcgttgcaaattcggaaggggaaagaaccatcgcgaggctcacgtggttatccctaaccctcggcattcttatcggaagtttgtgggcatacaaaactcttggatggggaggtttctggggatgggatccggtggagaacgcttccctacttccgtggctaactcttacagcctacttccatctcactaggggcagagactttttcgcttatctcaccttctcactcgttctttttgcaaccctagtcacgagaagtggcattataagctcagtgcacagttttggaggggaggttagtgattacagctacgtaattccgattctggcctctttagctcctttagttgtcagggcgagacagttttcgatttcaagtctctgcaatcagaatttgccaatcctctttttgtcagcagttattgtggtttttctaggaacgattgccggcgtttctgttgaggtgagcagagaatactacttcgtcacgtttctgccggtcttcgccttaatagtgctgctggttgtgcttaaaataaaaaaagtctcgatgcccgcgacgctgcttcacctgggcgtaattttcctctttgtcggagcaacttccgtttggcttttcgaggaaagcaagaccatcactcttgactcagagggttacaagcttctcgatttaagcattagcgaggatgcggaaaagtacactctcacagcgatagtcaaaaccccggatggcgtaatagcaccgaaagtttacttttacaaagttgctgggaacaacagagtttcttcagttgagataattccgacagtattgtgggacaactattactcaatcaagagcttcgatttggacaacaacgttgtaacgcttgagtactaccgcgttccgctgataaacgccgtctggttgggctcagccctaatgcttcttggagctctcctcaggttctcaggtaaagtttttaaattgggaggctga

SEQ ID NO: 67945 - protein, 503 aa, Archaeoglobus fulgidus DSM 4304
MEPGFLLLATSFVATFSAFSLFLAKKESLGEFSLYLATSTTFAALLLLVNYFVTDTFSIWYVYANSNAEMPLAYKISAVWAGKEGSLLLWVVLNLMVTSLYINWGVKDRKKAKVAAVMTLFTSYLLLNLLIFSNPFTVLPYTPPDGAGLNPLLRTVEMILHPPVVFLAYSLAALLYSVIVANSEGERTIARLTWLSLTLGILIGSLWAYKTLGWGGFWGWDPVENASLLPWLTLTAYFHLTRGRDFFAYLTFSLVLFATLVTRSGIISSVHSFGGEVSDYSYVIPILASLAPLVVRARQFSISSLCNQNLPILFLSAVIVVFLGTIAGVSVEVSREYYFVTFLPVFALIVLLVVLKIKKVSMPATLLHLGVIFLFVGATSVWLFEESKTITLDSEGYKLLDLSISEDAEKYTLTAIVKTPDGVIAPKVYFYKVAGNNRVSSVEIIPTVLWDNYYSIKSFDLDNNVVTLEYYRVPLINAVWLGSALMLLGALLRFSGKVFKLGG

SEQ ID NO: 67946 - DNA, 1992 bp, Mesorhizobium loti MAFF303099
  CDS (1)..(1992): transl_table=11
atggttgaaaccggacatttcgccctggtcctggcgttcgcgctttcgctggtgcagacgatcgtgccgctgttcggcgcgcgcctcaacaaccagcgcctgatggctgtcggcggtcctgtcgcggtcaccggcttcgcgctgacggcgctgtccttcgtcgcgctggcgagcgcctatgcgaactctgatttctccgtggcgagcgtctgggagaactcgcattcgctgcagccgatgatctacaagatcaccggaacctggggcaatcacgaaggctcgatgctgctctgggtgctgatcctgacctttttcggtgctctcgttgcggctttcggttccaatttgccggcaactctgcgcgccaatgtactggccgtgcagggcgccatcggcgcggccttcttcctgttcatcctggcgacgtccaatccattcatccggctcaatccggcgccgatcgaaggccgcgacctcaacccggtcctgcaggatctcggcctcgccattcatccgccgctgctctatctcggctatgtcggcttctcgatctgcttttccttctcggtcgccgccttgatcgaggggcgcatcgacgcctcctgggcgcgctgggtgcggccatggacactggtcgcctggatgtttttgaccggcggcatcgccatgggatcgtactgggcctattacgagcttggctggggcggtttctggttctgggatccggtcgagaacgcctccttcatgccttggctggcgggcaccgcgctgctgcattcggccatcgtcatggaaaagcgctcggcgctgaagatctggacgctgctgctcgccatcctcaccttttcgctgtcgctgctcggcaccttcctggtgcgctcgggcgtgctcacctcggtccacgccttcgccaccgacccggcgcgcggcgtcttcatcctgtgcatcctgacgctgttcatcggcgggtcgctggcgctgtttgcgctgcgcgcctcgagattgacggccggcggcctgttccatccgatctcgcgtgaaggcgcgctcgtcctcaacaatctgttcctgaccacggcgaccgccacggtgctcgtcggcacgctctatccgctggcgctggaggcgctcaccggcgacaagatctcggtcggagcaccgttcttcgatctgactttcggccccttgatgttgccgcttctggtcctcgtgccgttcggcccgctgctggcctggaagcgcggcgacgtcatcgccgcgtcgcagcgcctgatggcggccttcgcgacggcgctggcggcaatgctcgttaccggcctgtttatcgacggcgcgtcggtgttcgccgccctcggcatcggccttgcggtctggctggtcgccggtgcgctcaccgaccttgccgtcaagtccggcgccggatcggttgcgccggccgtcatgctcaggcgctttgccggcctgccgcgctcggtcttcggcacggcattggcccatctcggcctcggcctgaccttgctcggcattgtcgccacgctctccttcggcaccgagaagatcctcaccatgcgcgccggcgagacggtggaactgtcaggtcatacgctgcgtttcgtcgggctttatccggcgcaggggccaaactacagcgaggaccgtggccgcttcgagctgatcggtgtcggcggcagtcctgtcggtgaaatgagttccgccaagcgtttctatccggtgcggcagacgacgacgactgagtccggcatcagaaccctcggtctttcccagctctacatctcgcttggcgacgaagccaaggacggctcggtcgtggtgcgcctgtggtggaaaccattggtgacgctgatctggggcggcggcctgatgatgatggcgggcgcggccatgtcgctgatggacaggcgcctgcgcgtcggcgcgccttcgcgccggcgcaagcaggcgagcgccgtgacgcccgcggtcctgccatga

SEQ ID NO: 67947 - protein, 663 aa, Mesorhizobium loti MAFF303099
MVETGHFALVLAFALSLVQTIVPLFGARLNNQRLMAVGGPVAVTGFALTALSFVALASAYANSDFSVASVWENSHSLQPMIYKITGTWGNHEGSMLLWVLILTFFGALVAAFGSNLPATLRANVLAVQGAIGAAFFLFILATSNPFIRLNPAPIEGRDLNPVLQDLGLAIHPPLLYLGYVGFSICFSFSVAALIEGRIDASWARWVRPWTLVAWMFLTGGIAMGSYWAYYELGWGGFWFWDPVENASFMPWLAGTALLHSAIVMEKRSALKIWTLLLAILTFSLSLLGTFLVRSGVLTSVHAFATDPARGVFILCILTLFIGGSLALFALRASRLTAGGLFHPISREGALVLNNLFLTTATATVLVGTLYPLALEALTGDKISVGAPFFDLTFGPLMLPLLVLVPFGPLLAWKRGDVIAASQRLMAAFATALAAMLVTGLFIDGASVFAALGIGLAVWLVAGALTDLAVKSGAGSVAPAVMLRRFAGLPRSVFGTALAHLGLGLTLLGIVATLSFGTEKILTMRAGETVELSGHTLRFVGLYPAQGPNYSEDRGRFELIGVGGSPVGEMSSAKRFYPVRQTTTTESGIRTLGLSQLYISLGDEAKDGSVVVRLWWKPLVTLIWGGGLMMMAGAAMSLMDRRLRVGAPSRRRKQASAVTPAVLP

SEQ ID NO: 67948 - DNA, 3000 bp, Aeropyrum pernix K1
  CDS (1)..(3000): transl_table=11
atgtctagcctagtcggtctgcactacgccacggttctaccgctggcagcttacctactactagccgttgttattctgcttctcgctatggggagagatggcgcggcgaggaaaacattcacagctagcttgcttatgatagtgcttggctggatcccctatattgctgcgttcctcctgctcgactatagtcttgatgaggttgcgaaaaacgcgtcagacgagttatcgccgtacctgcggatcggggctgcatggtccgggggcggcggtagcctttatctcttctccgctttcctatcactagcaatcctgcttcaaatgctgcttaacaagggcttgaataggcgtgccatggccgttttcacgcttctagtattaacttcgatgacttcagcaactctcatgggagctttcggaaccggaccgggagagcggggagggctaggcataaatcctgttctaaagaactactgggttgtaccccacccaactacaaccttcctgggctacagcttcatattagtagggtctgtagctctggtactaggttattatagaacaggccttccaattcagcttctgggcctcgcgtttctcaccttcggcctcgtcttcggcggcatgtggagctacgagacatttgggtggggaggctactgggcatgggaccctgtcgagacaagccagctcgcggtctggcttgcaacggtcgcctcgatacatatgataggcccccttaggagccttaaccgggggttcgctgcgtatgccgccagctccgtattcttagctctctatgttactaggagcggggttagccctctacacagctttgcggcagagagcttttccgcggttctactgttatcggcttcactggtaatgctggctctctcgatgctactattttcagagggtgtcggagagactctcgagaagtggaagagccgtcttcaggacgcgcgctggccccctagaattgcggagatgaatctctcgaacatacttctgacggttggctctgtgtctattgccctctcagcacttatagtctactcgtcgctgttaacaccatcagtgttaaagctagttggtctcgatactcagcctccatcgtttgagcagggggtgaggttctacaatagactactcatacctctagctcttgtctccctctatgcggtggccggttactacgtctctgttagggcaggggcgaaggcggcttacagtctattcgcaacactgactgttgttctagccataatgggcctggctacggtcaagaataccataattatatcccccctttccgacacgaccacaaacctagcctccgctaccctactagccgcgggctcgatatcgggatcagtgctactagctatgtcactctggatgttatatggcatggtaaagggtaaggtagcaaagagtgtacacacactcaggatagtgcttgagaagctagtgcacgccactatgattatgatacttgtttctgtggccatgagcggtagctatgcttacaaccagggatacagcgaagaggtcttagtaccgttaggcggagaagttagcgttatgggggtcaccatatcatacgagggctacgattatgaattacaccagggtacggtggatctaaagaataatctcgacccttcaagcgccattttgattacagccagggaagccctaaacatgatggatgaggatttatcttcgactatcagggaatataggcttgcatcagcggaatcccagtcagaccggactcttcagactcttctaaaggcttcagccagcaactccgaatataggggcgtcttcacctcaaccagaggtgtagctgatgctgcagttgtcgatgtgagaacaggagaaaatatatctaacattcaaacggctggagaaacggttcttcagcttgaagaccctacacttgaggtcacaatagatcccaagctcgacccggagactgggaggatagagggaggtgctctgagcgttgtcttctaccctgagaggcttgtggtgtatgggatcggcagccccgtgtcacttgatccttattcatacttatatgttcggttccgtgagccggtggagattaatttggacgatataactgtgaatatggaggaagtagtcgtttattctactggtggcagtagcatagagggtgtggtatcggggcaatctgtcctattcgagggtgtagccattagggtagtttcgggggagttatcgttcggttctatgaacatagagttgccgtaccagctggataggggtgaattcttctactttatggtttataagggtcaggctgaggttttagatgatatcttgtcttccagcatatccgaccttctagagtctggaatagcgggactggcagccggagaagatatggacgattttaatgtgcctaggagagccccggctggagtcagtcttagactgttcatggaggttaacggggagcctgtggaggctgatctacggttcgaggctaacggggaggctatagggatacatggccttgtgatagacacaataatattgaggagggggctaacgaatgtatacataacagtacaggcgcccctagtcagcggccacttcggggaatatcacgagctcatggtttattatttaaatgaagctatgaacaccctcaggccagaagagtacttggcccttgcttcggtgatggctgcaggctacaatatagcgagcatagtatcctcgcccagtaaagagagggccgcgctagaggtagagagagctacgatagacctgtacctgctctcggagaagttagatgagaagcgttcaagcgcggctgagggaatagttgttagtgtgaagatagttcctggggttccgctcctctggttaactggcgtgctagcaggggtcctcctgcttgctatggcttctatccacttctacctgggcttcaggcagggccgacttattgatacttag

SEQ ID NO: 67949 - protein, 999 aa, Aeropyrum pernix K1
MSSLVGLHYATVLPLAAYLLLAVVILLLAMGRDGAARKTFTASLLMIVLGWIPYIAAFLLLDYSLDEVAKNASDELSPYLRIGAAWSGGGGSLYLFSAFLSLAILLQMLLNKGLNRRAMAVFTLLVLTSMTSATLMGAFGTGPGERGGLGINPVLKNYWVVPHPTTTFLGYSFILVGSVALVLGYYRTGLPIQLLGLAFLTFGLVFGGMWSYETFGWGGYWAWDPVETSQLAVWLATVASIHMIGPLRSLNRGFAAYAASSVFLALYVTRSGVSPLHSFAAESFSAVLLLSASLVMLALSMLLFSEGVGETLEKWKSRLQDARWPPRIAEMNLSNILLTVGSVSIALSALIVYSSLLTPSVLKLVGLDTQPPSFEQGVRFYNRLLIPLALVSLYAVAGYYVSVRAGAKAAYSLFATLTVVLAIMGLATVKNTIIISPLSDTTTNLASATLLAAGSISGSVLLAMSLWMLYGMVKGKVAKSVHTLRIVLEKLVHATMIMILVSVAMSGSYAYNQGYSEEVLVPLGGEVSVMGVTISYEGYDYELHQGTVDLKNNLDPSSAILITAREALNMMDEDLSSTIREYRLASAESQSDRTLQTLLKASASNSEYRGVFTSTRGVADAAVVDVRTGENISNIQTAGETVLQLEDPTLEVTIDPKLDPETGRIEGGALSVVFYPERLVVYGIGSPVSLDPYSYLYVRFREPVEINLDDITVNMEEVVVYSTGGSSIEGVVSGQSVLFEGVAIRVVSGELSFGSMNIELPYQLDRGEFFYFMVYKGQAEVLDDILSSSISDLLESGIAGLAAGEDMDDFNVPRRAPAGVSLRLFMEVNGEPVEADLRFEANGEAIGIHGLVIDTIILRRGLTNVYITVQAPLVSGHFGEYHELMVYYLNEAMNTLRPEEYLALASVMAAGYNIASIVSSPSKERAALEVERATIDLYLLSEKLDEKRSSAAEGIVVSVKIVPGVPLLWLTGVLAGVLLLAMASIHFYLGFRQGRLIDT

SEQ ID NO: 67950 - DNA, 1956 bp, Vibrio cholerae O1 biovar eltor str. N16961
  CDS (1)..(1956): transl_table=11
atgattgctgaaattggccactttgcactgattgtatcgctcagcttagcgatattactcagtgtgctgccattagttggggcgtcacgcaacaacacactattgatgaacacggctcgccctttggcatggggtatgttctttttgctgtcgatctcgtttgcggttttgctgtgggcattctatatcaatgattttacagtgcaatatgtggcaagtaactccaatagtgagctgccttggtactatcgcctcactgctgtatggggcgcgcatgaaggttcattactgctttgggtgcttatccaagcggcttggactgtggctgtcgcgagttttagccgcggtatgccacaagaatcggtagcgcgtgtgcttgcggtgatggggatgattactgttgggttcttactcttcatcattctaacgtctaacccgtttttacgcaccttgccttattttccgattgacggccgtgatttaaatccgctgctgcaagaccccgggttaatcattcacccgcctatgttgtacatgggatatgtgggattctccgtggccttctcgtttgcgattgcttctttgatgacaggccgtctcgacacggcatgggcacgttggtcacgaccttggacaacggccgcttggctctttttgacgctgggtatcgtactgggttcatggtgggcttactacgaacttggctggggcggttggtggttctgggatccagtggaaaacgcctctttcatgccttggcttgccggaacagcgctgatgcactcattagcggtgactgaaaaacgcggcacgttcaaagcgtggacggtactgctggcgatttctgcattctcgttgagcctattgggcaccttcttagtgcgctcaggcatcttggtttcggtgcatgctttcgcctccgatccggcgcgcggtatgttcattctcggcttcttgattgcggtgattggtggttcactactgctatttgcgatcaaaggcgcttcagtacgagtgcgtggtaattttgagctggtatctcgtgaaaacagcttgttggtaaacaacgtgctgctgatgaccgcactcgcggtggtactgattggtaccttgttgcctttagtgcacaaacaactgggtcttggttccgtctctatcggtgcgcctttctttaacatgctgtttgcctggttgatgattccttttgcattttttatgggaattggtccactgatccgctggaagcgcgatcaaatctccacactctttaaacctatgctcatcacagcgatggcatcgttagtattggcagcgttgatgatgtggctgaatgctccgacgtttagcccaatggcttatcttggttgggtcatggcgtggtggatcttactgttacacgcttatgaactgcacacgcgagcgactcatcgtcaccgcttcatagttggggtgaagaaactgcaacgtagccactgggcgatgatgcttggtcatgttggtttagcggtgagcatcattggtattgctatggtgcaaaactacagcattgaacgtgatgtgcgtttggctccgggagataacttccaactcaatgagtacaacttttacttccaaggtgtgcgtgataaagatggaccgaactacgatggctacattgctgattttgaaatcactagccaaggccaatatgtcaatacattgcatgccgagaaacgtttctatcgcaccgcaaagtcaatgatgaccgaagcggcgatcgaccgtggcattacgcgtgacctttacattgcgatgggtgagcgtttggatgataaccgctcttgggctgtgcgtatttattacaaaccttatgtgcgctggatttgggcaggcggcttgctgatggccatcggtggtgccttagccatcagtgacaagcgttaccgctttagaaaaaacgcacatcaggaggcttaa

SEQ ID NO: 67951 - protein, 651 aa, Vibrio cholerae O1 biovar eltor str. N16961
MIAEIGHFALIVSLSLAILLSVLPLVGASRNNTLLMNTARPLAWGMFFLLSISFAVLLWAFYINDFTVQYVASNSNSELPWYYRLTAVWGAHEGSLLLWVLIQAAWTVAVASFSRGMPQESVARVLAVMGMITVGFLLFIILTSNPFLRTLPYFPIDGRDLNPLLQDPGLIIHPPMLYMGYVGFSVAFSFAIASLMTGRLDTAWARWSRPWTTAAWLFLTLGIVLGSWWAYYELGWGGWWFWDPVENASFMPWLAGTALMHSLAVTEKRGTFKAWTVLLAISAFSLSLLGTFLVRSGILVSVHAFASDPARGMFILGFLIAVIGGSLLLFAIKGASVRVRGNFELVSRENSLLVNNVLLMTALAVVLIGTLLPLVHKQLGLGSVSIGAPFFNMLFAWLMIPFAFFMGIGPLIRWKRDQISTLFKPMLITAMASLVLAALMMWLNAPTFSPMAYLGWVMAWWILLLHAYELHTRATHRHRFIVGVKKLQRSHWAMMLGHVGLAVSIIGIAMVQNYSIERDVRLAPGDNFQLNEYNFYFQGVRDKDGPNYDGYIADFEITSQGQYVNTLHAEKRFYRTAKSMMTEAAIDRGITRDLYIAMGERLDDNRSWAVRIYYKPYVRWIWAGGLLMAIGGALAISDKRYRFRKNAHQEA

SEQ ID NO: 67952 - DNA, 1926 bp, Pasteurella multocida subsp. multocida str. Pm70
  CDS (1)..(1926): transl_table=11
atgatcccagaacttggttttttggctttactgatcgcttctttgtgtgcgttcttgcttgcgctagtgccacaagtcggcatttttttgcgtaagccgtatatgattggtactgcgtggaatttgagttatctctttgggatatttacctgtatagcgttattctgccttgcctatgcctttgcactcgatgatttttctgtgcaatatgtggcacatcattctaattcacaactgccaattttctttaaagtgtctgctacttggggtggacatgaagggtcgatgctattttggttgtttgctttagcactctggttgatgctctttgcgttttccagtcgtcataaagatccgattatttgtgcgcgtgcactttcagtgcttgggctcatttgttttggtttttgtctctttattttatttttatcaaatccatttgaacgcagttttccacaagcatttgaagggcgtgatttaaatccgatgttgcaagatgtggggctgatttttcatccgcctttattgtatttgggctatgtgggctttgccgtcaattttgctattaccatttctgctttagtgagtgggcatttagatgccgccgtggctcgcatgatgcgcccttgggttttgctatcttggttatttttaactttagggattgtgttagggtcttggtgggcgtattacgaactaggctggggcggctggtggttttgggatccggtcgaaaacgcctcattgatgccttggttattaggtttggcattattacatagtctatctatcacagaacagcgtggcatttttagttactggacgctgctattttcacttttggcattttctttcagtttactgggtaccttcatcgtgcgctcgggcgtcttaacttctgtgcacgcgtttgcagtagatggtgatcggggaattgccttactgattttattctttttgttgactgtgagtgcattcactttatttgcattaaaggttaacttgccacaaagtgcggtacgtttccgtttaatttcgaaggaaaatgccctgttgcttctcaatattttattgacgattgccacggtcagtgtctttttaggcactttttatccgattgtctttaccgcattacaatggggatctatttcagtcggcgcgccgtattttaatacaatttttctgccactgtttgtgatggcaatgcttgctatgattttggtgttgtctttacgttggaaaacactgaataaaaaaccgtttattcaacgtacgttattgttatttcccgcgcttatattggcttatggattaatccgttattatgtagatcataaccaagggttgcctttcaatttcagcgcttatggcttgttaagcttgtcgatttggttaattctggcgacgttatggctcccatggacgcagctgaaactgaaacagctcgccatggtgatcgcgcatttaggtgtagcgataacggcaattggggcgatcatgagtagctattacagcagtgagattggcgtgcgcttggcaccgcaacaacgccaaaaactcggtgattacgagtttcactatcagggttttcagcatgtgttaggtccgaattacaccagtgaaaaagcccattttgtggtgacaaagcaaaaccaagcttatgctgagatttacccagaacgccgttattatgatgtgcgtactatgaacatgagcgaagttgggattgattggggatggcttggtgatgtctatattgtaatgggcgataaattgggacaaggcgaatttactttccgcttgcaatataaaccttttatccgttggttatggtttggcgggcttttaatggcactaggcgccttgcttgccatattttccttgcgcaatagcaataaactaaaaccacgtcgtcaatcagattga

SEQ ID NO: 67953 - protein, 641 aa, Pasteurella multocida subsp. multocida str. Pm70
MIPELGFLALLIASLCAFLLALVPQVGIFLRKPYMIGTAWNLSYLFGIFTCIALFCLAYAFALDDFSVQYVAHHSNSQLPIFFKVSATWGGHEGSMLFWLFALALWLMLFAFSSRHKDPIICARALSVLGLICFGFCLFILFLSNPFERSFPQAFEGRDLNPMLQDVGLIFHPPLLYLGYVGFAVNFAITISALVSGHLDAAVARMMRPWVLLSWLFLTLGIVLGSWWAYYELGWGGWWFWDPVENASLMPWLLGLALLHSLSITEQRGIFSYWTLLFSLLAFSFSLLGTFIVRSGVLTSVHAFAVDGDRGIALLILFFLLTVSAFTLFALKVNLPQSAVRFRLISKENALLLLNILLTIATVSVFLGTFYPIVFTALQWGSISVGAPYFNTIFLPLFVMAMLAMILVLSLRWKTLNKKPFIQRTLLLFPALILAYGLIRYYVDHNQGLPFNFSAYGLLSLSIWLILATLWLPWTQLKLKQLAMVIAHLGVAITAIGAIMSSYYSSEIGVRLAPQQRQKLGDYEFHYQGFQHVLGPNYTSEKAHFVVTKQNQAYAEIYPERRYYDVRTMNMSEVGIDWGWLGDVYIVMGDKLGQGEFTFRLQYKPFIRWLWFGGLLMALGALLAIFSLRNSNKLKPRRQSD

SEQ ID NO: 67954 - DNA, 1995 bp, Deinococcus radiodurans R1
  CDS (1)..(1995): transl_table=11
atgcttgatttcctcggatacaacttttcgccgctcggcgctgccgggtcgctctcgctgctgctcgcgctggggtttgcgctcgtcgcgctggtgtccggcgtgctggggggcgtgcggcgcgacgagcggctgaccggcatggcccggtatgcgctgtggggcaacttcggcttcatgaccgtcgccacccttctgctgcaatacgccatcctgaccgacgacttctcggtgcgctacgtggcgcagcactccatgaccgtctcgccgctgtgggtcaaatgggtcacgctgtgggcggcgctggaaggctcgattttgctgtgggcgtggattctgtcgctctacgccttcctggtcagcctgaccgcccggcgcgacgtgctgcggccctgggtgctggcgacgatggcgctctcggtggtgtttttcgtggggctgaacttgacggtcgccagtccctttaccccggtggtggacgtgccgctgcaaggacgggggcccaacccgctgctgcaaaaccactggatgatggccgtgcacccggtgctgatgtacctgggcttcgtcggcctgagcgtgcctttcgcctacgcggtggccgccatgatcaccgggcggctcggcgagtcgtggctggtgcagacccggcgctggacgctggtggcgtggggctttctctcggcggcgattgtggcgggcggctggtggagctacgagattctgggctggggcggctactgggcctgggacccggtggaaaacgccagcttcattccctggctgctggcgaccgccttcctgcacagcgtgcagattcaggagcggcggcggatgctcaagacctggaacatttacctcatcgtcttcgcctacgccgccaccgtgctcggcaccttcctgacgcgctcgggcgtggtggaaagcgtgcacgccttttccaacggccccatcggcccggtgttcctgggctttttcgtgctgctggtggcccttggcgtggggctggcgacgtggcggctgccgcagatccgcgacccgcacagcctcgacagcccgctgtcgcgtgaggggtctatgctcggcggcaacgtggtcttcgtggtgttcggactgctggtcgtgctcggcacgctgtttccggtgctggtggaggaggtgcgcggcatccgcaccagcgtgggcgagccgttctacaactacttcgccattccgctgggcctgctgctgctgctggtgatgggcgtcggcccggtgctgccctggcgcaaggccggcaacggcgacctgcggagcctgtgggcgctcacccgctggccggtggccgccgccgtggtcggcacggtgctcgccttcgcgctgggcgtccgcaacgtggggctggcactcacgctggggctgtgcgcgtacaacgtggtcgggctggggcagctcgtcgccggcagcgcccgcgcccgtggcggtctgggcgccctgccgggactggtgcgcgagtatccccggcgctacggggcgtatgtcgctcacctcggcatcgtgctcatcgccatcggcatcggcttttcgggcacctacaaggcgcggcaggaagtcaccctgcgccctaacgtgccgcaaaccgtgctcggcaagaccctgacgctgacgaacctgggcaccgagcagcgccccgaacgccagtccattgtggcgacggtgcaggcggggagtgaaacgctgatgcccaagctcaacacctacgtcaacatgccgcaacaggtcgccatgcccgccgtcaaatatcacctgatgggcgacacctacgtgacgctgctcagcggcgacgtgaaccagcagtgggcgacggtggccgtcatcgactcgccgctggtcggctggatctggtggggcggcctggtgctgctgctcggcacggcgctgagcgtgacggccccagtgcgcgagacggtggcggtccgtgccccggcacgggggctggaaggggtgacagcgtga

SEQ ID NO: 67955 - protein, 664 aa, Deinococcus radiodurans R1
MLDFLGYNFSPLGAAGSLSLLLALGFALVALVSGVLGGVRRDERLTGMARYALWGNFGFMTVATLLLQYAILTDDFSVRYVAQHSMTVSPLWVKWVTLWAALEGSILLWAWILSLYAFLVSLTARRDVLRPWVLATMALSVVFFVGLNLTVASPFTPVVDVPLQGRGPNPLLQNHWMMAVHPVLMYLGFVGLSVPFAYAVAAMITGRLGESWLVQTRRWTLVAWGFLSAAIVAGGWWSYEILGWGGYWAWDPVENASFIPWLLATAFLHSVQIQERRRMLKTWNIYLIVFAYAATVLGTFLTRSGVVESVHAFSNGPIGPVFLGFFVLLVALGVGLATWRLPQIRDPHSLDSPLSREGSMLGGNVVFVVFGLLVVLGTLFPVLVEEVRGIRTSVGEPFYNYFAIPLGLLLLLVMGVGPVLPWRKAGNGDLRSLWALTRWPVAAAVVGTVLAFALGVRNVGLALTLGLCAYNVVGLGQLVAGSARARGGLGALPGLVREYPRRYGAYVAHLGIVLIAIGIGFSGTYKARQEVTLRPNVPQTVLGKTLTLTNLGTEQRPERQSIVATVQAGSETLMPKLNTYVNMPQQVAMPAVKYHLMGDTYVTLLSGDVNQQWATVAVIDSPLVGWIWWGGLVLLLGTALSVTAPVRETVAVRAPARGLEGVTA

SEQ ID NO: 67956 - DNA, 1941 bp, Xylella fastidiosa 9a5c
  CDS (1)..(1941): transl_table=11
atgctgcctgagtttggccagatcctcctgatcctcgccctgctgacagcactgctgcagggactgcttcccctgattggcgcccagcgccgccgcacggcttggatggccgttgcacgcccagccgcctatgtgcaactgagcctgctcgctggcgcattcgcactgctcacctatgccttcctcggcaacgacttctccgtccaatacgtcgccgaaaactcccattcactgctacccaccctctaccgctctaccgccgtgtggggtgcccacgaaggatccctcttactctgggtattgctcctggcaggatggaccgctagcgtcgccttacgttcccacaccctcccagccaccctgagcgcacgcatccttggcgtcctgggcctgattgcactcggcttcctcgccctgatcctcttcacctccaacccattcgcacgtctcctgcctgccgtcccagaagggaacgacctcaacccgttgctgcaagatcccgggatgattgtgcatccccccctgttatatgccggctacatcggtttcgcagtgccattcgcctttgccgtcgcggtcctgctggaaggacgcatcgatccaacctggctacgctggagccgcccttggacccataccgcctgggcactgctgaccctgggtatcgcactgggcagctggtgggcctactacgaactcggctggggcggctggtggttctgggaccccgtggaaaacgccagcttcatgccgtggctcatcggtgtcgcactgattcattcccaagcgatcaccgacaaacgcggcagcttcacccactggacactcctgctcgcaatcaccgcctttgcactagcactgctgggcacattcctcgtccgctcaagcgtactgacctcagtccatgcctttgctgctgatccggtacgcggcgcgtttattctgctgctcatcttcacgttgattggcggcgcactgctgctgtatgcacggcgtgcaccgcagctcacccccgtcacaataaacatgcaacaacgctttacacccgtctcacgcgaaaccctattactgctcaacaacctattgctgacctgcgcctgtgcgatggtgctgctaggcaccctctatcccctgctggccgatgcactggcactgggtcaactttcagtcggcccaccctacttcggccccctattcaccctgctgatgacaccactaatcgtcttactgccattgggtccattcacccgatggcaacgcgaacacccctcaacacccctcgtactgctggccccttgggccgcactgagcctggctgtcgccgcactggctggcatcaccacaccacagcaccattggaaaaccatgctcagcgtggccgcggcagcatgggtactcctgggaaccctccgcttcctctggtggcactggcgcatcaccggatcccgtcccacccccagcaccctgggcatggtcctggcacacgccggaattggtgtcttcctcactggcgcgctgttagttgaaacactcagcctacaacgtgaaattgcactcagcccgggccagacactcaccctcggccccatcaccctgcactttgatgccctcctcgaacaccacggccccaactacgtggctgatcgtgcccgattcagcctattacgcaacacgcatcccctgggcaccctgacgacagaaaaacgccgctatgtcagtggcggccaagtcaccaccgaagccggcatccatcctggagcgctcggtgacatctacgtcgcattaggagaatccctgggcaatgggtcatgggcaattcaggcacactacaaacccttcgtccgctggatctggctgggcgcagcactaatggccctgggcgggctgatcgctgctgctgatcgccggttccgccaccacccggagtcatcgcatgtctga

SEQ ID NO: 67957 - protein, 646 aa, Xylella fastidiosa 9a5c
MLPEFGQILLILALLTALLQGLLPLIGAQRRRTAWMAVARPAAYVQLSLLAGAFALLTYAFLGNDFSVQYVAENSHSLLPTLYRSTAVWGAHEGSLLLWVLLLAGWTASVALRSHTLPATLSARILGVLGLIALGFLALILFTSNPFARLLPAVPEGNDLNPLLQDPGMIVHPPLLYAGYIGFAVPFAFAVAVLLEGRIDPTWLRWSRPWTHTAWALLTLGIALGSWWAYYELGWGGWWFWDPVENASFMPWLIGVALIHSQAITDKRGSFTHWTLLLAITAFALALLGTFLVRSSVLTSVHAFAADPVRGAFILLLIFTLIGGALLLYARRAPQLTPVTINMQQRFTPVSRETLLLLNNLLLTCACAMVLLGTLYPLLADALALGQLSVGPPYFGPLFTLLMTPLIVLLPLGPFTRWQREHPSTPLVLLAPWAALSLAVAALAGITTPQHHWKTMLSVAAAAWVLLGTLRFLWWHWRITGSRPTPSTLGMVLAHAGIGVFLTGALLVETLSLQREIALSPGQTLTLGPITLHFDALLEHHGPNYVADRARFSLLRNTHPLGTLTTEKRRYVSGGQVTTEAGIHPGALGDIYVALGESLGNGSWAIQAHYKPFVRWIWLGAALMALGGLIAAADRRFRHHPESSHV

SEQ ID NO: 67958 - DNA, 1989 bp, Rickettsia conorii str. Malish 7
  CDS (1)..(1989): transl_table=11
gtgagtgaaatcggtaattttttactactaacaacgatgtacttgtcggttatcggtttgtcttttgtcttttatgtcattcctgcgaaagcgggaatccataaaaaatctctactttatagactgaattgccgctttcgcgggaatgacaactacctcattacttgccccttctacatagctgcctcatgtactatacttgccttttttaccctagtctatgcctttattatctctgacttttcactacaaaatgttttcttaaattccagtactttaaaacctttaatatataaaatagccggtagttggtcgagccacgaaggctcaatgttattatggttttgtttattacaaatcgttagttgctgttatatatttttacttgaagataaccgtcttaaatttttatctattattattctatcagccatacaattattgtttagcagctttatttactttacctccaatccttttaacgtgttttctttcgttcctaaagaagggttaggcttaaacccgatgctacaagatattgctttgagcatccatcctcctctgctttatttaggctatgttagctatgtagtaccgtttactattgtttgtgcctctatgtcattctcatacccacttatgtcattcccgcgaaagcgggcatccattaatgacctaagacttctcaaaacattttccaatatcggtatcttatttactaccataggaattagccttggttcttggtgggcatatagagaactcggctggggcggattttggttttttgatccggtagaaaatatttcactatttccttggttatccggaattatgctccatcattctataattgtaacaacaaaaaccagacgtatgcaaaactggacagtaattttatccatcattacttttttattagtaatatttagtgcttttttagtacgttccggttttattacctcaattcactcttttgcattctcacctgagagaggaatatacttgcttgggatatttttgattatggggattggtagtattgggtggtatactaccacatcattgcgaggaaatgcattaacattgacgaagcaatctcaggaagctaaccaagattgctacagccacttttgtggcttcgcaatgacgcattgtggaaactccatactcctcggtaatatattcctccttcttagccttattgtgctaatagctgccacactttatccgccactttactctttattcgacgataaatctattattattagtgaaacattttttgttaataattttattatattcgttatccctattcttggtaccataggattatttactaccagaagctctattaaaaaacatattataattctaatattatctctaataattacttatttaatatcattaaaagtaacatttagtgttatatcgattttaactataatcgcatctatatttcttatgcttcataatattcattatcttttggttaaaactaattattgtagaaatagacttaaagcaagtaacgctagtatgatccttgggcattttggttttgcactaattagttttagtattactatgaatacattattacaaagtgaaatggattttaccggcagagtaggaacaagtaaaacatttaacgaatttaaagtaacattgcaaaatattaagtttgctcaaggtaaaaattattatagacaaatcgctgaattttggcttgaggataatagccgtaatataactatattaaagccggaaaatagactttatatagttgaaaagagtttatcgcaagaaagtgatatatactcttacttattatatgatctttacgcagttttaagtaatatagacggcgatataatccatgctaaaatatattacaagccaacgataagctttatttggcttggaattattcttaccgcgtccggtttttttattgcactaatcagaaaaaattctagctaa

SEQ ID NO: 67959 - protein, 662 aa, Rickettsia conorii str. Malish 7
MSEIGNFLLLTTMYLSVIGLSFVFYVIPAKAGIHKKSLLYRLNCRFRGNDNYLITCPFYIAASCTILAFFTLVYAFIISDFSLQNVFLNSSTLKPLIYKIAGSWSSHEGSMLLWFCLLQIVSCCYIFLLEDNRLKFLSIIILSAIQLLFSSFIYFTSNPFNVFSFVPKEGLGLNPMLQDIALSIHPPLLYLGYVSYVVPFTIVCASMSFSYPLMSFPRKRASINDLRLLKTFSNIGILFTTIGISLGSWWAYRELGWGGFWFFDPVENISLFPWLSGIMLHHSIIVTTKTRRMQNWTVILSIITFLLVIFSAFLVRSGFITSIHSFAFSPERGIYLLGIFLIMGIGSIGWYTTTSLRGNALTLTKQSQEANQDCYSHFCGFAMTHCGNSILLGNIFLLLSLIVLIAATLYPPLYSLFDDKSIIISETFFVNNFIIFVIPILGTIGLFTTRSSIKKHIIILILSLIITYLISLKVTFSVISILTIIASIFLMLHNIHYLLVKTNYCRNRLKASNASMILGHFGFALISFSITMNTLLQSEMDFTGRVGTSKTFNEFKVTLQNIKFAQGKNYYRQIAEFWLEDNSRNITILKPENRLYIVEKSLSQESDIYSYLLYDLYAVLSNIDGDIIHAKIYYKPTISFIWLGIILTASGFFIALIRKNSS

SEQ ID NO: 67960 - DNA, 1983 bp, Caulobacter crescentus CB15
  CDS (1)..(1983): transl_table=11
atgatcgtcgaactcggcgctttcgcgctcattctctctctgatgctgtcggtcgcccagaccggcctgtcggccgtgggcggcgcgcggcgctcgccggtgctggcgggcgcgggccagggcgcggcgatcgcgaccttcgtggccctgctggtctcgttcgcggcgctgatctacgccttcgtgacgtcggacttctcggtgaccaacgtcgccaccaactcccacaccgacaagccgatgctctacaaggtggccggcgcctggggcagccacgagggctcgatgctgctgtggtgcttggtgctgaccggctttggcgcggccatggccgtgttcggcgacagcctgccgccgcgcctgcgcgcctacgccatcgccgtgcagggcgggctgggcgtcatgttcctggcctacaccgtgttggcgtcgaacccgctggcgcggctgcttgaggcccccatcgagggcaagtcgctcaatccgctgctgcaggactgggccttggccttccacccgccgttcctctacgtcggctatgtcgggttctcggtagtctattcgctgtcgatggcggccctgatcgaaggccggatcgacgcggcctgggcgcgctggattcgcccctggaccctggcggcctggagcatgctgacggtcggcatcacgctgggcgccttctgggcctattacgaactgggctggggcggctggtggttctgggacccggtcgagaacgccagcttcatgccctggctgatcggggcggccctgctgcactcggccatcgtcaccgaaaggcgcggcgcgctgccgggctggacggcgttcctggccctggcggcctacaccttctcgatgctgggcgccttcctggtgcgctcgggcgtgctgacctccgtccacgccttcgcggtcgatccgacgcgcggcgtgctgctgctgatcatgatggccgtggccgccggcgcgggcttcctgctgtttggcctgcgcgcccccagcctgaaccgcggtggccagttccggccgatcagccgcgagagcgccatcgtgctcaacaacatcctgctgtcgacggcgacggcggtggtgctgctgggcaccctctatccgctgatccgcgaggccatggacggcgaggccgtgtcggtgggcgcgccgttcttcaacctgaccttcacgccgctgatgatcctggccttcgccgtgctgcccgccggaccactgttggcttggaagcgcggcgacgccaagggcgtggcgcgcaagctgtgggtcgtgctggccctggcggccctgctgggcctgatcgcctatgccgtggtgcagccgcgcaaggccctggccagcggcggcctggtggtcggcttctggctgatcggcggcgcgctgctcgagatcgccgagcgcctgaagctggcgcgcgcgcccttcgccgagagccttcgccgggcacacggcctgccgcgcggcgcctggggcacgaccctggcccatgcgggtctgggcgtgttcgtgctgggggcctcgttcgagaccgcctggcgcgtcgaggcggctcaggccctgagcctgaacggcagccagccgctgggcgcctataccgtaaccctgacggatgtggtgacgatcgaggggccgaactatctggccgagcgcggcatcatcaccgtcaccaacaaggccggcgccgaggtgtgccgcgcccagcctgagcgccgcttctatccgacgggggcccagaccacgtccgaggtcgccatctgcgccaagggcctggacgacatctatgtggtgatgggcgagcggcgggcaggcgagggcggcaagccggcctggctggtgcgggcctatgtgaacccgtgggtgcggctgatcttcctgggtccgctgctgatggccgtcggcgggatcgtctcgctgtcggaccgccgcgtgcgcctgggcgtgggacgacggaccggggaggtggtgtcgtga

SEQ ID NO: 67961 - protein, 660 aa, Caulobacter crescentus CB15
MIVELGAFALILSLMLSVAQTGLSAVGGARRSPVLAGAGQGAAIATFVALLVSFAALIYAFVTSDFSVTNVATNSHTDKPMLYKVAGAWGSHEGSMLLWCLVLTGFGAAMAVFGDSLPPRLRAYAIAVQGGLGVMFLAYTVLASNPLARLLEAPIEGKSLNPLLQDWALAFHPPFLYVGYVGFSVVYSLSMAALIEGRIDAAWARWIRPWTLAAWSMLTVGITLGAFWAYYELGWGGWWFWDPVENASFMPWLIGAALLHSAIVTERRGALPGWTAFLALAAYTFSMLGAFLVRSGVLTSVHAFAVDPTRGVLLLIMMAVAAGAGFLLFGLRAPSLNRGGQFRPISRESAIVLNNILLSTATAVVLLGTLYPLIREAMDGEAVSVGAPFFNLTFTPLMILAFAVLPAGPLLAWKRGDAKGVARKLWVVLALAALLGLIAYAVVQPRKALASGGLVVGFWLIGGALLEIAERLKLARAPFAESLRRAHGLPRGAWGTTLAHAGLGVFVLGASFETAWRVEAAQALSLNGSQPLGAYTVTLTDVVTIEGPNYLAERGIITVTNKAGAEVCRAQPERRFYPTGAQTTSEVAICAKGLDDIYVVMGERRAGEGGKPAWLVRAYVNPWVRLIFLGPLLMAVGGIVSLSDRRVRLGVGRRTGEVVS

SEQ ID NO: 67962 - DNA, 1932 bp, Salmonella typhimurium LT2
  CDS (1)..(1932): transl_table=11
atgatgcctgaatacggccacgcgctgctgtgcctggcgctcggcgtggcgctgctgctgtccgtttacccgctgtggggcgtggcgcgcggtgacgcgcggatgatggcgtcggccggggtgttcgcctggctgctgtttatctgcgtggcgggcgcgtttttcgtgctggtgcacgcctttgtggttaacgacttcaccgtggcctatgtcgccggcaactcgaacacgcagctgccggtgtggtaccgggtggccgccacctggggggcgcacgagggctcgctgctgctgtgggtgctgctgatgagcggctggaccctggcggtggcggtgttcagccggcaggtgccggcggatatcgtcgcccgggtgctggcggtgatggggatggtctgcgccggttttctggcgttcatcctgttcacctccggcccgttcgcccgcacgctgccggcctttccggtggaggggcgcgacctgaacccgctgctgcaggacccggggctgattttccacccgccgctgctgtacatgggctatgtcggcttctcggtggccttcgccttcgccatcgccgcgctgctgagcgggcgtctggacagcgcgttcacccgttttgcccgcccgtggacgctggcggcgtgggtgttcctgacgctgggcatcgtgctcggctcggcgtgggcctactacgagctgggctggggcggctggtggttctgggacccggtggagaacgcctcctttatgccgtggctggcgggcaccgccctgctgcactcgctggcggtcaccgaacagcgcgccggctttaaggcgtggacgctgctgctgtccatctgcgccttctcgctgtgcctgctgggcaccttcctggtgcgctccggggtgctggtgtcggtgcacgccttcgcctccgacccggcgcgcgggatgtttatcctcgcctttatggtgctggtcaccggcggctcgctgctgctgttcgccgtgcgcgggcacagggtgcgttcgcgggtgaacaacgcgctgtggtcgcgcgagtcgctgctgctcggcaacaacgtcctgctgatggccgccatgctggtggtgctgctgggcaccctgctgccgctggtgcacaaacagctggggctgggcagcatttcggtgggggagccgttctttaacaccatgttcacctggctgatggtcccctttgccctgctgctgggggtggggccgctggtgcgctggggccgggaccggccgcgtaacatcaggacgctgctgctcaccgccctggtctccaccctggtgctgtcggtacttttgccatggctgctggaagataaaatcatcgccatgacggcggtggggatggcgatggcctgctggattgcggtgctggcggtggccgaagccgtacagcgcgtgtcccgcggcacgaaaacctctctcagctactggggaatggtggcggcgcacctcgggctggcggtgacgattaccggcatcgccttcagccagaattacagcgtggagcgtgacgtgcggatgcgggcgggcgacagcgtgaccattcacgactaccgcttcaccttccgggaggtgcgggacatcaccgggcccaactaccgcggcggggtggccctcatcggggtgacgcgccacggcgagccggaggcggtgctgcacgcggagaaacggctctacaacaccagccggatggtgatgaccgaggcggcgattgacggcgggctgacccgcgacctgtacgccgcgctcggggaggagctggacaacggcgcgtgggccgtgcgcctgtactacaaaccgtttgtccgctggatatgggccgggggactgctgatggcgctgggcgggctgctgtgcctggcggacccgcgctaccgccgccgtaaaccattgccggaggccggatga

SEQ ID NO: 67963 - protein, 643 aa, Salmonella typhimurium LT2
MMPEYGHALLCLALGVALLLSVYPLWGVARGDARMMASAGVFAWLLFICVAGAFFVLVHAFVVNDFTVAYVAGNSNTQLPVWYRVAATWGAHEGSLLLWVLLMSGWTLAVAVFSRQVPADIVARVLAVMGMVCAGFLAFILFTSGPFARTLPAFPVEGRDLNPLLQDPGLIFHPPLLYMGYVGFSVAFAFAIAALLSGRLDSAFTRFARPWTLAAWVFLTLGIVLGSAWAYYELGWGGWWFWDPVENASFMPWLAGTALLHSLAVTEQRAGFKAWTLLLSICAFSLCLLGTFLVRSGVLVSVHAFASDPARGMFILAFMVLVTGGSLLLFAVRGHRVRSRVNNALWSRESLLLGNNVLLMAAMLVVLLGTLLPLVHKQLGLGSISVGEPFFNTMFTWLMVPFALLLGVGPLVRWGRDRPRNIRTLLLTALVSTLVLSVLLPWLLEDKIIAMTAVGMAMACWIAVLAVAEAVQRVSRGTKTSLSYWGMVAAHLGLAVTITGIAFSQNYSVERDVRMRAGDSVTIHDYRFTFREVRDITGPNYRGGVALIGVTRHGEPEAVLHAEKRLYNTSRMVMTEAAIDGGLTRDLYAALGEELDNGAWAVRLYYKPFVRWIWAGGLLMALGGLLCLADPRYRRRKPLPEAG

SEQ ID NO: 67964 - DNA, 2223 bp, Salmonella typhimurium LT2
  CDS (1)..(2223): transl_table=11
ttgcataatctggacatcttccttcctgaagccggatttctggcgctgttgttgagtctcggggtcaacgtgctgaccccgctggcgacgtggtgcgggatggggcagcactggcgcggcgtcatgcgcctgacgacctgcggcgcgtggacggcgttcacgctgctgctactggcgtttgcgattctggttagctgttttctgaccagcgatttttcggtcgtttatgttgcgcagcatagccatagtcagttgtcatggggactgaaactggcggcggtatggggcggtcatgaaggttcgctcctgctgtgggcgctgcttctttcggggtggacggcgctattcgcctggcgctcccggcatgaatctgacgcgctttttccgctgaccctgagcatcttgtccttcattatggcctcgctgctgctatttattgtgctgtggtccgatccgttcctgcgtattttccctcccgccatggaagggcgcgaccttaatcccatgctgcaacatctggggctgatcttacatccgccgctgctctatctgggttatggcggcctgatgaccgcggcgagcgtagcgctggcttcgctactgtgcggcggctttaacgccacaaccgcctgggtttgctggcgctgggcgttaccgggttggtgcgctctgacgctggggatcattctcggatcgtggtgggcatattgcgaactgggctggggcggctggtggttctgggacccggtggaaaatgcctcgttgttgccgtggcttgccgccagcgcgttgctgcacagtctgtatgtcagccgccagcgcgggagcttccgccactggtcgttgctgctggcgatactgacgctgatcctctcgttgctgggaacgctgattgtgcgttccggcattctgctctccgtccatgcttttgcgctggataacgtgcgcgcggtgccgctgtttatcctttttgccgcgttaagtctggcatcgcttgctctgtacggctggcgggcacgggagccgtatccggcgacgcgtttgggcggcggaaagtgcgaaacgctcattctgacgacgctgctgctctttagcgccgtcttgttgatcgtgctggtcgggacgctctaccccatgatttatggtttgatgggctggggaaggctttcggtgggcgcgccctattttaatcgcgtcacgctgccgtttggcctgctgatgctggtagttatcgtgctggcgacaatcagaagccgcaaagtctctgtgcgttgtcagcttccggcattgctggcgcatacgggcgtatttatcttcgccgccgggatcatggtttccagcggcagtcggcatgaaatcagccttaacctcagccccggtcagcaggtggtactggcgggctatacctttcgtttcgagcgtctggatctggaagccaaaggcaactacaccagtgaaaaagcgcggatcacgttgtggcggaatgaaaaacgcattggcagcctgcagcctgaaaggcgcttctatgccgcgcgtcgtcaacagatgatggagccggggattcactggaacctgctacatgactggtacgcggtgatgggcgaaaaaaccggaccggatcgttacgccatgcgcttatacgtgcagaccggcgtgcgctggatctggggtgggggattgttgatggtgtgtggagcgctgctgagcggatggcgggggaggaagcatcctgagttattgcctgatggcgctgcgcttatcaggcctacgagtgaaaagcatggtaggccggataaggcgttcacgccgccatccggcaaaacgatgttacttttggctttactgatttttctgccttttgccacccatgcccaggtggtggacacatggacgtttgccaacccgcagcagcaggagaaagcgctgtctattgccagtcagctgcgctgtccgcagtgtcagaaccagaacttgctggaatccaatgcgcccgtggcggtcagtatgcgccatcaggtttacagcatggttgccgaaggtaaaagcgaagcggaaatcaccgcctggatgaccgaccgctatggtgatttcgtgcgctacaacccgccgctgaatgagcaaacgctgctgttgtgggcgctgccgtacctgctgttattgctggtgggcgtggtggcctggcgggtgagaaagcgtcagcacgcaggagagggggaacaatga

SEQ ID NO: 67965 - protein, 740 aa, Salmonella typhimurium LT2
MHNLDIFLPEAGFLALLLSLGVNVLTPLATWCGMGQHWRGVMRLTTCGAWTAFTLLLLAFAILVSCFLTSDFSVVYVAQHSHSQLSWGLKLAAVWGGHEGSLLLWALLLSGWTALFAWRSRHESDALFPLTLSILSFIMASLLLFIVLWSDPFLRIFPPAMEGRDLNPMLQHLGLILHPPLLYLGYGGLMTAASVALASLLCGGFNATTAWVCWRWALPGWCALTLGIILGSWWAYCELGWGGWWFWDPVENASLLPWLAASALLHSLYVSRQRGSFRHWSLLLAILTLILSLLGTLIVRSGILLSVHAFALDNVRAVPLFILFAALSLASLALYGWRAREPYPATRLGGGKCETLILTTLLLFSAVLLIVLVGTLYPMIYGLMGWGRLSVGAPYFNRVTLPFGLLMLVVIVLATIRSRKVSVRCQLPALLAHTGVFIFAAGIMVSSGSRHEISLNLSPGQQVVLAGYTFRFERLDLEAKGNYTSEKARITLWRNEKRIGSLQPERRFYAARRQQMMEPGIHWNLLHDWYAVMGEKTGPDRYAMRLYVQTGVRWIWGGGLLMVCGALLSGWRGRKHPELLPDGAALIRPTSEKHGRPDKAFTPPSGKTMLLLALLIFLPFATHAQVVDTWTFANPQQQEKALSIASQLRCPQCQNQNLLESNAPVAVSMRHQVYSMVAEGKSEAEITAWMTDRYGDFVRYNPPLNEQTLLLWALPYLLLLLVGVVAWRVRKRQHAGEGEQ

SEQ ID NO: 67966 - DNA, 1992 bp, Agrobacterium tumefaciens str. C58
  CDS (1)..(1992): transl_table=11
atgatcaacgagatcggccattatgtcctggttttggcgctcggtgttgggctgatcgtctcgacgctgcctgttatcggcgcgcgccgcaacgatcgggcactgatggatgtcgcctcccttggctcggtcctgatgttcctgctggtggggttctccttcgcggcactgacacatgcctatgccgtctcggatttttccgtgcgcaacgtctgggaaaactcccattcgctgatgccgatgctctacaagctgaccggtgtttggggcaaccatgaaggctccatgctgttgtggctgctgatcctggtgtttttcagcgcgcttgtcgccgccttcggcggcaacctgccggaaacgctcaaagccaatgtgcttgcggtacaggcatggatttcggtcgccttcctgctgttcatcctgctcacctccaacccgttcctgcggctggagcgggtgccggccgaggggcaggacctcaatcccatccttcaggatttcggcctcgccatccatccgccgctgctctatctcggttatgtcggtttttccgtctgcttctcctttgccgtcgcagcacttctggaaggtcgtatcgacgccgcctgggcgcgctgggtaaggccgtggacgctcgccgcctggacgttcctgaccgcaggtatctccatgggctcctactgggcctattatgaactcggctggggcggctggtggttctgggatccggtggaaaacgcctccttcatgccctggcttgccggcacggcgctgctgcattcggcgctcgtcatggaaaaacgcgaggcgctgaaaatctggaccgtgcttctggcgatcatgaccttttcgctgtcgctgctcggcaccttcctcgtgcgctccggcgtgctgacctccgtgcatgctttcgccaccgatccgagccgcggcatcttcattctcggcattctgacgatcttcatcggtggcgcctttgcgctctttgcctggcgcgcgccgtcgctgaaggccggcggcctgttcgcgccgatctcgcgtgaaggcgcgctcgtcctcaacaaccttatcctgacggtttcgaccgccaccgtgctgatcggcacgctttacccgctcattctcgaaaccctgacgggcgaaaaaatctcggtcggtgcgccgttcttcaacctcaccttcggcctgctgatgatcccggtcctgatcgtcacacctttcgggccgatgctcgcctggaagcgcggcgatctcttgggtgccttccagcggctttatgtggccgcggctatcgcggctctggccgggctgaccctctggtatatcgaaaatggcggtccggtgctggcagcactcggtattgccgccggtttctggttgatcttcggggcgctcaccgatctctggtatcgcgccaatttcggcaaactggccttcggcattgcattccgccgcctgaaaggcctgccgcgttcggccttcggcacggcgctggcgcatatgggcctcggcatcaccgtgctcggcatcgtcatcgtcaccacctatgagaccgaaacggttctggaaatgaaacagggcacggtggcggaagcgggcggttacagcctgaccttcgacggcatccgccacgccgtcggcccgaatttcaccgaggatcgtggccatttcaccgtgcgcaaggcgggtgttgaggtggccgacgtctggtcgtccaagcggctttataccgcgcggcgcatgccgacgacggaagccggcatcctgaccttcggcctcagccagctttatgtctcgctgggcgatcccatggccgatggcggcatggtcgtgcgcatctggtggaaacccttcatcctctgcatctggggcggcacgctgttcatgatggcgggcggtttcatctcgctttccgacaggcggttgcgggtgggtgcgccgacccgcaaggcgaagcctgtacgggctgcaatgccggaggcggcggaatga

SEQ ID NO: 67967 - protein, 663 aa, Agrobacterium tumefaciens str. C58
MINEIGHYVLVLALGVGLIVSTLPVIGARRNDRALMDVASLGSVLMFLLVGFSFAALTHAYAVSDFSVRNVWENSHSLMPMLYKLTGVWGNHEGSMLLWLLILVFFSALVAAFGGNLPETLKANVLAVQAWISVAFLLFILLTSNPFLRLERVPAEGQDLNPILQDFGLAIHPPLLYLGYVGFSVCFSFAVAALLEGRIDAAWARWVRPWTLAAWTFLTAGISMGSYWAYYELGWGGWWFWDPVENASFMPWLAGTALLHSALVMEKREALKIWTVLLAIMTFSLSLLGTFLVRSGVLTSVHAFATDPSRGIFILGILTIFIGGAFALFAWRAPSLKAGGLFAPISREGALVLNNLILTVSTATVLIGTLYPLILETLTGEKISVGAPFFNLTFGLLMIPVLIVTPFGPMLAWKRGDLLGAFQRLYVAAAIAALAGLTLWYIENGGPVLAALGIAAGFWLIFGALTDLWYRANFGKLAFGIAFRRLKGLPRSAFGTALAHMGLGITVLGIVIVTTYETETVLEMKQGTVAEAGGYSLTFDGIRHAVGPNFTEDRGHFTVRKAGVEVADVWSSKRLYTARRMPTTEAGILTFGLSQLYVSLGDPMADGGMVVRIWWKPFILCIWGGTLFMMAGGFISLSDRRLRVGAPTRKAKPVRAAMPEAAE

SEQ ID NO: 67968 - DNA, 1992 bp, Brucella melitensis 16M
  CDS (1)..(1992)
atgagtgtcgagatcggccattttgctctggtgctggcgcttgcgctgtcgattgttcaatccatcgtgccggtggtcggcgcgcatcgccgtgatgcgcaactgatggcagtggccgtgccaacggcgcttgcagtcttcgctctgatcgttctggcatccgccgctctgatccacgcctatgtcgtttccgatttctcggtccttaacgtggtcgagaactcccattcgcaaaagccgcttctctacaagatcaccggtgtctggggcaatcatgaaggctccatgctgctctgggtgttcatcctcacccttttcagcgcgctggttgcagccttttccggcaatctgcctgaaacgctgcgtgccaatgttctggccgtgcagggctggattggcaccgcctttctcgcattcatcattttcacgtccaatcccttcacccgcattttcccggctcccatggaaggcggcgatctcaacccggtccttcaggatatcggcctcgccatccatccgccgcttctttatctgggctatgtcggcttttcggtctgtttctcctttgctgttgcggcgcttctcgaaggccgtctcgacgcggcatgggcgcgctgggtgcgcccatgggcgctcatggcgtggatgttcctcaccggcggtatcgcaatgggttcttactgggcctattatgaactgggttggggtggctggtggttctgggatccggttgaaaatgcatcgctcatgccatggctggtcgggacggcgctgcttcattccgccatcgtcatggagaagcgctcggcgctcaagatctggacggtgcttctcgccattctcaccttctcgctgtcattgctcggcactttccttgtgcgctccggcgtgctgacctccgtgcacagtttcgcgaccgatccggggcgcggcctgttcattctgggcattctcgcgctcttcattggcggctcgctgtcgctcttcgcgctgcgcgtccaaagcctgagcgcaggcggcattttccatccgatttcccgcgaaggcgcgctggtcttcaacaatctctttctgacgactgccgccgcaaccgttctcatcggaacactctatccgttgcttcttgaagttacgaccggcgaaaagatttccgttggcgcacccttcttcaacatgaccttcggcccgctgatggtgccgctcctgtttgccgtgcctttcggcccgctgctcgcatggaaacgcggtgatctttatggcgtcgggcagcgcctgatgacggctttcgcattgtcgctggccgttgtcggcatcatgctctggcgaacctccgcgcattcggtcctagctgctctcggcatcggtcttgcggcatggctcatcttcggcagcctgaccgatcttgttctcaaggctggtattggcaaggtgtcggccagcaaggcgtttgcgcgcttcaagggcctgccgcgctccgtcttcggaacgtcgcttgcgcatatcggacttggtctcacgcttctcggtattgtcagcgtcacgacattcggtaccgaaaacgtgctcgtcatgcagcccggcgggaccgccaaagtccagaattacacgctgcgttttgaaggactgcgccccatcacgggttccaacttcaccgagaacaggggcgccttcacgctgcttgattccagtggccgcgatctggccgtgatcgaaccgtccaagcggttcttccctgcgcgccagatgcccacgactgaatccggtatcaagacgctctggttcagccaggtctatgtcgcccttggtgacgagccgggcaatggcgcggtggtcgtgcgcatctggtggaagccgctggtcacgctcatctggtacggtgcgcttgtcatgatgctgggtggcttgttctcgctggccgaccgccgcctcagggttggtgcgccttccaaggtgcgcaggtccgcctcgaaggaagcggaagccgtcgcatga

SEQ ID NO: 67969 - protein, 663 aa, Brucella melitensis 16M
MSVEIGHFALVLALALSIVQSIVPVVGAHRRDAQLMAVAVPTALAVFALIVLASAALIHAYVVSDFSVLNVVENSHSQKPLLYKITGVWGNHEGSMLLWVFILTLFSALVAAFSGNLPETLRANVLAVQGWIGTAFLAFIIFTSNPFTRIFPAPMEGGDLNPVLQDIGLAIHPPLLYLGYVGFSVCFSFAVAALLEGRLDAAWARWVRPWALMAWMFLTGGIAMGSYWAYYELGWGGWWFWDPVENASLMPWLVGTALLHSAIVMEKRSALKIWTVLLAILTFSLSLLGTFLVRSGVLTSVHSFATDPGRGLFILGILALFIGGSLSLFALRVQSLSAGGIFHPISREGALVFNNLFLTTAAATVLIGTLYPLLLEVTTGEKISVGAPFFNMTFGPLMVPLLFAVPFGPLLAWKRGDLYGVGQRLMTAFALSLAVVGIMLWRTSAHSVLAALGIGLAAWLIFGSLTDLVLKAGIGKVSASKAFARFKGLPRSVFGTSLAHIGLGLTLLGIVSVTTFGTENVLVMQPGGTAKVQNYTLRFEGLRPITGSNFTENRGAFTLLDSSGRDLAVIEPSKRFFPARQMPTTESGIKTLWFSQVYVALGDEPGNGAVVVRIWWKPLVTLIWYGALVMMLGGLFSLADRRLRVGAPSKVRRSASKEAEAVA

SEQ ID NO: 67970 - DNA, 2109 bp, Pyrobaculum aerophilum str. IM2
  CDS (1)..(2109): transl_table=11
atggccagcctgcggcgaatactcgctaattatttccacctatccccggccgtttctctcgcccttttatttttttacatctctaggtttataacgctagacacctcctatttagacgtctacgccaacacctcatggggaatgccgctgtactaccggctggccgcctcgcttgtaaacgtgggggggattatgttgtacatcgccgcgattttaggcctaatggccgttgtggcaaaaagctggaggctcgccgcggcttcgcacgtatttctactcgccgcattttactggggggcttttgtcaaatggggaggcggggggccgggcattggcctaaaccccttgttgagaaacccctgggccctcccccacccgctaatggttattgcctcttacgccatggttttagccgcagtggcggagcccagagtcagggagagagcgggcgttttggcctgggttttctccacggccgggctggccgcgggcgggtattggtcttataccaccttcggctgggggggctactgggcgtgggaccccgtcgagacctctgtgtttattatgtggcttttcctaaccgcttggatacacggcagaggctccggggctttgtacgcggcgcttggggccgtcttcctcaccatggccgtcacgtacagcggggtgtcgccgttgcactccttcgcgggagtggcggccgcggggaagtggctcctcataacctctgtaattgccttaatctacggcctcataaaggcgagctgggagaggggatctgcgttctcctacctcccgcctctcgtcgccggggcgtatatctattggataatcgccggccccatggcggcgcagtcattaggcctccccgtggctattccctcaggggatagcgccgtggcgcttatccacccgctcttaatacccgcagtcttggcggcgttttttggaatggcgaaaagggcctttcccccgagggcagtggccctttacatgggggcgtcggcagttgcctcgctcgccctagtctctatgggcattctctggtcccccctgagcagcctctggacaaacgtggctatttacctcatagtcctaaccgctccgctgccaattgccgcgtcgcttttaaaaatacgtaaagacttggcagagctttcccacataggctttgccgttttagcagtgggggccgcgctgagcggcccgtatgcctatcacatgcagtacggcgtcgtggtgcccctcggcgtgggacagccggcgcttgtgcccctgcccagcccttacgggccggaggcggttagcattaaagttgtggagtggcgggcggcggggccgtgggagttagtgtcaatcccgccgtatctctcaaggctcgtctcgcccgatttggccggcttaatgggcgtgtggggcttggatttgaggtttgacagcgtcgtcctcaacggcactaaatacgtagtggcctttggcaattacacgcctggttttcacaggctgggtagctactggctatacgttaactccacagtagacaccccgaggggcaagcttttagtagccgccctgggcatcggggacagggcccttgtcttcagccctcagaaattcgacgtaatttcagcagtcgtcgcgtgtaagcccaacgccacttcattgaatttaatagaggagagagtcatcctggggatagacggcgcggctgttgaggctacaattagatacgaggcctcgggggagttcaaactcattaggggcttaatacacggaatagccacagtgcccagagggctagacgacgtttatatcgccgtgacccccgaggtggccgtggtgggcaacgtgagctatacccgcatcgccttagagctggcgaggcggaatttaaatgcgtgtctcccccttggcgcgtggatgttgctgtcggcatatagcggtaggccgctcagcggcggggaggtaaacgccttgttgaaaaacagcccccagggctacgtggcgtatgtaaagataatccccatggttcaattagtgtggataggggcggcgcttttagtagcaggaggccttgtaaaggctgttaggagacatgtggcttag

SEQ ID NO: 67971 - protein, 702 aa, Pyrobaculum aerophilum str. IM2
MASLRRILANYFHLSPAVSLALLFFYISRFITLDTSYLDVYANTSWGMPLYYRLAASLVNVGGIMLYIAAILGLMAVVAKSWRLAAASHVFLLAAFYWGAFVKWGGGGPGIGLNPLLRNPWALPHPLMVIASYAMVLAAVAEPRVRERAGVLAWVFSTAGLAAGGYWSYTTFGWGGYWAWDPVETSVFIMWLFLTAWIHGRGSGALYAALGAVFLTMAVTYSGVSPLHSFAGVAAAGKWLLITSVIALIYGLIKASWERGSAFSYLPPLVAGAYIYWIIAGPMAAQSLGLPVAIPSGDSAVALIHPLLIPAVLAAFFGMAKRAFPPRAVALYMGASAVASLALVSMGILWSPLSSLWTNVAIYLIVLTAPLPIAASLLKIRKDLAELSHIGFAVLAVGAALSGPYAYHMQYGVVVPLGVGQPALVPLPSPYGPEAVSIKVVEWRAAGPWELVSIPPYLSRLVSPDLAGLMGVWGLDLRFDSVVLNGTKYVVAFGNYTPGFHRLGSYWLYVNSTVDTPRGKLLVAALGIGDRALVFSPQKFDVISAVVACKPNATSLNLIEERVILGIDGAAVEATIRYEASGEFKLIRGLIHGIATVPRGLDDVYIAVTPEVAVVGNVSYTRIALELARRNLNACLPLGAWMLLSAYSGRPLSGGEVNALLKNSPQGYVAYVKIIPMVQLVWIGAALLVAGGLVKAVRRHVA

SEQ ID NO: 67972 - DNA, 1998 bp, Xanthomonas campestris pv. campestris str. ATCC 33913
  CDS (1)..(1998): transl_table=11
atgacgcctgaacttggccagatcgcgctgattttggcgttgctgttgtcgctgacgcagggcgtgttgccgctgatcggtgcctggcgcggcaacaccgcgctgatggcggttgcgcggcctgccgccgccggccaggcggtgttcgtgtggctggccttcggcctgttggcctggtcgctgctgtcgctggatttttcggtgcgctatgtcgccgacaacgccaacatcgccctgccctggtattaccgcatcgccgcggtgtggggcgcgcacgaaggttcgctgctgctgtggatcgcgatcctgtccacctggacggtgctgctggccgcctgcagccggcacttgccgcagcacttcgccgcacgcgtgctggcggtgctggggctggtatcggtgggctttctggccttcatcctgctgacctccaatccgtttgggcggctgtcgccgattccgctcgacggcagggaactcaatccggtgctgcaggacccgggcatgaccttccacccaccggtgctctacaccggttatgtcggcttctcggtggcattcgcgttcgcggtagccgccctgctgggcggcgaactcgaacaggcctgggtgcgctgggcgcggccatggaccaacgtcgcctgggcctgcctcaccgccggcatcgtggccggcagctggtgggcgtatgcggaactgggctggggcggctggtggttctgggacccggtggaaaacgccagtttcatgccgtggctggtgggcaccgcgctgattcatacccaggcagtgaccgaaaaacgcggcagcctgcgtgcctggaccatcctgctgtcgatcctggcattttcgttgtcgttgctgggtaccttcctggtgcgctcgggcgtgctcacctcggtgcatgcgtttgccgccgacccacggcgcggcctgtacatcctgattttcctggtggcggtggtgggcggctcgctgctgctgtatgcgctgcgcgcgcccaagatcgccaccggcaaaccgttcgcagcggcctcgcgcgagaccgcgatcctggtcggcaacctgctgctcaccgtggccgcggcgatggtgttgctgggcaccttgttcccgctggtggccgatgcgttcgggctgggcaaggtgtctgtgggcccgccctacttcggcctgctgtttccgttgctgatggcgccggtggtgctgttaatgccattcggcccgtacttgcgctggggcaaggccgagatggcaccgctgctgtcgctgggcgcgcgtgcgggcattgccgccatcgcctgcgcgctggtcgccagcgtgtttgccgagggccaggccaaggccattgccggcatcggtgcggccgcctgggtggctgccggcaccgcgttgtacatgcacaagcgctggcgcgagatgccgcgcggccggcgctttcctgccgagatggccggcatgttgttggcgcacgccggtgtggcggtgttcgtggccggcgtgctggtgtcggacagcctgtcggtggaacgcgacgtgcggctggcgcccggccagagcgcggagatcgccggctacagcttccgcttcgatggcgtgcagctggtggatgggcccaactggaaagccgaacaaggcagcgtgcaggtcagccgtgatggtgcgccggtggctaccttgcatccgcaaaaacgcctgtacagcagtgagcgcatccagaccgaatcggcgatcgacgccggcgccacccgcgacctctacgtggcgctgggcgagccgctggacgaccagcacatcgaaaacgactggacgctgcggctgtactacaaaccgttgatccgctggatctgggccggcgggctgttgatgatgctgggcgggttcgtcagcgcctgcgcgcggcgcttccgcgcaccggtacctgcggttgccgcggtgtcgtcgcctgctcccatcgcccccactcccctcgccgttgccggagagttgcacctgtga

SEQ ID NO: 67973 - protein, 665 aa, Xanthomonas campestris pv. campestris str. ATCC 33913
MTPELGQIALILALLLSLTQGVLPLIGAWRGNTALMAVARPAAAGQAVFVWLAFGLLAWSLLSLDFSVRYVADNANIALPWYYRIAAVWGAHEGSLLLWIAILSTWTVLLAACSRHLPQHFAARVLAVLGLVSVGFLAFILLTSNPFGRLSPIPLDGRELNPVLQDPGMTFHPPVLYTGYVGFSVAFAFAVAALLGGELEQAWVRWARPWTNVAWACLTAGIVAGSWWAYAELGWGGWWFWDPVENASFMPWLVGTALIHTQAVTEKRGSLRAWTILLSILAFSLSLLGTFLVRSGVLTSVHAFAADPRRGLYILIFLVAVVGGSLLLYALRAPKIATGKPFAAASRETAILVGNLLLTVAAAMVLLGTLFPLVADAFGLGKVSVGPPYFGLLFPLLMAPVVLLMPFGPYLRWGKAEMAPLLSLGARAGIAAIACALVASVFAEGQAKAIAGIGAAAWVAAGTALYMHKRWREMPRGRRFPAEMAGMLLAHAGVAVFVAGVLVSDSLSVERDVRLAPGQSAEIAGYSFRFDGVQLVDGPNWKAEQGSVQVSRDGAPVATLHPQKRLYSSERIQTESAIDAGATRDLYVALGEPLDDQHIENDWTLRLYYKPLIRWIWAGGLLMMLGGFVSACARRFRAPVPAVAAVSSPAPIAPTPLAVAGELHL

SEQ ID NO: 67974 - DNA, 1938 bp, Xanthomonas campestris pv. campestris str. ATCC 33913
  CDS (1)..(1938): transl_table=11
atgctgcctgaactcggtaccttcctgctggtgctggcgctgctggtggcgctggtgcaggccgtcgtgccgctggccggtgcgcagcgcgggcgcagtgcctggatggcggttgcccgccccgccgcattggtgcaactggcactgatcgctgcggcattcgcggtgttgacgcacgctttcctggtgcaggatttttcggtgcgatacgtggccgagaactccaactcgctgctgccgttgatctatcgctattcggcggtctggggcgcacacgaaggctcgttgctgctatggacgctggtgctggcgctatggacgggcgcggtggcgatctggtcgcggcagttgcccgcccaggtgatcgcacgcgtgctgggcgtgatggcgctggtgagcatcggcttcctggcgttcctgttgttcacctccaatccgttcgcgcggttgatgccggtgccgctggaaggcgccgacctcaatccgctgctgcaggacccgggcctgatcatccatccgccgatgctttattgcgggtatgtgggctttgcggtgccgttcgcgttcgccattgccgcgctgctggaaggccgcatggacgcacgctggctgcgctggacgcggccatggaccaacattgcctggtcgatgcttaccgtaggcatcgcgctgggcagctggtgggcgtattacgaactgggctggggtggctggtggttctgggacccggtggaaaatgccagcttcatgccctggctggtcggaactgcgctgctgcactcgcaggcggtcaccggaaaacgcggcagcttcgccagctggacgctgctgctggcaatcgccgccttcgcgctgtcgctgctggggaccttcctggtgcgttcgggtgtgctgaccagcgtgcattcgtttgcggccgatccctcgcgcggcgtgttcatcctggtgttcctgctgagcgtggtcggcggctcgttgctgctgtatgtgctgcgcgcgccgcggttgtcgcagggcgatgacccgcgccgggcctttgccggcagctcgcgcgaaacgctgttgctgttgaacaacctgctgctggcctgcgcctgcgcgatggtgctgctgggcacgctgtacccgctgctggccgatgcgctgggcctgggcaaactgtcggttggcccgccctacttcggcacgctgttcctggtgctgatggcgccgctggtggcgctgctgccgttcgggccgctgacccgctggcagcgcgaccaaccctcgcgtccgctggcgatgctcgcgccctgggccgcgctggccgtcgtgctcggggtgctggcctggttcgccgcaccgcagggccagctgaaaacggcactcggcgtggcgggagcggcctgggtggtgctgggcacgctgcgttttttgtggacgcgccgcgctgccaaggggcgcaagttcaccgccgagatgctcggcatggcgctggcgcatacgggcgttgctgtgttcctggccggtgccttgctggtggaatcgctcagcctgcagcgcgaagtcgcgctggcacccggccagcagatggagatcggcagctacgcactgcatttcgacgggctgaaagaagtgcgcgggccgaactacgtctccgaccgcgccaccttgcaggtgttcaaggacgacgcggcagtgggcacgctgcatgccgaaaaacgccgttacgccagtggcggccaaaccctgaccgaggcggcgatccgcccgggtccgtttggcgatctttacgtcgccctgggcgaaccgctgggcaatcaggcctgggcggtgcgtgtgcatctcaaaccgtttgtccgctggatctggctgggagcgctgctgatggcgctcggcggcctggtcaccgcggccgaccggcgtttccgtcgttctccggagtccctaaatgtctga

SEQ ID NO: 67975 - protein, 645 aa, Xanthomonas campestris pv. campestris str. ATCC 33913
MLPELGTFLLVLALLVALVQAVVPLAGAQRGRSAWMAVARPAALVQLALIAAAFAVLTHAFLVQDFSVRYVAENSNSLLPLIYRYSAVWGAHEGSLLLWTLVLALWTGAVAIWSRQLPAQVIARVLGVMALVSIGFLAFLLFTSNPFARLMPVPLEGADLNPLLQDPGLIIHPPMLYCGYVGFAVPFAFAIAALLEGRMDARWLRWTRPWTNIAWSMLTVGIALGSWWAYYELGWGGWWFWDPVENASFMPWLVGTALLHSQAVTGKRGSFASWTLLLAIAAFALSLLGTFLVRSGVLTSVHSFAADPSRGVFILVFLLSVVGGSLLLYVLRAPRLSQGDDPRRAFAGSSRETLLLLNNLLLACACAMVLLGTLYPLLADALGLGKLSVGPPYFGTLFLVLMAPLVALLPFGPLTRWQRDQPSRPLAMLAPWAALAVVLGVLAWFAAPQGQLKTALGVAGAAWVVLGTLRFLWTRRAAKGRKFTAEMLGMALAHTGVAVFLAGALLVESLSLQREVALAPGQQMEIGSYALHFDGLKEVRGPNYVSDRATLQVFKDDAAVGTLHAEKRRYASGGQTLTEAAIRPGPFGDLYVALGEPLGNQAWAVRVHLKPFVRWIWLGALLMALGGLVTAADRRFRRSPESLNV

SEQ ID NO: 67976 - DNA, 1938 bp, Xanthomonas axonopodis pv. citri str. 306
  CDS (1)..(1938): transl_table=11
atgcttcctgaactcgggacgttgctgctggtgctggccctgctggtggcgctggtgcaggccgtggtgccgctggccggcgcacagcgcggacgcagcagctggatggccgtggcgcgaccggcggcgctggtgcagctggcactgatcgcatcggccttcgccgtgttgacgcacgccttcttggtgcaggatttttcggtgcgctacgtcgccgagaattccaacagcctgctgccggtgatgtaccgctattcggcagtgtggggtgcgcacgaaggctcgctgctgctgtggacgctggtgctggggttgtggaccggcgcggtggcgatctggtcgcggcagctgccggcgcatgtgatcgcgcgcgtgctcggcgtcatggcgctggtcagcatcgggtttctggcgttcttgctgttcacctccaacccgtttgcgcggttgtttccggtgccgctggagggtggcgacctcaatccgctgctgcaggatccggggctgatcgtccatccgccgatgctgtattgcggctacgtcggctttgcggtgccgttcgcattcgccatcgccgcactgctggaaggccgcatggacgcgtgctggctgcgctggacgcggccgtggaccaatgtcgcctggtcgatgctcaccgtcggcatcgcgctcggtagctggtgggcgtattacgagctgggctggggtggctggtggttctgggacccggtggagaacgccagtttcatgccgtggctggtgggcaccgcactgttgcattcgcaggcggtgaccgaaaagcgcggcagcttcgccagctggaccttgttgctggcgatcgccgcctttgcgctgtcgctgctgggcacgtttctggtgcgctcgggcgtgctgaccagcgtgcattcgttcgccgccgacccgtcgcgcggactgttcattctggtattcctgctggccgtggtcggtggttcgttgctgctgtatgcgctgcgcgcgccgcttctgtcggtggcggacgatccgcgtcgcgcattcgccggcagttcgcgcgaaaccttgttgctgttgaacaacctgctgctcacctgcgcctgcgcaatggtgttgctgggcaccttgtatccgctgctcgccgatgccttggggctgggcaagctgtcggttggcccgccctacttcggcaccttgttcgtggtgttgatggcgccgctggtggcactgctgcccttcggcccgctcacccgctggcagcgcgaacaggcctcgcggccggtggcgctgctggcgccgtgggcagccctggcgttggctgccggcgtgctggcctggttcgccgcgccgcaggggcagttgaaagccgccttcggtgtcgccggtgcagcctgggtgttgctgggcaccgcgcggttcctgtggacgcggcgggcggccaaggggcgcaaattcaccgccgagatgctgggcatggtgctggcgcacctgggcgttgcggtgttcctgtccggtgccatgctggtggagggattgagcctgcagcgcgaagtggcgctggcgcccgggcaacaggtgcagatcggccgctatgcactgcatttcgacgggctggaagagctgcgcgggcccaattacgtgtccgaccgtgccaacctgcaggtgttcaaggacgatgcgccggcgggcatgctgcatgcggaaaagcgccgctacgccagtggcggccagacgttgaccgaggcggcgatccgccctggcccgtttggcgacctgtatgtcgcccttggcgaaccgctgggcaaccaggcctgggcggtacgtgtccacctcaaaccgttcgtccgctggatctggctgggagcgctgctgatggcgctcggcggcctggtgaccgcggccgaccggcgttttcgtcgttctccggagatccaagatggttga

SEQ ID NO: 67977 - protein, 645 aa, Xanthomonas axonopodis pv. citri str. 306
MLPELGTLLLVLALLVALVQAVVPLAGAQRGRSSWMAVARPAALVQLALIASAFAVLTHAFLVQDFSVRYVAENSNSLLPVMYRYSAVWGAHEGSLLLWTLVLGLWTGAVAIWSRQLPAHVIARVLGVMALVSIGFLAFLLFTSNPFARLFPVPLEGGDLNPLLQDPGLIVHPPMLYCGYVGFAVPFAFAIAALLEGRMDACWLRWTRPWTNVAWSMLTVGIALGSWWAYYELGWGGWWFWDPVENASFMPWLVGTALLHSQAVTEKRGSFASWTLLLAIAAFALSLLGTFLVRSGVLTSVHSFAADPSRGLFILVFLLAVVGGSLLLYALRAPLLSVADDPRRAFAGSSRETLLLLNNLLLTCACAMVLLGTLYPLLADALGLGKLSVGPPYFGTLFVVLMAPLVALLPFGPLTRWQREQASRPVALLAPWAALALAAGVLAWFAAPQGQLKAAFGVAGAAWVLLGTARFLWTRRAAKGRKFTAEMLGMVLAHLGVAVFLSGAMLVEGLSLQREVALAPGQQVQIGRYALHFDGLEELRGPNYVSDRANLQVFKDDAPAGMLHAEKRRYASGGQTLTEAAIRPGPFGDLYVALGEPLGNQAWAVRVHLKPFVRWIWLGALLMALGGLVTAADRRFRRSPEIQDG

SEQ ID NO: 67978 - DNA, 1971 bp, Yersinia pestis KIM
  CDS (1)..(1971): transl_table=11
atgatccctgaaattggcagttttttattatgtttggcgttggcgatttcactgctgctgagtctgtatccacaatggggagccgcgcgtcaggatgcccgtatgatggcggttggcaggccactgacttatggcatgtttgccgcgatcacgttgtcatttatctgtctgatatatgcatttgtggtaaatgattttaccgtctcctatgtcgcggcgaattccaactcatatttgccgatttattaccgtattgccgcgagttggggagcgcacgaaggctccttattattatgggtattgctgctcagttgttggtcattggcggtagcgctgtttagccgttcgatgccagaggatgcggtggcgcgggtgttatccgtgctgggaatgattaccggcggttttctgctatttattattctgacgtctaacccgttctctcgcacattacctgattttcctattgatggccgcgatctgaacccgctactacaagatgttgggttgattttccatcccccgctgctctacatggggtatgtcggtttctccgtcgcgtttgcttttgcaattgcatcattaatggccggtaggctcgacagtgcctgggcgcgttggtcacgtccatggactcaggccgcatggattttcctaacgcttggcatcgtacttggctcagcgtgggcttattatgaattggggtggggcggctggtggttctgggacccggtcgaaaatgcctcctttatgccgtggctggcaggtaccgcactgattcactcactggctgtcacggagaagcgcggtactttcaaagcgtggacggtattgttggcgatcaccgcgttctccttgtgtttgatggggacattcttagtccgctcaggcgtgctggtttcggtgcactcctttgcctctgatccggcccgtggcatgtttattctggcctatctggtgattgtgattggcggttccctgctgctgtatgcggtaaaaggcgcgcaggtgcgcagccggactcagcatgaagtcttttcccgcgagactttcctgctcggcaacaatgtgttgcttattgccgcaatgctcgtggtgttgctgggaacattactgccactggttcacaaacagttgggattgggcagtatctccattggtgaaccgttctttaatacgatgttcacttggttaatggctccgatggcattgctcatggggatagggccgctcgtgcgttggcgtcgtgatgaaccgagcaaactgtggaagcggttgagtgtggctctggtggtcactctgctgttatcgatatccgtaccgtggctgctgcaagatagtgtcgccggtatgacggtcgtcgggttgatgatggccatttgggtgatcatcctgacattaatggaattgcacgaacgggccacccatcgttatggcttctggcgtgggttgactcacctttcccgtagccactggggcatggtgttggggcatctcggggtggcggttacggtaattgggattgcgtttagccagaattacagtgtcgaacgcgatgtgcgcatgaaggccggtgatagtatcgatatccatgattatcacttcacttttcgcgatgtccacgatatcaaagggcctaactataccggcggcgttggcattattgatgtcacccgtaatggtaaattggaggccacattacatgcagaaaaacgctattacagtgtcgcccgctcaatgatgactgaagcagccattgatggggggctgacccgcgatctttatgccgccttgggtgaagagctgggcgatggctcatgggcggtccgcttgtattacaaaccttttgtgcgttggatatggtttggcgggatctttatggccgtcggcggcatcttctgtatgctcgatccgcgctatcggatgagtaaaaagctaaaacgcggtgcgataccggaggcagagtcatga

SEQ ID NO: 67979 - protein, 656 aa, Yersinia pestis KIM
MIPEIGSFLLCLALAISLLLSLYPQWGAARQDARMMAVGRPLTYGMFAAITLSFICLIYAFVVNDFTVSYVAANSNSYLPIYYRIAASWGAHEGSLLLWVLLLSCWSLAVALFSRSMPEDAVARVLSVLGMITGGFLLFIILTSNPFSRTLPDFPIDGRDLNPLLQDVGLIFHPPLLYMGYVGFSVAFAFAIASLMAGRLDSAWARWSRPWTQAAWIFLTLGIVLGSAWAYYELGWGGWWFWDPVENASFMPWLAGTALIHSLAVTEKRGTFKAWTVLLAITAFSLCLMGTFLVRSGVLVSVHSFASDPARGMFILAYLVIVIGGSLLLYAVKGAQVRSRTQHEVFSRETFLLGNNVLLIAAMLVVLLGTLLPLVHKQLGLGSISIGEPFFNTMFTWLMAPMALLMGIGPLVRWRRDEPSKLWKRLSVALVVTLLLSISVPWLLQDSVAGMTVVGLMMAIWVIILTLMELHERATHRYGFWRGLTHLSRSHWGMVLGHLGVAVTVIGIAFSQNYSVERDVRMKAGDSIDIHDYHFTFRDVHDIKGPNYTGGVGIIDVTRNGKLEATLHAEKRYYSVARSMMTEAAIDGGLTRDLYAALGEELGDGSWAVRLYYKPFVRWIWFGGIFMAVGGIFCMLDPRYRMSKKLKRGAIPEAES

SEQ ID NO: 67980 - DNA, 1980 bp, Shewanella oneidensis MR-1
  CDS (1)..(1980): transl_table=11
atgatcccagaacttggacacttttcgctgataataggagtggcttttgccttcttattaaccagcgttccccttataggtgttgcccgtaaagaccaatatctagtgaggtatgcttggccgttagcctacggaatgttcttttttatcgctttatccgtagtatcacttggttacagcttcgccgttgatgatttctccgtggcctatgtggcacatcactctaattctcagttacctatcttctttaagattgcggccgtatggggcggtcatgaagggtcgctgctattctgggtgttcgcgctatccacttgggctgcctctgttgctttattcagtaaaggcttagaagaagtcttcaccgctcgcgtgttagcggtattggcattgattgtgattggcttcagcttgtttatgttactcacttctagcccatttgaacgtatattcccaatgcctgctgaaggccgcgacttaaatccaatgctgcaggatgtgggcttaatcttccaccctccgatgttatatttgggttatgtgggtttctcagtcagttttgcatttgcgattgcagctttgatgagtggtcaccttgattctgcttgggctcgttggtcgcgtccttggaccttagccgcttgggttttcctcactggtggtattgcattaggttcttggtgggcgtattacgaattaggctggggtggatggtggttctgggatccagtagaaaacgcttcatttatgccttggctagtgggtacggctttagtgcattcactgatcgtgacggaaaagcgcggtgcattccgtaactggacggtattgctgtctatcttcgcattctcgctaagtttactcggtacctttatcgtacgctctggtgtgttgacttcagtgcattcatttgcagccgatccaagccgcggtatgtttattctattattgcttggtctcgctatcggtggttcgctcactttgtttgccttccgtgcaagtgaaatgagcagccctgcacgcttcgagctgaaatcaaaagaaaccatgctgttagtttgtaacgtgttactgacggttgcagcgggtactgttctgttaggcactttatacccactgctgatcgatgcgttaggcatgggtaagatttctgttggacctccatactttaacgctgtgtttgtacccatagtacttgtactgtttgcctttatgggcgtcggtccaatcattcgttggaaaaaatcgaaagctggtgaattgaagcgacagttactcgtacctgcattagtatctctggtgattggtattgtcacgccgtttatcgtcgatggggcctttaacgcttgggttgcttgcggtatcgccgctgcagcttggattattttggcaaccgcaaaagcagcttacagcatcgttaagcctaaagatggtgaagtaagcatcgcacgtatgggccgtagccaactcggtatgatcatcgcgcacttaggtattgctgtgtctgttattggtgccactatggtgtctaactactcagtggagaaaagtgtgcgtatggggcctggcgtaagccaagagctagcgggttacacctttaaatatctcgaaactaaaaacgttgttggtcctaattacactgcgcagcaaggtcaaattgagatttacaaaggcgataagttactgacactgctcaaacccgatcgtcgccaatacaatgtgcgtactatggatatgaccgaagccggtatcgattggggtctgttccgcgatctgtatgtgacgatgggcgatccgattagtagtactgaatttgctgtgcgtttgaactacaagccgtttgtgcgttggttatggttcggagcaatattcatgatggtcggcggtttctttgccgcatcggataaacgctatcgctcaaaagtcgcggctaccgttaaaccgcaagctgaaaaagcgaaattagctaccgctcaataa

SEQ ID NO: 67981 - protein, 659 aa, Shewanella oneidensis MR-1
MIPELGHFSLIIGVAFAFLLTSVPLIGVARKDQYLVRYAWPLAYGMFFFIALSVVSLGYSFAVDDFSVAYVAHHSNSQLPIFFKIAAVWGGHEGSLLFWVFALSTWAASVALFSKGLEEVFTARVLAVLALIVIGFSLFMLLTSSPFERIFPMPAEGRDLNPMLQDVGLIFHPPMLYLGYVGFSVSFAFAIAALMSGHLDSAWARWSRPWTLAAWVFLTGGIALGSWWAYYELGWGGWWFWDPVENASFMPWLVGTALVHSLIVTEKRGAFRNWTVLLSIFAFSLSLLGTFIVRSGVLTSVHSFAADPSRGMFILLLLGLAIGGSLTLFAFRASEMSSPARFELKSKETMLLVCNVLLTVAAGTVLLGTLYPLLIDALGMGKISVGPPYFNAVFVPIVLVLFAFMGVGPIIRWKKSKAGELKRQLLVPALVSLVIGIVTPFIVDGAFNAWVACGIAAAAWIILATAKAAYSIVKPKDGEVSIARMGRSQLGMIIAHLGIAVSVIGATMVSNYSVEKSVRMGPGVSQELAGYTFKYLETKNVVGPNYTAQQGQIEIYKGDKLLTLLKPDRRQYNVRTMDMTEAGIDWGLFRDLYVTMGDPISSTEFAVRLNYKPFVRWLWFGAIFMMVGGFFAASDKRYRSKVAATVKPQAEKAKLATAQ

SEQ ID NO: 67982 - DNA, 2058 bp, Shewanella oneidensis MR-1
  CDS (1)..(2058): transl_table=11
atgattccagaaatcgggcacatattgctgatcatgagtactgtgtttgcattattgtcggcggccagtcatttaatcggtagttaccagcgcaacctttatttaattgcatttggcaatagattattttacgcgttatttttcaccttattaaccgcgttatgtagcttagtttttagctttattgccgatgacttttcagtcgcctatgttgccaatcattccaacagccaactcgccctcggttataaagtcgctgcggtgtggggcagccatgaaggctcaatgctgttttgggtatttgccattgccctatggggtgcagtgatcaattggcgccaagcaacccatagcgccaaactcgatctggaaaacttacaagcagataaggcttactttggtcgggtactcgctattttggccttagtgatcctcggttttaatttgtttttactctttacttccaatccctttgctcgcttgctaccgaacattccagtcgaagggcgcgaccttaaccccatattgcaggacattggcttaatactgcatccacctatgctgtttttgggttatgtcgggctaacggtttgctttgccgcagcgctggcatcactgattgggggcaagttacctgctcgccacctcgattatttacgtccttgggtgctactggcgtggattttcctcacaggtggtaatgcctttggctcttggtgggcctacaacgaactgggttggggtggttggtggttttgggaccccgttgaaaacgcctcttttattccttggttggttgcaacagcgctggtgcattccttagtactcacccgaaaaacccagggatttaccctcaccaccctgtttttatgtttattggccttctccctcagtctgttaggcagctttttagtgcgttcaggcatagtgcaatcggtgcatgcctttgccgcagatccaacccgcggtatgtctattctcagtttgctggtgatttttgttggcgctgcattattaatttttgcgctcaaggccaatctattaaggcgtgaaatcgactttggtctgtacagtaaggaaacgctattactgctcgggatagtgattttagtggttgccgccttttcagtgttgcttggcactttttacccgctgatttatgaactcctcaacctaggtacactttcagtcggggcgccgtacttcaacgccatatttgtaccattgacctttttagtcgtactactgatggggattgcccccctcgtcgaatggcaaaatacctctaaggctcaagctatgccgatattgctgttcggctttggggtattggctatcgccttttgggtaagtctacaggcggcgtctggcagcaacttattcttactgcttggcacggcggcagccttatggcttatcgtgtgcttattactgacgctgttagtgagtcttagtgttcgcaaacgcgccagtacaaaccaaattacagccaacgcgcccgtaaaatcccgcacctcaaaacaacgctttatcggcatgatgctcgcccacctcggggttgccatcaccattattggtgcctcagcggtatccaattttgaagaagaagcactgctcagaatgggcccaggccaaggtaagccgttagcgggttatatcttagtgtatgaaagcactgagaatgtcgaaaccaatagctttacggcaatccaagccaatatcagtatccgcgatggcgcgaatgatgaagagatcctcggttatgtaaggccgcaacgacaaacttttaaaagcaacgcgatggaaatgtcccacgcggggatcgaccacggtttttggcgggatatttatgtctcaatgggcgtgcaattaagtgacagcgaatatctgatccgtattagctataaaccactggccacttggatttggctgggggcacttttcatgatgctcggcggcgccattgccgcgtggcccgtaaggcaagctcgccgcgtcgaacaatcagaacagctcagtacaagctcatcatctgcaagggagacggtaacccaatga

SEQ ID NO: 67983 - protein, 685 aa, Shewanella oneidensis MR-1
MIPEIGHILLIMSTVFALLSAASHLIGSYQRNLYLIAFGNRLFYALFFTLLTALCSLVFSFIADDFSVAYVANHSNSQLALGYKVAAVWGSHEGSMLFWVFAIALWGAVINWRQATHSAKLDLENLQADKAYFGRVLAILALVILGFNLFLLFTSNPFARLLPNIPVEGRDLNPILQDIGLILHPPMLFLGYVGLTVCFAAALASLIGGKLPARHLDYLRPWVLLAWIFLTGGNAFGSWWAYNELGWGGWWFWDPVENASFIPWLVATALVHSLVLTRKTQGFTLTTLFLCLLAFSLSLLGSFLVRSGIVQSVHAFAADPTRGMSILSLLVIFVGAALLIFALKANLLRREIDFGLYSKETLLLLGIVILVVAAFSVLLGTFYPLIYELLNLGTLSVGAPYFNAIFVPLTFLVVLLMGIAPLVEWQNTSKAQAMPILLFGFGVLAIAFWVSLQAASGSNLFLLLGTAAALWLIVCLLLTLLVSLSVRKRASTNQITANAPVKSRTSKQRFIGMMLAHLGVAITIIGASAVSNFEEEALLRMGPGQGKPLAGYILVYESTENVETNSFTAIQANISIRDGANDEEILGYVRPQRQTFKSNAMEMSHAGIDHGFWRDIYVSMGVQLSDSEYLIRISYKPLATWIWLGALFMMLGGAIAAWPVRQARRVEQSEQLSTSSSSARETVTQ

SEQ ID NO: 67984 - DNA, 1989 bp, Pseudomonas putida KT2440
  CDS (1)..(1989): transl_table=11
atgaacgcagcactggtagtccccgaactgggccagttggcgatgattctggccatctgctttgccgtcgtacaggccagtgtgccgttgcttggcgcgtggcgtggcgacagcctgtggatgagcctggcgcggccggcagcctgggggcagttcgccttcctggcgtttgcctttgcctgcctgacccatgccttcatgacagacaatttctcggtcgcctatgtggccagcaactccaacagcgccttgccctggtactacaagttcagtgcggtgtggggcgcccatgagggttcgttgctgctttgggcgctgatccttggcggctggacctttgccgtgtcggtgttctcccggcagttgccgcaggtgatgctggcccgcgtgctggcggtaatgggcatgatcagcgtgggcttcctgagcttcctgatcattacttccaacccgttccagcgcctgctgccgcaggtgccgaccgatggccgtgacctcaacccgctgttgcaggactttggcctgatcgttcacccacccatgctctacatgggctatgtgggcttctcggtggctttcgcgttcgccattgccgccttgctcggcggccggctggacgctgcctgggcgcgctggtcgcggccgtggaccatcgtcgcctgggctttcctgggtgttggcatcaccttggggtcgtggtgggcctactacgaactgggctggggtggctggtggttctgggacccggtggaaaacgcctcgttcatgccttggctggtgggcaccgcactgatccactcgctggcggtgaccgagaaacgcggggtgttcaagagctggaccgtgctgctggcaattgccgcattctccctgagcctgctgggtaccttcctggtgcgttccggagtgctgacctcggtgcacgcgtttgccgccgacccgtcgcggggtattttcatcctgtttttcctgctgttcgtggtcggcggctcgctcaccctgttcgccctgcgcgcaccggtggtcaagagccaggtcggtttcgccctgtggtcgcgtgaaacgctgctgctggccaacaacctggtgctggtggtcgcggcttcgatgattctgctcggtaccctgtacccattggtgctcgatgccctgaccggggccaagctgtcggtcggcccgccctatttcgacgccttgttcctgccactgatggcgctgctgatggtggtgctgagcgtgggcgtggtggtgcgctggaaggacaccccgggcaaatggttggtcagcatgatgaccccggtattgatcggcagtgccatccttgcaccggttgccggctttatcgtcgacgacttcgactggccgacgctgacggccttcgccctggccgcctgggtagtgcttggcgggctgcgtgacattttcgacaagacccgccacaagggcctggtcaaaggcctgccgggcctgggccgcagctactggggcatgcaactggcgcacctgggcctggcggtgtgtgcgctgggcgtggtgctgtccagcaacaacagcgccgagcgcgacctgcgcatggcgccgggcgaaagcgtggagctgggtggctaccacttcctgttccagggcgccaagcacttcgaggggccgaacttcatctctgacaagggcaccatcgtggtcagccgcgagggccgtgaagtgaccacactgtacccagagaagcgcctgtacaccgtgcaacagtcgatgatgaccgaagcgggcatcgacgccggctttacccgcgacctgtacgtcgcgcttggcgagccactggagaatggcgcctgggctgtgcgcgtacatattaagccttacgtccgctggatctggctgggcggtctgctgaccggcctgggcgggttgctggcggccctcgaccggcgctaccgcgtcaaggtcaagacccgggtgcgtgatgtcctgggcgtgtctggagcagctgcatga

SEQ ID NO: 67985 - protein, 662 aa, Pseudomonas putida KT2440
MNAALVVPELGQLAMILAICFAVVQASVPLLGAWRGDSLWMSLARPAAWGQFAFLAFAFACLTHAFMTDNFSVAYVASNSNSALPWYYKFSAVWGAHEGSLLLWALILGGWTFAVSVFSRQLPQVMLARVLAVMGMISVGFLSFLIITSNPFQRLLPQVPTDGRDLNPLLQDFGLIVHPPMLYMGYVGFSVAFAFAIAALLGGRLDAAWARWSRPWTIVAWAFLGVGITLGSWWAYYELGWGGWWFWDPVENASFMPWLVGTALIHSLAVTEKRGVFKSWTVLLAIAAFSLSLLGTFLVRSGVLTSVHAFAADPSRGIFILFFLLFVVGGSLTLFALRAPVVKSQVGFALWSRETLLLANNLVLVVAASMILLGTLYPLVLDALTGAKLSVGPPYFDALFLPLMALLMVVLSVGVVVRWKDTPGKWLVSMMTPVLIGSAILAPVAGFIVDDFDWPTLTAFALAAWVVLGGLRDIFDKTRHKGLVKGLPGLGRSYWGMQLAHLGLAVCALGVVLSSNNSAERDLRMAPGESVELGGYHFLFQGAKHFEGPNFISDKGTIVVSREGREVTTLYPEKRLYTVQQSMMTEAGIDAGFTRDLYVALGEPLENGAWAVRVHIKPYVRWIWLGGLLTGLGGLLAALDRRYRVKVKTRVRDVLGVSGAAA

SEQ ID NO: 67986 - DNA, 1683 bp, Escherichia coli CFT073
  CDS (1)..(1683): transl_table=11
ttgttgttaagtctcggggtcaacgtgttgaccccgttgacggccttcgcgggagtgcggttgcgctggcctgccatgatgcgactcacttgcatcggcattctggcgcagttcgcgctcctgctgctcgcctttggcgtactgacgtattgttttctcatcagcgatttctcggtcatttatgtcgcccaacatagctatagcctgctgtcgtgggaactcaaactggcggcggtgtggggcggtcatgaaggttcgctgctgctttgggtgctgctgctttccgcctggagcgcgctgtttgcctggcattatcgacagcaaaccgatccgctatttccgctgacgctagccgttttatctctcatgctcgccacactgctactgtttgtggtgctgtggtccgatcccttcgtgcggatatttccaccagcaatcgaaggccgcgatctcaatccgatgctgcaacatcccggtcttatctttcatccaccgctgctttatctcggctacggcggtttgatggtggcggcgagcgtggcactggcgagtttactgcgcggcgagcttgatggtgccagcgcccgaatttgctggcgttgggcactacctggctggagcgcattaacggcggggatcatcctcggttcctggtgggcctattgcgaactgggctggggcggctggtggttctgggatccggtggaaaacgcgtcgttattaccctggctttctgccacagcgctgctgcacagtttatccctgacacgccagcgggggattttccgccactggtcgctgttgctggcgatagtaactctgatgctgtcgctgctgggcaccttaattgtccgttctggcattctggtttcggttcatgcgttcgcgctggataacgtccgcgccgtgccgttgttcagcctgtttgcactgattagccttgcgtctctggctctgtatggctggcgagcgcgggacggtggcccggcggtgcgtttttcggggttatcgcgggaaatgttaatcctcgctacgctgttgctgttttgcgcagtgctactgatcgtgctggtgggaacgctttatccgatgatttacggcctgctgggctggggacgcctctccgttggcgcgccgtattttaaccgcgcgacgttaccgtttgctctgttgatgctggtggtgattgtgctggcgacgtttgtctctggcaaacgtgctcagcttccggcgctgctggcgcatgcgggcgtgctgttatttgccgcggggatcgtggtttccagcgtcagccgtcaggagatcagcctgaatttacagccgggtcagcaggtgacgctggcaggatacaccttccgttttgagcgcctcgatctgcaagccaaaggcaattacaccagcgaaaaagcgatagtggcactgtttgaccatcagcaacgcattggtgaattaacgccggagcggcgtttttacgaagcacgtcgtcagcaaatgatggaaccgtcaattcgctggaatggcatccatgactggtatgcggtcatgggcgagaaaaccggagcggatcgttacgcttttcgtttgtatgtacaaagcggtgtgcgctggatctgggggggaggattgttgatgattgcgggcgcattgttaagcggatggcggggaaggaagcgcgatgaataa

SEQ ID NO: 67987 - protein, 560 aa, Escherichia coli CFT073
MLLSLGVNVLTPLTAFAGVRLRWPAMMRLTCIGILAQFALLLLAFGVLTYCFLISDFSVIYVAQHSYSLLSWELKLAAVWGGHEGSLLLWVLLLSAWSALFAWHYRQQTDPLFPLTLAVLSLMLATLLLFVVLWSDPFVRIFPPAIEGRDLNPMLQHPGLIFHPPLLYLGYGGLMVAASVALASLLRGELDGASARICWRWALPGWSALTAGIILGSWWAYCELGWGGWWFWDPVENASLLPWLSATALLHSLSLTRQRGIFRHWSLLLAIVTLMLSLLGTLIVRSGILVSVHAFALDNVRAVPLFSLFALISLASLALYGWRARDGGPAVRFSGLSREMLILATLLLFCAVLLIVLVGTLYPMIYGLLGWGRLSVGAPYFNRATLPFALLMLVVIVLATFVSGKRAQLPALLAHAGVLLFAAGIVVSSVSRQEISLNLQPGQQVTLAGYTFRFERLDLQAKGNYTSEKAIVALFDHQQRIGELTPERRFYEARRQQMMEPSIRWNGIHDWYAVMGEKTGADRYAFRLYVQSGVRWIWGGGLLMIAGALLSGWRGRKRDE

SEQ ID NO: 67988 - DNA, 2052 bp, Nitrosomonas europaea ATCC 19718
  CDS (1)..(2052): transl_table=11
atgattccggaacttggtaactttgccctcatcctcgcaatgctgctggccctggtccagggaacactacccatcattggcgcggcacgtggtataccctcgtggattgctttggcgcgtccggtcacacagggacattttgtatttatcgcgattgctttcgggtgccttgcctattcgttcgtaaataatgatttctctgtattgaacgtggcatccaactcgaattctgatcttcctgtgcattttcgttttgctgcaacatggggatctcatgagggttcattattgctatgggtgaccatgcttgccggctggtctgtggctgtaagtgttttcagtcgtcagttgccggacgatatggtagctcgtgtcttgggtgtgctggggctggtcagtgctggttttctgctgtttcttttgtttacctccaaccctttcgacaggttgttgccggcagcaatcgaagggaatgacctcaatccactactgcaggatccgggaatggttatgcatccacccatgttgtatatggggtatgtaggtttttcagtggcatttgcatttgcaattgcagcactgcttaacggccagctggatgcagcctgggcgagatggtcacgtccatggaccgttgttgcctggattttcctgactattggcatcatgggcggcagctggtgggcatattatgagctggggtggggtggctggtggttctgggatccggttgaaaatgcatcattcatgccttggctggtaggtaccgcactgatacattcactggccgtgactgaaaaacgcggaagtttcaagagctggacggtgttactggcaattactgctttttcactgagtctgttggggactttcctggttcgttctggggttctgacttccgtacatgcttttgcaacagatccggcacgcgggatatttattctggtctatctctcgctggtcgtagggtgttcactgacactgtttgcatggcgagcatcgaaagtaggtcttggtggtaattttgaaattgtctcacgtgaaactactttgcttgccaataatgtattgctgctggtggctgcaggtagcgtattgctgggtacactttaccctctcctgatcgatgcattggatctggggaaaatttctgtaggccctccttattttgaggctgtttttgtgcctctgatggcaccggcaatctttctgatcgggttggggccgattgctcgctggaagaaagccagcctgccagccctggcggtgctgatgagatgggcattcgttgtgagtctggtggctgcagggatcatgccgttcatcatgggcgagtggaaacctatggtcagttttggattgcttctggctttctgggtcatcgccagtatatttgtcagcatcagccatcgactccggaacggtggtgaaggtggattgtttaccagactggcaaaacagccaaggggttattacggtatgcactgtgcacatttgggtattgcagtgttcatcatcggtgtgacgctggtcaatggttatgaaaccgagaaagatgtgcgaatggaagtcggcagtaccgtgacactcaaggaatataccttccagttcaatggaaccaagtcggttaccggccctaattacaatgcatctcagggacaggtcgaggtattcagggaaggtaaaaaagtcagtgagttgcagcctgaaaaaagaacctataccgcatcaggtatgcctatgactgaggcggcggttgacatggggctgttgcgtgatttgtatgttgcactgggtgagccgttggaaaacggtgcctggatagttcgtgtctatcacaaaccttttgttaactggatatggctgggttgtatgttgatggctttaggaggagcgctggctgccagtgatcgacgttatcgtctcgcaattggcaagaaatcgaggaataaggcagcttcaggaccagtagcaccggaaactgcagatataccggccgggagcatggttaccaattcagttatcctctcggaggaaggtggtaaggtatga

SEQ ID NO: 67989 - protein, 683 aa, Nitrosomonas europaea ATCC 19718
MIPELGNFALILAMLLALVQGTLPIIGAARGIPSWIALARPVTQGHFVFIAIAFGCLAYSFVNNDFSVLNVASNSNSDLPVHFRFAATWGSHEGSLLLWVTMLAGWSVAVSVFSRQLPDDMVARVLGVLGLVSAGFLLFLLFTSNPFDRLLPAAIEGNDLNPLLQDPGMVMHPPMLYMGYVGFSVAFAFAIAALLNGQLDAAWARWSRPWTVVAWIFLTIGIMGGSWWAYYELGWGGWWFWDPVENASFMPWLVGTALIHSLAVTEKRGSFKSWTVLLAITAFSLSLLGTFLVRSGVLTSVHAFATDPARGIFILVYLSLVVGCSLTLFAWRASKVGLGGNFEIVSRETTLLANNVLLLVAAGSVLLGTLYPLLIDALDLGKISVGPPYFEAVFVPLMAPAIFLIGLGPIARWKKASLPALAVLMRWAFVVSLVAAGIMPFIMGEWKPMVSFGLLLAFWVIASIFVSISHRLRNGGEGGLFTRLAKQPRGYYGMHCAHLGIAVFIIGVTLVNGYETEKDVRMEVGSTVTLKEYTFQFNGTKSVTGPNYNASQGQVEVFREGKKVSELQPEKRTYTASGMPMTEAAVDMGLLRDLYVALGEPLENGAWIVRVYHKPFVNWIWLGCMLMALGGALAASDRRYRLAIGKKSRNKAASGPVAPETADIPAGSMVTNSVILSEEGGKV

SEQ ID NO: 67990 - DNA, 1995 bp, Bordetella parapertussis 12822
  CDS (1)..(1995): transl_table=11
atgatcccggaaatcggcctgttcagcctcatcctggcgttgctggttgccatcgtgcagggcgtgctgccgctggtgggcgcatcgaccggctggcaggccggcctgcgggtggcgcggccggccgccgtcacccaattctgcctggtcaccgtggccatgggctgcctggcgtggtcgttcctggacaacgatttctcggtgctgtatgtggcgggcaactcgcacgccgacctgcccgccgcctaccgcttcgcggcgctatggggcggccacgagggatcgctgctgctgtggctgtacctgctgaccgcctggacgctggcggtggcgctgcacagccgcgcgctgccgccggccttcgcggcgcgcgtgctggccgtcatggcctggatcagcatcggcttcctgctgttcctgctgttcctgtccaatccgttcgagcgcctgatgccgccggcgcaggccggacgcgacttgaaccccttgctgcaggatccgggcatgatcgtgcatccgcccatgctgtacatgggctatgtgggcttttcggtggcgttcgccttcgccatcgccgcgctgctgtcgggcgagctggacgccatctgggcgcgctgggtgcggccctggaccttgctggcctggatgttcctgaccatcggcatcctgctgggcagcgcctgggcctactacgtcctgggctggggcggctggtggttctgggatccggtcgagaacgcctcgttcatgccgtggctggccggcacggcgctgatccattccctgatcgtcacggagcggcgcggcgccttccgcagctggacggtgctgctggccatcgcggcgttctcgctgagcatactgggtactttcctggtgcgctccggcgtgctgacctcggtgcacgccttcgcggtcgatcccggccgcgggctgtacatcctgggcttcatgacgctgatcgtgggcggctcgctggccctgtacgcctggcgcgcgcccaccgtaggccttggcgggggcttcgccctgctgtcgcgcgaatcgctgctgctcagcaacaacgtggtgctggccgcggctaccggcgcggtgctgctgggcacgctgtacccggtggcgctggacgtgctggactggggcaagatctcgatcggcccgccctacttcgaggcggtgttcgtgccgctgatgacgccggcgatcttcctgatgggcgtgggaccgatggcgcgctggaagcacagcgccgtgccggacctggcgcagcgcctgcgcattgccttcggcgtgagcctggccaccgcgctgacggtgccgctggcctggcccggcgcgcgcgcctggccaggctcgccgctgatcgtattgggcctgtggctggcggcctggtcggtcgccagcgccgccgcgcatgcctggcagcgcctggccgacggcgaaggctcgtgggcgcggcgcctgcgccgccagccgcgcgcctggtacggcatgctgctggcgcacgccggcgtgggcgtgttcatcgccggcgtgacgctggccaatggctatgaggacaagcaggaattgcgcatggacatcggcgccacgcaggccgccggcggctaccagttcaccttcgccggtatcgcgccggccgccggccccaactaccaggccgaacgcgcccgcttcgtggtcacgcgcgacggccggccggtggtcacgctgcatcccgagaaacgccactacacggtgcagggcatgccgctcagccatgccgccatcgacacccgctttacccgtgacctgttcgtggcgctgggcgagccggtcggccagcgggcctggacggtgcggctgcaggtcaagcccttcatggcctggatctggtcgggttgcgtgctgatggcgctgggcggcctgatggcggcaaccgaccggcgctaccgccagtggcgcgccgccgaagcgcgccaagcggtgacggcggtggcgcgggaggccggctga

SEQ ID NO: 67991 - protein, 664 aa, Bordetella parapertussis 12822
MIPEIGLFSLILALLVAIVQGVLPLVGASTGWQAGLRVARPAAVTQFCLVTVAMGCLAWSFLDNDFSVLYVAGNSHADLPAAYRFAALWGGHEGSLLLWLYLLTAWTLAVALHSRALPPAFAARVLAVMAWISIGFLLFLLFLSNPFERLMPPAQAGRDLNPLLQDPGMIVHPPMLYMGYVGFSVAFAFAIAALLSGELDAIWARWVRPWTLLAWMFLTIGILLGSAWAYYVLGWGGWWFWDPVENASFMPWLAGTALIHSLIVTERRGAFRSWTVLLAIAAFSLSILGTFLVRSGVLTSVHAFAVDPGRGLYILGFMTLIVGGSLALYAWRAPTVGLGGGFALLSRESLLLSNNVVLAAATGAVLLGTLYPVALDVLDWGKISIGPPYFEAVFVPLMTPAIFLMGVGPMARWKHSAVPDLAQRLRIAFGVSLATALTVPLAWPGARAWPGSPLIVLGLWLAAWSVASAAAHAWQRLADGEGSWARRLRRQPRAWYGMLLAHAGVGVFIAGVTLANGYEDKQELRMDIGATQAAGGYQFTFAGIAPAAGPNYQAERARFVVTRDGRPVVTLHPEKRHYTVQGMPLSHAAIDTRFTRDLFVALGEPVGQRAWTVRLQVKPFMAWIWSGCVLMALGGLMAATDRRYRQWRAAEARQAVTAVAREAG

SEQ ID NO: 67992 - DNA, 2016 bp, Cupriavidus necator
  CDS (1)..(2016): transl_table=11
atgaatgccgaactcggccatttcgcgctgatcgtggccctgctggtcgcgatagtgcaggccgcattgccgctggccggcgccgcgcacggcaacatcgcgtggatggccgtggcccgtcccgccgcgcgcgtgcagtgcgtgctggtggcgctggccttcggctcgctgacatgggccttcgtcagcaatgacttcagcgtgcgctacgtggcggcgaatgccaacaccgccctgccgctgacctaccgcattgcggccgtatggggcgggcacgaaggttcgatgctgctgtggacgctgatgctcgggctgtggtcgacggcagtttccttctgcagccggcagcggccactcgccgtcgtggcgcgtgtgctgggtgtgatgggcaccatcagcgccggcttcctgctgttcctgctgttcgcgtccaatccgttcctccgcctgctgccgcccgcgatggaaggccgcgacctcaacccgctgctgcaggacccgggcatggtgtttcatccgccgctactctatatgggctatgtcggcttctcggtcaccttcgccttcgccgtggccgcgctgctggcaggccgggccgacgccgcttgggcacgctggtcgcgcccgtggaccacggtggcgtgggcactgctgacgctgggcatcatgctcggcagtgcctgggcgtactacgaactcggctggggcggctggtggttctgggatccggtcgagaacgcctccttcatgccctggctcgcgggcaccgcgctgatgcactcgctcgcggtcacagagaaacgcggcgcgttccgcgcctggacggtgctgctcgccatctttaccttctcgctgagcctgctcggcactttcctggtccgctccggcgtgctcacctcggtgcacgcgtttgcggtcgacccgaagcgcggcatcttcatcctggcgctgctgggactggtcaccggactgtcgctgacgctctatggatggcgcgcgccgcggcttgcacggcgcgtcgaattttccgtggcagcgcgggaatccctgctgctcgccaacaatgtgctgctggccgtcgccgctgccaccgtgttgctcggcacgctctacccattgctgctggacgtgctcgggctgggcaagatctcggtcggcccggcgtacttcgagcaggtattcgtgccgctgatggcgcccgccgtgctgctgatgggcgccgcgccgctggcgcgctggcggcacggcggcctgcccgacatggcgcgacggctgcgctgggcggcggcggccagcatcgtcgtcggactcggcctgttgctggttcagcgcaacgcgtcggcgctcgcagggctggggctggtgctggcggcctggtgcgggctcagcgccgtggccagcctgtctacgcgcctgcggaaccagcaaggccggcgcctggccgccttgcgccagctgcccgcgagctattggggcatgctgctgtcgcacgcgggcgtgggcgtcttcatcgccggcgtgacgctggtgtcgagccaggagagcctgcgcgaactgcccatgcgcgtgggccacaacatcagcgttggcggctatagcttccgcttcgacggcgtgacgcaggcggcgggccccaactacgatgcgctgcgcggaacgctgtccgtgtcccgccacggcaagatcgtcgccgtcctcgccccggaacgccgcatctaccgcagccaggacatgcccaccaccgaagccgccatcgacagcggcctgacccgcgatctctacgtcgcgctgggcgagggcgtgggcgatggcggctgggcggtgcgcatccacgtcaagccgttcgtcgactggatctgggccgggtgcatcctgatggcgctgggcggcttgcttgccgtctgcgacaaacgctaccgcctgcgtcggcgcgccccggctccacaggccgaaacagtcgatgcgccgaaggcaccggcactggcgctttccaccgccgaggagacgcgggcatga

SEQ ID NO: 67993 - protein, 671 aa, Cupriavidus necator
MNAELGHFALIVALLVAIVQAALPLAGAAHGNIAWMAVARPAARVQCVLVALAFGSLTWAFVSNDFSVRYVAANANTALPLTYRIAAVWGGHEGSMLLWTLMLGLWSTAVSFCSRQRPLAVVARVLGVMGTISAGFLLFLLFASNPFLRLLPPAMEGRDLNPLLQDPGMVFHPPLLYMGYVGFSVTFAFAVAALLAGRADAAWARWSRPWTTVAWALLTLGIMLGSAWAYYELGWGGWWFWDPVENASFMPWLAGTALMHSLAVTEKRGAFRAWTVLLAIFTFSLSLLGTFLVRSGVLTSVHAFAVDPKRGIFILALLGLVTGLSLTLYGWRAPRLARRVEFSVAARESLLLANNVLLAVAAATVLLGTLYPLLLDVLGLGKISVGPAYFEQVFVPLMAPAVLLMGAAPLARWRHGGLPDMARRLRWAAAASIVVGLGLLLVQRNASALAGLGLVLAAWCGLSAVASLSTRLRNQQGRRLAALRQLPASYWGMLLSHAGVGVFIAGVTLVSSQESLRELPMRVGHNISVGGYSFRFDGVTQAAGPNYDALRGTLSVSRHGKIVAVLAPERRIYRSQDMPTTEAAIDSGLTRDLYVALGEGVGDGGWAVRIHVKPFVDWIWAGCILMALGGLLAVCDKRYRLRRRAPAPQAETVDAPKAPALALSTAEETRA

SEQ ID NO: 67994 - DNA, 2001 bp, Chara vulgaris
  CDS (1)..(2001)
atgtatgttgaaataggtcattattttttcattcttagcatttttgttgcattagcctacaaaaaaaagaatctatctttttttttttcactttactttctcgttttaaccatctgtttttttagctttttgttttgttatgtttcttctgatttctctatttatagcgtttttacaaattcaaataatcaattaccattgttttataaagtttctggaacttggtcgaatcatgaaggtagtctcttattatggtgttggatcctgagtctttatggttttttcttttgttttcgaactcgcaacgaagttgccttgactggtgcccctcttatgattcacaaatggattgctttatttttctctgtttttttatgtttaacctccaatccttttcttcgaatttcctttttaagcactgattcgggaaaagaattcaaccctgtactacaagaccccgtattggctatacatcctccttgtatttatgcaggatacgttgccagtactattggtttttgtttatgtgtatccggaactcaacaaaaaaaacacactgcgcgtgaaatcaatgaaagtgggaagctgaaagatcactgtggaaaaagaaaggcagtgatcttacgttctgtgcttcgcaccataacgcgacctcttggaagtgcctattggaaactgatacgaatttggattttaacgtgctggtgttttttaactgtaggaatactactgggaagttggtgggcttatcatgagctaggttggggcggttggtggttttgggatcccgtagaaaatgcatctttgatgccttgggtattagctacagcttgtattcattcagtcatttcatttcggttgaattcttggaccttctttctaaacattgttacttttttattcagtcttttaggtactttttttgttcgttcgggattacttgcatctgttcatagctttgccacagattcgcaacgaggaatctttttattaagttttttttttatggcaagcctatctcttttaaaaaagaatagaacgactggcgcctacgatcacctatctgaaatcgaacagattctcaaactacagctaacgctcctttgtataatttgtttggttgttctctgtggtaccgcggcacctgtgctttttcatctattagctcaaagagaagtttccactggtgctcctttctttaatggtactataatacctatttttatttgtttactacttgttttagtttatatacattacagaagtgcacagcaagcgcacagcaatcacagtgtgtttttgtgtgttttatttattattcatgtaattttcatcaagttaattgcagatttgtcgtatctagagtctttctgctgtgctctttgtttttctctctttttcagtttctttttgttcaaaccttctgcaccaatgaatatgattttgtcacatggaggagtttgtattttgattacaggtgttatcttatccaatacaaaaaagatacaaattactcaaatcatgcactttggttttgaacaaaatataggcaacggaaggttgtgttgtttacgaagtattgatcaattacatggacctacttttcaatccatttgtggaaacatagcatgtgtttctaatcatgacaccaaggctgcgatagcagcgcatcattactttgaaaaagtgatctcttgcgtgcaaagcactgatttagcaagtgatttgacgcgtagtgttgatagctttgttatgtttccagaaaaaagattctgtttttcgaatccagaaaccagtactactaaagtggctatacataccaactttttcacagatctctatgctttgataggaactggaagttttgaaactggttggtatactaccataatgaagttacctttcattttttgtatttggataggttttgttttggcttcttttggaggtttccgaagtttaatacgtcagctttcaaaacaaaaactgaattggaattaa

SEQ ID NO: 67995 - protein, 666 aa, Chara vulgaris
MYVEIGHYFFILSIFVALAYKKKNLSFFFSLYFLVLTICFFSFLFCYVSSDFSIYSVFTNSNNQLPLFYKVSGTWSNHEGSLLLWCWILSLYGFFFCFRTRNEVALTGAPLMIHKWIALFFSVFLCLTSNPFLRISFLSTDSGKEFNPVLQDPVLAIHPPCIYAGYVASTIGFCLCVSGTQQKKHTAREINESGKLKDHCGKRKAVILRSVLRTITRPLGSAYWKLIRIWILTCWCFLTVGILLGSWWAYHELGWGGWWFWDPVENASLMPWVLATACIHSVISFRLNSWTFFLNIVTFLFSLLGTFFVRSGLLASVHSFATDSQRGIFLLSFFFMASLSLLKKNRTTGAYDHLSEIEQILKLQLTLLCIICLVVLCGTAAPVLFHLLAQREVSTGAPFFNGTIIPIFICLLLVLVYIHYRSAQQAHSNHSVFLCVLFIIHVIFIKLIADLSYLESFCCALCFSLFFSFFLFKPSAPMNMILSHGGVCILITGVILSNTKKIQITQIMHFGFEQNIGNGRLCCLRSIDQLHGPTFQSICGNIACVSNHDTKAAIAAHHYFEKVISCVQSTDLASDLTRSVDSFVMFPEKRFCFSNPETSTTKVAIHTNFFTDLYALIGTGSFETGWYTTIMKLPFIFCIWIGFVLASFGGFRSLIRQLSKQKLNWN

SEQ ID NO: 67996 - DNA, 1983 bp, Rhodopseudomonas palustris CGA009
  CDS (1)..(1983): transl_table=11
atgatcgccgaggccgggcactacgcactggttctggcgctggctctggcgctgatccagtccaccgttccgctgctcggcgcccggctcaatgacggcgcgctgatgaatgtggcgcgctcgaccgcgctggtgcagctgttgttcgccggcctgtcgttcaccgcgctggtgtggctgcacgtcacctccgacttctcggtggtgaacgtgtacgagaactcccactcgatgaagccgctgctctacaagatcaccggcgtgtgggggaaccacgaaggctcgatgctgctgtgggtcgcgatcctggcgctgttcggcggcctggtcgcggcgttcggcaacaatttgccgctgtcgctgcgcgcccacgtgttggctgttcagggctgggtcgcaaccgcgttctatctgttcatcctgatcacctcgaacccgttcgcgcggattgccaatgcgccggccgagggccgcgatctcaacccggtgctgcaggatatcggtctcgcggtgcatccgccgatgctgtacctcggctatgtcgggttctcgatttcgttctcgttcgccgccgctgcgctgatggaaggccggctcgacgccgcctgggctcgctgggtgcggccgtggacactggtcgcctggatcttcctcaccctcggcatcgcgatgggctcgtattgggcctactacgaactcggctggggtggctggtggttctgggacccggtcgagaacgcctcgctgatgccgtggctcgccggcaccgcgctcttgcactcggcgctggtgatggagaagcgcaacgcgctgaaggtctggaccatcctgctgtcgatcctgaccttctcgctgtcgctgctcggcaccttcctggtgcgctccggcgtgctcacctcggtgcacgccttcgccaccgatccgtcgcgcggcgtgttcatcctgatcatcctgtgcgtgttcatcggcggcagcctgacgctgtttgcctggcgggcctcgtcgctgaagcagggcggcctgttcgcgccgatctcgcgcgaaggctcgctggtgctgaacaatctgttcctcaccaccgcctgcgccaccgtgttcgtcggcacgctgtatccgctggcgctggaagtgctgaccggcgacaagatctcggtcggcgcgccgttcttcaatctcaccttcggcccgctgatggtgccgctgctggtcgcggtgccgttcggcccgctgttggcctggaagcgcggcgatctggtcggcgccgcgcagcggctgatcgccgccggcgtggtggcgctgctggcggtcgccttcgtatatgcctgggtccatggcggcgcggtgctggcaccgctggcgatcgggcttgcggtgttcgtcatcatcggcgcgctggttgacatcgccgagcgcattgcgctgttccgcggtccgctgtcgatctcgctgcgccgcgcctccggcctgccgcgctcggcctggggcacgatgttcgcccatgcggcgctcggcgtgacgctgatcggcatcgtctgcgagaccacctggaacagcgagtacatcgccgcgatgaagccgggcgacagcaccaagctcgccggctacgagttcaagttcgaaggcgccaatcagcgccagggaccgaactatcgcgagttgctgacgcagttcacggtgaccgagaacggccggctggtcggcggcatggcgccgtcgaagcgcagcttcatcacccgcggctcctccaccaccgaggcggcgctgctgacccgcggcttcagccagctctacatctcgctcggcgatctcaacgaccagggcgcggtgacggtgcggatctatcacaagccgatggtgctgctgatctggttcggcccgatcctgatggcgctcggcggcctgctgtcgctgtccgatcgccgcttgcgggtcggcgcgccgaagcccgccaaggcgccgcgcgtgctgcagccggccgagtag

SEQ ID NO: 67997 - protein, 660 aa, Rhodopseudomonas palustris CGA009
MIAEAGHYALVLALALALIQSTVPLLGARLNDGALMNVARSTALVQLLFAGLSFTALVWLHVTSDFSVVNVYENSHSMKPLLYKITGVWGNHEGSMLLWVAILALFGGLVAAFGNNLPLSLRAHVLAVQGWVATAFYLFILITSNPFARIANAPAEGRDLNPVLQDIGLAVHPPMLYLGYVGFSISFSFAAAALMEGRLDAAWARWVRPWTLVAWIFLTLGIAMGSYWAYYELGWGGWWFWDPVENASLMPWLAGTALLHSALVMEKRNALKVWTILLSILTFSLSLLGTFLVRSGVLTSVHAFATDPSRGVFILIILCVFIGGSLTLFAWRASSLKQGGLFAPISREGSLVLNNLFLTTACATVFVGTLYPLALEVLTGDKISVGAPFFNLTFGPLMVPLLVAVPFGPLLAWKRGDLVGAAQRLIAAGVVALLAVAFVYAWVHGGAVLAPLAIGLAVFVIIGALVDIAERIALFRGPLSISLRRASGLPRSAWGTMFAHAALGVTLIGIVCETTWNSEYIAAMKPGDSTKLAGYEFKFEGANQRQGPNYRELLTQFTVTENGRLVGGMAPSKRSFITRGSSTTEAALLTRGFSQLYISLGDLNDQGAVTVRIYHKPMVLLIWFGPILMALGGLLSLSDRRLRVGAPKPAKAPRVLQPAE

SEQ ID NO: 67998 - DNA, 2190 bp, Leptospira interrogans serovar Copenhageni str. Fiocruz L1-130
  CDS (1)..(2190): transl_table=11
atgaatgatttcggcgctctttgcatcataacgtcttttgcgatccttatattttcgatcgtacaaacttcttacggaatttggaaacaagacaaacaggtaatcgaactcggtagatatactttgatggcaaattccgccatcatccttttagcttttatcgtcttactcgttcaacttttcagaaccgatctttctaattactatgtggtaatgcattccaacgaacacttacctttattttatagacttaccggaatttggtccggttcctccggttccttacttttttggaatcttttactttcactttttacattcatcgttctttggcaaacaaaggatctaacccaagatagaattcctgtcttaaatttaacgttagccgtcatatctgcttttttttcttatcttgctgtattttatccggatgcccaaccatttcgagaatttcaaccggcggcagttgccggcagaggattaaatcctcttttacaacactgggccatggtcatccatcctccgattctttatgtgggttacgtaagttttgcgattccttttgcaattgcagcctcggctttaatcacaggacatctttccgaaaattggtttcgttttgttagaaggtggactatcttttcttggttttttttaggaaccggaattctactcggttccaaatgggcttacgaagaattaggttggggaggttactgggcctgggatcccgtagaaaacgcttctcttatgccctggcttttatccactgcatttcttcattctatgatcatccaagaaagaagaggtatgttaaagttttggaatatgcttttgatcatactcgcttttcatttttgtttattaggaacttggatcacccgaagtggagtactcgaaggtcctcatagtttttccaagtccacaatcggcaccccgttcatcatctacatcggaattagttttttcttctttttaggatttttaatctaccgcagaaattctctaaaacccgagcgcaatctggaggcaatgacctctaaagaaggcagttttctttttaataacttcctacttgtaatcgctactcttgcgattcttttaggagttttttctcctcttctttatggaagagaatttaaagctccttggttcaactcttggggagttccagtgggaatccttttgatccttttgatgggttcggcaccacttctcgcttggagaaaaagcgcggacaaaatttttttctcgaccctcctcaaaccgttgttagtcggaattgcaggagctggaatgtacattttattttatactaaaaactttacgattagcgaatacagtttaggcgacgtattaggggaaatttattcagtgatcgcggttggtctcggaatttttacgactgccggaattgtacaggaatatcatagagggatcatcgccagaaaaactgcgtatccaaacgagaattattttttttccggatttaggatgcttttaaaaaataaaagaagatacggaggttacctagttcacttggcgatggtgatactttttataggttatgcagggaacgcgtttaaacaaaacacatccattaagtttttctacttcttgaacgcacccgaaaaaaacgaaatcgtctattcgagtcaggatacgggagttctcggaaactatcagatctcggcaaacactctgaagatcaaacctctcgtcaacggagacgcaaagaacggactcaacattcaaaacgtgatcgtttctcacgaagcaacctttcaagtaaaacggaatctaaaagaattttctacaatggttacagaaagaagattttatccacaaatctctcacttaagcggagactttgaaactcatatccctacaagcgaacccgcaatttcttccactcctaaagaagacttatacattcaactcggggctatcgaacattccgatctttccgatgaaaatccagaccttcctatactttttatgaattatctttttacaaatgagaatcagccagttcgtaaattggaaaacttcaatcgatttccaagacaactcgtagccaacttagaagtctgggtaaaccctctggtaaaatttatttgggtgggttcattgttatttttcttttcggggctattaattcttctcccgatcggagaatccagatcatga

SEQ ID NO: 67999 - protein, 729 aa, Leptospira interrogans serovar Copenhageni str. Fiocruz L1-130
MNDFGALCIITSFAILIFSIVQTSYGIWKQDKQVIELGRYTLMANSAIILLAFIVLLVQLFRTDLSNYYVVMHSNEHLPLFYRLTGIWSGSSGSLLFWNLLLSLFTFIVLWQTKDLTQDRIPVLNLTLAVISAFFSYLAVFYPDAQPFREFQPAAVAGRGLNPLLQHWAMVIHPPILYVGYVSFAIPFAIAASALITGHLSENWFRFVRRWTIFSWFFLGTGILLGSKWAYEELGWGGYWAWDPVENASLMPWLLSTAFLHSMIIQERRGMLKFWNMLLIILAFHFCLLGTWITRSGVLEGPHSFSKSTIGTPFIIYIGISFFFFLGFLIYRRNSLKPERNLEAMTSKEGSFLFNNFLLVIATLAILLGVFSPLLYGREFKAPWFNSWGVPVGILLILLMGSAPLLAWRKSADKIFFSTLLKPLLVGIAGAGMYILFYTKNFTISEYSLGDVLGEIYSVIAVGLGIFTTAGIVQEYHRGIIARKTAYPNENYFFSGFRMLLKNKRRYGGYLVHLAMVILFIGYAGNAFKQNTSIKFFYFLNAPEKNEIVYSSQDTGVLGNYQISANTLKIKPLVNGDAKNGLNIQNVIVSHEATFQVKRNLKEFSTMVTERRFYPQISHLSGDFETHIPTSEPAISSTPKEDLYIQLGAIEHSDLSDENPDLPILFMNYLFTNENQPVRKLENFNRFPRQLVANLEVWVNPLVKFIWVGSLLFFFSGLLILLPIGESRS

SEQ ID NO: 68000 - DNA, 1932 bp, Thermus thermophilus HB27
  CDS (1)..(1932): transl_table=11
atgaccccggcccttctcggcaacctcggcgtgagcctggccctggcctttagcctcctgggcctgggcctcgccctcctcgcctacctccagggggacgggcgcttcctaaggggggcgcgggccctcgtgtttcctgccttcctcgctgcgcttgccgccttcctcgccttggagtgggccctcctcgtccacgacttcagcctggcctacgtggcgaggaaccactccaccaaggaccccctctgggtgaccctggtgaccccgtgggcggccctcgagggcagcatcctcctctggggcctcctccagaccctctacaccctgctcgcaagccgcaaacccttggacccctggcgggcctccctggtcctcgccgtgctcttcggcatccaggtcttcttcttcggagtcatggccaccatcgcgagcccctttgagaccctgcccgacccgcctcccgacggcgtgggcccgaaccccctcctccagaaccactggatgatggccgtccaccccgtcctcatgtacctgggtttcgtgggcctgagcgtgccctacgcctacgcggtggcggccatggccacccggcgctaccagacctgggtggaggagaccaggtggtggaccctcatcgcctggggcttcctcaccgcggggaaggtggcggggatgtggtggagctacgaggtcctgggctggggcgggtactgggcctgggaccctgtggaaaacgccagcttcatcccctggctcctcgccacggccttcctccacacggccttcgtccagcagacccggggggccttcaagacctggaacttcgccttcgtgaccctggccttcgccgccacccttctcggcaccttcctcacccgaagcgggatcatccagtcggtccacgccttcgccgagggccccgtggggcccgccttcctcggcttcttcctctttgccacgggccttggcctcggcctcctctcccgggtctcccgggaggtgcgggacgccgcccttttccaccctctctcccgggagggggcgcttctcctcggggccttcttcttcgcgggctgggccctcgtggtcgtcctcggcaccttctacccccttcttgtggaggccttcaccggggccaaggtgagcgtgggggcccccttcttcaaccaggtttccgcccccctgggggcggggatcctcctcctcatgggggtggggcccctcctcccctggcgcagggcccggggggaggtcttgcggaacctcctcgtccttctcctcgccctcgccttggggaccctattcggcctcctccggggctacaccttgggggcctccttcgccttggggctcttcctctacaacgccgccgccatctacctcctggcccgggagggggttttggcccgggtgcgggcggggctttccccctggggcttcttggcgaaccgcaggcgggtgggaagcctcgtggtccacttcgccgtggccctcatggggcttgccatcgccttcagccagacctaccgcctggagagcgagaagaccctctaccggggagaggcctgggaggtggggggcgtgcgcatgaccttccagggggtgcgggccttggacgaggggcggcgcttcgccgtggaggcccttctaaagaccgaccgcttcggggaggtcaggcccaggctccacttctacccccagatgaatagcccccttcccgcccccaaggtcatttacaccccggggaacgactactacttcctcctcatggactttgaccgggaaaagggggagtgggcctccctaaggctcatcgtcacccccttggtcttctggatgtgggtggcgggggggcttatggccctgggcaccctttacatcctctggcccgcggcgaggccggaggaagctaggggggtgagcccggcgtga

SEQ ID NO: 68001 - protein, 643 aa, Thermus thermophilus HB27
MTPALLGNLGVSLALAFSLLGLGLALLAYLQGDGRFLRGARALVFPAFLAALAAFLALEWALLVHDFSLAYVARNHSTKDPLWVTLVTPWAALEGSILLWGLLQTLYTLLASRKPLDPWRASLVLAVLFGIQVFFFGVMATIASPFETLPDPPPDGVGPNPLLQNHWMMAVHPVLMYLGFVGLSVPYAYAVAAMATRRYQTWVEETRWWTLIAWGFLTAGKVAGMWWSYEVLGWGGYWAWDPVENASFIPWLLATAFLHTAFVQQTRGAFKTWNFAFVTLAFAATLLGTFLTRSGIIQSVHAFAEGPVGPAFLGFFLFATGLGLGLLSRVSREVRDAALFHPLSREGALLLGAFFFAGWALVVVLGTFYPLLVEAFTGAKVSVGAPFFNQVSAPLGAGILLLMGVGPLLPWRRARGEVLRNLLVLLLALALGTLFGLLRGYTLGASFALGLFLYNAAAIYLLAREGVLARVRAGLSPWGFLANRRRVGSLVVHFAVALMGLAIAFSQTYRLESEKTLYRGEAWEVGGVRMTFQGVRALDEGRRFAVEALLKTDRFGEVRPRLHFYPQMNSPLPAPKVIYTPGNDYYFLLMDFDREKGEWASLRLIVTPLVFWMWVAGGLMALGTLYILWPAARPEEARGVSPA

SEQ ID NO: 68002 - DNA, 1896 bp, Desulfovibrio vulgaris subsp. vulgaris str. Hildenborough
  CDS (1)..(1896): transl_table=11
atgcacctttccgcctacctgcttctcgtagcctcgctgctgttcgcgctcttctttgcgggcacggcggccatacagatatggcagggcagaaccacggcgctgccgtggatggagaaggggcacctcatgctcaccgcgttcatgtcggtggcatcagccgtgcttcttcatgcccttgcgaacttcgacttctcgctggtgtacgtcgccagctacaccgacagggcattgcccctgttctaccgtctcaccgcattctgggctgggcaggccgggtccatgctcttctggggctggtcggtcgcgctgttcggtgtgttcttcctcttctcccccgtctatcggcgtgtgagcgaaccgacccgcatgtggttctggttgctctttctcgccatgatgggcttcttcctgctggttctcacctgctggagcaaccccttcaccgtggtcgaccccgccccggcggacggcaacggcctgaacccgctgctgcagaaccccggcatgatcttccacccgccgctgctcttcctcggctacggcggcttcgccattcccggctgtcttgcgctggcacagtcgctgagcggcatgcgtctctccgaaggcgcatgggcggaccatgcacgtcccttcacccttgttgcgtggctcttcctcaccgccggcatcgtgcttggcggctggtgggcctacatggaactcggctggggcggctactgggcatgggacccggtcgagaacgcatcgctcatcccgtggctcatcgcctccgcgtacctgcatacggccgtcatcgaggcccgacgcaacaagctgcaccgtgtgaacaccttcctgatggccctgacgaccatctccgccttcttcgcgacctatctggtcagaagcggcgtggtcgaatcgctgcacgccttcggcgacggcggcgtgggcactcccctgctcatcttcatcatcgtcttcaccgcggtcgccctcggtggctccatcctgtggaaacacccggatgccaagcccctttcgggtgtcgaaagccgcgagggctttctcgtgatggtcgcgtgggtgctgcttgccctcggtgccatcatcctcgtcgccaccatgtggcccgtgttcagcaagttctgggtcgacaagcccgtggggctggaaccggcgttctacaaccgtgtgtgcctcccgctcttcgccgtgctggtcgtcatgctcgccatatgcccttggcttggctggaagggcggcctgcgcaacaaggtgggtgccgtcacggcactgggtctcttcgtcggggccgctggcggcatatgggccgctggctacaccatccccaccgcagtcctcggtgcagccggtgccatcgcggcccttggcggcattgtcatgctgctggcgaccgaaccgcacctgaggcgctcgccgcagtctctggccgcctacggcgtccacatcggccttgcgctcaccgcccttggcgtggccttctccggcccgtacaagaccgagcatgaggtcatcatgcagcagggcgacaccgtgcaggtggccggatacgacgtgaccttcaaggcgttgtacgagggcgaaggccccggctacatcttcatcgaggccgaactcgacgtgaagaagaacggctccgatgtgggcatggcccagccgcaacgccgcatctactccaagttcggcaagcaggcgttcgccgaggcgtcgaccattccgggtctcggcaacgaattctatgccgtactgcttggcgtcgaccgcgaaggcaaggccaccctgcacctcaacgtcaccccgctgatcaactgggtctggataggcagcatcatcatgtgcctgttccccttcatcgggatgcgtcgccggaagacagcggaggcgtga

SEQ ID NO: 68003 - protein, 631 aa, Desulfovibrio vulgaris subsp. vulgaris str. Hildenborough
MHLSAYLLLVASLLFALFFAGTAAIQIWQGRTTALPWMEKGHLMLTAFMSVASAVLLHALANFDFSLVYVASYTDRALPLFYRLTAFWAGQAGSMLFWGWSVALFGVFFLFSPVYRRVSEPTRMWFWLLFLAMMGFFLLVLTCWSNPFTVVDPAPADGNGLNPLLQNPGMIFHPPLLFLGYGGFAIPGCLALAQSLSGMRLSEGAWADHARPFTLVAWLFLTAGIVLGGWWAYMELGWGGYWAWDPVENASLIPWLIASAYLHTAVIEARRNKLHRVNTFLMALTTISAFFATYLVRSGVVESLHAFGDGGVGTPLLIFIIVFTAVALGGSILWKHPDAKPLSGVESREGFLVMVAWVLLALGAIILVATMWPVFSKFWVDKPVGLEPAFYNRVCLPLFAVLVVMLAICPWLGWKGGLRNKVGAVTALGLFVGAAGGIWAAGYTIPTAVLGAAGAIAALGGIVMLLATEPHLRRSPQSLAAYGVHIGLALTALGVAFSGPYKTEHEVIMQQGDTVQVAGYDVTFKALYEGEGPGYIFIEAELDVKKNGSDVGMAQPQRRIYSKFGKQAFAEASTIPGLGNEFYAVLLGVDREGKATLHLNVTPLINWVWIGSIIMCLFPFIGMRRRKTAEA

SEQ ID NO: 68004 - DNA, 1989 bp, Bartonella quintana str. Toulouse
  CDS (1)..(1989): transl_table=11
gtgcttgttgaactgggtcatatttttttagccgcagcgtttgcagtgagtttaatgcaggcatttttacctgctttgggtgtttggtgggaggatcattcattgatgcgaacagcagttcccttcacctatattacttttacattattgctcttatcttttttgattattgttcatgcccatatggtatctgatttttctgttttaaatgttgttgagaatagccattctgaaaaaccaatgctttataagatcactggtgtttggggaaatcacgaaggatccatgttgttatgggttttaagtcttgcttttttcagtacattgatggcattatttagccaacatttaccagaacagtttaagacattaattttggtttgccaaagttggattataagtgcctttcttgtatttgttctttttttatcgaatccatttttacgtattaatccaccggcattgcagggaaatgatctcaatcctcttttgcaagatatcgctttagcaattcatccaccacttctttatttaggctctgtcggtttttctctttgtttttcttttgcagtagctgcattggttatgggacatgtcgatgggcgttgggcgcattgggttcgtccttggcttcttcttgcttggtgttttttgacactaggcattatggttgggtcctattgggcttattatgagttaggatggggtggttattggttttgggatccagttgaaaatgcttcgtttatgccctggctttcaggaacagcttttttgcattctgctcttgttctggaaaagcgggaaacattaaaaagttggactttatttttggcacttcttactttttctctttctcttatgggaacttttcttgttcgttcaggtcttttagtatctgttcacagttttgccattgatccagcacgtgggcgggcaattcttgcacttttattctttttcaccggaggagctttttttctctttgctttgcgcgtacccgttttaaaagcaggtagattatttcggccaatttcacgtgaaggttttattgttttaaataatctcttgcttacaacaataacagcgacagtattgattggtacgctctatccttattttattgaggcattgactggaaaaaaaatttctgtaggtgccgctttttttaacattacctgtggtcctttaatgatattattgttgttgttggttccgtttggatcaatgatggtatggaaaagcggtgattttcttgcggtttttgaacggttgtggtttgtttgcgtattagcctgtgtagcctgttttataacgttttatgcaacatctttgcgtgatatttttgcagctttaggagtaggactttcagtttttgtttttttaggcagtttagctgatctttggaagaaaagtggacatcacaagttagctttgtcggtgcggtttaagagatttattggattgccatggtcagtttttggtgcagcaatggcacatatgggattagctgttacattgtttggtattgtctgtgttgcgacttttgctcaagagcgtattttaaccatgcacataggagatagggttacaatagcgggtaaaactatttgctttgacaaagtgcatgaaagcgccggtccgaattattctgcaatggagtttaattttacagtctatgaaaacaaacatgcagtccgcaacgtaatagcatcaaaacgtttctattcaagccagaacatatcaacaacagaagttggtattcaaaatcatggcttattatcccaattatatattgcaccgggccatatagatgatcaagggcttgttgtgcatctatggtggaagccttacgtgatttgtgtatggttaggggcaataatgatggctatgggggggtgtttttctctttttggttattggtttcgcattgggttgcatcgacggatagcttcccgcttcaagttttctgaaaaggctttgagatga

SEQ ID NO: 68005 - protein, 662 aa, Bartonella quintana str. Toulouse
MLVELGHIFLAAAFAVSLMQAFLPALGVWWEDHSLMRTAVPFTYITFTLLLLSFLIIVHAHMVSDFSVLNVVENSHSEKPMLYKITGVWGNHEGSMLLWVLSLAFFSTLMALFSQHLPEQFKTLILVCQSWIISAFLVFVLFLSNPFLRINPPALQGNDLNPLLQDIALAIHPPLLYLGSVGFSLCFSFAVAALVMGHVDGRWAHWVRPWLLLAWCFLTLGIMVGSYWAYYELGWGGYWFWDPVENASFMPWLSGTAFLHSALVLEKRETLKSWTLFLALLTFSLSLMGTFLVRSGLLVSVHSFAIDPARGRAILALLFFFTGGAFFLFALRVPVLKAGRLFRPISREGFIVLNNLLLTTITATVLIGTLYPYFIEALTGKKISVGAAFFNITCGPLMILLLLLVPFGSMMVWKSGDFLAVFERLWFVCVLACVACFITFYATSLRDIFAALGVGLSVFVFLGSLADLWKKSGHHKLALSVRFKRFIGLPWSVFGAAMAHMGLAVTLFGIVCVATFAQERILTMHIGDRVTIAGKTICFDKVHESAGPNYSAMEFNFTVYENKHAVRNVIASKRFYSSQNISTTEVGIQNHGLLSQLYIAPGHIDDQGLVVHLWWKPYVICVWLGAIMMAMGGCFSLFGYWFRIGLHRRIASRFKFSEKALR

SEQ ID NO: 68006 - DNA, 1986 bp, Bartonella henselae str. Houston-1
  CDS (1)..(1986): transl_table=11
gtgcttatcgaactggggcatctttttttatccgcagcttttgcagtgagtttattaggggcttttttacccgttttagtttttttgtggggagagcgttcattaatgcaaacagctgttcccctaacatatattacttttacattattattcttatcttttttgattattgttcatgcccatattgtttctgatttttctgttttgaatgtggttgagaactctcattcagaaaagccaatgctgtataaaattattggtgtttggggaaatcacgaaggatctatgttgttatgggttttaagtctcgctttttttagtacattggtggcgttgtttagccagcatttgccagaacagcttaaggcacttattttagtatgccaaagttggatgacaagcgcttttcttttatttattctttttatgtccaatccatttttacgtgttaatccacccgccttgcaaggaaaagatctcaatcctcttttacaggatatcgcgttagcaatacatccaccacttctttatttaggttatgttggtttttcactttgtttttcttttgcagtagctgcattgattatgggatatgtcgatagactttgggcgcgttgggttcgtccttggcttctacttgcttggtgttttttgacattgggtattatggttgggtcctattgggcttattatgagttaggatggggtggttattggttttgggatccagtagaaaatgtttcgtttatgccttggctttcaggaacagctcttttacattccgctctcgctcttgaaaaacggggaatattgaaaagttggactttatttttgtccattcttactttttccctttctcttatgggaacttttcttgttcgttctggtcttttaatatcagttcatagttttgctcttgatccagcacgaggacgagcaattcttgcacttttattgtttttcacgggaggggctttgtctctttttgctttgcgggtacctgctttgacaccgggaagattttttcagccaatttctcgtgaaggttttattattttaaataatttattgctcacaacaataacagcgacagtcttgattggtacgctctacccttattttattgagctgttaacagggcaaaaaatttctgtaggagcagatttttttaaccttacctgtgggcctttaatgatgttattgttattattggttccatttggatcaatgatagcgtggaaacgcggtgattttctcgcagtttttgaacggctgtgggttgtttttgcattagtcgctatagtttgttttatcacattttatgtagtttctttgcgtgatatttttgccattttaggaattggactttcaacttttgttttcttaggtagtttagctggtctttgggcgaagagcggacatcgcaaaatagctttattagcacggtttaaaagatttattggattaccatggtccgtttttggtgcagcaatagcgcatatgggattaggtgttacattgtttggtattatctatgtcgcaacttttgggcaagagcgtattctcatcatgcataaaggagatatggtaacgatagcagataaaactcttcatttgaatgaagtgcatgatgaaactggcccgaattattcagcaatagagtttcattttacaatatatgaaaataaaaatacggtgggtaatgtaacagcatcaaagcggttttatccaagtcaaaatacatcaacaacggaagttggtattcaaaatcatggtttatctcagctctatattgttccaggacggatagatgaacgagggcttgttttacatatatggtggaagccttacataatatgtgtttggttaggggcattgatgatggctatgggcggatgtttctctctttttagttattggtttcgcattagagtgcatcaacggagagtctcccgctttaaattttctgaaaaggcattgagatga

SEQ ID NO: 68007 - protein, 661 aa, Bartonella henselae str. Houston-1
MLIELGHLFLSAAFAVSLLGAFLPVLVFLWGERSLMQTAVPLTYITFTLLFLSFLIIVHAHIVSDFSVLNVVENSHSEKPMLYKIIGVWGNHEGSMLLWVLSLAFFSTLVALFSQHLPEQLKALILVCQSWMTSAFLLFILFMSNPFLRVNPPALQGKDLNPLLQDIALAIHPPLLYLGYVGFSLCFSFAVAALIMGYVDRLWARWVRPWLLLAWCFLTLGIMVGSYWAYYELGWGGYWFWDPVENVSFMPWLSGTALLHSALALEKRGILKSWTLFLSILTFSLSLMGTFLVRSGLLISVHSFALDPARGRAILALLLFFTGGALSLFALRVPALTPGRFFQPISREGFIILNNLLLTTITATVLIGTLYPYFIELLTGQKISVGADFFNLTCGPLMMLLLLLVPFGSMIAWKRGDFLAVFERLWVVFALVAIVCFITFYVVSLRDIFAILGIGLSTFVFLGSLAGLWAKSGHRKIALLARFKRFIGLPWSVFGAAIAHMGLGVTLFGIIYVATFGQERILIMHKGDMVTIADKTLHLNEVHDETGPNYSAIEFHFTIYENKNTVGNVTASKRFYPSQNTSTTEVGIQNHGLSQLYIVPGRIDERGLVLHIWWKPYIICVWLGALMMAMGGCFSLFSYWFRIRVHQRRVSRFKFSEKALR

SEQ ID NO: 68008 - DNA, 1878 bp, Erwinia carotovora subsp. atroseptica SCRI1043
  CDS (1)..(1878)
ttgatgttgttattgccagagtttgggtatgtgtcgctgttactggcggtttgcgtcggtgtggcaacagcattgctgacattttcaggctacaccctgcgctggtcgggcacttaccgactggcgcggtgctggacgctggtgctgtttggtctcgtgctgttcgcgtttgtcgcgctgacgttgagcgtggtgcaggatgatttttctgttaattacgtcgctcagcatagccaccgtgatttaccgctggggctcaaaattgcggcggtctggggcgggcatgaaggttcgctgctgctgtggctcttgtgtttatccggctggagcgccacatttgcctgccgctatcgcaaggcgatgagcgatctgttcccgctgacgctggcgatgctcgcggtgattgcgaccgcattgctggtattcattgtgtttttttccgatccttttgtgcgcctcttcccgcctgcggtggcggggagggatctcaacccgatgttgcaacatattggcctcattctccatccaccgttgctctatctaggctatggcggcttaaccgtgagtgcggcactggcgttagctgccctgattcacggcgagtttactgcaccagccgcctggatttgctggcgttggacgctgcccgcctggagcctgttgacgctgggaatcattttgggatcgtggtgggcttataacgagctgggctggggaggatggtggttctgggatccggtagagaacgcctcgttgcttccgtggttaacggctagcgcattgcttcacagtctgtctgtcactcgaatgcgcggtatcttccgccattggtcgctgatattggcgctgttgacgttcattttatgcctgctggggacgctgattgttcgttccggaatactggtttctgtccatgcctttgccctcgaacatgatcgcgcggtacctttatttatcttgtttgcctgcttaagcatggctgcgctggctgtttatggctggcgtgctcagcttgtccattccgcagcccgcttctctggctggtcacgggaaatggcaatactgctggttttgttgctattcagtgccgtcgcgctggtggtactactcggtacgctttatccgatgatttatggactagcgggctgggggaaaatctcagtaggcgcaccctattttaaccgcgtgctcttgccctttgctggcttgatgctgttgctcattggcgttgcggcgggaggctactggaaacgcagtacgcggtggcctgtctggcacttaggcgtgacgctggcagtcggtgtcgtcaccgctctggtcttatggccgtatggatacgatgtggcgctggcttccggtctgatcggctgggtgatggctgcgcagtggctacagccgctgttggcgctacgccagcagcttccagcgctgttagcacatacgggcgtggtgctgtttgccttggggattgcgttctctgcggggagcaagcaggaaattagcgccaatgtgggtcagggagaacaggtcacgctgggtgactatcaatttcattttttacagctggatttagtggcggcgcagaattacaccgcagagcaggccgtgattgcgatttatcgtggcgactcgccgatcgcccgcgtcatcccagaacggcgttattacaatgcacgcaaacagcagatgattgaaccgggtattgcctggggaccaatcagagaatggtatgccgtgatgggagaaaaaaccggcgaaaaccgctatgcgatgcgtttctatgtgcaaaccggtgttcgctgggtgtggggcggcggcatgctaatggttgcgggcgcactgctgggatggttccgagggagaagggtctatgactaa

SEQ ID NO: 68009 - protein, 625 aa, Erwinia carotovora subsp. atroseptica SCRI1043
MMLLLPEFGYVSLLLAVCVGVATALLTFSGYTLRWSGTYRLARCWTLVLFGLVLFAFVALTLSVVQDDFSVNYVAQHSHRDLPLGLKIAAVWGGHEGSLLLWLLCLSGWSATFACRYRKAMSDLFPLTLAMLAVIATALLVFIVFFSDPFVRLFPPAVAGRDLNPMLQHIGLILHPPLLYLGYGGLTVSAALALAALIHGEFTAPAAWICWRWTLPAWSLLTLGIILGSWWAYNELGWGGWWFWDPVENASLLPWLTASALLHSLSVTRMRGIFRHWSLILALLTFILCLLGTLIVRSGILVSVHAFALEHDRAVPLFILFACLSMAALAVYGWRAQLVHSAARFSGWSREMAILLVLLLFSAVALVVLLGTLYPMIYGLAGWGKISVGAPYFNRVLLPFAGLMLLLIGVAAGGYWKRSTRWPVWHLGVTLAVGVVTALVLWPYGYDVALASGLIGWVMAAQWLQPLLALRQQLPALLAHTGVVLFALGIAFSAGSKQEISANVGQGEQVTLGDYQFHFLQLDLVAAQNYTAEQAVIAIYRGDSPIARVIPERRYYNARKQQMIEPGIAWGPIREWYAVMGEKTGENRYAMRFYVQTGVRWVWGGGMLMVAGALLGWFRGRRVYD

SEQ ID NO: 68010 - DNA, 1956 bp, Erwinia carotovora subsp. atroseptica SCRI1043
  CDS (1)..(1956)
atgatgcctgaagtgggcaattatctgctctgtctggcgctgggcgttgcactgctgctcagcgtgtatccgctgtggggagcatcgcgtcaggatgaacgcctaatggcgctggcgcgtccacttgcctgggcgctgtttgcatgcattttggcttccttcctcgtgttggtacacgcgctggtgatcaatgatttcaccgtcctctatgtagcaaataactcgaaccgtgcgctgccagtctggtatcgcgtggcggcggcgtggggcgcacatgaaggatcgctgctgctctgggttctgctgatgagcggttggaccttcgccgtggcggtcttcagccgagggatgtcgctggatgcagtagcccgggtattagccgtcatgggaatgattaatgtcggcttcttattgttcattattctgacgtcgaatccctttacgcgcacgctgccggactacccaattgacgggcgcgatctcaatccgctgctgcaggatgtcgggttaatcttccaccctccgctgctttacatgggttatgtcggtttttccgtggcgtttgcgtttgcggttgcctcgctgctggctgaacggctggacagcgcgtgggcacgttggtctcgaccgtggacgcaggcggcctggtcgttcctgacgttgggtatcgtgctcggctctggttgggcgtattacgaactcggctggggcggttggtggttctgggatccggtagaaaatgcctcactgatgccgtggctggtgggcacggcgctgctgcattcgctgtcggtcaccgaaaaacgcggcagctttaaagcctggacggtgttgttggctatcggcgcgttctcgctctgcctgttgggtacctttctggtgcgttctggcgtactggtgtcggtgcatgcatttgcctccgatccggcgcgtgggatgtttattctcgcatttctggtcattgtcatcggcggttcattgctgctgttcgccatcaaaggcaacagagtacgggcacgggtgacgaattcgctctggtcgcgtgagacgttcctgctcggcaataacctgatcctgatggctgccacgctcgtggtgctgctgggaacgctgctgccgttggtgcataagcaattgggtttgggcagcatttccattggcgcaccgttcttcaacaccatgtttaccctgttaatgtcgccttttgctctgctgttgggcgtggggccactggttcgttggcggcgcgatgagccgcaaaagctgcgtaagctgctgctggttgcgctggctgtgaccgccgcgctgtcgctgctgcttccgtggttgttgcaggactcgctggttgccatgacggtagtcggcttgtcgatggcgctgtgggtatttttcttaacggtgtacgacctgcatgccaattctactcgacgtcatggcctgctgcgcggtttgaccacactctcactgagccagtggggcatggtgtgcggtcatattgggctggcggtgacggtggtgggcatcgccttcagtcagaattatagcgtcgagcgtgatgtgcggatgcgggcaggcgacagcatccagatccatgattatcggtttacgtttcaaggtgtgcagaatgttgtggggcctaactggcacagcggtaaagggacgattgaggtcacgcgtaacggcaagccggaggcgatcctgaaagcggaaaaacgcttctataacaccagcggcgcggtcatgacggaagctgctattgatgcgggtgtgacgcgcgatctctatgcggccttgggcgaacaattagatgacgatagctgggcggtacggctgtattacaaaccctttattcgctggatttggtatggcggggggctgatggcgttaggtggcattctgtgcatgtttgaccctcgctatcgcctgcgtcgggccgttagggagacatcagcatga

SEQ ID NO: 68011 - protein, 651 aa, Erwinia carotovora subsp. atroseptica SCRI1043
MMPEVGNYLLCLALGVALLLSVYPLWGASRQDERLMALARPLAWALFACILASFLVLVHALVINDFTVLYVANNSNRALPVWYRVAAAWGAHEGSLLLWVLLMSGWTFAVAVFSRGMSLDAVARVLAVMGMINVGFLLFIILTSNPFTRTLPDYPIDGRDLNPLLQDVGLIFHPPLLYMGYVGFSVAFAFAVASLLAERLDSAWARWSRPWTQAAWSFLTLGIVLGSGWAYYELGWGGWWFWDPVENASLMPWLVGTALLHSLSVTEKRGSFKAWTVLLAIGAFSLCLLGTFLVRSGVLVSVHAFASDPARGMFILAFLVIVIGGSLLLFAIKGNRVRARVTNSLWSRETFLLGNNLILMAATLVVLLGTLLPLVHKQLGLGSISIGAPFFNTMFTLLMSPFALLLGVGPLVRWRRDEPQKLRKLLLVALAVTAALSLLLPWLLQDSLVAMTVVGLSMALWVFFLTVYDLHANSTRRHGLLRGLTTLSLSQWGMVCGHIGLAVTVVGIAFSQNYSVERDVRMRAGDSIQIHDYRFTFQGVQNVVGPNWHSGKGTIEVTRNGKPEAILKAEKRFYNTSGAVMTEAAIDAGVTRDLYAALGEQLDDDSWAVRLYYKPFIRWIWYGGGLMALGGILCMFDPRYRLRRAVRETSA

SEQ ID NO: 68012 - DNA, 1947 bp, Mannheimia succiniciproducens MBEL55E
  CDS (1)..(1947): transl_table=11
atgattgcggaattaggtaattttgcgttagccctcggcttagctatttctgttttattagcggtttttccgttatggggagccgaaaaagggaataaacaattgatgtcattggcacgcccaatgacttatgggttatttatttgtttaacttttgcattcggcgctttgttttatgcctttgcggtcaatgatttttctattcagtatgtcgtaaataactctaatagccgcttgccgttgcaatatcggttatccgcagtgtggggggctcacgagggttcgttattactatggatttggttgttatcggtctggagtgtcgctgtttcattatttagccgacaactgccacaagaagcggtagcgcgggttcttggcattatggggttagtgactattgggtttttaatctttattttgttcacgtctaacccttttgcgcgtacattccctaatttgccgattgacggtaaagagcttaatccaatgttgcaggatgtaggtttgatttttcatccgccgctgctttacatgggttatgtaggattctccgtcgcgtttgctttttcaatcgcctcattaatgacaggaaaattagacaccgcatgggcgcgttggtctcgtccctggacaatggcggcttgggtgtttttaaccgtaggtatcgtacttggttcctggtgggcttattacgaacttggctggggcggctggtggttctgggatccggtagaaaattcatccttaatgccttggcttgccggcaccgcgttattgcattctttagcagtgaccgagaaacggggagcgttcaaagcctggacggtactgcttgccattcttgccttttcgctttgcttattaggtacttttttagtgcgttcgggcgtgttggtttctgtacatgcttttgcttccgatcctacgcgcggtttatatattttggcctatttgattgttgtgattggcggttcattaactctgtatgcttacaaaggggggcaaattcgttcccgtgataatgccgagcgctattcgcgcgagtctatgttgctgttaaataatattttattaatggcggcattggttgtagtgctgttgggtacattattgccgttagttcataagcagttgggattaggttcgatttccatcggtgcaccgttttttaatcaaatgtttttggttttaatgacgccgttcgctttgttattaggcatcgggcctttagttaaatggcgtcgggataaattttccgctatccgtaagccggttattatcagtttgtttttgatgattattctaggttttgcgttgccttactttatcggcaataaattatccctaagtgcggtacttggtacgatgatggtggtgattattactctgctaagcttgtatgaactgaaacaacgcgccgcccatcgggacaacttcttaataggcattactaaattatcacgttctcattggggaatgtttttagctcatttaggcgttgccatgactgtttggggcgtgactttcagccaaaactttagtgttgagcgtgacgtaagaatgtcagtcggcgattccgtgaacattgccggttatgaatataaattccaaggcatacgggatgcaaacggaccgaactatttaggcggcacggcacaagtggatattttaaaagagggtaaacttgaaggttctttatttgccgaaaaacggttctatacggtaagccgcatgacaatgacggaagccgccatcgattggggatttacccgtgatctgtatgtggcgttaggcgagcagttagaggataaatcctgggcaatgcgtctatattacaaaccttttatccgttggatttggtttggcggcgtctttatggctctagggggggtactctgtatgttcgatcgtcgttaccgtttttctaaaattttaaataaatag

SEQ ID NO: 68013 - protein, 648 aa, Mannheimia succiniciproducens MBEL55E
MIAELGNFALALGLAISVLLAVFPLWGAEKGNKQLMSLARPMTYGLFICLTFAFGALFYAFAVNDFSIQYVVNNSNSRLPLQYRLSAVWGAHEGSLLLWIWLLSVWSVAVSLFSRQLPQEAVARVLGIMGLVTIGFLIFILFTSNPFARTFPNLPIDGKELNPMLQDVGLIFHPPLLYMGYVGFSVAFAFSIASLMTGKLDTAWARWSRPWTMAAWVFLTVGIVLGSWWAYYELGWGGWWFWDPVENSSLMPWLAGTALLHSLAVTEKRGAFKAWTVLLAILAFSLCLLGTFLVRSGVLVSVHAFASDPTRGLYILAYLIVVIGGSLTLYAYKGGQIRSRDNAERYSRESMLLLNNILLMAALVVVLLGTLLPLVHKQLGLGSISIGAPFFNQMFLVLMTPFALLLGIGPLVKWRRDKFSAIRKPVIISLFLMIILGFALPYFIGNKLSLSAVLGTMMVVIITLLSLYELKQRAAHRDNFLIGITKLSRSHWGMFLAHLGVAMTVWGVTFSQNFSVERDVRMSVGDSVNIAGYEYKFQGIRDANGPNYLGGTAQVDILKEGKLEGSLFAEKRFYTVSRMTMTEAAIDWGFTRDLYVALGEQLEDKSWAMRLYYKPFIRWIWFGGVFMALGGVLCMFDRRYRFSKILNK

SEQ ID NO: 68014 - DNA, 1935 bp, Mannheimia succiniciproducens MBEL55E
  CDS (1)..(1935): transl_table=11
atgatcccagaactcggctttattgcattgcttattgcattactttcttctttcttgcttacgttaattccgcttgtaggtatgataaaacgcaatacgaatttactgagttatgcctggaatttcagttatctgtttgccattttcagcacgatttccattgcctgtttagcctattctttttcggttaatgatttttcggtggaatatgtcgccgcccattcgaattcacagcttcctctgttttttaaaattgccgcgacctggggcgggcatgaaggctccatgttattctggctgttttcattaagtttatggactgccgcttttgcttttttcagtcgaaaaattgatcctgttttttcagcgcggaccctttctattctcggttttatttgtttgagttttgctatttttattctgtttttttccaaccctttcattcgtcagttccctttaccgccggaagggcgggatcttaatccgatgttgcaagatatcggtctgattattcatccgccgctgctttatttgggttatgtggggttcgcggtaaattttgctatgactttatccgtcatgctaagcggacatgttgatgccgctatcgcacgctggacaagaatttgggtattgttatcatggttcttcttaactttaggcattatgctcggtgcatggtgggcatattacgaactcggctggggcggctggtggttctgggatccggtggaaaacgcctcgttgatgccttggttaatcggtctggcgttattgcacagcctgatagttaccgaacaacgcgggattttcagctattggacgatacttttttcattatttgcctttgctttcagcctgcttggcacctttatcgtgcgttccggcgtattaacttcggttcacgcttttgccgtggacggcgaacgggggactgcattattacttattttcttcctgttaacggcgttggcattaaccgttttcgcccttaaagtcaatttgcgtcaaagtgcggtccgtttttccgttttttcgaaagaaagctttttgttgttggctaatgtagttctcactattgccactgtcagcgtgtttttaggaactttttatccaatggtattttcggcgatgggctggggttctatttccgtcggtgcgccgtattttaatagcatttttgtgcctttgttgctgattatgcttattgcgatggttttcgtattagctacaaaatggcaaaaaatgaaccgcactttattgcggcaaaaatcaatattgcttatccccgcccttctgattgcatatttgattattcatttcaccgttcggcaggatgaaagtctgcgctttcatttttccgcatttgtgctgcttagtttggcaatttggctgttgcttgcaactttatggataaattggcgaaaaatagggttgcggcggtcaggcatgatccttgctcattgcggtgttgcttttgcggtgattggtgcggtgatgtccggttatttcggcagtgaaatcggcgtacgtttagcgccgcaacagagccaaatgttaaacggttatgagttccgctatataggctttactaatgagctaggtcctaactttacttcggaaaaagcgcattttgaaatttataaaaataaccaaaaactgaccgcactttatccggaacgccgttattatgaggtacgaactatgaatatgtcggaagtgggtattcaatggggcgttttaggcgatatttatattgtcatgggagataagctggcgccgaatgagttcagttttcgcctgcattacaaaccttttgtccgctggttatggctgggtggaattttaatggcattaggcgctttagtagccgccgttagcctggttcaacggaaaaacgccatggcgttttcatcggcaattaaaaaagaataa

SEQ ID NO: 68015 - protein, 644 aa, Mannheimia succiniciproducens MBEL55E
MIPELGFIALLIALLSSFLLTLIPLVGMIKRNTNLLSYAWNFSYLFAIFSTISIACLAYSFSVNDFSVEYVAAHSNSQLPLFFKIAATWGGHEGSMLFWLFSLSLWTAAFAFFSRKIDPVFSARTLSILGFICLSFAIFILFFSNPFIRQFPLPPEGRDLNPMLQDIGLIIHPPLLYLGYVGFAVNFAMTLSVMLSGHVDAAIARWTRIWVLLSWFFLTLGIMLGAWWAYYELGWGGWWFWDPVENASLMPWLIGLALLHSLIVTEQRGIFSYWTILFSLFAFAFSLLGTFIVRSGVLTSVHAFAVDGERGTALLLIFFLLTALALTVFALKVNLRQSAVRFSVFSKESFLLLANVVLTIATVSVFLGTFYPMVFSAMGWGSISVGAPYFNSIFVPLLLIMLIAMVFVLATKWQKMNRTLLRQKSILLIPALLIAYLIIHFTVRQDESLRFHFSAFVLLSLAIWLLLATLWINWRKIGLRRSGMILAHCGVAFAVIGAVMSGYFGSEIGVRLAPQQSQMLNGYEFRYIGFTNELGPNFTSEKAHFEIYKNNQKLTALYPERRYYEVRTMNMSEVGIQWGVLGDIYIVMGDKLAPNEFSFRLHYKPFVRWLWLGGILMALGALVAAVSLVQRKNAMAFSSAIKKE

SEQ ID NO: 68016 - DNA, 1953 bp, Legionella pneumophila subsp. pneumophila str. Philadelphia 1
  CDS (1)..(1953): transl_table=11
atgatagcggaattagggctgttttttttggttttggctttagtggcttctttgatgttagctttgatcccattggcgggtttgcaattcaatcggaaagactggattgattcctccaggaattatgtcgtgctgcaatttttatttgtggcatgtgcttacctatgtctcacggcctgttttttgatggatgatttttcggtgatctatgtgctgaataattccagcttattgctcccatggttttataaattttgtgctgtgtggggtgggcatgaaggttccatgctgttatgggtcgctatccttagtttttggatgatcctggtttgtttttttagctcaagccttgatacggaaatgcgcgctcgggtattagttattttaggttggctaagtattggttttattctttttttgttaatgacttccaatcctttcttgcgccaatttcaagtattgaatacacagggccgtgatctgaatccattgctgcaagatcctggctttttattccatcctcctatgttgtacatgggatatgtagggttttgtgtcgcttttgcttttgctattgccgctttatgggcagggaaagtagaaaccagttggtctaaatggaccagaccctggactctggctgcctggtgttgtttaaccgcgggaattactttaggcagttggtgggcttatagagaattaggctggggtggttggtggttttgggatcctgtagaaaacgcttcttttatgccctggctggttggtacggcactattgcattctttggcagttacagagcaacgccagcaatttaaagcgtggaccatgttgcttgcaatcgctgctttttctttaagtttaattggtacttttcttgttcgctctggagttttaacttcagttcatgcctttgcggttgatcctcagcggggattatatattctgggatttttgttattcgtcattgggggttctttaacattgtttcttttcagagcccaaaccttgcaagtcaataaacatcctggcttattatcccgagaaagtgcgttgttgttaaacaatgtgtttttagtggttattatgctgacggtattaatgggcacggtttatccattgctggtggaagggttagggttaggtaaattatccgttggagcgccctattttaatgcagtatttgttccattaatgattcctttattgttgctaatggggttaggtgtccgtttgaaatggcagaatgattgttggagggatgtcttcagaaagctaaatcgtatttttttgcttagtctgatattgcctgtcattttactattctgtacctcaactgaaatacaccttacagcccttttgggattaattttggcattctgggttttgttgagtactgctaatgcggcgtatcacaaagtcagggatagaggggtggcaggagttggacaggcttattgggggatggttttggctcattgtggtgtcgcagcaacagtgattggcattgctgtttcttcagcttatggcgtacaagatgatgtacgtatgtctcctggcaagcaagtgaatctgctggattatcagattggattcattaatcagactccgttgaatggcccaaattacaaagggacaagggctgagttttcaatacaatatcagaataaaaccaggaaaatttttcctgaaaaaagagtgtataccattggacaaatgccaatgactgagtctgcgattgatgttactcctttccgagatatttacattgctttgggggaaccactgtctgaggatgcctggtcggtacgtatttattataaaccgttggtccgctggatttgggctggcggatttatgattttagccggaggcgttttggcattaacagatagaaggtattacagaaaaaggcaagtaacggtaatgtcagtgcgggagatcaagatatga

SEQ ID NO: 68017 - protein, 650 aa, Legionella pneumophila subsp. pneumophila str. Philadelphia 1
MIAELGLFFLVLALVASLMLALIPLAGLQFNRKDWIDSSRNYVVLQFLFVACAYLCLTACFLMDDFSVIYVLNNSSLLLPWFYKFCAVWGGHEGSMLLWVAILSFWMILVCFFSSSLDTEMRARVLVILGWLSIGFILFLLMTSNPFLRQFQVLNTQGRDLNPLLQDPGFLFHPPMLYMGYVGFCVAFAFAIAALWAGKVETSWSKWTRPWTLAAWCCLTAGITLGSWWAYRELGWGGWWFWDPVENASFMPWLVGTALLHSLAVTEQRQQFKAWTMLLAIAAFSLSLIGTFLVRSGVLTSVHAFAVDPQRGLYILGFLLFVIGGSLTLFLFRAQTLQVNKHPGLLSRESALLLNNVFLVVIMLTVLMGTVYPLLVEGLGLGKLSVGAPYFNAVFVPLMIPLLLLMGLGVRLKWQNDCWRDVFRKLNRIFLLSLILPVILLFCTSTEIHLTALLGLILAFWVLLSTANAAYHKVRDRGVAGVGQAYWGMVLAHCGVAATVIGIAVSSAYGVQDDVRMSPGKQVNLLDYQIGFINQTPLNGPNYKGTRAEFSIQYQNKTRKIFPEKRVYTIGQMPMTESAIDVTPFRDIYIALGEPLSEDAWSVRIYYKPLVRWIWAGGFMILAGGVLALTDRRYYRKRQVTVMSVREIKI

SEQ ID NO: 68018 - DNA, 1974 bp, Methylococcus capsulatus str. Bath
  CDS (1)..(1974): transl_table=11
atgatcgccgaactcggccacatcgccctgatcatggccctcctgatggccctcctgcagggcgccttcccgctgatgggcgcctcccagggcgtggacatctggatgagcgtcgccaagccggccggccgcgcgcagttcctgtttctgctggtatccttcggcgccctcaccgcctgcttcgtcaacaacgatttttcggtggaatacgtcgcccgcaactcgaactcggccctgccgctctactatcgcatcgccgcggtatggggctcacatgaggggtcgatgctgctgtgggccacgatcctgggtctctggacagcggcggtgacggtgttcagccgcagcctgtcggaagactttctggcccgggtgctgggcatcatggggctggtgagcgtcggcatcctgctgttcatcctgttcacctcgaacccgttcgagcggctgacaccggtgccgcccgacggcaacgacctgaatccgctgctgcaggatttcggcatgacggtgcatccgcccatgctgtacatgggctatgtgggactgagcgtagccttcgccttcgccatcgccgccctgctgggcggctcgctggactcggcatgggcgcgctggtcacggccctggaccctggtggcctggctgttcctgaccggcggcatcaccctcggctcatggtgggcctattacgaactgggctggggcggctggtggttctgggacccggtggaaaacgcctccttcatgccctggctggtcgccaccgcacttatccactcgctggccgtcaccgagaagcgcggcgccttcaaggcctggaccgtgctgctggcgatcttcgccttttcgctgagcctgctgggcaccttcctggtacgttccggcgtgctgacctccgtgcatgccttcgcttccgaccccacccgcggcctgttcatcctgatcctgctggccatcgtggtgggcggttcgctgctggtttacaccgtgaaggcgccggccgtgcgcgatgtggcgcgctatagcctggtgtccaaggaaaacctgctgctgctcaacaacatcctgctggtgaccgcctccggcagtatcctgctcggcaccctttatccgctgatcctggacgcgctgaagctgggcaagatttcggtcggcccgccgtatttcggcacggtgttcgctccgctgatggcgccgatcttcctgctcgccggtatcgggccgatgttcgcctggcgggagagcccgatcggccgcatcctgcaccgggtccgctatctgttcccggcgagcttcgcggccggcatcgcgctcgccgccctggcctgggacgagaccgacttcaagatgatggccgggctgggctgcgcgttctggctggcggcgagcgcctgcctcagcctgtggagccggatccggctgcgcgacggctggctcgaaggactgcgcgcccagtcgcccagcgtctacgggatgaccgccgcgcatctcggcgtcgcggtgttcctggtgggcgccgtgctgtccgaccgcctgagtcaggaaaagctggtacgcatggcgcctggcgacagcgtgatgctggccggctacgccttccacttcctcggcacggagaccgtgcaggggccgaacttctcggcccagcaggccaccttccgggtggagcgggacggcgaaagcctggaacttcggccccagaagcggaactacaaggtgcagcgcaacatgatgaccgaagctgcgatagaccccggtctgtcccgcgatctctatgtcgccctcggcgagccactggacgggaacgcctggagcgtgcggctctacgtcaaaccgttcatccgctggatctgggccggcggcctgttcatgatcgccgggggcatcctgtccgtcagcgaccgacgctaccgcctgccgctgcctgaaacccgcgcagttgccggacgcgccgcgtcccgtgcaatttga

SEQ ID NO: 68019 - protein, 657 aa, Methylococcus capsulatus str. Bath
MIAELGHIALIMALLMALLQGAFPLMGASQGVDIWMSVAKPAGRAQFLFLLVSFGALTACFVNNDFSVEYVARNSNSALPLYYRIAAVWGSHEGSMLLWATILGLWTAAVTVFSRSLSEDFLARVLGIMGLVSVGILLFILFTSNPFERLTPVPPDGNDLNPLLQDFGMTVHPPMLYMGYVGLSVAFAFAIAALLGGSLDSAWARWSRPWTLVAWLFLTGGITLGSWWAYYELGWGGWWFWDPVENASFMPWLVATALIHSLAVTEKRGAFKAWTVLLAIFAFSLSLLGTFLVRSGVLTSVHAFASDPTRGLFILILLAIVVGGSLLVYTVKAPAVRDVARYSLVSKENLLLLNNILLVTASGSILLGTLYPLILDALKLGKISVGPPYFGTVFAPLMAPIFLLAGIGPMFAWRESPIGRILHRVRYLFPASFAAGIALAALAWDETDFKMMAGLGCAFWLAASACLSLWSRIRLRDGWLEGLRAQSPSVYGMTAAHLGVAVFLVGAVLSDRLSQEKLVRMAPGDSVMLAGYAFHFLGTETVQGPNFSAQQATFRVERDGESLELRPQKRNYKVQRNMMTEAAIDPGLSRDLYVALGEPLDGNAWSVRLYVKPFIRWIWAGGLFMIAGGILSVSDRRYRLPLPETRAVAGRAASRAI

SEQ ID NO: 68020 - DNA, 2049 bp, Photobacterium profundum SS9
  CDS (1)..(2049): transl_table=11
atgatcccagaagttggacattatgcattaatacttgggtgtgtattcgctgtattaggcggaacaatcccgttgtatggtcttataaaaaaagacccatatcttatccgctatgcgtggccgttaagctatggtgcttttttcgctatctcatcttcaatcgtattacttggctatagctttgctgttgatgatttttcggtggtgtatatcgcgcagcattctaattctcagcttcctcaagtgtttaaaattgccgctgtatggggcgggcatgaagggtcatttttattttggttattttcacttgcaggctggagcgctgctgttgcatttgtctatcagtacaaagccccttcaggcgttaatcaaccagaaaaacaagtgcagcatgaagcttttatcgggcgggtgttggttgttctttctctgttaattgccgcatttagtttatttacgttattcacctcgaatccttttttacgcttattgccaataccgatggaagggagagatttaaacccaatgttgcaagatgtggggctaatttttcatcctcctatgttgtatctcggttatgtcggttttgcggtgagcttcgcattcgccattgctgcgttaacaacgtctgcatcgtctgaactgccttgggcggggtggagtcgtccttgggcattgagtgcatgggtgtttctaactggtggtatctcactgggttcttggtgggcatattatgaactgggttggggaggctggtggttttgggatcctgtcgaaaatgcttctctaatgccttggttaacgggtaccgctttactgcattctttgataatgactgaaaagcgaaatgcattaaccagttggacgatactgctgtcgatctttaccttctcgttaagcttactcggcacatttatcgttcgttcaggcgtactaacttctgtgcacgcgtttgctgttgatccaacccgtggtgttgcattgctaagtattcttggcgtggtgctactgagttctttgacgttgtttgctttaaggggcggtcaatatattaaacccgtccggtttggattcttatcgcgtgaagctgcgttattggcgggtaacagtttatttgccgttgcgacgcttactattttacttggcacgttttatccaatgatattccaagcatttgggttgggaaatatttcagtaggagccccgtattttaatagcttgttcgtgccattaagtttcgtgatttttgcagttatgggcttagcaccattgataaaatggaaaaatgcgacatcagataatttcatcatgcgtattattgccccactgtctgcttctgtggtcattggtgttgcactatccgtgatgtttgaacgagggattaacctcgtagtttgcgtcgcctttattatggcattatgggttacgctaacgtcattacaagtgttttatattgttcaaaaatcgcgtaagcattggaaatttgatagccaatgttgccgccagttcgcgatggtgaccgcgcatattggtgtggctgttgcgcttgtgggggcaacgctagtcagttattacgttgaagaaactaataatagaatggggccgggtagccaattagttctgggtgattaccagtttgattaccaagaaacggagttattaattggccctaattacactgcagaacaagccaatattgcagtaacacgaattaatggcgttgataaaaatgcggaacgtattggtgttattaagccacagcgtcggcattacacggtgcgaacaatgaatatgagtgagccgggtattcattggttttggaaaggtgatatttacataacgctgggcgacaaaatcaataagacagattacgcggtacgtattcaatataagccttatgttcgttggttatggatcggtagcttgttgatgatgttgggcggtattatggcagtgcttgcccgtattagaatcatggtgatgaccaagaagcagcagcgccaatgtcaaaaggcaaaactcacatcaacaattatcatgtggaagtag

SEQ ID NO: 68021 - protein, 682 aa, Photobacterium profundum SS9
MIPEVGHYALILGCVFAVLGGTIPLYGLIKKDPYLIRYAWPLSYGAFFAISSSIVLLGYSFAVDDFSVVYIAQHSNSQLPQVFKIAAVWGGHEGSFLFWLFSLAGWSAAVAFVYQYKAPSGVNQPEKQVQHEAFIGRVLVVLSLLIAAFSLFTLFTSNPFLRLLPIPMEGRDLNPMLQDVGLIFHPPMLYLGYVGFAVSFAFAIAALTTSASSELPWAGWSRPWALSAWVFLTGGISLGSWWAYYELGWGGWWFWDPVENASLMPWLTGTALLHSLIMTEKRNALTSWTILLSIFTFSLSLLGTFIVRSGVLTSVHAFAVDPTRGVALLSILGVVLLSSLTLFALRGGQYIKPVRFGFLSREAALLAGNSLFAVATLTILLGTFYPMIFQAFGLGNISVGAPYFNSLFVPLSFVIFAVMGLAPLIKWKNATSDNFIMRIIAPLSASVVIGVALSVMFERGINLVVCVAFIMALWVTLTSLQVFYIVQKSRKHWKFDSQCCRQFAMVTAHIGVAVALVGATLVSYYVEETNNRMGPGSQLVLGDYQFDYQETELLIGPNYTAEQANIAVTRINGVDKNAERIGVIKPQRRHYTVRTMNMSEPGIHWFWKGDIYITLGDKINKTDYAVRIQYKPYVRWLWIGSLLMMLGGIMAVLARIRIMVMTKKQQRQCQKAKLTSTIIMWK

SEQ ID NO: 68022 - DNA, 2367 bp, Haloarcula marismortui ATCC 43049
  CDS (1)..(2367): transl_table=11
atgacaacagtcgtattcgggctagcagtcgggacctggctgctggcaatcggcctgttcggaagcgtgcttgccacggcgctactcggctacgagtacgtgaccggcgacgagtcgttccttcgcgtcagcaaggctgccgcgggcgtcgcgacggggtcgttcgttatcgcactgctatacctgacttcgcagtttctcagtggggattacaccaacgcgtatgtctgggacaacactgcaaattacctcccgacgctgtacaaagtcacaggagtgtacgcgtccaacgcgggatcgatactgctgtgggcgatgctcacggctgttgtcgtcacgacgaccttgcttctgggccggtacagcacacgcggcgcacgtctctcgcaatcccttgggatgggcgttgtcaccgtgttcgcctggatgctagtcaacgacagcccgtttactcccctgtcggcagagtacccgtcggtcgcggctaacgggattccacaggacggcagcgggctgaacccgctactggtcgacccgttcatggcaatccacccgccgataacgttctcggcgtacgcgctcatggtggttcccttcaccgttggcgtgacccacttcgtcgccaaactccgggggacggagagcatgttcgacgactggctgggcagcatgacgcgctggctccgggggtcgtggctcctgctgactgccgcgatcacgctcggcggcatctgggcgtatcgagtcctcggctggggtggcttctggtcgtgggacccagtcgaaacgtcagtgctcatcccgtggctcggactgaccgccgtgttgcatacgctcaaccagtaccggcgctccggccggtacgcagtactcgcgccggccgccacggcggcgttgctcccgctcgtcatctacgcgacgaccgtggtccggagcggcgtcttccggagcgtccactcgttcgccggcgggggcatcgggagcggcgtcctgttcctcctcggaacgacgagcacgctggcggtcggtcccgcgttcatccactggttcaggactgagcaaagcgacgccgaagaagcgagcctgctcgaccgggcgacaatctaccacgctgccgtgctcgggttcatcctgcttgcgttcgtctcgctctggggcctcacgttccccgtggttcgcagcctcgcttcaggtgtcgaagtcagcgtcgacgcgcggtactacaacctctggagcttcccggtcgtcgtcgggatgctccttgccggagggatgtacgcacaacaagagcgcttcagtacgcgagcgacagtcgtgaccgccgctacagtgctcatcgccgccctcgccgttggtttcgtgctggcacgacctgagtggcagctggcgtcgactgagccgttcgacccggtgtattaccgcgccatcgggagcctcagtgtggtcaccgtgctgccgccggccgtgtacttcgcaggcgcgtgggtcgtccgctacgcgggccgtctccgccgactgaccggacggcaggcgaagctaaacgagaccggcatcgccctcattcacgtcggcgcggcgctgctcatcgtctccgtctccttcgtctatgtcttctcgacgacagcgtccgtcggtatcgtgggcgcgacagaactggacgataccggcgagcgaatcgtccgcgacgtcgaggggtcgccgtacacggtcgaggtaaccaactactcgccggagaacacgccgacgatgaccgaggcggcgatgacgccggccgaagtcggctccgttgacccctcgtcatcggtgattctcgtaaaaggagaggtgaccgcagtgcaacgcttcgaggacacgaccatcgcacagctcaacgggtcccgcgtgtgggtcggtgccgacagcgggacagtgcagttcgaagaggggtcggtgatcgtcgcccgcgggacactctctgaccctcgttccgagaacatcgacgcgctcgtctacaccaacggggaaaacgtcggaccggcgtcggccccgccgacagacgtgtactcgccgcgggtcgtcgaccatcggttcgacgttcaactgtaccggggcgacacgctggtcgccgatggcactgtggccgaacagtcatatcgcggtcgcgatatgcagacgaacgacccgctcatcgaacgcggtatcaccggcgacacgtacgtcgtggggactcgaaccgcgggcgggctctcgatcgaaatcagtcgctacccgcttgccaaccagatctggttcggcgtcgcagtgatgctcgtcggcatggggctggtcttcctgttcgatccagcgtcgggtgccgccggtggccgtcgctccggaaatcgcgattga

SEQ ID NO: 68023 - protein, 788 aa, Haloarcula marismortui ATCC 43049
MTTVVFGLAVGTWLLAIGLFGSVLATALLGYEYVTGDESFLRVSKAAAGVATGSFVIALLYLTSQFLSGDYTNAYVWDNTANYLPTLYKVTGVYASNAGSILLWAMLTAVVVTTTLLLGRYSTRGARLSQSLGMGVVTVFAWMLVNDSPFTPLSAEYPSVAANGIPQDGSGLNPLLVDPFMAIHPPITFSAYALMVVPFTVGVTHFVAKLRGTESMFDDWLGSMTRWLRGSWLLLTAAITLGGIWAYRVLGWGGFWSWDPVETSVLIPWLGLTAVLHTLNQYRRSGRYAVLAPAATAALLPLVIYATTVVRSGVFRSVHSFAGGGIGSGVLFLLGTTSTLAVGPAFIHWFRTEQSDAEEASLLDRATIYHAAVLGFILLAFVSLWGLTFPVVRSLASGVEVSVDARYYNLWSFPVVVGMLLAGGMYAQQERFSTRATVVTAATVLIAALAVGFVLARPEWQLASTEPFDPVYYRAIGSLSVVTVLPPAVYFAGAWVVRYAGRLRRLTGRQAKLNETGIALIHVGAALLIVSVSFVYVFSTTASVGIVGATELDDTGERIVRDVEGSPYTVEVTNYSPENTPTMTEAAMTPAEVGSVDPSSSVILVKGEVTAVQRFEDTTIAQLNGSRVWVGADSGTVQFEEGSVIVARGTLSDPRSENIDALVYTNGENVGPASAPPTDVYSPRVVDHRFDVQLYRGDTLVADGTVAEQSYRGRDMQTNDPLIERGITGDTYVVGTRTAGGLSIEISRYPLANQIWFGVAVMLVGMGLVFLFDPASGAAGGRRSGNRD

SEQ ID NO: 68024 - DNA, 1923 bp, Anaplasma marginale str. St. Maries
  CDS (1)..(1923): transl_table=11
atgcaatattcgatgggcggcttgggcgcgtttttaatgtgcgcgtgcgcgctgtctctgctatgttccgtggttgcgcgcttatcaaccgcgtggggggcaacactgacgcacgtggcattctcgttatacagcgcagctgcagccctgctcacctacctgcgggttacggaccacttcaactacgcacacgtatatcagaattcgcatactactcaaccactcctgtacaaggtgtgcgggatatggggaaactatgagggctcaaacctgctgtttgtatggatgctgagtgcatatggaacgcttattgcgcttctggtcaagcgagacgatctgaaaggagctgcgctcgtcgtacaaaacttgctcagctttggctttgcgctgtttggcgtcatatttgcaaatccattcctgaaagttataaccctggacgcagacgggctgggttttaacccaatgttgcaggatgtcgggcttgcacttcaccccccagtattgtttgggggttatacgggttttggcgcagtattttccataacgattgctgcacttgttttgcgcatagaccccaaagaatgggtcgcggttatacgtggttgggtgttaggcgcgtggactttactcacgctgggtgtagcacttggcggatggtgggcatatagggaattaggttggggaggattttggtcttgggatccggttgagaatgtttccttgatgccgtggtttttgggggtggcgctcattcacatgatgccggtggtgaaaaagtttggcatatattgcaattttacgtttttgctcgctttgctggcgtttatttccagtttgtgcggcacatttttagtgcgctctgggtttttagtttctgtccatgctttcgcgaatgatcaaggatgcggcatttttctactggctttggttacgacaataacggtgggcgggctgctaacatttgttattaagtacagaaatttgccggagacctgctgccacttcggctgcatatcaaaactcaccgcgattttggccaatagcgtaataatgttgaccgcgtttttggtggttttggcagggactgtgtatcccataattctagagctgcttgagggggataccatatctgtaggcgcgccatattacaataacgtgttcagcgtgctatccgtagcgttgttttcggttatgatattgctctctggcctaagttgggacggctcggagaaatttaaaatgaccttcaaaatttcttccgtaatcgcaacacttcttgtaccttttgcagcgccccttgggctcaccggagtgttaattttgctggctgcgctgttgtttttttcgatactggaagattacatttatcgagtgcgtagctcacaaatgcggctgagtgctgcggtcaggcgtgtgagccttgggcgatatgcaatgatgatgacacacgccggtgttgcggtttgcatgtttggcatcatctgctctactgcatttcaggaagatgtaacacaatacatgaaagagcgcgaatccgcagaaattcacgggtttagcgtgacattatctggtgtgtcactggtaaagcggccgcataacgaggccataagggcgaagttttccgtggctagatcaggcaaagtagtgtgtctattgttccccgaaagtaggttctactatgtcgaaggtattagaaattctgaaagtagcatctgtcacggattacttgcggacatatacatagtagtaggtgaagtggataaaaatcgcgggatagcggtgcagatgcactacaaaccactaatcaatctggtatgggcagggtttgccctgatggcggccgggggagtgctgtcggtagttaaagtatggctgcgccgcaggcaaaacaatcctgctataggtgcaaatagtactgcctga

SEQ ID NO: 68025 - protein, 640 aa, Anaplasma marginale str. St. Maries
MQYSMGGLGAFLMCACALSLLCSVVARLSTAWGATLTHVAFSLYSAAAALLTYLRVTDHFNYAHVYQNSHTTQPLLYKVCGIWGNYEGSNLLFVWMLSAYGTLIALLVKRDDLKGAALVVQNLLSFGFALFGVIFANPFLKVITLDADGLGFNPMLQDVGLALHPPVLFGGYTGFGAVFSITIAALVLRIDPKEWVAVIRGWVLGAWTLLTLGVALGGWWAYRELGWGGFWSWDPVENVSLMPWFLGVALIHMMPVVKKFGIYCNFTFLLALLAFISSLCGTFLVRSGFLVSVHAFANDQGCGIFLLALVTTITVGGLLTFVIKYRNLPETCCHFGCISKLTAILANSVIMLTAFLVVLAGTVYPIILELLEGDTISVGAPYYNNVFSVLSVALFSVMILLSGLSWDGSEKFKMTFKISSVIATLLVPFAAPLGLTGVLILLAALLFFSILEDYIYRVRSSQMRLSAAVRRVSLGRYAMMMTHAGVAVCMFGIICSTAFQEDVTQYMKERESAEIHGFSVTLSGVSLVKRPHNEAIRAKFSVARSGKVVCLLFPESRFYYVEGIRNSESSICHGLLADIYIVVGEVDKNRGIAVQMHYKPLINLVWAGFALMAAGGVLSVVKVWLRRRQNNPAIGANSTA

SEQ ID NO: 68026 - DNA, 1956 bp, Idiomarina loihiensis L2TR
  CDS (1)..(1956): transl_table=11
atgattgctgaagcaggacatcttgccatagcgattgcgctggccttttctgtattactggcggtttatcctttatggggagcggcgaaaggaaacggcggcatgatggctttagcccggccgtttgcctatggccagtttttctttaccgctatcgcttttgctttattagtctggggctttgtcagtaacgactttagtattgcttatgttgcggcaaactcgaatagtcagctaccggttgcgtatcgggttaccgcggtgtgggggtcacatgagggctcttttcttctctggatgctaatgcaggcaggctggatagccgcagttgcgatattttcccgctctatgccattgccgatgatagcccgggtgcttgccattctggggctggtcagcattggcttctatttgtttatgctaacggtttcgaacccctttgatcccagtttgcctctcattcctgttgacggtcgcgatctcaatccgctgctgcaagacccgggaatgatcattcatccgccattgctgtatatgggctacgtcggtttctctgttgcttttgcttttgctattgccgctttaatgtcaggcaagcttgatgcagcctgggctcgttggtctcgtccctggactctcgcagcatggatttttctgacactgggtattgccattggtagctggtgggcatattacgaacttggctggggtggctggtggttctgggacccagttgaaaatgcgagctttatgccatggctggtaggaacggcattactgcactcacttgccgtaactgaaaaacgtggcagctttaagtcctggacggtattgctggctatatccgctttcagtttgagcttattaggcacctttttggtacgttccggcgttttagtgtcagtgcatgcgtttgcaaccgaccccgcccgaggcttgtttattctgatactgctggggctggttgtcggcggttcgcttattctttacggcctgcgcgccggaaagatgcaaagttacagccgttatgaactgctttcacgagaagtgatgctgctgggtaacaatgtcttgttaatggcggctatgatagttgtgtttctgggcaccatgctacctctggttcataaagaaattggtctgggtaccatttctattggggcacctttctttaatgagctgtatagctggctggttattccatttgcattaatgctgggtcttggacccttaatgcgctggcgcagacaagctatgcaaccacttctgaaaccgctggccttagcactttctttggcgctgattctggcctacacgctgccgaagatttgggccgacgaattacccgcgttggtggttattgcgctgtttctggcgttctgggtggctctggctacactgaccgaagtccagcaaacggtaaaacaacgcaagcagggttgggccgggctgaccaaaatttcaggtagtcattggggaatggttctggggcatttaggttttgccgtaacgcttatcggcatcaccctggtttcaaactatgagcaggagcgcgatattgcgcttgcgccggggcaatcggttgatgttatcggttataacgttgtgttcgaaagcctgcagcatagggaaggacctaactacgatgccgatcagggagtatttactgtctacaaagacgggcaggaagtaacgcagttaaccagcgagaaacgtttttaccgggtacaacgcaccagtatgaccgaagttgggctcgatgcgagtttgttacgcgatatctatattgctatgggcgagccgctggatgatgaaacctgggccattcgtttctatatcaagccctttgtccgctgggtttggctgggcgctattatcatggcaataggcggcgctatggcatttgctgataaacgttatcgtaagcgtggcaaaaaggagatggccaatgactaa

SEQ ID NO: 68027 - protein, 651 aa, Idiomarina loihiensis L2TR
MIAEAGHLAIAIALAFSVLLAVYPLWGAAKGNGGMMALARPFAYGQFFFTAIAFALLVWGFVSNDFSIAYVAANSNSQLPVAYRVTAVWGSHEGSFLLWMLMQAGWIAAVAIFSRSMPLPMIARVLAILGLVSIGFYLFMLTVSNPFDPSLPLIPVDGRDLNPLLQDPGMIIHPPLLYMGYVGFSVAFAFAIAALMSGKLDAAWARWSRPWTLAAWIFLTLGIAIGSWWAYYELGWGGWWFWDPVENASFMPWLVGTALLHSLAVTEKRGSFKSWTVLLAISAFSLSLLGTFLVRSGVLVSVHAFATDPARGLFILILLGLVVGGSLILYGLRAGKMQSYSRYELLSREVMLLGNNVLLMAAMIVVFLGTMLPLVHKEIGLGTISIGAPFFNELYSWLVIPFALMLGLGPLMRWRRQAMQPLLKPLALALSLALILAYTLPKIWADELPALVVIALFLAFWVALATLTEVQQTVKQRKQGWAGLTKISGSHWGMVLGHLGFAVTLIGITLVSNYEQERDIALAPGQSVDVIGYNVVFESLQHREGPNYDADQGVFTVYKDGQEVTQLTSEKRFYRVQRTSMTEVGLDASLLRDIYIAMGEPLDDETWAIRFYIKPFVRWVWLGAIIMAIGGAMAFADKRYRKRGKKEMAND

SEQ ID NO: 68028 - DNA, 2142 bp, Azoarcus sp. EbN1
  CDS (1)..(2142): transl_table=11
atgcctgagcgcacgagctgggtcgccgtcatcctggcagccttggcgggcgtgctgttttcagggcttggcgatgtcgtgatcggcctcgcggccctatccgtgcttgtcgccggtgcttcggcacgataccggctgcgcctgtgccgggtcggcgctgcggcgctttgggggtcgatcctgacacttgcggtgctgatgctcgccgaccgcttcgatgtccgctatgtatggctctacagcggagccgaactgccgattttcctgaagctctccaacctgtggggaggcgacgagggcactacgctgctgctggcagccttcggtgcaagcctcgctgcccgttcttcgtcggccccgctgcgttttgacgtcaccgcgtttcttgccggggcgctcgcgctcgctgcggcgaccttgtcgccgtttgcagcgaccccgccggagtggctggagcgagcggcttaccagggcatgaatgcgcacctgatgaaagtgtggatgcttgcccacgctccgttggtgctggcggcctatgcctggacactgtctctcgcgtcgccggcgctggcagcgcttgcgggagaccttgcacgctggcccgacgacgcgttgatacgtgcgcgccgcgcttgggcactgctgacggccggcatcggattcggcatggtgtgggcgttcgaggatgcgatgtatggccaggtgtggcattgggatccggtgcagaccgccgtgttcgcagtctggtgtctcctcggcgcccacttgcatggtctctccggctggcgcgcgggccgcccgatgtggcgctggacgccgctcgcggccgcactcgcggcggcgctgaccttggtggcgatgggagtcacgcgacacgatgcgctcgccagttcgcatcgctacgtcggcgcaacgtcgtctttcgtgtacttctcgctcgccggccttctcgtgctgacgatcggcgcaacctgggtgcgcggattgcgccgtgcagcggccgtcgggtcgcagtcgccgctcggcctgtcgacaggggcactgcgtgccacgcaggttgcgttcgtcatcgtgggagtattcgcggccgcacaccttgcgtgggccttcgctgcaagtgcgaaggagttgccgcggccggacgagctgagaccctttttctcgacgctgacgaactgggcgcgcggctccgagttgccatacctgcgctcagccttcgcccagtgggatgtcgatggctatgcgctggcccaggctttgctgtttccgctcatcgtcgtcgggcttctcggcgggtggttcttcctgcggcgtgtgtctgcccggctcgcgtggatgtcgttggcgctcgcgtccgttgcctgcgccggcatatggttcgaaggcggcgtgctcgtccgcgaatactccgggaagggcgttctttcgcagcagatcatcgccgttttgccgcgcatcgacgccagccttgccgcaggcgcgtatctggctctgggcaccgccgtctggagtatccgcactgcgtgcaagacctcggcgaaaggctatgtactgtcgctgggcatggtgcatcttggcgcaatgatgagcctgtggggcgcgctgctttcgaccgccctcaatggctactcgcaacacgtcatcgacgtcgccgaaacctggcagcgcgaccaccacggctatgcgtttcgcgtgacgtcgcttgccgtcgatcattccgccgacggaggacggacgaacggcgaggccggtttccgggcccttgcgcaggtcgagctccggaccccctcgcaccaggtgctgaacggggagacgctgtatcgcgacgggcgccgcgccgtcgaaggctacgccgggccggtgcgccagatctgcgagatcctcgactaccgctacgcgcgctatgcgaacacgccgggctatgtcctcgatccattcatcgatcgcggctgggagcgcgatgtccagctctgggtctccccttcggccgcggtggccgcgctcgaaggcgggccgcaggcctcgcaggtggtcgtggtcctgcgcgtattccctttcgcatcccttctctggatggggctcctgctgacctcggcgggagctctctggctcgcgctgcgccggcccaaggagcattcatga

SEQ ID NO: 68029 - protein, 713 aa, Azoarcus sp. EbN1
MPERTSWVAVILAALAGVLFSGLGDVVIGLAALSVLVAGASARYRLRLCRVGAAALWGSILTLAVLMLADRFDVRYVWLYSGAELPIFLKLSNLWGGDEGTTLLLAAFGASLAARSSSAPLRFDVTAFLAGALALAAATLSPFAATPPEWLERAAYQGMNAHLMKVWMLAHAPLVLAAYAWTLSLASPALAALAGDLARWPDDALIRARRAWALLTAGIGFGMVWAFEDAMYGQVWHWDPVQTAVFAVWCLLGAHLHGLSGWRAGRPMWRWTPLAAALAAALTLVAMGVTRHDALASSHRYVGATSSFVYFSLAGLLVLTIGATWVRGLRRAAAVGSQSPLGLSTGALRATQVAFVIVGVFAAAHLAWAFAASAKELPRPDELRPFFSTLTNWARGSELPYLRSAFAQWDVDGYALAQALLFPLIVVGLLGGWFFLRRVSARLAWMSLALASVACAGIWFEGGVLVREYSGKGVLSQQIIAVLPRIDASLAAGAYLALGTAVWSIRTACKTSAKGYVLSLGMVHLGAMMSLWGALLSTALNGYSQHVIDVAETWQRDHHGYAFRVTSLAVDHSADGGRTNGEAGFRALAQVELRTPSHQVLNGETLYRDGRRAVEGYAGPVRQICEILDYRYARYANTPGYVLDPFIDRGWERDVQLWVSPSAAVAALEGGPQASQVVVVLRVFPFASLLWMGLLLTSAGALWLALRRPKEHS

SEQ ID NO: 68030 - DNA, 1974 bp, Azoarcus sp. EbN1
  CDS (1)..(1974): transl_table=11
atgattcccgaactcggccatttctcgctgatcctggcgctggtgctcgcgctcgtccaggcggtcgtcccgatgatcggcgccaaccgcaaccgcatcgcgctgatggcagtcggacggccggcggcgcaggggcagttccttgccatcgcgttcgccttcggctgcctgacctgggcgttcgtcacgagcgatttctcgttgcagctcgcggcagtcaactcgcataccgacacgccgctgatctacaagatcaccggcgtgtggggcaaccacgaagggtcgctgctgctgtgggcgctgtcgctgtcgctgtggacggtcgcagtgacggtgttcagccgcaatttgccggacgccttcatggcgcgcgtcctcggcgtgctcggctggatcagcgcgggattcctgtcgttcacgctggtcacgtccaaccctttcgaccgcctgctgccggcggtcgcgcagggacgcgacctcaacccgctgctccaggacgccggcatgatcatccacccgccgctgctgtacatgggctacgtgggcttttcggtcgcgttcgcgttcgcgatcgcggcgctgctcagcggccgcatggatgccgcatgggcgcgctggtcgcgaccatggacgacggtcgcgtgggtgttcctcactgccggcatcgcggtcgggtcgggctgggcctactatgagctcggttggggcggctggtggttctgggatccggtcgaaaacgcgtccttcatgccgtggctgctcggcaccgcgctgatccattcgctcgcggtcacggaaaaacgcggcgcgttccgcagctggacgatcctgctcgcgatcagtgcgttctcgctgtcgctgctcggcactttcctggtccgctcgggcgtcatcacgtcggtgcatgcgtttgcgaccgacccgcgccgcggtctgttcatcctcgcgctgctggtcgtcgtgatcggcgtttcgctgacgctgttcgcatggcgcgcgccgaagctcgccggcggcggcagcttcggcctcgtgtcgcgcgacgcgacgctgctcggcaacaacgtcctgctcgcagtggcgacgggttcggtgctgctcggaacgctctacccgctgttcctcgacgcgctgaacctcggcaagatctcggtcgggccgccgtacttcgaagcggtgttcgtgccgctgatgacgccggtcgtggtgctgatggtgctcgggccgttcgtccgctggaaaggggacggcctcgggcgcgtgctgcggccgctgctgccggtgatggtggcgagcatcgcgatcggtctcggtgtcgcgttcgcggtcgggcacgtcacggtgcgcacggtgctcggcctggtgctggcgtcgtgggtgctgctcggcagcgcccggctgctggcgagccgcttcgcggagcgtcgcggcgcgagtactgcggcagtgctgcggggcatcccgttggcgtggtggggaatgtggctcgcgcacgccggcatcggcatcttcatcatcggcgcgacgatggcgggcagtctcaacgagcgcctcgacgtcaagatgcagcccggccagaccgcacaactcgccggctacacgttcacgttccgcggtgtcgccgacgcaccggggccgaactacgacgccgcgcgggcgacgatcgacgtgacgcgcagcggcattccggtcgcgacgctgcacccggaaaagcgcttctacgtcgcgcagcagatgccgatgaccgaggcgtcgatcgacatcggcccgtttcgcgatgtctacgtcaacctcggcgaccgcctcgacgacggcagctgggttgtcggcctgttctacaaacccttcatcagctgggtatggctcggctgcgtgctgatggcaatcgggggcgttttcgcggcctcggatcgtcgctaccgccgcctcgccgagcgtgaagtccctgccggcgcggcgcgccggacgacatga

SEQ ID NO: 68031 - protein, 657 aa, Azoarcus sp. EbN1
MIPELGHFSLILALVLALVQAVVPMIGANRNRIALMAVGRPAAQGQFLAIAFAFGCLTWAFVTSDFSLQLAAVNSHTDTPLIYKITGVWGNHEGSLLLWALSLSLWTVAVTVFSRNLPDAFMARVLGVLGWISAGFLSFTLVTSNPFDRLLPAVAQGRDLNPLLQDAGMIIHPPLLYMGYVGFSVAFAFAIAALLSGRMDAAWARWSRPWTTVAWVFLTAGIAVGSGWAYYELGWGGWWFWDPVENASFMPWLLGTALIHSLAVTEKRGAFRSWTILLAISAFSLSLLGTFLVRSGVITSVHAFATDPRRGLFILALLVVVIGVSLTLFAWRAPKLAGGGSFGLVSRDATLLGNNVLLAVATGSVLLGTLYPLFLDALNLGKISVGPPYFEAVFVPLMTPVVVLMVLGPFVRWKGDGLGRVLRPLLPVMVASIAIGLGVAFAVGHVTVRTVLGLVLASWVLLGSARLLASRFAERRGASTAAVLRGIPLAWWGMWLAHAGIGIFIIGATMAGSLNERLDVKMQPGQTAQLAGYTFTFRGVADAPGPNYDAARATIDVTRSGIPVATLHPEKRFYVAQQMPMTEASIDIGPFRDVYVNLGDRLDDGSWVVGLFYKPFISWVWLGCVLMAIGGVFAASDRRYRRLAEREVPAGAARRTT

SEQ ID NO: 68032 - DNA, 1947 bp, Zymomonas mobilis subsp. mobilis ZM4
  CDS (1)..(1947): transl_table=11
gtgattgccgaatccggtcttatctttttgtggctcgccgccatgatggccttgttgcaaggcctctttggcctgtctgttctgaataatcgccttgatgacgtcttctccggtgccgtcaaaataacagcccttatccaagccgccttggcgctatccgcttttgcaatgctgctttggttgtttatgcgggtggatttatcggtaaccttggtcgctgaaaacgatcattgggcaaaaccgatgctttatcgtgtggccgccagttggggcaatcacgaaggttcaatgctgctttgggtcactattctcagcttttgcggggctttgcttgcgctttttggcgggaagatcgaccagaaattattatctttggctttgggatcgcaagcctttctagccttaggcttttttgcctttttgctctttgtttccaatcctttcgctcgcctcaatccacctgcgacagaaggccttggcttaaatccgctgttacaagacccaggattggcctttcatcctccaacgctttatcttggctatgtcggcctatcggtcgctttttcttttgcggtcgccgctttactgacagggaaagcagatcgtgcctttgcgaaagccatgcgcatttgggttctaggcgcttgggtttttctgactatcggcattaccgcaggcagctattgggcatattacgaattgggctggggcggcttctggttctgggaccctgttgaaaatgccgctttgatgccgtggctcgccgctaccgccttattccattccgtttccgtcctcgccaaaagggattctttacgggtctggacattggtcttggctgttaccgctttttcaatgagcatgatcggcacttttctggtgcgttccggtattctagtcagtgttcatgcctttgcggttgatccatggcggggcagttttatccttggcttgcttgggctttatatcggtggtgccttagccctgtttgcgcttcggatcgctaaaatccaccaaggcaatcattttattctacccagccgtgaagccggtttggtgctgaataatcttttcctcggcgtcattctggcaatcgtgctgattggcacgctctatccgcttctggcggaaatgatgaacggagaaaaactatccgtcggcgcgccttattttaatatgattatcacgccgctagccttgcttctctgccttttgatgcctttcggtacattactccgctggaaacaagaccgttgggcaagtctcaaatggccgcttctggtcggggcagggctattcatcctgacagaagtcattcttgccttaaaaggcctgttctcaaccgcacctcttgcctcaatttctttgggcgttgcggtaatggtagggcttctttgcctctggccactcctccggcaaaagaccatccatctcaatttatggggcatggtgctggcgcatcttggcattgcgataactttaggcggtattgcatcagatacacttttttctcaagaattgctcaccgccctcaaaccgcaacaaacggcgcgtttgggtgattggcaactgcatttcgacagggtaatgcccgatcttggttcggattggacagcgattgtcgccgatatccgcctcgaaagaaacggacaatcttttacccttcatccagctttgcggcattttaccaatcctgtcacggataccagtgaaaccgcccttaaaacaacaaaggccggtcaactctatctggtattgggacaacaggccgaagatggtcgctggcaaattcgtgcttggtggaaacctttggtaacgcttatctgggatggcggtttcctaaccgctttcggcggcatactgatcctgctggataggcttttgcgctatctccagaaacgccgttatcaaaatcgccccgatgaaagacaaaggctgtctttatga

SEQ ID NO: 68033 - protein, 648 aa, Zymomonas mobilis subsp. mobilis ZM4
MIAESGLIFLWLAAMMALLQGLFGLSVLNNRLDDVFSGAVKITALIQAALALSAFAMLLWLFMRVDLSVTLVAENDHWAKPMLYRVAASWGNHEGSMLLWVTILSFCGALLALFGGKIDQKLLSLALGSQAFLALGFFAFLLFVSNPFARLNPPATEGLGLNPLLQDPGLAFHPPTLYLGYVGLSVAFSFAVAALLTGKADRAFAKAMRIWVLGAWVFLTIGITAGSYWAYYELGWGGFWFWDPVENAALMPWLAATALFHSVSVLAKRDSLRVWTLVLAVTAFSMSMIGTFLVRSGILVSVHAFAVDPWRGSFILGLLGLYIGGALALFALRIAKIHQGNHFILPSREAGLVLNNLFLGVILAIVLIGTLYPLLAEMMNGEKLSVGAPYFNMIITPLALLLCLLMPFGTLLRWKQDRWASLKWPLLVGAGLFILTEVILALKGLFSTAPLASISLGVAVMVGLLCLWPLLRQKTIHLNLWGMVLAHLGIAITLGGIASDTLFSQELLTALKPQQTARLGDWQLHFDRVMPDLGSDWTAIVADIRLERNGQSFTLHPALRHFTNPVTDTSETALKTTKAGQLYLVLGQQAEDGRWQIRAWWKPLVTLIWDGGFLTAFGGILILLDRLLRYLQKRRYQNRPDERQRLSL

SEQ ID NO: 68034 - DNA, 2001 bp, Silicibacter pomeroyi DSS-3
  CDS (1)..(2001): transl_table=11
atgatcgaaacgtcgatagagcttggtcagttcgcggtcagccttgccctgatcctgagcgtatttggctgctttcaggctgtgctggcggcccggtcgggggcagcgtcacggctggtatcggcccgaaacgcaatcttcgcaaacttcgtgcttgcgacgattggctgcgccgttctgatccaggcgttcgtgacctcggatttctcggtcgcctatgtggcgcagaacagcaaccgggatctgccgatgctctacaaggtgacggcaatgtggggcgcgcatgagggcagcctgcttctgtggctgtggtatctgacgctgttttcggccgccgcagtctggctgcactggcgggactacccgaaatccatgccctgggtgatcgccacgctggcggcgattcagctggggttcctggcctttgtcgttttcctgtcaaacccgttcctgacgctcacgccgatgcccggaaacgggcgtgatctgaaccctcttctgcaggatccgggcctcgcctttcatccgccggttctctatctcggctatgtcggctttgccgtgccctttgcctttgccatcgcttcgctgatccggggtcagaccggggtggaatgggtcaccgtggtgcgccgctgggtgctgtttgcgtggacggcgctgacctcgggcatcatttgcggcggttactgggcctattacgagctgggctggggcgggtactgggcctgggacccggtcgagaacgcctcgttgatgccctggctcaccggcaccgcgttgctgcattcgatgatggtgcaggacaagcgcgggatgttccgggcctggaacgtgtttctggtggtcaccaccttcctgctgaccctgctgggaacattcctggtgcgttcgggcgtgctgacatcggtccatgcctttgccgtcgatcccgggcgcggagcctatatgctgggcttcatgactgtcgcgatggtggtcggttacgggctgatcattctgcgggcggaccggctgcaggatgacggcggcatctcgtcacttctgtcgcgcgaggctgcgatccttggcaacacggtgctgctgctggtggtgacggccacggtcatggccggtacgcttttcccgctggtggtcgaggtcttctcggacgccaagatcagcatcggcgcgccctactataacaaggtcatcgtccccatcatggtggcgctggtctttctgctggggctggggccatcggtgccctggcggcagatgagtgcgaaacgcttcgtgggccggtttcgcctgccgctggcttttgccgggctgacggctgttgccgcggtgctggtcagcgaggccgggatcatcactcttgccgcgatctttgcggtaggtttcgcgggctttgcatcactggcggatattgccagtgcgattgccgctcggcgccgggtgatggagcagggggtgctgcgcgccacgggcgacgtgctgacacattcccgacagcgtatcggcgcgctgatcattcatttcggggtcgtcatgatcggggctggcatgattgcatcgggcctgttccagaccacccagaccgtggccatgcgcatcggcgacagggcagaggcgggcggctacacgctgacgctgcgcgagcttcaggataccggcagcgccaattacaacgcgcgggtcgcacggttcagtatcagccgcgacggggagttgctgttcgagatggcgcccgaaaagcgattctatccggtccgcgaaatggcaacgaccgagattgccatccggtcatcgctggccggggatctctacatggtcatgggcgatgaggatgggcagggaacggttgtcgtccgcatcttctggaacccgctggtcaactggatctggctgggatggctggttctgctgctgggcgcgttgctgtccttgtcaaaaccgtcgcgccgggcggcgcggagccgcacgcccgaaccgatcgaaggagtgcccgcagaatga

SEQ ID NO: 68035 - protein, 666 aa, Silicibacter pomeroyi DSS-3
MIETSIELGQFAVSLALILSVFGCFQAVLAARSGAASRLVSARNAIFANFVLATIGCAVLIQAFVTSDFSVAYVAQNSNRDLPMLYKVTAMWGAHEGSLLLWLWYLTLFSAAAVWLHWRDYPKSMPWVIATLAAIQLGFLAFVVFLSNPFLTLTPMPGNGRDLNPLLQDPGLAFHPPVLYLGYVGFAVPFAFAIASLIRGQTGVEWVTVVRRWVLFAWTALTSGIICGGYWAYYELGWGGYWAWDPVENASLMPWLTGTALLHSMMVQDKRGMFRAWNVFLVVTTFLLTLLGTFLVRSGVLTSVHAFAVDPGRGAYMLGFMTVAMVVGYGLIILRADRLQDDGGISSLLSREAAILGNTVLLLVVTATVMAGTLFPLVVEVFSDAKISIGAPYYNKVIVPIMVALVFLLGLGPSVPWRQMSAKRFVGRFRLPLAFAGLTAVAAVLVSEAGIITLAAIFAVGFAGFASLADIASAIAARRRVMEQGVLRATGDVLTHSRQRIGALIIHFGVVMIGAGMIASGLFQTTQTVAMRIGDRAEAGGYTLTLRELQDTGSANYNARVARFSISRDGELLFEMAPEKRFYPVREMATTEIAIRSSLAGDLYMVMGDEDGQGTVVVRIFWNPLVNWIWLGWLVLLLGALLSLSKPSRRAARSRTPEPIEGVPAE

SEQ ID NO: 68036 - DNA, 1965 bp, Silicibacter pomeroyi DSS-3
  CDS (1)..(1965): transl_table=11
atgattacggaactcggtcacttcgccctcatcctcgccttcatggtcgccatcgtgcaaatggtcgtgcccttgatcggagcccataaacgctggcccggctggatggccctggccgaaccggcggcaggggcgcaattcctgctcaccgcctttgcctttgccgcgctggtctgggcctttgtgacctcggatttctcgctgcggctggtggtgttgaacagccattcggccaagccgatgctgtacaagatcagcggcacatggggcaatcacgaggggtccatgctgctctgggtgctgatcgtcaccctgtttggcgccatggcggcctggtttggcggcggtctgccgccgacgctcaaggcccgcgtgctggcggtgcaatcggcgattgcggtggcgttcttcgccttcatcctgtttacctcgaacccgttcctgcggctggcggtgccgccctttgacgggcaggacctgaacccgctgttgcaggatccgggcctcgcgttccatccgccgttcctctatctcggctatgtgggcctgagcatggcgttttcctttgccgtggctgccctgatcgaggggcgcgtcgatgccgcctggggccgctgggtgcggccctggacgcttgcggcctggattttcctgaccatcgggatcgcgctgggctcgtggtgggcctattacgagctgggttggggcgggttctggttctgggatccggtggaaaatgccagtttcatgccctggctgctggccgccgccttgctgcattcggccatcgtggtggaaaagcgcgaggcgttgaaaagctggaccatcctgctggcgatccttgccttcggcttctcgcttatcgggacgttcatcgtgcgctcgggcttgctgaccagcgtgcatgcctttgccaatgaccctgagcgcggcgtgttcatcctgattatcctcggcctttttaccggcggcgcgctgacactgttcgccgcgcgcgcgcaggcgatggaggccaagggcgtcttttccatggtcagccgggaaagcgcgctggtgctcaacaatatcctgctggcggtgtcggcctttgtggtgttcttcggaacgctctggccgatcctggccgagatgttctttgaccgcaaactctcggtcggggcgccgttcttcaacgcggccttcacaccgttcatggtggcgctgggggtggtgttgccgctgggcgccatgctgccgtggaaacgcggcaagctgggccgggtggcgcacagcctgcgctatgcctttgtgctggcgctggcgctggcgatcctggtctgggtcatgcagaccgggcgcagcgcgctgggtccggtgggtctgttcctgggggcctggatcacctttggcgctattgtcgatctgtggtcgcgcaccgggcgcagtggcagcgtggcgcggctgttccgtctgccgcgcgccgactggggcaaggcggtggcccattccggtctgggtgtcaccatgttcgcgattgccgggctgatggcctgggaggtcgaggatatccgcgtcgcccgtctcggcgaacctttcgaggtgggcgggttcaccctgacgctcgacggggtcgagcgcgtgcaggggcccaactatatctcgaccatgggcagtgtccgcctggaacaggcgggtcgggccatcgacacgctgcaccccgaaaagcgcgactatccggttgcgcgcatgcccaccacagaggcggcgatcgactatcgcattctgcgcgatgtctatgttgtgatcggcgaccagcaggacgacggcggctggaccatacggacctatatcaagccctttgccaactggatctggggcggctgtatcctgatggcgcttggcggcgcgctcagcctcagcgaccggcgcttccgggtggcggcgggtgcgcgcaaggcaccggccggcggggtgcccgcggaatga

SEQ ID NO: 68037 - protein, 654 aa, Silicibacter pomeroyi DSS-3
MITELGHFALILAFMVAIVQMVVPLIGAHKRWPGWMALAEPAAGAQFLLTAFAFAALVWAFVTSDFSLRLVVLNSHSAKPMLYKISGTWGNHEGSMLLWVLIVTLFGAMAAWFGGGLPPTLKARVLAVQSAIAVAFFAFILFTSNPFLRLAVPPFDGQDLNPLLQDPGLAFHPPFLYLGYVGLSMAFSFAVAALIEGRVDAAWGRWVRPWTLAAWIFLTIGIALGSWWAYYELGWGGFWFWDPVENASFMPWLLAAALLHSAIVVEKREALKSWTILLAILAFGFSLIGTFIVRSGLLTSVHAFANDPERGVFILIILGLFTGGALTLFAARAQAMEAKGVFSMVSRESALVLNNILLAVSAFVVFFGTLWPILAEMFFDRKLSVGAPFFNAAFTPFMVALGVVLPLGAMLPWKRGKLGRVAHSLRYAFVLALALAILVWVMQTGRSALGPVGLFLGAWITFGAIVDLWSRTGRSGSVARLFRLPRADWGKAVAHSGLGVTMFAIAGLMAWEVEDIRVARLGEPFEVGGFTLTLDGVERVQGPNYISTMGSVRLEQAGRAIDTLHPEKRDYPVARMPTTEAAIDYRILRDVYVVIGDQQDDGGWTIRTYIKPFANWIWGGCILMALGGALSLSDRRFRVAAGARKAPAGGVPAE

SEQ ID NO: 68038 - DNA, 1971 bp, Rhodobacter sphaeroides 2.4.1
  CDS (1)..(1971)
atgattgtcgaactcggccatttcgcgctggtgctgtcgctggctgtggcccttgtgcagtccgtggtgccgctcgtcggcgcggatcggcgctggtctggctggatggcggtggccgaacccgcggcggtcacccagcttctgctgatcggcttctccttcgccgcgctgacctgggccttcgtgacctcggatttctcggtgcgcctcgtggtgctgaactcgcacacgctgaagcccatgctctacaagatcagcggcgtctgggggaaccacgagggctcgctgctcctgtgggtgctgatcctcgcgctgttcggagcctgcgccgcggtcttcgggcagaacctgccgcccacgctcaaggcgcgcgtgctggcggtgcaggggatgatcggcgcggccttcctggcctttctcctcttcacctcgaacccgttcctgcgcatgggcgaggtgcccttcgacggcgaggatctgaacccgctcctgcaggatccgggcctcgccttccacccgcccttcctttacctcggctatgtcggcctctcgatggccttctccttcgcggtggcggccctgatcgagggccgcgtcgatgccgcctggggccgctgggtccggccctggacgctcgccgcctgggtgtttctcaccatcggcatcgcgctcggctcctggtgggcctattacgagctcggctggggcggcttctggttctgggacccggtcgagaacgcctccttcatgccctggctgatcgcggcggcgctgctccactctgccatcgtggtcgagaagcgcgaagcgctgaagagctggacgatcctgctggccatcctcgccttcggcttctcgctcattggcaccttcatcgtgcgctcgggcgtcatcacctccgtccatgccttcgccaacgatcccgagcgcgggatcttcatcctgatgatcctcgcggtcttcatgggcggggcgctcacgctcttcgccgcgcgggcgagcgccatggaggccaagggggtcttcggcatcgtcagccgcgagtcgggcctcgtgctgaacaacgtgctgctgacggtggcctgtttcgtggtcttcatcggcacgatctggccgctcctggccgaactcctctggggccgcaagctgtcggtgggtgctccgttcttcaacgcggccttcacccccttcatggtggtgatcgccctcgtcctgcctctgggcgccgtcctgccctggaagcgggccgagctcggccgcgggatgcggccgctctggggggcgctcgcgctctcggcggccctgggtgcgctggtcttcgcgctgcagacgggccggtcggcgctcgggcccgtcggcctcgcgctcggcgcctggctcgtcttcggcacgctcctcgacctctggggccgcaccgggcgcggcgcgctcggcgggcggctcgcgcgcctccggcgactgccgcgcgcggactggggcaaggccactgcccatgcgggcctcggcgtcacgatcttcgccgtggcggccatcaccgcctggcaggtcgagtcgatccgcgtgatgaagccgggcgagaccttcgccctcggccgctacgacgtcctgctcgagggcgtgcgcgagatcgaggggccgaactaccgctcgaccgtggccgacttccgcgtgacccgcgacggggccgaagtggcgacactccatcccgagaagcgcgtctatccggtggccgccatgcccacgacggaagccgccatcgactacggcttcacccgcgacctctacctcgtgatcggcgacccgcaggagggcggcggctatgcggtgcgcagctacatcaagcccttcgccaactggatctggggcggcgcgctgctgatggcgctcggcgggctgctgagcctctcggaccgccgctaccgcatcgccgccggggcgcgccggatgccggccgcggtggctgcagaatga

SEQ ID NO: 68039 - protein, 656 aa, Rhodobacter sphaeroides 2.4.1
MIVELGHFALVLSLAVALVQSVVPLVGADRRWSGWMAVAEPAAVTQLLLIGFSFAALTWAFVTSDFSVRLVVLNSHTLKPMLYKISGVWGNHEGSLLLWVLILALFGACAAVFGQNLPPTLKARVLAVQGMIGAAFLAFLLFTSNPFLRMGEVPFDGEDLNPLLQDPGLAFHPPFLYLGYVGLSMAFSFAVAALIEGRVDAAWGRWVRPWTLAAWVFLTIGIALGSWWAYYELGWGGFWFWDPVENASFMPWLIAAALLHSAIVVEKREALKSWTILLAILAFGFSLIGTFIVRSGVITSVHAFANDPERGIFILMILAVFMGGALTLFAARASAMEAKGVFGIVSRESGLVLNNVLLTVACFVVFIGTIWPLLAELLWGRKLSVGAPFFNAAFTPFMVVIALVLPLGAVLPWKRAELGRGMRPLWGALALSAALGALVFALQTGRSALGPVGLALGAWLVFGTLLDLWGRTGRGALGGRLARLRRLPRADWGKATAHAGLGVTIFAVAAITAWQVESIRVMKPGETFALGRYDVLLEGVREIEGPNYRSTVADFRVTRDGAEVATLHPEKRVYPVAAMPTTEAAIDYGFTRDLYLVIGDPQEGGGYAVRSYIKPFANWIWGGALLMALGGLLSLSDRRYRIAAGARRMPAAVAAE

SEQ ID NO: 68040 - DNA, 1941 bp, Xylella fastidiosa Dixon
  CDS (1)..(1941)
atgctgcctgagtttggccagatcctcctgatcctcgccctgctgacagcactgctgcagggactgcttcccctgattggcgcccagcgccgccgcactgcttggatggccgttgcacgcccagccgcctatgtgcaactgagcctgctcgctagcgcattcgcactgctcacctatgccttcctcggcaacgacttctccgtccagtacgtcgccgaaaattcccattcactgctacccaccctctaccgctctaccgccgtatggggtgcccacgaaggatccctcctactctgggtattactcctggcaggatggaccgccaacgtcgccttacgttcccacacccttccagccaccctgagcgcacgcatccttggcgtcctgggcctgattgcactcggcttcctcgcactgatcctcttcacctccaacccattcgcacgtctcctgcctgccgccccagaagggaacgacctcaacccgttgctgcaagatcctgggatgattctgcatccccccctgttatatgccggctacatcggtttggcagtgccattcgcctttgccgtcgcggtcctgctggaaggacggatagagccagcctggctacgctggagccgaccttggaccaacatcgcctgggcactgctgaccttgggcattgccctgggcagctggtgggcctattacgaactcggctggggcggctggtggttctgggacccagtggaaaacgccagcttcatgccttggctcatcggtgtcgcactgattcattcccaagcgatcaccgacaaacgcggcagcttcacccactggacactcttgctcgcaatcaccgcctttgcactagcactgcttggcacattcctcgtccgctcaagcgtactgacctcagtccatgcctttgctgctgatccggtacgcggcgcgtttattctgctgctcatcttcacgttgattggcggcgcactgctgctgtatgcacggcgtgcaccgcaactcacccccgtcacaatggacatgcaacaacgctttacacccgtctcacgcgaaaccctattactgctcaacaacctattgctgacctgcgcctgtgcgatggtactgctaggcaccctatatcccctgctggccgatgcactggcactgggtcaactttcagtcggcccaccctacttcggccccctattcaccctgctgatgacaccactaatcgtcttactgccattgggtccattcacccgatggcaacgcgaacacccctcaacacccctcgtattgctggccccttgggccgcactgagcctggctgtcgccgcactggctggcatcaccacaccacaacaccattggaaaaccatgctcagcgtggccgcggcagcatgggtactcctaggaaccctccgcttcctctggtggcactggcgcaccaccggatcccgtcccacccccagcaccctgggcatggtcctggcacacgccggaattggcgtcttcctcactggtgcgctgttagttgaaacactcagcctacaacgtgaaattgcactcaccccgggccagacactcacccttggccccatcaccctacactttgatgccctcctcgaacaccacggccccaactacgtggctgatcgcgcccaattcagcctattacgcaacacgcatcccctgggcaccctgacgacagaaaaacgccgctatgtcagcggcggccaagtcaccaccgaagttggcatccatcctggagcgctcggtgacatttacgtcgccttaggagaatcgctcggcaatgggtcatgggcaattcaggcacactacaaaccattcgtccgttggatctggctgggcgcagcactgatggccctgggtgggctgatcgctgctgctgatcgccggttccgccaccacccggagtcatcgcatgtctga

SEQ ID NO: 68041 - protein, 646 aa, Xylella fastidiosa Dixon
MLPEFGQILLILALLTALLQGLLPLIGAQRRRTAWMAVARPAAYVQLSLLASAFALLTYAFLGNDFSVQYVAENSHSLLPTLYRSTAVWGAHEGSLLLWVLLLAGWTANVALRSHTLPATLSARILGVLGLIALGFLALILFTSNPFARLLPAAPEGNDLNPLLQDPGMILHPPLLYAGYIGLAVPFAFAVAVLLEGRIEPAWLRWSRPWTNIAWALLTLGIALGSWWAYYELGWGGWWFWDPVENASFMPWLIGVALIHSQAITDKRGSFTHWTLLLAITAFALALLGTFLVRSSVLTSVHAFAADPVRGAFILLLIFTLIGGALLLYARRAPQLTPVTMDMQQRFTPVSRETLLLLNNLLLTCACAMVLLGTLYPLLADALALGQLSVGPPYFGPLFTLLMTPLIVLLPLGPFTRWQREHPSTPLVLLAPWAALSLAVAALAGITTPQHHWKTMLSVAAAAWVLLGTLRFLWWHWRTTGSRPTPSTLGMVLAHAGIGVFLTGALLVETLSLQREIALTPGQTLTLGPITLHFDALLEHHGPNYVADRAQFSLLRNTHPLGTLTTEKRRYVSGGQVTTEVGIHPGALGDIYVALGESLGNGSWAIQAHYKPFVRWIWLGAALMALGGLIAAADRRFRHHPESSHV

SEQ ID NO: 68042 - DNA, 1917 bp, Actinobacillus pleuropneumoniae serovar 1 str. 4074
  CDS (1)..(1917)
atgcttcctgagttgggttattttacgttaatttttgcagcggttgccgctgtttgccaagtggggctgacattgtggggagagatcactaagaaaacggattttcttcgatacaatgcgttgttgagcagcctgcaaacggtaggttgtttgtcgtcgttcgggatattggcttacgcttttttgagtgatgatttttcggtgatttatgtcgcccaacattccaacagccaattaccggatttctttaaatttgcggcgacttggggcggacacgaaggctcaatgctgttttggctgaccgctctgacactatggaccagcgttttttgcattttttcggataaatctgaccgcttgtttaatcagcgaaccttggcggtattaggtttaatcagccttggatttatgctctttattttattggtttccaatccgtttgagcgtagttttccgcctccgccggagggcagagatcttaacccgatgttgcaagacgtagggcttatcttccatccgcctttactttatttaggttatgtcggttttgcggtaagctttgcaatggtcgtggcggcattaatggaaggtatgctggatgccgcagtagtgcgttggattcgaccttggacaatgatctcttggggctttcttaccgcagggattattctcggtgcatggtgggcgtattatgaactgggctggggcggctggtggttctgggatccggttgaaaacgcttcgttaatgccgtggctattgggaaccgcattagtgcatagcttggttgtgagcgagcagcgcggtatttttaactattggacgattttactggcgatttttgcttttgcattgagcttactcgggacttttatcgtgcgttccggcgtactcacttcggtacatgcgtttgcagttgatccggatagaggaatggcactgcttattctgtttttcagtttaagttttattgcgttagccttgttcgcttttagagtgaatttgtggcagggcgaagtgcgtttccaaccgctatccaaagaaaccgctttattattagtaaacggcttattgagcgtagcgacttcggttgtcctactcgggactttttacccgatgatttttacggcgatgaattggggctcgatttcggtcggcgcaccttatttcaataatgtttttgcaccgttggcattattattaatgacggtaatgggatttgccgtcgtattgcgttggaagcaaattccgtcaaaacaaattctgatgaaattatggctgttaccggtagcggtaggattgagtttcctattgattcaacaaacgatttcgcaaacaaagttgtatcaatttggcgtcttgccgacggtattcgtcagccttgccgtttggattattctgacgcatttgccttattcggcgaaatttctgaaaatccgaccgcttgctatgcgtttggcgcatatcggttttgcgatttgtgttattggtgccatgatgaacagttattacggcgatgaaatcggcgtacgtttaaaaccgcagcaacaggcggatcttgccggatttacctttaaatatgaagattatcaggatgggatcggtgcgaactatacgtccgaaaatgcgttatttagcataagcaaagcgggaaaaacgcttgcgacggtagtggcggagcgccgctattacgatattcgtaccatgacgatgtcggaagtcgggctttatcatcacggcttggacgatatttatattgtgatgggcgataaattcggcaatttggaatatgctttccgtttgcattataagccttatgtcggcgcattatggcttggcggtattattatggtgatagcttccatacttgccttattcggttatcgtcgaaaatcggatcttacagcggataaataa

SEQ ID NO: 68043 - protein, 638 aa, Actinobacillus pleuropneumoniae serovar 1 str. 4074
MLPELGYFTLIFAAVAAVCQVGLTLWGEITKKTDFLRYNALLSSLQTVGCLSSFGILAYAFLSDDFSVIYVAQHSNSQLPDFFKFAATWGGHEGSMLFWLTALTLWTSVFCIFSDKSDRLFNQRTLAVLGLISLGFMLFILLVSNPFERSFPPPPEGRDLNPMLQDVGLIFHPPLLYLGYVGFAVSFAMVVAALMEGMLDAAVVRWIRPWTMISWGFLTAGIILGAWWAYYELGWGGWWFWDPVENASLMPWLLGTALVHSLVVSEQRGIFNYWTILLAIFAFALSLLGTFIVRSGVLTSVHAFAVDPDRGMALLILFFSLSFIALALFAFRVNLWQGEVRFQPLSKETALLLVNGLLSVATSVVLLGTFYPMIFTAMNWGSISVGAPYFNNVFAPLALLLMTVMGFAVVLRWKQIPSKQILMKLWLLPVAVGLSFLLIQQTISQTKLYQFGVLPTVFVSLAVWIILTHLPYSAKFLKIRPLAMRLAHIGFAICVIGAMMNSYYGDEIGVRLKPQQQADLAGFTFKYEDYQDGIGANYTSENALFSISKAGKTLATVVAERRYYDIRTMTMSEVGLYHHGLDDIYIVMGDKFGNLEYAFRLHYKPYVGALWLGGIIMVIASILALFGYRRKSDLTADK

SEQ ID NO: 68044 - DNA, 1974 bp, Pseudomonas aeruginosa UCBPP-PA14
  CDS (1)..(1974)
atgatccccgaactcggccacctggccctgatcctcgccctttgcctggccctggtgcagtcgagcctgccgctggtcggcgcctggcgcggcgaccgccagtggatgagcctggcgcgcccagcggcctgggggcagttcgccttcctcgccttcgccttcggctgcctgacctgggccttcctgcgcgacgacttctcggtggcctacgtggccggcaactccaacagcgcgctgccctggtactacaagttcagcgccgtctggggcgcccacgaaggttcgctgctgctctgggcgttgatcctcggcggctggaccttcgccgtgtcgatcttctcccggcaactgccggaggtcatgctggcccgcgtgctggcggtgatgggcatgatcagcaccggcttcctgctgttcctgatcatcacctccaacccgttcagccgcctgctgccgcagaccccgatggacggcaacgacctcaacccgctgctgcaggacgtcggcctgatcgtccacccgccgatgctctacatggggtacgtcggattctcggtggccttcgccttcgccatcgccgcactgctcggcggccgcctggacgccgcctgggcgcgctggtcgcggccctggaccctggtggcctgggccttcctcggtatcggcatcgtgcttggctcctggtgggcctactacgagctgggctggggtggctggtggttctgggacccggtggaaaacgcctccttcatgccctggctggtcggcactgcactgatccactcgctggcggtgaccgagaagcgcggcgtgttcaagagctggaccgtgctgctggcgatcgccgctttctccctgagcctgctgggcaccttcctggtccgctccggcgtgctcacctcggtgcacgccttcgcctccgacccggagcgcggggtgttcatcctcgccttcctgctgctggtggtcggcggctcgctgaccctgttcgccctgcgcgcgccggtggtcaagagccaggtcggcttcgccctgtggtcgcgcgagaccctgctgctgctgaacaacctggtgctggtggtggcggcctcgatgatcctcctcgggactctctacccgctgctgctcgatgccctcagcggcgccaagctgtcggtcggcccgccgtacttcaacgccatgttcctgccgctgatggcggcgctgatggcggccctggcggtcggcgtgctggtgcgctggaaggacaccccgagccgctggctgctcggcatgctgaccccggtgctggtggccagcgcggtcctggcggcggccggttcgatgtacttcggcgatttcaactgggcggtgctggcggtgttcctgctgtccgcctgggtggtcctggccggtttccgcgacttcctcgacaagacccggcacaagggcgtgctggccggcgcccgcagcctgacgcgcagctactggggcatgcaactggcgcacctgggcatcgccgtgtgcgccatcggcatcgtcctcagcagccagtacagcgcccagcgtgacctgcgcatgtcgcccggcgacaccgtcgaactgggcggctaccacttcctcttcgacggcgcgaagcaccacgaagggccgaactacacctcggacaagggcagcatccacgtcagccgcgacggcaaggagatcgccaccctgcatccggagaagcgcctgtacaccgtgcagagttcgatgatgaccgaggccgggatcgatgccggctttacccgcgacctctacgtggcgctcggcgagccgctggagaacggtgcctgggcggtgcgcgtgcacgtcaagccgttcgtccgctggatctggttcggtggcctgctgatgggcctcggcggcgccctggcggcgctcgaccggcgctaccgggtgaaggtgaaaacacgtgtgcgcgaggccctgggcctcgccggtcagggagcctga

SEQ ID NO: 68045 - protein, 657 aa, Pseudomonas aeruginosa UCBPP-PA14
MIPELGHLALILALCLALVQSSLPLVGAWRGDRQWMSLARPAAWGQFAFLAFAFGCLTWAFLRDDFSVAYVAGNSNSALPWYYKFSAVWGAHEGSLLLWALILGGWTFAVSIFSRQLPEVMLARVLAVMGMISTGFLLFLIITSNPFSRLLPQTPMDGNDLNPLLQDVGLIVHPPMLYMGYVGFSVAFAFAIAALLGGRLDAAWARWSRPWTLVAWAFLGIGIVLGSWWAYYELGWGGWWFWDPVENASFMPWLVGTALIHSLAVTEKRGVFKSWTVLLAIAAFSLSLLGTFLVRSGVLTSVHAFASDPERGVFILAFLLLVVGGSLTLFALRAPVVKSQVGFALWSRETLLLLNNLVLVVAASMILLGTLYPLLLDALSGAKLSVGPPYFNAMFLPLMAALMAALAVGVLVRWKDTPSRWLLGMLTPVLVASAVLAAAGSMYFGDFNWAVLAVFLLSAWVVLAGFRDFLDKTRHKGVLAGARSLTRSYWGMQLAHLGIAVCAIGIVLSSQYSAQRDLRMSPGDTVELGGYHFLFDGAKHHEGPNYTSDKGSIHVSRDGKEIATLHPEKRLYTVQSSMMTEAGIDAGFTRDLYVALGEPLENGAWAVRVHVKPFVRWIWFGGLLMGLGGALAALDRRYRVKVKTRVREALGLAGQGA

SEQ ID NO: 68046 - DNA, 1659 bp, Rickettsia sibirica 246
  CDS (1)..(1659): transl_table=11
atgttattatggttttgtttattacaaatcgttagttgctgttatatatttttacttgaagataaccgtcttaaatttttatctattattattctatcagccatacaattattttttagcagctttatttactttacctccaatccttttaacgtgttttctttcgttcctaaagaagggttaggcttaaacccgatgctacaagatattgctttgagcatccatcctcctctgctttatttaggctatgttagctatgtagtaccgtttactattgtttgtgcctctatgtcattctcatacccacttatgtcattcccgcgaaagcgggaatccattaatgacataagactgctcaaaacattttccaatatcggtatcttatttactaccataggaattagccttggttcttggtgggcatatagagaactcggctggggcggattttggttttttgatccggtagaaaatatttcactatttccttggttatccggaattatgctccatcattctataattgtaacaacaaaaaccagacgtatgcaaaactggacagtaattttatccatcattacttttttattagtaatatttagtgcttttttagtacgttccggttttattacctcaattcactcttttgcattctcacctgagagaggaatatacttgcttggaatatttttgattatggggattggtagtattgggtggtatactaccacatcattgcgaggaaatgcattaacattgacgaagcaatctcaggaagctaaccgagattgccacagccactttcgtggcttcgcaatgacgcattgtggaaactccatactcctcggtaatatattcctccttcttagccttattgtgctaatagctgccacactttatccaccaatttactctttattcgacgataaatctattattattagtgaaacattttttattaataattttattatattcgttatccctattcttggtaccataggattatttactaccagaagctctattaaaaaacatattataattctaatattatctctaataattacttatttaatatcattaaaagtaacatttagtgttatatcgattttaactataatcgcatctatatttcttatgcttcataatattcattatcttttggttaaaactaattattgtagaaatagacttaaagcaagtaacgctagtatgatccttgggcatttcggttttgcactaattagttttagtattactatgaatacattattacaaagtgaaatggattttaccggcagagtaggaacaagtaaaacatttaacgaatttaaagtaacattgcaaaatattaagtttgctcaaggtaaaaattattatagacaaatcgctgaattttggcttgaggataatagccgtaatataactatattaaagccggaaaatagactttatatagttgaaaagagtttatcgcaagaaagtgatatatactcttacttattatatgatctttacgcagttttaagtaatatagacggcgatataatccatgctaaaatatattacaagccaacgataagctttatttggcttggaattattcttaccgcgtccggtttttttattgcactaatcagaaaaaattctagctaa

SEQ ID NO: 68047 - protein, 552 aa, Rickettsia sibirica 246
MLLWFCLLQIVSCCYIFLLEDNRLKFLSIIILSAIQLFFSSFIYFTSNPFNVFSFVPKEGLGLNPMLQDIALSIHPPLLYLGYVSYVVPFTIVCASMSFSYPLMSFPRKRESINDIRLLKTFSNIGILFTTIGISLGSWWAYRELGWGGFWFFDPVENISLFPWLSGIMLHHSIIVTTKTRRMQNWTVILSIITFLLVIFSAFLVRSGFITSIHSFAFSPERGIYLLGIFLIMGIGSIGWYTTTSLRGNALTLTKQSQEANRDCHSHFRGFAMTHCGNSILLGNIFLLLSLIVLIAATLYPPIYSLFDDKSIIISETFFINNFIIFVIPILGTIGLFTTRSSIKKHIIILILSLIITYLISLKVTFSVISILTIIASIFLMLHNIHYLLVKTNYCRNRLKASNASMILGHFGFALISFSITMNTLLQSEMDFTGRVGTSKTFNEFKVTLQNIKFAQGKNYYRQIAEFWLEDNSRNITILKPENRLYIVEKSLSQESDIYSYLLYDLYAVLSNIDGDIIHAKIYYKPTISFIWLGIILTASGFFIALIRKNSS

SEQ ID NO: 68048 - DNA, 2046 bp, Psychrobacter sp. 273-4
  CDS (1)..(2046)
atgttaatcacagaattgggttattttgccgtgctagccgcctttatgttggcgattttgcaggtagtattaccaacaataggcgttatgcgtgaccatgttgcttggcagcgtttggcaccgagcttggcgtgggcgcagtttgcagccatgattacctcgtttggcgcactaatggcaggcttttattttaatgactttagccttgtctatgtgtcgcagcactcgaatactttgctgccttggtattataagctatcagcgacgtggggcgggcatgaaggctcgctcctgctatggatgactatcatggcaacgtggtgtgccttggtctcatactttagtcgtggtttaccattgtcgatgcgcgcgcgcgtattggtgatattagccggtgtacagatgatgatgctggcaatgctcatctttacctcgtcaccgtttgaccgcactttaccaaacctgccagtggatggtgctgacctaaatcctgtcttacaagactttggtctaattatccatccaccgatgctgtatatgggctatgttggtatggtggtgccgtttgcattttgtatggcagcattgtgggaaggtcgcttggatgcggtatggacacgctggtcacgtccatgggcattggctgcttgggggtttttaaccatcggtattgcactaggttcgtggtgggcatattacgagcttggttggggtgggtggtggttttgggatccagtagaaaacgcttcattgctgccttggctggcaggtttggcattgctacattcgcttgcagtcactgaaaagcgtggtgtctttaaagcgtggacgattatgctggcaatttttgcctttgcattaagcttactcgggacatttttggtacgctctggggtaattacctctgtgcattcatttgccgcagatcccacgcgtggtttagtggttttagcgattcttgggattattattggtggtggtttattgatgtttgctgtacgtggctggcgtcttacgatcgagagtcagtatcagctgatttcacgtgagtcgtttttagtcattaacaacgtcattattttgattgcgaccttagtggtattacttggtacgctatatcccatcattgccgatgcctttaatttaggtcaggtatccgtaggtcctccgtattttaatgcgctgtttgtaccgttgacttggctattgatggtagcaatgggcatgggctctaatatccgctggaaacaagacagccgtccgttattgggcgttggcatggtcattgcggcaagtagccttgttttagccgcagttattgcctattttgttagcccatctgccatgctcaatattggcgtgacgctagcggtgagtttttgggtattgttatggatggtagttgattttaaagacaagaccaaaaatgccccaagcttctttaaaggcttagctaagctgcgtttaagctactggggtcagcagacagctcacattggcgttattatagcggtcattggtattgcctttaccagtaccttaagtattgagcgcgatgtggcattgggtgaaacggatactgttcatgtgcaagggtacgactttgaaataaaagacttccatgaagtcagaggcagtaactttgatggtatgcaagcagaagttgaagtgaccaaagacggtcgcccagtcgttactttatatccagaaaaacgtacctatgttatcagtggtatgccactgactgaggcagcgattgatgccagccttatgcgtgatgtgtacgtagcactcggtgagcctatcgctgaagacggcaaccaatgggcgatacgtatttacgtgaagccattgattcgctggatatggcttggcgctattattatggcattgggtggtctgctgagtatgcttgataggcgctatcgtctcaaaacaactaagacgcccgctcaaatcgcagcgagtaagtcaggttttgcgaccgttgctgacttagatattaacaatgcgacagatgccacggcaccaatgggggagaagtaa

SEQ ID NO: 68049 - protein, 681 aa, Psychrobacter sp. 273-4
MLITELGYFAVLAAFMLAILQVVLPTIGVMRDHVAWQRLAPSLAWAQFAAMITSFGALMAGFYFNDFSLVYVSQHSNTLLPWYYKLSATWGGHEGSLLLWMTIMATWCALVSYFSRGLPLSMRARVLVILAGVQMMMLAMLIFTSSPFDRTLPNLPVDGADLNPVLQDFGLIIHPPMLYMGYVGMVVPFAFCMAALWEGRLDAVWTRWSRPWALAAWGFLTIGIALGSWWAYYELGWGGWWFWDPVENASLLPWLAGLALLHSLAVTEKRGVFKAWTIMLAIFAFALSLLGTFLVRSGVITSVHSFAADPTRGLVVLAILGIIIGGGLLMFAVRGWRLTIESQYQLISRESFLVINNVIILIATLVVLLGTLYPIIADAFNLGQVSVGPPYFNALFVPLTWLLMVAMGMGSNIRWKQDSRPLLGVGMVIAASSLVLAAVIAYFVSPSAMLNIGVTLAVSFWVLLWMVVDFKDKTKNAPSFFKGLAKLRLSYWGQQTAHIGVIIAVIGIAFTSTLSIERDVALGETDTVHVQGYDFEIKDFHEVRGSNFDGMQAEVEVTKDGRPVVTLYPEKRTYVISGMPLTEAAIDASLMRDVYVALGEPIAEDGNQWAIRIYVKPLIRWIWLGAIIMALGGLLSMLDRRYRLKTTKTPAQIAASKSGFATVADLDINNATDATAPMGEK

SEQ ID NO: 68050 - DNA, 1995 bp, Dechloromonas aromatica RCB
  CDS (1)..(1995)
atgattcctgaactcggccatttcgccctgatccttgccgcactggttgccctgatcctcggcaccctgccgctagtcggcgcccaccagaaccgcctggcctgggttgccatcgcccgccccgccgcttcggcgatggcgctgctgctcaccttctcttttgcctgcctggtgcaggctttcgtgaccaacgatttctccgtggtttatgtcgcgcaacactccaattcgttgctgcccattcagtaccgcgttgccgccgtctggggcggccatgagggctcgctgctactttggatgctgttcctgacctggtgggccttcagcgtcgccatgctgtccaagcaactgccggaaacgatggttgcccgcgtgctcggaacccttgggctggtcgccttcggcttcatgctcttcatcctgatcacctccaatccatttgagcgcctgcttccagccgccgccgaagggcgcgacttgaacccgctgctacaggacccgggactcgtcatccatccgcccatgctctacatgggttacgtcggtttctcggtcgccttcgcctttgccattgcagccctgctttctggccagttggatgccgcctgggcacgctggtcgcggccatggaccatggctgcctggtgcttcctgaccatgggcatcgccctcggctcgtggtgggcctattacgaactgggctggggcggctggtggttctgggatccggttgaaaacgcctcgttcatgccctggctggtcggcacggcgctgatccactcattggcggtcaccgaaaagcgcggcagtttcaagaactggacggttctgctggccatctctgccttctcgctgtcgctgctcggcaccttcctggtccgttccggcgtactgacctcggttcatgccttcgccaccgatccacggcgcggtatcttcatcctgattttcctggtcgccgtcatcggtagctcgctggcactgttcgcctggcgggcgccgaaggttggcctgggtggccgttttgggctgatttctcgcgagtcgctgctgctaaccaataacgtactgctcgtcgtcgcctgcgccaccgtgctcctcggcacgctctacccactgctgatcgacgccctcggcatcggcaagatttcggtcgggccaccgtacttcaacgcggttttcgttcccgtcatggctccggttctgtttctgatgggcattgctcccttcgcccgctggaaggaagcgtcgattccggacatcacccgaatcgtgcgctgggcgatggtcgccgctgcggtagtcgctatcgccctgccgctgatttacggccactggagcacgctgatcgcactgggcatcctgctcgccgcctgggtcgcgatcacgacggtgattaccttcgtcgagcgtgtccagcacacgcgtgccggccagtccttcctgagtaccgccgtcaagcagccgcgcagcttcgtcggcatgtgcctggcgcactttggcatcgccgttttcgtggttggcgtgaccatggtcaatagcttccaggacgaaaaggacatcaagatggcgccgggtgaaacaaccacggttgccggctacagtttcactttcaacggcgtcaaatccgtgcaggggccaaactacacggccgctcagggtgatttcgaccttgcggtcgacggcaaattcatgcgcaaaatgaacccggaaaagcgcaactacgcgtcctccggcatgccgatgaccgaagccgccatcgacgctggtttcctgcgcgatgtctatgtctcgctcggtgagccaatcgaccgtgacaagccggaagccgagtgggcggtgcgcgtctattacaagcccttcgttgactggatctggggtggctgcttcctgatggcactgggcggcctgctcgctctgctcgaccgccgctatcgcgtcaaatcccgcgtctcagccactgtcaaaatccctgccggaacacaacaagcatga

SEQ ID NO: 68051 - protein, 664 aa, Dechloromonas aromatica RCB
MIPELGHFALILAALVALILGTLPLVGAHQNRLAWVAIARPAASAMALLLTFSFACLVQAFVTNDFSVVYVAQHSNSLLPIQYRVAAVWGGHEGSLLLWMLFLTWWAFSVAMLSKQLPETMVARVLGTLGLVAFGFMLFILITSNPFERLLPAAAEGRDLNPLLQDPGLVIHPPMLYMGYVGFSVAFAFAIAALLSGQLDAAWARWSRPWTMAAWCFLTMGIALGSWWAYYELGWGGWWFWDPVENASFMPWLVGTALIHSLAVTEKRGSFKNWTVLLAISAFSLSLLGTFLVRSGVLTSVHAFATDPRRGIFILIFLVAVIGSSLALFAWRAPKVGLGGRFGLISRESLLLTNNVLLVVACATVLLGTLYPLLIDALGIGKISVGPPYFNAVFVPVMAPVLFLMGIAPFARWKEASIPDITRIVRWAMVAAAVVAIALPLIYGHWSTLIALGILLAAWVAITTVITFVERVQHTRAGQSFLSTAVKQPRSFVGMCLAHFGIAVFVVGVTMVNSFQDEKDIKMAPGETTTVAGYSFTFNGVKSVQGPNYTAAQGDFDLAVDGKFMRKMNPEKRNYASSGMPMTEAAIDAGFLRDVYVSLGEPIDRDKPEAEWAVRVYYKPFVDWIWGGCFLMALGGLLALLDRRYRVKSRVSATVKIPAGTQQA

SEQ ID NO: 68052 - DNA, 1989 bp, Mesorhizobium sp. BNC1
  CDS (1)..(1989)
atgagcgtcgaacttggccatttcgcactcgtgctggcgctggcgctggccttggtgcaggcgctggtgccgctcctcggcgcgcgcttgggcagcgctccgctgatgcggatgggcgaaccggtggccattaccgggtttgcgctgatcgcgttcgccttcgcggcgctggtgcttgcctatgtccaatcggatttctcggtgctgaatgtgtgggagaactcacactcggccaagccgcttctgttcaagattaccgggacttggggcaatcatgaaggctcgatgctcctttgggtgctgatcctagcctttttcggggctcttgtggcagccttcggccagaatctgccgccaacgctcagggccaatgtgctggccatacagggcctgattgccagcgccttcctcctgttcatcctctttacctccaatcccttcatccgccttgagcgggcgccgattgaaggccgtgacctcaatccgatcctgcaggacatcgggctcgcgatccatccgccgctgctctatctcggctatgtggggttctcgatctccttttcgttcgcggtggcggcgctgatcgacgggcgcctggacgcggcttgggcacggtgggtgcgtccgtggacgctcgttgcctgggccttcctcaccggcggcatcgcgatgggctcctactgggcctattatgaattgggatggggcggcttctggttctgggacccggtggagaacgcttccctgatgccctggctggcgggtacggcgttgctgcactcggccattgtcatggaaaagcgctcggcactgaaaatctggacggtgctgctggccattctcactttttcgctgtcgctgcttggcacatttctggtccgctcgggcgttttgacctctgttcactcctttgcgacagatcccacacgcggcgtcttcattcttgcgatactggtgttctttatcggcggcgctctggctttgtttgcagtaaggggcgcgtcgctcgcgccgggtggactgttccatcccatttccagggagggggcgcttgtcttcaacaatctgatgcttacgaccgcggcggcgacggtgctcatcggcactctctaccccctgctgatcgaggccatcagcgaagacaagatttccgtcggcgcgccgttctttaatctgaccttcgtgccgctgttcctgccgctcctgctggccgtgccttttgggccgcttctcgcctggaagcgcggcgatctgccaggagctctccagcgcctgcaattcgcgttctgggcagccggggcggccgcaatcgcgagctatttcctgattgaccgcgccaacgccgcagctgcgctcggcatcggcctggggctgtggcttgtcttcggcgcgctgacagatctcgctttcaaatccggcatcggcaaggtcgggccagcacttgcccttcgccggctctccggcttgcccctttcgatgttcggcacctgtttcgcacatgccgggctgggccttaccgtgctcggcattgtctccgtcaccgcgcttcaggccgagaaaatcctgacaatgcagccaggccagagcaccgaaatcagcggctacactcttcgcttcgtggatctgcggcccttcaccggcccaaattacacggaagaccgcgccgagttcgcgctcgggaccacccgcggtgcgtcgctgggggaactcgtttcgtccaagcgtctttatacggcccggggtatgccgacgaccgaagccggcatcagaacgatgggcctgagccagctctatgtttcgatcggtgaccgtacaccggctgggctcgtcgtgcggatctggtggaagcctttcgtcacgctgatctgggccggtgcgctggtgatgatgggcggcggcttcatctctctcatggaccgcaggctgcgcgtcggtgcgccggcaaggcgcaaagcagcgctcgcggcggacggtgggggaacgcgatga

SEQ ID NO: 68053 - protein, 662 aa, Mesorhizobium sp. BNC1
MSVELGHFALVLALALALVQALVPLLGARLGSAPLMRMGEPVAITGFALIAFAFAALVLAYVQSDFSVLNVWENSHSAKPLLFKITGTWGNHEGSMLLWVLILAFFGALVAAFGQNLPPTLRANVLAIQGLIASAFLLFILFTSNPFIRLERAPIEGRDLNPILQDIGLAIHPPLLYLGYVGFSISFSFAVAALIDGRLDAAWARWVRPWTLVAWAFLTGGIAMGSYWAYYELGWGGFWFWDPVENASLMPWLAGTALLHSAIVMEKRSALKIWTVLLAILTFSLSLLGTFLVRSGVLTSVHSFATDPTRGVFILAILVFFIGGALALFAVRGASLAPGGLFHPISREGALVFNNLMLTTAAATVLIGTLYPLLIEAISEDKISVGAPFFNLTFVPLFLPLLLAVPFGPLLAWKRGDLPGALQRLQFAFWAAGAAAIASYFLIDRANAAAALGIGLGLWLVFGALTDLAFKSGIGKVGPALALRRLSGLPLSMFGTCFAHAGLGLTVLGIVSVTALQAEKILTMQPGQSTEISGYTLRFVDLRPFTGPNYTEDRAEFALGTTRGASLGELVSSKRLYTARGMPTTEAGIRTMGLSQLYVSIGDRTPAGLVVRIWWKPFVTLIWAGALVMMGGGFISLMDRRLRVGAPARRKAALAADGGGTR

SEQ ID NO: 68054 - DNA, 1908 bp, Haemophilus influenzae R2866
  CDS (1)..(1908)
atgctcccagaacttggctttttccttcttttactcgcaacagctagcgcgttttttcttgcgttagtgcctcaatttgggttattcaaaaaaaattcgactttaattaatgctgcttggccgcttagttatatttttacccttgcgacgacgttctcaattggtttgcttgcttattcttttgcggtggatgatttcacccttgaatatgtagcggcacattctaattcccaattacctacattttttaaaatggctgccacttggggaggacatgaaggttcaatgttgttttggttattttcattgagtttatggcttgctgcttttgctttttttaatcgaaaaaatgaccgcactttttccgctcaatctttatctttattgggattgatttgctttggttttgcggtgtttattttattttattccaatccatttggacgcattttccctgctcccgcagaagggcgcgatctcaatccaatgttgcaagatgtgggattaattttccatccgcctttattatatgttggctatgtgggctttgcggtaaattttgcaatgagtttgagtgcgttgatttataaccaatctgcacgacaaattgcccgctcaatgcgtggatgggtgttggtttcttggttgtttttaaccattggtattgtgctcggtgcttggtgggcatattacgagctcggctggggcggttggtggttctgggatcccgtagaaaatgcgtctttaatgccttggttacttgggttagcgttattacacagtttaatggcgacggaaaaacaaggcgtatttagttattggacaacgcttttttctctgcttgcttttgcctttagcgtattaggcacgtttattgttcgttctggtgcgctcacttctgtgcacgcctttgcattggataacacgcgcggttatgtgttgttattaattttctttgttttgacagcgttagcctttggtttattcgctttacgagcgggaagttcatcagaaagtgcggtgaaatttcagttcatttctaaatcaggtggcattttattactgaatattttgctgaccattgcgacggtttctacctttttaggtaccttttacccgatgttattccaagcgatgaattggggctcaatttcggtgggaagtccttattttaatagtattttcttccccattattacggcgattttaatcttaatggtaattgtgcttagcatacgtaaggggcaatttgatcgcacattattgatacgttatgggtggttgcttattccgtctttgattcttgcaggcctaatgatttggcaacagctacgccataattctgcgttgaattttcacgctttcgcctttgtgttattaactcttgcgatttggcttttattcgtcacgttatggcaaaattggcgacaaattcgcttgtctcaatttgggatgattttagcacactgtggcgtggcgattgtgactattggtgcggtgatgactgggtattttggcagtgaaattggtgtgcgtttagcaccgcaacaaagtcaaacgctggggcaatatgaatttcattatcgccaattttctaatgaaattgggccaaattttacggcagaagtcgccttttttgacgtaactaaaaatggtaaaccttatgcaaaaattatcccagaacgccgttattacgatgtacgaacaatgacaatgagtgaagtggggcttgatggtggtttttggggagatttatatattgtgatgggcgattctctcggcaaaggggaatttactttccgcttacattataaaccactgattcgttggctctgggcgggcggtattttaatggcctttggcgcactttttagcgttttcggattacgcagaaaacaggaaaaataa

SEQ ID NO: 68055 - protein, 635 aa, Haemophilus influenzae R2866
MLPELGFFLLLLATASAFFLALVPQFGLFKKNSTLINAAWPLSYIFTLATTFSIGLLAYSFAVDDFTLEYVAAHSNSQLPTFFKMAATWGGHEGSMLFWLFSLSLWLAAFAFFNRKNDRTFSAQSLSLLGLICFGFAVFILFYSNPFGRIFPAPAEGRDLNPMLQDVGLIFHPPLLYVGYVGFAVNFAMSLSALIYNQSARQIARSMRGWVLVSWLFLTIGIVLGAWWAYYELGWGGWWFWDPVENASLMPWLLGLALLHSLMATEKQGVFSYWTTLFSLLAFAFSVLGTFIVRSGALTSVHAFALDNTRGYVLLLIFFVLTALAFGLFALRAGSSSESAVKFQFISKSGGILLLNILLTIATVSTFLGTFYPMLFQAMNWGSISVGSPYFNSIFFPIITAILILMVIVLSIRKGQFDRTLLIRYGWLLIPSLILAGLMIWQQLRHNSALNFHAFAFVLLTLAIWLLFVTLWQNWRQIRLSQFGMILAHCGVAIVTIGAVMTGYFGSEIGVRLAPQQSQTLGQYEFHYRQFSNEIGPNFTAEVAFFDVTKNGKPYAKIIPERRYYDVRTMTMSEVGLDGGFWGDLYIVMGDSLGKGEFTFRLHYKPLIRWLWAGGILMAFGALFSVFGLRRKQEK

SEQ ID NO: 68056 - DNA, 1935 bp, Ehrlichia canis str. Jake
  CDS (1)..(1935)
atgattaatttaatagagcttccgcttttaatagcgtgtgtattttcaattgtatatccatttgtttcttatttatctttttgctggtcaaaggtatttacaatattgatatttatgctgacaagttctgctatgggtttactgttgtatacacacattgttgatgatttctcattttataatgtgtactacaactcacatacaacgaaacctttattatataaaatatttggtatttggggtaatcatgaaggctctattttattatgggtatggataataagtttttatagtttactattagagttttttcttgaaagggaagatctcaaaaaaatagctatttcaatacaacatataatgaactttggatttttgttatttaccttgttcatatctaacccttttctaaagatgcctactattgaatatgaaggattagggtttaaccctatactgcaggatactgggttaatgatacatcctcctattttgtatttaggatatgtaggatttagtgtagtgttttcccttgctgtagctggtgtaatcgttcaaaaggatagtgtaaaatgggcaactattataaataagtgggtcttgttagcgtggtcatttttaactttaggaatagggttaggtagctggtgggcttatagagaattaggttggggaggattttggttttgggatcctgttgaaaatgcttcacttatgccatggctatttggaacagctttacttcatttgctgcccttagttagaaagtttaatatattttataactttgcaattttattatcaattttttcatttataatgagcctgattggtacgttcttagtgagatctggtgttttaatatctgttcatgcttttgctaatgatccaaagtgtggattctatatattaatgttgattggtatcataattagtagtgggattgtaagtttcatttgttttgcaaagaaggctcaagagaaaaaacatgattttttactcttgtcaaaagtaacaatgttgttgtttaacaatgttctgctgttaacagcttttactatagtatttatcggtactatatatcctattgtattagaagttataacaggagatgttatttctataggtgcaccgtattataattctttatttaactatttaatattttgtactttgttattgatgatcattgttatgggattggacaaaaagagaaataaaattttagtagagaattttaagttttcaggacttataacttcattgattgttccttttattatagataataatttttttattattgcaatgattctattatcagttttattgtttttatctgtactggaaacctattgtaggaaaataagaatacttgctgtgccattttgtgaaactgccagattaattaaatcatactctacaaaatattattccatgctagtgtcacacattggtgttgctgtttttatatttggtgtgattggatctactgtatggggcgaaacttatgaactttatatgaaggaaggcaactctgttaagacaaaaaatcttcaagttgttttatctaaattatcttttgtaaaaaatgaaaattacaatgctatacgtggaaagtttctaataataaagtctggggaaatattagataaaatatttcctgagaatagattttatatagttgaaggagttagaaatactgaaagtgctatatatagacattggttatctgatgtttatattgtgattggtgatatagataaagcgatgggtatagcagtaaagatatattataagccttttataaatttgatatggataggatttttgttaatcacgtttggtggtgttataggattgttcgctaacactactacaagaaaagcttcgatgtttgaagaattgaaagctgatgattccacttgtatgtga

SEQ ID NO: 68057 - protein, 644 aa, Ehrlichia canis str. Jake
MINLIELPLLIACVFSIVYPFVSYLSFCWSKVFTILIFMLTSSAMGLLLYTHIVDDFSFYNVYYNSHTTKPLLYKIFGIWGNHEGSILLWVWIISFYSLLLEFFLEREDLKKIAISIQHIMNFGFLLFTLFISNPFLKMPTIEYEGLGFNPILQDTGLMIHPPILYLGYVGFSVVFSLAVAGVIVQKDSVKWATIINKWVLLAWSFLTLGIGLGSWWAYRELGWGGFWFWDPVENASLMPWLFGTALLHLLPLVRKFNIFYNFAILLSIFSFIMSLIGTFLVRSGVLISVHAFANDPKCGFYILMLIGIIISSGIVSFICFAKKAQEKKHDFLLLSKVTMLLFNNVLLLTAFTIVFIGTIYPIVLEVITGDVISIGAPYYNSLFNYLIFCTLLLMIIVMGLDKKRNKILVENFKFSGLITSLIVPFIIDNNFFIIAMILLSVLLFLSVLETYCRKIRILAVPFCETARLIKSYSTKYYSMLVSHIGVAVFIFGVIGSTVWGETYELYMKEGNSVKTKNLQVVLSKLSFVKNENYNAIRGKFLIIKSGEILDKIFPENRFYIVEGVRNTESAIYRHWLSDVYIVIGDIDKAMGIAVKIYYKPFINLIWIGFLLITFGGVIGLFANTTTRKASMFEELKADDSTCM

SEQ ID NO: 68058 - DNA, 1986 bp, Rubrivivax gelatinosus PM1
  CDS (1)..(1986)
atgattcccgagctcgggcagatcgcgctgctgctggcgctggccaccgccctgatccagggcaccctgccgctgctgggcgccgctcgcggccgcgccgactggatggcgctcgcgcggccggcggcgcagacgcagttcctgctggtcgcgctggccttcggctgcctggtggcgtccttcgtgcgacacgacttctcggtgctgaacgtggccaccaactcgaacagcgcgctgccgctgttctaccgcatcgccgcctcctggggcagccacgagggctcgctgctgctgtgggtgctgatgctcagcagctggacgctcgcggtggcgctgcgcagccgccacctgccggtgccggtggtgtcgcgcatcctcgcggtgatgggcctgatcagcgtgggcttcctgctgttcatgctgatcacctccaaccccttcgaccgcctgttcccggtcccaccggacggcaacgacctgaacccgctgctgcaggaccccggcatgatcgtgcacccgccgatgctctacatgggctacgtgggcttctcggtggccttcgccttcgccgtcgcggcgctgctcggcggcacgctcgacgccacctgggcgcgctggacgcggccctggaccaccgccgcctgggccttcctgacgctgggcatcatgctcggcagcacctgggcctactacgtgctgggctggggcggctggtggttctgggacccggtggagaacgcctccttcctgccctggctggccggcacggcgctgatccattcgctggcggtcaccgagaagcgcggcgccttcaagtcctggacggtgctgctggcgatcgtcgccttctcgctgtcgctgctcggcaccttcctcgtgcgctcgggcgtgctgtcgtcggtccacgccttcgccacggacccgcagcgcggcctgttcatcctgctgttcctggtcatcgtgatcggcggctcgctcaccctgtacgcgtggcgcgcgcccaaggtggggctcggcgcgcgcttcggcgtggtgtcgcgcgagtcgatgctgctcgccaacaacgtgctgttcgtcgtcgccacgctgtcggtgctgctcggcacgctctacccgctgctgctcgacgccatgggcctgggcaagatctccgtcgggccgccctacttcgacgccgtgttcgtgccgctcatggcgccagcggtgttcttgctcggcgtggggccgctggcgcgctggaagcaggccgaactgcccgacctggcccgccggctgcgctgggctgccgccatcgcggtggtcgcggcgctgctcacgggctggctggccggccgcatcgcgctgggcgcgacgctcggcctgctgatgagctactggatcgtcgccgccctcggggtcgacctgtgggagcggctgcgcccggccggtggcctgccgatgagcctggcggcccgcgcgcggcagctgccgcgcgcgatgctcggcatgatgctggcccacctgggcgtggcggtgttcgccttcggcgtgagcatggtcaccacctaccagctcgagcgtgacgtgaagatggcgatcggcgacaccaccgaggccggcggcttcgtgttcgcgctgcgcggcctgaaggagatccagggcccgaactacgacggcctgcagggccagatcgaagtcacgcgcgacggcaaggcggtggcgctgctgaagcccgagaagcgcatctaccgcgtgcagcgcaacccgatgaccgaggccgacatcaaccgcggcatcacgcgcgacctctacgtgtcgctgggcgagcccaccgccgacggcagctggatcgtgcgggtctacttcaagcccttcgtcaactggatctggggcggctgcgtcctgatggcgctgggcggcgccctcgcggcgagcgatcggcgctaccgcgcccggcagcgccaggagcacgggcagcaggccggcccggccggagcggtggcgtga

SEQ ID NO: 68059 - protein, 661 aa, Rubrivivax gelatinosus PM1
MIPELGQIALLLALATALIQGTLPLLGAARGRADWMALARPAAQTQFLLVALAFGCLVASFVRHDFSVLNVATNSNSALPLFYRIAASWGSHEGSLLLWVLMLSSWTLAVALRSRHLPVPVVSRILAVMGLISVGFLLFMLITSNPFDRLFPVPPDGNDLNPLLQDPGMIVHPPMLYMGYVGFSVAFAFAVAALLGGTLDATWARWTRPWTTAAWAFLTLGIMLGSTWAYYVLGWGGWWFWDPVENASFLPWLAGTALIHSLAVTEKRGAFKSWTVLLAIVAFSLSLLGTFLVRSGVLSSVHAFATDPQRGLFILLFLVIVIGGSLTLYAWRAPKVGLGARFGVVSRESMLLANNVLFVVATLSVLLGTLYPLLLDAMGLGKISVGPPYFDAVFVPLMAPAVFLLGVGPLARWKQAELPDLARRLRWAAAIAVVAALLTGWLAGRIALGATLGLLMSYWIVAALGVDLWERLRPAGGLPMSLAARARQLPRAMLGMMLAHLGVAVFAFGVSMVTTYQLERDVKMAIGDTTEAGGFVFALRGLKEIQGPNYDGLQGQIEVTRDGKAVALLKPEKRIYRVQRNPMTEADINRGITRDLYVSLGEPTADGSWIVRVYFKPFVNWIWGGCVLMALGGALAASDRRYRARQRQEHGQQAGPAGAVA

SEQ ID NO: 68060 - DNA, 1962 bp, Pseudomonas fluorescens PfO-1
  CDS (1)..(1962)
ttgggccatctggccatgatcctggcgctgtgtttcgcgctggtgcaggcggtggtgccgttgctcggtgcctggcgcggtgatcgtctgtggatgggcctcgctcaaccggcggcgtgggggcagttcgcgttcctgctgttcgccttcggttgcctgacctacgccttcatgaccgacgatttctccgtggcctacgtcgcgatgaactccaacagcgcgctgccgtggtactacaagttcagcgcggtgtggggcgcccacgaagggtcgctgctgctgtgggcgctgatcctcggcggctggaccttcgcggtgtcggtgttctcgcggcagttgccgcaagtcatgctcgctcgcgtgctggcggtgatgggcatgatcagcaccggttttctgctgttcctgatcctcacctcgaacccgttttcgcggatcctgccgcagatcccggccgacggtcgtgacctcaatccgctgctgcaggacatcggcctgatcgttcatccgccgatgctgtacatgggctatgtcggtttctcggtggccttcgcgtttgccattgccgcattgctgggcggtcgtctcgatgcggcgtgggcacgctggtcgcgtccgtggaccatcgtcgcctgggccttcctcggcatcggcatcaccctcggttcatggtgggcttactacgaactcggctggggcggctggtggttctgggacccggtggaaaacgcatcgttcatgccatggctggtgggcacggcgctgattcactcgctggcggtcaccgagaaacgtggcgtgttcaagagctggacggtgttgctggcgattgccgcattctccctgagcctgctcggtacgttcctcgtacgttccggcgtgctgacctcggtgcacgcgtttgcctccgatcctgagcgcggcgtgttcatcctgatcttcctgctgttcgtggtcggtggttcgctgacactgtttgcgctgcgcgcgccggtggtcaagagccaggtcggtttcaatctgtggtcgcgggaaaccctgctgctgggtaacaacctggtgctggtggtggcggcgtcgatgatcctgctcggcacgctgtacccgctgattctcgatgcgatcagcggcgccaagctgtcggtcggcccgccgtacttcaacgcgctgttcattccgttgatggcgctgttgatgctggtgatggcggtcggcgtgatcgtgcgctggaaggacaccccggtgaaatggctggtcagtatgctgactccggtgctgctgggcagcgtcgcgctggcggtggtggccggtgtcgcttatggtgatttcaactgggcggtgatcgcgacgttcctgcttgcggcctgggtgttgctggccggtgtgcgcgacatcttcgacaagactcgtcacaaaggcctgatcaaaggcctgccgaccctgacccgcagctactggggcatgcagatcgcccacctcgggatcgccgtctgcgcgctgggcgtggtgttgtcgagccagaacagtgccgaacgtgacctgcgtctggcaccgggcgaatcaatggacctggccggttatcagttcgtgtttgaaggcgccaagcacttcgaaggcccgaacttcacttccgacaagggcaccgtccgggtgatccgcaacggtcaggaagtcagcgtgctgcacccggaaaaacgcctgtacaccgtgcagaactcggtgatgaccgaagccgggatcgacgccggtttcacccgtgacctctacgtcgctttgggtgaaccgctgggcgatggcgcctgggcagtgcgggtccacgtcaaaccgttcgtgcgctggatctggttcggcggcctgctgaccggtttcggtggtttgctggcggcgctggatcggcgttatcgagtgaaggtcaaagccaaagtgcgtgaagcgctgggcatggaaggagccgctgcatga

SEQ ID NO: 68061 - protein, 653 aa, Pseudomonas fluorescens PfO-1
MGHLAMILALCFALVQAVVPLLGAWRGDRLWMGLAQPAAWGQFAFLLFAFGCLTYAFMTDDFSVAYVAMNSNSALPWYYKFSAVWGAHEGSLLLWALILGGWTFAVSVFSRQLPQVMLARVLAVMGMISTGFLLFLILTSNPFSRILPQIPADGRDLNPLLQDIGLIVHPPMLYMGYVGFSVAFAFAIAALLGGRLDAAWARWSRPWTIVAWAFLGIGITLGSWWAYYELGWGGWWFWDPVENASFMPWLVGTALIHSLAVTEKRGVFKSWTVLLAIAAFSLSLLGTFLVRSGVLTSVHAFASDPERGVFILIFLLFVVGGSLTLFALRAPVVKSQVGFNLWSRETLLLGNNLVLVVAASMILLGTLYPLILDAISGAKLSVGPPYFNALFIPLMALLMLVMAVGVIVRWKDTPVKWLVSMLTPVLLGSVALAVVAGVAYGDFNWAVIATFLLAAWVLLAGVRDIFDKTRHKGLIKGLPTLTRSYWGMQIAHLGIAVCALGVVLSSQNSAERDLRLAPGESMDLAGYQFVFEGAKHFEGPNFTSDKGTVRVIRNGQEVSVLHPEKRLYTVQNSVMTEAGIDAGFTRDLYVALGEPLGDGAWAVRVHVKPFVRWIWFGGLLTGFGGLLAALDRRYRVKVKAKVREALGMEGAAA

SEQ ID NO: 68062 - DNA, 2016 bp, Rhodospirillum rubrum
  CDS (1)..(2016)
atgatcgccgagcttggacatttctgcctcgtgctcgccctgttcgtcgccctcgtccaggcggtggtgccgatggttggggcgcagcgcggcaatctggcgtggatggacttggcgcgcagcggctcggtcgccctgttcggcctgatcgttctggccttcgccgccctgacctattgctatgtcgtcagcgacttctcggtgatgaacgtcttcgagaacagccatagcgacaagccgatgctctataaggtctcgggcgtctggggcaatcacgaggggtcgctgctgctgtggatcctgatcctgtcgggcttcagtctggcggtcagtctggtcggcggcaatctgccccccgccctgcgggcccgcaccctgtcggtccaggcgatgatcacctgcggctttttgctgttcatcttgttcacctccaatcccttcgcccgggtgcccggcctcgaggttcccttgaatggccgcggccttaacccgctgctccaggatcccggcctcgccttccatccgcccatgctctatgccggctatgtcggcttctcgatggccttctccttcgccatcgccgccctgatcgagggcaaggtcgatgccgcctgggcccgctgggtccgcccgtggacgctggtggcctgggtcttcctgaccttcggcatcgccctgggcagttggtgggcctattacgaactgggctggggcggctggtggttctgggacccggtcgagaacgccagcttcatcccctggctatcgggcacggcgctgctgcattcggccgtcgtcgtcgagaagcgcgacgccttgaaatcctggacgatcctgctggcgatcgtcaccttctcgctgtcgctgcttggcactttcctggtgcgttcgggcgtcatcacctcggttcacgcctttgccaccgatcccacgcgcggcctgttcattctggggctgctgctggtcgccatcggcggatccttcaccctttacgccgtgcgcgccccggcgctgaagggcggcgggctgttcgcgccgatttcgcgcgaaggcgggctgttgatcaataatctgctgatgagcacggcctcggccacggtgctgctcggcacgctgtatccgctgatcgccgacgccctcgatttgggcaaggtcacggtgggcgcgccgttcttcaaccgggtcttcctgccgctgatggtgcccttgctggtgctgatggcgatcggcccgctgctgtcgtggaagcgcgccgatctgcgtggggcgctcggccggctgaagggcgcgctgatcgtcgcggcgctggttttcgccggcaccttcctggcgaccgggggcggtctggcccaggtcggcgccgccgccggcatgaccctggccgcctgggtgctggtcggcaccctggtcgaactggccgatcggatccgctttttgcgcattcccttagccgattcgctgcgccgcctcgtcggtctgccgcgatcgacctggggcatggttctggcccatggcggcatggggctggtggtgatcggcgtcgttggcaatacggcctggaaggccgaaagcatccagaccctgcgcccgggcgaaagccgcgagctggccggccataccttcaccctgcaaggcgccgccccgatccagggccccaattacgaggcgctgcgcggcgatatcctcctgtcgcgcgagggcgagaccctggcccgcttggctcccgagaagcggctttacaccaccccgccgatgccgaccaccgaggccgggatccacagcaacggcctgtcggactattacgcggtgatcggcgatcccaccgacaacggcggcttcgtcacccgcttctattacgagccggcggtgcctttcttgtggtatggcgccttgttcatgggcctgggcggactggtctcgctgtcggatcgccgccaccgggtgggggcgccaacggcgcgccgcgtctccccggccaagaccgccagcccccccgcccccgccccggcggaataa

SEQ ID NO: 68063 - protein, 671 aa, Rhodospirillum rubrum
MIAELGHFCLVLALFVALVQAVVPMVGAQRGNLAWMDLARSGSVALFGLIVLAFAALTYCYVVSDFSVMNVFENSHSDKPMLYKVSGVWGNHEGSLLLWILILSGFSLAVSLVGGNLPPALRARTLSVQAMITCGFLLFILFTSNPFARVPGLEVPLNGRGLNPLLQDPGLAFHPPMLYAGYVGFSMAFSFAIAALIEGKVDAAWARWVRPWTLVAWVFLTFGIALGSWWAYYELGWGGWWFWDPVENASFIPWLSGTALLHSAVVVEKRDALKSWTILLAIVTFSLSLLGTFLVRSGVITSVHAFATDPTRGLFILGLLLVAIGGSFTLYAVRAPALKGGGLFAPISREGGLLINNLLMSTASATVLLGTLYPLIADALDLGKVTVGAPFFNRVFLPLMVPLLVLMAIGPLLSWKRADLRGALGRLKGALIVAALVFAGTFLATGGGLAQVGAAAGMTLAAWVLVGTLVELADRIRFLRIPLADSLRRLVGLPRSTWGMVLAHGGMGLVVIGVVGNTAWKAESIQTLRPGESRELAGHTFTLQGAAPIQGPNYEALRGDILLSREGETLARLAPEKRLYTTPPMPTTEAGIHSNGLSDYYAVIGDPTDNGGFVTRFYYEPAVPFLWYGALFMGLGGLVSLSDRRHRVGAPTARRVSPAKTASPPAPAPAE

SEQ ID NO: 68064 - DNA, 1962 bp, Ralstonia metallidurans CH34
  CDS (1)..(1962)
atgattccagaaatcggccacctcgccctcatcgctgccttgttcgtggcactcgctcaaggtgttcttgccctggccggcgcggcgcgagccaacctcacctggatcgcgttcgcccgccccgctgcacgcgctcaattcctgttggtgatggtcggttttgccgcgctcacctgggcctttgtcgcgaaggactactcggtcgcctacgtcgctcaaaactccaattctcagctcccgctgggctacagaatggccgcggtctggggcggacatgagggttcgctcctgctctggctgctgatgcagaccggctgggcctatgcggtcagccggttgtcgaaacagcttccggatgccatggtggcgcgcgttctgggcgtgctcggcctggtgacggccggcttcctgctgttcgtcctgttgacctccaatcccttcgagcgacttttcccggtaccgcaagatggatgggatctgaatccgctcctgcaggatatcggcttgatctttcatccaccgctgctttacatggggtacgtcggattttcggtggccttcgcattcgcgattgctgcattgcttgccggacaactggactcgacgtgggcacgctggtctcgtccctgggccaccgcagcctgggcaaatctgacggtcggaatcgccttggggagttggtgggcctactacgagttgggctgggggggctggtggttttgggacccggtcgagaactcgtcgttcatcccctggctggtgggcaccgccttgatccactctttggcggtgacggaaaagcgggccagtttcaagaactggacggtgctgctctcgatcggcgcattttcttgctcgcttttgggtgcctttctggtgcgctcgggcgtactgacttctgtgcatgcatttgccaccgatccgcgacgcgggttattcattctgattctgctgacggtcattgtgggcacgtcgctcgctttgttcgcatggcgagcccctaaggtcggcatgggaggacggttcgacatggtctccagggagtccttgctgctggtcaacaatgtgctgttggtcgtcactgccggcgctgtcgcgctcggtacgctgtacccactgctcgtcgatgcgctgggcctgggcaagctctccgtggggccgccatacttcaatgcggtgttcgtgccattgatgatccccgcgttgcttctgattgcggtaggacccgccgccaattggaaggccgcccagttcggtgccatcttcaggcagttgcgcgtgccgatgattgctgcacccctggtgggcctgaccgccccgttcgtgctggggcactggtcagcttctgcggcgttgggcttgatgctcgccacgtggattgcggtgtcggtggtgacgggcatcttcggccgaatgcgcgccacccgcggcgggttgcgtgcccagccacgcagttggcttgggatgcatatggcgcatctgggcatcgcggtattcgtgactggcgtgaccatcgtcagtgggtatgagaccgagcgagacgttcgattggcccagggcgagtccgtcagcatcggcggctacgacctcactttgatcggcgtcagaagcacgcgggggcccaactacgtggcgcagataggcgatatcgaactgtcgcgcgacggcaaggtcttgcgtcggctgcatccggaaaagcgcaattacccggcctcgcagatgccgatgaccgaggtggcgatcgatgcaaacggactgcgccacgtctacgcggcgctcggcgaaccgctcggcgacggtgtttggagcgttcgtgtctaccacaagccattcgttgactggatctggatcggctgcatcctgatggcgcttggcggtggcttggccatcagcgatcgtcgataccgtctgaagcctcgccgtcaacacgtcgctccgccattgcccgaggccgcatcatga

SEQ ID NO: 68065 - protein, 653 aa, Ralstonia metallidurans CH34
MIPEIGHLALIAALFVALAQGVLALAGAARANLTWIAFARPAARAQFLLVMVGFAALTWAFVAKDYSVAYVAQNSNSQLPLGYRMAAVWGGHEGSLLLWLLMQTGWAYAVSRLSKQLPDAMVARVLGVLGLVTAGFLLFVLLTSNPFERLFPVPQDGWDLNPLLQDIGLIFHPPLLYMGYVGFSVAFAFAIAALLAGQLDSTWARWSRPWATAAWANLTVGIALGSWWAYYELGWGGWWFWDPVENSSFIPWLVGTALIHSLAVTEKRASFKNWTVLLSIGAFSCSLLGAFLVRSGVLTSVHAFATDPRRGLFILILLTVIVGTSLALFAWRAPKVGMGGRFDMVSRESLLLVNNVLLVVTAGAVALGTLYPLLVDALGLGKLSVGPPYFNAVFVPLMIPALLLIAVGPAANWKAAQFGAIFRQLRVPMIAAPLVGLTAPFVLGHWSASAALGLMLATWIAVSVVTGIFGRMRATRGGLRAQPRSWLGMHMAHLGIAVFVTGVTIVSGYETERDVRLAQGESVSIGGYDLTLIGVRSTRGPNYVAQIGDIELSRDGKVLRRLHPEKRNYPASQMPMTEVAIDANGLRHVYAALGEPLGDGVWSVRVYHKPFVDWIWIGCILMALGGGLAISDRRYRLKPRRQHVAPPLPEAAS

SEQ ID NO: 68066 - DNA, 2043 bp, Ralstonia metallidurans CH34
  CDS (1)..(2043)
atgaatccggaactgggccacttcgcactgatcctggccatgctcgtggcgctggtgctggcaacgctgccgatggtgggcgcggcgcgcggcaatgttgcctggatgtgccttgcacggcccgccgccttcctgcatggcacgctgctgatcgcggcctacctctcgctgacatacgctttcgtcgacaacgacttcagcgtgctctatgtggcggcgaactctaacagcgcgctgccactgatctaccgcatggcggcggtatggggcggccatgaggggtcgatgctgctgtggtcgctgatgctggcgctgtgggcaatggccgtggctggcttcagccgccgcctgccactggcgttcgtcgcccgcgtgcttggcgtgatggggggcatcagcaccggactgctgctgttcgtgctgttcgcatcgaatccgttcctgcgtctgttgccccgcgcgatggaggggcgcgacctcaatccgctgctgcaggaccccggcatggtgttccatccgccattcctgtacatgggctacgtcggcttcgcggtggcattctcattcgcggtggcggccttgcttgaaggacgactcgacgcggcctgggcacgctggtcgcgcccgtggacgatcctggcgtggatgttcctgaccatcggcatcgcgatgggcagcatgtgggcctactacgaactgggctggggcggctggtggttctgggacccggtggagaacgcgtcgttcatgccctggctggccggcaccgcgctgatccactcgctggcggtcaccgagaagcgcggcgcgttccgcgcctggaccgctctgctggcgatcttcacgttctcgctgagcctgctcggcacgttcctggtccgctctggcgtgcttacctcggtccacgcgttcgcggtggatccccggcgcggcatcttcatcctgacgttgctgggactggtcacggggctggcgctcgcgctattcgcgtggcgcgcgccccggctgacccagcgcaccgatttcaacctgacctcgcgcgagtcttttctgctggccaataacgtgctgctggccgtggccgcctcggcggtgctgctcggcacgctgtatccgctgctgctcgacgtgctggacctcggcaaggtatcggtcggccccgagtacttcgaagaagtgttcgtgccgctgatggcccccgccgtgctgctgatgggtgccgccccgctggcacgctggggacgcagcgacctgcccgacatggccaggcgactgcgctgggcggccgtggcaagtgtggtcatcgcgcttgggctgctggccgtgctgcgcaacagctccgccatgaccgggctcggcctcacgctggccgcgtggtgtgcaatgagcgggctggccagcctggccacgcagatgcggcacgcgcgggactggcgctccggcctgcgccagttgccggccggctactacggcatgttgctggcccacatcggcgtgggcgtgttcatcaccggcgtcacgctggtcaagagccaggagagcgtgcgcgagttgtcgatgcgcgtgggcgattcggtcgcggttggcggctacgatttccgcttcgacggtgtggcgccggtcaggggaccgaactacgacgcgctgcggggcacggtcacggtgacgcggcaaggccgtccggtcaccacgctcgccaccgagcggcgcgtctaccgcagccaggacatgccgaccaccgaggccgccatcgacaccgggctcgcacgcgatctctatgtggcgctcggcgattcgtcggatgccacgtccgccgatgcccgctgggcgctgcgggtctacgtgaagcccttcgtctcgtgggtctggggcggctgcgcgttgatggcgctgggcggactccttgccgccagcgaccgccgatatcgcgcgcgccatccggcggcagcggtcacgtctgcggtcacggccaatgacgatgcgggggcccggcccgccacgccaccgctgacgctgcctgctggcaaggagtccgaagcatga

SEQ ID NO: 68067 - protein, 680 aa, Ralstonia metallidurans CH34
MNPELGHFALILAMLVALVLATLPMVGAARGNVAWMCLARPAAFLHGTLLIAAYLSLTYAFVDNDFSVLYVAANSNSALPLIYRMAAVWGGHEGSMLLWSLMLALWAMAVAGFSRRLPLAFVARVLGVMGGISTGLLLFVLFASNPFLRLLPRAMEGRDLNPLLQDPGMVFHPPFLYMGYVGFAVAFSFAVAALLEGRLDAAWARWSRPWTILAWMFLTIGIAMGSMWAYYELGWGGWWFWDPVENASFMPWLAGTALIHSLAVTEKRGAFRAWTALLAIFTFSLSLLGTFLVRSGVLTSVHAFAVDPRRGIFILTLLGLVTGLALALFAWRAPRLTQRTDFNLTSRESFLLANNVLLAVAASAVLLGTLYPLLLDVLDLGKVSVGPEYFEEVFVPLMAPAVLLMGAAPLARWGRSDLPDMARRLRWAAVASVVIALGLLAVLRNSSAMTGLGLTLAAWCAMSGLASLATQMRHARDWRSGLRQLPAGYYGMLLAHIGVGVFITGVTLVKSQESVRELSMRVGDSVAVGGYDFRFDGVAPVRGPNYDALRGTVTVTRQGRPVTTLATERRVYRSQDMPTTEAAIDTGLARDLYVALGDSSDATSADARWALRVYVKPFVSWVWGGCALMALGGLLAASDRRYRARHPAAAVTSAVTANDDAGARPATPPLTLPAGKESEA

SEQ ID NO: 68068 - DNA, 2079 bp, Burkholderia fungorum LB400
  CDS (1)..(2079)
ttgattcctgaaatcgggcactttgcgctgatcctcgcgttgctgctcgcactcacgactggtgtactgccggtgatcggtgtgcagcgcggcatcgatggctggatacgtcttgcctggccggcggcgcgcgcgcagtttgctttcgtcgcgattgcttttggctgtctgtcatggtcgttcctcatcaatgacttttccgtcctctacgtggtggagaactcgaattccgcgttacccgccgtctatcgttttactgcggtctggggcggtcatgaaggctcgctgctgctgtgggtgttgctgttgacgctttggatggtggccgtcacctgtttcagcaagcaattgccggtgacgatggtggccacggtactgggtgtgatgagttggattgcgagtggctttttgctgttcatgctcttcacgtcgaacccattcagccgcctgattccgcagtccatggagggccgcgatctgaatccgctgctgcaggaccctggcatggtcattcatccgccggtgctctacgcgggctacgtcggtttctcggtggctttcgcatttgcgattgcggcgttgctgtcgggccggcttgacgcggcatgggcacgctggtcgcgcccgtggaccacggccgcctgggtgttcctgacgctgggcatcatgctgggcagcggctgggcttactacgaacttggctggggcggatggtggttctgggatccggtcgaaaacgcttcattcatgccgtggctggcgggtacggccttgatccattcgctcgcggtcacggagaagcgcggcagcttccgcagttggaccgctttgctggcgatctgcgcgttttcgttgagcctgctaggcacgttcctcgtgcgttccggcgtgattacctcggtccatgcatttgcgtccgatccgacccgcggcgtgttcatcctcgggtttcttgcgctggtggtgggtggcgcgctgcttctctttgcctggcgcgcgccgcagatcggcctgggggccggctttgagcccgtgtcgcgggaggccttgctgctgtcgaacaatgtgctgttaatggtggctgccgcgtcggtgctgctcggcacgctttatccgatggtgctggatgcacttggactcgacaagatttcggtcgggccgccgtatttcgacagcgtgttcgtgccgttgatgacgccggctatctttctgatgggcgtgggaccgcttgcccgctggaaggcggctcgcgtgcccgatctcgcggcgcgcctgcgctgggccgcggcggtcagcgtcgtcacagcgctggcgctgccgttcacgctcggcagttggcggccgctcgtcagtcttggcctgctgctcgcgacctggagcttcgcgacggtcgcggtgagcatgcgtgagcgcatcggtagccagcagggccgtcctcttctgcgattcaggcgcgtaccgcgggcgagctacggcatgtggctcgcgcacgctgggatcggtgtgtttatcgtgggtgtgacgctggtcaaaggttacgagtcggagcgcgatgtgccgatgcgcaggggccagaccgtcgaggttggcggctaccagttccgtttcgacggggtccgcgatgtcgacgggccgaactaccgtgcgacgcgcgcctcgatcgcagtgagtcgcgaggggcgaccggttacgacgctctatccggagaagcgtctttttctcgtgcagaagatgcccatgaccgaggctgcgatcgaccacggcgtgctacgcgatctgtacgtggcaatgggcgagccgattggcgaggaagcatggaccttgcggatccagatcaagccattcgttcgctggatctgggcgggttgcctgctgatggcattgggcggaatgcttgccgccagcgaccggcgatatcggttgtttccgggccggcgcgtgctgcagatgaacgaggctgcgcgtagtgctggagtgcggccccttgctgcaaacgaaattcgccaaaccggcgcgatcggagcgccgggcgtgatagctgccgcgccacaccatcccgtcaacgaggaccgcggatga

SEQ ID NO: 68069 - protein, 692 aa, Burkholderia fungorum LB400
MIPEIGHFALILALLLALTTGVLPVIGVQRGIDGWIRLAWPAARAQFAFVAIAFGCLSWSFLINDFSVLYVVENSNSALPAVYRFTAVWGGHEGSLLLWVLLLTLWMVAVTCFSKQLPVTMVATVLGVMSWIASGFLLFMLFTSNPFSRLIPQSMEGRDLNPLLQDPGMVIHPPVLYAGYVGFSVAFAFAIAALLSGRLDAAWARWSRPWTTAAWVFLTLGIMLGSGWAYYELGWGGWWFWDPVENASFMPWLAGTALIHSLAVTEKRGSFRSWTALLAICAFSLSLLGTFLVRSGVITSVHAFASDPTRGVFILGFLALVVGGALLLFAWRAPQIGLGAGFEPVSREALLLSNNVLLMVAAASVLLGTLYPMVLDALGLDKISVGPPYFDSVFVPLMTPAIFLMGVGPLARWKAARVPDLAARLRWAAAVSVVTALALPFTLGSWRPLVSLGLLLATWSFATVAVSMRERIGSQQGRPLLRFRRVPRASYGMWLAHAGIGVFIVGVTLVKGYESERDVPMRRGQTVEVGGYQFRFDGVRDVDGPNYRATRASIAVSREGRPVTTLYPEKRLFLVQKMPMTEAAIDHGVLRDLYVAMGEPIGEEAWTLRIQIKPFVRWIWAGCLLMALGGMLAASDRRYRLFPGRRVLQMNEAARSAGVRPLAANEIRQTGAIGAPGVIAAAPHHPVNEDRG

SEQ ID NO: 68070 - DNA, 1965 bp, Magnetococcus sp. MC-1
  CDS (1)..(1965)
atgtggatagaagttggacattatgccgccatcctggcgttgctgctgagtattacccaaatggtcacccctatggtgggcatacgcagtggtcagatggcctgggtcagggttggtcgctacagcgcctttgcggtgtttttgctcttgagcgtagccagtggcacactgatacacgcctttatgagccacgatttttccgtgctctatgtggcccgcaactcttccttgagcctgccatccttctatttggccaccgccatgtgggggggacatgagggctctttgttgctgtgggcttggttaatgtccttttttattgccgttgcagcatggcgccactggaacacccactcggtctcgatgccctggattttgaccattctaggggccgtgaccctgggttttctgtgcttggtattgctgctctcttcgccctttgagcggctgtttcccatccccatggatggacgggatcttaatccgctgttgcaagatcctggtatggtttttcaccccccctttctctatctgggttatgtgggttttgcggttccctatgcctttgccatggcggcactgataaccggacaggccaaggatgagtggatcttggcaacccggcgctggaccctgtttgcctggaccatgcttacgacgggcatcgtgtttggtgcctactgggcctattatgagctgggctggggcggctattgggcttgggatccggtggagaatgcctctttcatgccctggttaaccggtaccgcctttttgcattcgatcatggtgcaagagcgccgccagatgtttaaggtatggaatctattcctgattatcaccaccttttcgctctcactgctgggtacctttttggtgcgttcgggggtgcttagttcggtacatgcgtttgctaccgacccgggccggggtatgtttattttaagctttatggcggttatgttgctgtttagctttggtgtgctggtgtggcgagccgatgccttaaaagcggaaaaccgcatggacgcggtggtgtgtcgcgagagcaccttcttgtttaataacctgttcctgttggttggggcgatcacggtgctgctgggcaccctctacccgctcgctttggaagcgttgatggatgccaaggtcacggtgggccccccctactttaacaaggtgtttgtgccgattatgctgggcctgcttattctgatgggcattggtcccttgatctcttggcggcgggccgcccagggacagttaaaaaagaactttttggtgccgggtctgttggccttggtggggattcctatcgccctgctcttgggtgtgcagcacccttacgccattgttacggtgatgatcattctgtttgtgggcagcacccaccttattgatgtacagcggggcgttgcggctcgccttcaagcgggtagccacaaccccatttctgctttcgttaaaatggtcgcccgtaacaagcgccgctacggtggcctgacggtgcatattggcattctggttatgtgcgcgggttttattggcagtggcatgttccaggaggttcagaccgtcattatgcaacccggcgataaggtacgcctttcgggttgggagctgaccctggaaaagtaccatcaggtgcgtaaagataactggacagcaaccgaagcggtgatgcatggcgtgcgggaggatggtctgaccgtcagcttgcatccccaaaaacgtaagtatgataaccatgagatggagaccaccgaggcctccattatcaactttttctgggaagatctctatgtggtgttgggagatcgcatccctggcaaggggtgggccattaaagcctaccgcaaccccttgattagctgggtttggtatggctccttcatcatcgcggcgggggctatactggcactcttccagggacgccgttttaaacgcatccagggggcctcttag

SEQ ID NO: 68071 - protein, 654 aa, Magnetococcus sp. MC-1
MWIEVGHYAAILALLLSITQMVTPMVGIRSGQMAWVRVGRYSAFAVFLLLSVASGTLIHAFMSHDFSVLYVARNSSLSLPSFYLATAMWGGHEGSLLLWAWLMSFFIAVAAWRHWNTHSVSMPWILTILGAVTLGFLCLVLLLSSPFERLFPIPMDGRDLNPLLQDPGMVFHPPFLYLGYVGFAVPYAFAMAALITGQAKDEWILATRRWTLFAWTMLTTGIVFGAYWAYYELGWGGYWAWDPVENASFMPWLTGTAFLHSIMVQERRQMFKVWNLFLIITTFSLSLLGTFLVRSGVLSSVHAFATDPGRGMFILSFMAVMLLFSFGVLVWRADALKAENRMDAVVCRESTFLFNNLFLLVGAITVLLGTLYPLALEALMDAKVTVGPPYFNKVFVPIMLGLLILMGIGPLISWRRAAQGQLKKNFLVPGLLALVGIPIALLLGVQHPYAIVTVMIILFVGSTHLIDVQRGVAARLQAGSHNPISAFVKMVARNKRRYGGLTVHIGILVMCAGFIGSGMFQEVQTVIMQPGDKVRLSGWELTLEKYHQVRKDNWTATEAVMHGVREDGLTVSLHPQKRKYDNHEMETTEASIINFFWEDLYVVLGDRIPGKGWAIKAYRNPLISWVWYGSFIIAAGAILALFQGRRFKRIQGAS

SEQ ID NO: 68072 - DNA, 1968 bp, Novosphingobium aromaticivorans DSM 12444
  CDS (1)..(1968)
atgatcgctgaactcggtcttgccgtcctgtggatggcggcggcgcttgccgccttgcagcttttcgccggcgtttcggccctgcgcccaggcggcggggcggcgggcaagtcgctcgccggcatggttcgcccgctagctgtcatgcagggtgcgctcgtcgcgatctcgttcctggcgctgatcgacttgttcctggaaacggacctgtcggtgaagctcgtggcggaaaacagccactcgatgaagccgttcatcttcaagctggcgggtacgtggggcaaccacgaaggctcgatgctgctgtgggtgacgatcatggcggtatcgggcggtttcgtcgcgctcatcgagaagcgcctgcgcgaagacacgctgatcgccacgctggcggggcaggccttcgtcagcctcggcttctatgccttcctgctgttctcctcgaacccgttcgagcgactggcggaaccagcgcctgatggtgccggcctcaacccgctgctgcaggacatcggcctcgcatttcatccgcccacgctctacgtcggttatgtcgggctttcggtggcgttcagctttgccatcggcgcgctgatcacgcgtgacgtcggccccgctttcgcccgcgcgatgcgcccctgggtgctgggcgcgtggattttcctcaccatcggcatcacggccggttcctactgggcctactacacgctcggctggggtggctggtggttctgggaccctgtcgagaacgcctcgctcatgccctggctggccgcgacggcattgcttcactcggcctccgtccttgccagtcgcaacgccttgcgcgcgtggacggtgatgcttggcgtgatcgccttttcgatgtcgatggtcggcaccttcctggtgcgctcgggcatcctgacgtcggtccatgctttcgccgtcgatccggaacgcggctcgttcatccttgcgcttctggccatctacatcggcggtgcattggcactcttcggcctgcgcgcgtcgaccgtgaccgagggtgaacgtttcagcctgttcagccgtgaggcgagcctcgtgttcaacaacgtgatgctctgcggcacgctcggcatcgtgctgatcggcacgctctacccactgctgaccgaagcgttcggtgccaaggtttcggtgggacctccctatttcaatccggtatccgcgatcttcgtgattccgatgatgctcgtcatgggcgtcgggccgctgcttcgctggcgcaaggacaagccaggccgcgtgaccggcagtgtcgcggtgcctgcgctgctcaccgcgctcgtcctgctcgccgtcgtggtcctggcccccggcattcgcatcctgcccgcgctcggccttgcggttggcgccgggttggcgctggcgagctggttcccgctcaggggccgcaacctgcgccgcacgccgctcagcgtctggggcatggtcttcggccacttcggcattgccgtcgccttgctcggcgctgccagcgaaagcgcattctcgaccgaacggctggccgcgatgaatgtgggcgatacgcaaagcgtcggtccgatctcgctcaagctcgagaagatcgaacctgtcgccggccccaactggaccgcgctcgaggcaacggtcagcgcatcgtacaagggcggggcgccggtcacgctgcatccgcaggcgcgcaccttctcctcgccgcctggcgagcgtaccgaatccgcactccatacgcgctggaacggccagctctatgccgtgctcggcaacgagggcgaggatggccgctggcagatgcgcttctggtggaagccgttcgtgccgctgctctggctcggcgggctgctgattgcgtttggcggcgttctggcgcttctgggccgggtggcgcatgatgttcgccgcctgcgcgcaggcggcaagattgcatatcgccgggcccggatggagcaggtgaagtga

SEQ ID NO: 68073 - protein, 655 aa, Novosphingobium aromaticivorans DSM 12444
MIAELGLAVLWMAAALAALQLFAGVSALRPGGGAAGKSLAGMVRPLAVMQGALVAISFLALIDLFLETDLSVKLVAENSHSMKPFIFKLAGTWGNHEGSMLLWVTIMAVSGGFVALIEKRLREDTLIATLAGQAFVSLGFYAFLLFSSNPFERLAEPAPDGAGLNPLLQDIGLAFHPPTLYVGYVGLSVAFSFAIGALITRDVGPAFARAMRPWVLGAWIFLTIGITAGSYWAYYTLGWGGWWFWDPVENASLMPWLAATALLHSASVLASRNALRAWTVMLGVIAFSMSMVGTFLVRSGILTSVHAFAVDPERGSFILALLAIYIGGALALFGLRASTVTEGERFSLFSREASLVFNNVMLCGTLGIVLIGTLYPLLTEAFGAKVSVGPPYFNPVSAIFVIPMMLVMGVGPLLRWRKDKPGRVTGSVAVPALLTALVLLAVVVLAPGIRILPALGLAVGAGLALASWFPLRGRNLRRTPLSVWGMVFGHFGIAVALLGAASESAFSTERLAAMNVGDTQSVGPISLKLEKIEPVAGPNWTALEATVSASYKGGAPVTLHPQARTFSSPPGERTESALHTRWNGQLYAVLGNEGEDGRWQMRFWWKPFVPLLWLGGLLIAFGGVLALLGRVAHDVRRLRAGGKIAYRRARMEQVK

SEQ ID NO: 68074 - DNA, 1956 bp, Microbulbifer degradans 2-40
  CDS (1)..(1956)
atggcgggtagctacaacggtaagctggtgtggatggcctctgcgcgatctttatccaccggcatgtttgtgtttgttgcaatctcaatagtgttgcttggcgtttcgttctatcaggacgatttcactgtagcctatgtcgccaatcactcgaattcattgctgcctgtggtgtacaaaatatgtgccgtttggggcgggcacgagggttcaatgctgctgtgggtgttaatgcttgcaggttggactttagcggtaactatttttagccgcgaattaccgctagattttcaagctagggtgctttcagtactcggcatggtgtcgtttggctttattttgtttattttgctcacctcaaacccatttgaccgaatattgcccttaccgcctgtggatggcgctgacttaaacccattcttacaagaccccggctttatcttccatccgccaatgctgtatatgggctatgttggctttgctgttatttttgcattcagtattgcggcattgctaagtggccggttagatagcgcctgggcaagatggtgtaggccttggggtaatttggcgtggtgctttttaacgctgggtttaacacttggaagttggtgggcgtactacgagctaggttggggtggctggtggttctgggacccagttgaaaacgcagcctttatgccttggttggtgggtaccgcatttatccataatttggcggtgtcggaaaagcgtgggttatttaaaaactggaccctatttttagctatttttggcttctcgctgagcttgttgggcacgttactagtgcgctcgggcttgcttacatccgttcatgcttttgccagtgatccgtcgcgcggggtatttattggggcattcttatttattgtgattcttgcctcgctcatactatttgctatgcgggcgcctctggttaaatcaaaaacaggttttgcgctgctatcgcgcgatgcgtttttattgctaaacagtgtggtgtttattgtttctgcttccattgtattgctaggcacactttaccctgtagtgttgttgctacttgggttgggcgctgtgtcggtgggcgagccatactttaatatctttttctctatattaatgagcattgccgccatagctaccggtattggcatggtgcttaattggaaaaagaccgaagctaaaagaatgcgtgactgggttaagtcgcccgcgttgtatgcgctttggttgggtaccgcattgccgggcatgatagccgatgaatattcttgggctgcggcggtttctattgcgcttggcagctgggttattttgtcttgtttgttcgatctagtacgtaaaacccgcaatgctgcgagtgtgtggattggaatgggcaagctaacggctacgtactacggcatgattgtggcgcatattggctttggtatatgcctattgggtgtgtgtttagataccatttacgatgatcagcgtgatctacggttagagctaggtaagcccgcgtttgctggccacttagagtatgagcttgttgatgtaagccgcgtaagagggccaaactataatggcgagcgagccgaagttatagtgcgcaaagacggcgagacaataagcattctgcacccagaaaagcgcgcttatttttctggtggcaatataatgagtgaagtggctatcgaccctggctttttttacgatatttatattgcgctgggggaaaagctagacaatacctcgtggagtatgcgtattcactacaaaccggtagtgcgttggatatggtttggcgcagtgtttatggcgctgggtggccttatagctattacagataaacgctacaagcgcaaaaaaactgttgctgtaaaaaatgcagtgggtgaagacgcaaaagctggcgatgccgatgcgaagcccatacttgccactgccaaacaacaacccgagtaa

SEQ ID NO: 68075 - protein, 651 aa, Microbulbifer degradans 2-40
MAGSYNGKLVWMASARSLSTGMFVFVAISIVLLGVSFYQDDFTVAYVANHSNSLLPVVYKICAVWGGHEGSMLLWVLMLAGWTLAVTIFSRELPLDFQARVLSVLGMVSFGFILFILLTSNPFDRILPLPPVDGADLNPFLQDPGFIFHPPMLYMGYVGFAVIFAFSIAALLSGRLDSAWARWCRPWGNLAWCFLTLGLTLGSWWAYYELGWGGWWFWDPVENAAFMPWLVGTAFIHNLAVSEKRGLFKNWTLFLAIFGFSLSLLGTLLVRSGLLTSVHAFASDPSRGVFIGAFLFIVILASLILFAMRAPLVKSKTGFALLSRDAFLLLNSVVFIVSASIVLLGTLYPVVLLLLGLGAVSVGEPYFNIFFSILMSIAAIATGIGMVLNWKKTEAKRMRDWVKSPALYALWLGTALPGMIADEYSWAAAVSIALGSWVILSCLFDLVRKTRNAASVWIGMGKLTATYYGMIVAHIGFGICLLGVCLDTIYDDQRDLRLELGKPAFAGHLEYELVDVSRVRGPNYNGERAEVIVRKDGETISILHPEKRAYFSGGNIMSEVAIDPGFFYDIYIALGEKLDNTSWSMRIHYKPVVRWIWFGAVFMALGGLIAITDKRYKRKKTVAVKNAVGEDAKAGDADAKPILATAKQQPE

SEQ ID NO: 68076 - DNA, 1524 bp, Haemophilus influenzae 86-028NP
  CDS (1)..(1524)
ttgggattgatttgctttggttttgcggtgtttattttattttattccaatccatttggacgcattttccctgctcccgcagaagggcgcgatctcaatccaatgttgcaagatgtgggattaattttccatccgcctttattatatgttggctatgtgggctttgcggtaaattttgcaatgagtttgagtgcgttgatttataaccaatctgcacgacaaattgcccgctcaatgcgtggatgggtgttggtttcttggttgtttttaaccattggcattgtgcttggtgcttggtgggcatattacgaacttggctggggcggttggtggttctgggatcccgtagaaaatgcgtctttaatgccttggttgcttgggttagcgttattacacagtttaatggcgacggaaaaacaaggcgtatttagttattggacaacgcttttttctctgcttgcttttgcctttagcgtattaggcacgtttattgttcgttctggcgcgctcacttctgtgcacgcctttgcattggataacacgcgcggttatgtgttgttattaattttctttgttttgacagcgttagcctttggtttattcgctttacgagcgggaagttcatcagaaagtgcggtgaaatttcagttcatttctaaatcgggtggcattttattactgaatattttgctgaccattgcgacggtttctacctttttaggtaccttttacccgatgttattccaagcgatgaattggggctcaatttcggtgggaagtccttattttaatagtattttcttccccattattacggcgattttaatcctaatggtaattgtgcttagcatacgtaaggggcaatttgatcgcacattattgatacgttgtgggtggttgcttattccgtctttaattcttgcaggcctaatgatttggcaacagctacgccataattctgcgttgaattttcacgctttcgcttttgtgttattaactcttgcgatttggcttttgttggtcactttatggcaaaattggcgacaaattcgtttgtctcaatttggtatgattttagcgcattgtggcgtggcgattgtaactattggtgcggtaatgagtggttattttggcagtgaaattggtgtgcgtttagcaccgcaacaaagtcaaacgctgggacaatatgaatttcactatcgccaattttctaatgaaatcggaccaaactttacggcagaagtcgccttttttgacgtaactgaaaatggtaaaccttatgcagaaattatccccgaacgccgttattacgatgttcgtacaatgacaatgagtgaagtggggcttaatggcggtttttggggcgatttatatattgtgatgggcgattctctcggcaaaggggaatttactttccgcttacattataaaccactgattcgttggctttgggcgggcggtattttaatggcctttggcgcactttttagcgtcttcggattacgcagaaaacaggaaaaataa

SEQ ID NO: 68077 - protein, 507 aa, Haemophilus influenzae 86-028NP
MGLICFGFAVFILFYSNPFGRIFPAPAEGRDLNPMLQDVGLIFHPPLLYVGYVGFAVNFAMSLSALIYNQSARQIARSMRGWVLVSWLFLTIGIVLGAWWAYYELGWGGWWFWDPVENASLMPWLLGLALLHSLMATEKQGVFSYWTTLFSLLAFAFSVLGTFIVRSGALTSVHAFALDNTRGYVLLLIFFVLTALAFGLFALRAGSSSESAVKFQFISKSGGILLLNILLTIATVSTFLGTFYPMLFQAMNWGSISVGSPYFNSIFFPIITAILILMVIVLSIRKGQFDRTLLIRCGWLLIPSLILAGLMIWQQLRHNSALNFHAFAFVLLTLAIWLLLVTLWQNWRQIRLSQFGMILAHCGVAIVTIGAVMSGYFGSEIGVRLAPQQSQTLGQYEFHYRQFSNEIGPNFTAEVAFFDVTENGKPYAEIIPERRYYDVRTMTMSEVGLNGGFWGDLYIVMGDSLGKGEFTFRLHYKPLIRWLWAGGILMAFGALFSVFGLRRKQEK

SEQ ID NO: 68078 - DNA, 1965 bp, Silicibacter sp. TM1040
  CDS (1)..(1965)
atgattacagagctcggtcacttcgccctcatcctcgcctttatgatcgccatcgtgcagacggttgtgcccctgattggtgcgcataaacgctggcccggctggatggccgtggcggaacccgcagcgcaggcccagttcctgtttacggcgttttcctttggggcgctcacatgggcctttgtgacctcggatttctcgctgcggctggtgacgctcaacagccactccgccaaaccgatgatctacaagatctcgggcacttgggggaaccatgagggctccatgctgctctgggtgctgatcgtgaccctctttggggccttggcctcggtgtttggaggcgggctgccgccgacactcaaggcgcgggtgctcagtgtgcaatcggccattggcgtggcctttttcgcgttcatcctctttacctccaaccccttcttgcggctggaaaaccctccctttgacgggcaggatctcaatccgctcctgcaagatccgggcctcgcgttccacccgccgtttctgtacttgggctatgtggggctctcgatggcgttctcctttgctgtggctgccctgatcgaagggcgggttgatgcggcctgggggcgctgggtccggccctggacattggcggcgtgggtgttcctgaccatcggcatcgcgctggggtcctggtgggcctattacgagcttggctggggcggcttctggttctgggatccggtggagaatgcgtccttcatgccatggcttctcgccgctgcgcttctgcattccgcgatcgtggtggaaaagcgcgaggcgctcaagagctggaccatccttctcgcgatcctcgcctttggcttttcgctcatcggcaccttcatcgtgcgctctgggcttttgacctcggtgcatgcctttgccaatgatccagagcgtggcgtggtgatccttggaattctcgccttctttaccggcggcgcgctgctgctctttgccctgcgcgcgcaggctatggaggccaaaggcgtgttctccatggtcagccgggagagcgcgctggtggccaacaacctcttgctggcggtcagctgctttgtggtttttgttggcacgctctggccggtggtggcggagatggcctttgatcgcaagctctcggtcggggcaccgttctttgatgcggccttcccgcccttcatggtggcgctggggctcttgctgccgatcggctcaatgctgccgtggaagcgcggtaaaggcgccaagacgctctggacgctgcgctatggcatcgtactggcgctggcccttgcggggctcgcctgggcgatccagaccgaaaagagcctgcttggccccgttggcgttctgctgggcgcttgggtcgtaagcggcgctgcacttgatttgttgcaacgcgcagggcgcaaggaccggctctcgcgcctgatgcggttgccgcgtgccgattggggcaaggcggtggcgcatgccgggcttggcgtgacgatctttgccgtggcagggctgacggcctggcaaaaagaagacatccgtgttgccaacctcaatgagccgttccgcgtcggtccctttgaactggtgctgtctgcggtcgaagaggggcgcgggccgaattacttcaccacgatgggcgtggtggatgtgacccgcaacggcaaggacgtcgcaacgctgcggccggagaaacgcgtctatccggtggcgcagatgcccaccacggaggcggcgattgattatcggttcacccgcgatctctatgtggtgctgggcgatgcgcaagagggcggcggatttactctgcgcacctatatcaagcccttcgccaactggatctggggcggcagcctgctgatggcccttggcggcttcctgagcctctcggaccgtcggttccgggttgcggccggggtgcgcaaggcccccaccgagggggtgcccgcggaatga

SEQ ID NO: 68079 - protein, 654 aa, Silicibacter sp. TM1040
MITELGHFALILAFMIAIVQTVVPLIGAHKRWPGWMAVAEPAAQAQFLFTAFSFGALTWAFVTSDFSLRLVTLNSHSAKPMIYKISGTWGNHEGSMLLWVLIVTLFGALASVFGGGLPPTLKARVLSVQSAIGVAFFAFILFTSNPFLRLENPPFDGQDLNPLLQDPGLAFHPPFLYLGYVGLSMAFSFAVAALIEGRVDAAWGRWVRPWTLAAWVFLTIGIALGSWWAYYELGWGGFWFWDPVENASFMPWLLAAALLHSAIVVEKREALKSWTILLAILAFGFSLIGTFIVRSGLLTSVHAFANDPERGVVILGILAFFTGGALLLFALRAQAMEAKGVFSMVSRESALVANNLLLAVSCFVVFVGTLWPVVAEMAFDRKLSVGAPFFDAAFPPFMVALGLLLPIGSMLPWKRGKGAKTLWTLRYGIVLALALAGLAWAIQTEKSLLGPVGVLLGAWVVSGAALDLLQRAGRKDRLSRLMRLPRADWGKAVAHAGLGVTIFAVAGLTAWQKEDIRVANLNEPFRVGPFELVLSAVEEGRGPNYFTTMGVVDVTRNGKDVATLRPEKRVYPVAQMPTTEAAIDYRFTRDLYVVLGDAQEGGGFTLRTYIKPFANWIWGGSLLMALGGFLSLSDRRFRVAAGVRKAPTEGVPAE

SEQ ID NO: 68080 - DNA, 1974 bp, Azotobacter vinelandii
  CDS (1)..(1974)
atgattcccgaactcggccacctggggatgatcctcgccctgtgcctggcgctggtgcagggcaccttgccgctgatcggcgcctggcgtggcgaccgcctgtggatgggcctggccgtgccggccgcctgggggcagttcgctttcctgtcgttcgccttcgtctgtctgacccaggctttcctggtcgacgacttctcggtcgcctacgtggccggcaactccaacagcgccttgccctggtactacaagctgagcgccgtgtggggcgcccacgaaggatcgctgctgctctgggcgctgatcctctccggctggaccttcgcggtgtcggtcttttcccggcaactgcccgaggagatgctggcccgcgtgctgggcgtgatggggctgatcagcgtcggcttcctgctgtttctgatcgtcacctccaaccccttcgcccgcctgttgccgcagacgccggtcgatggccgcgacctcaacccgctgttgcaggacttcggcctgatcgtccatccgccgatgctctacatgggttacgtcggcttctcagtggccttcgccttcgccatcgccgcgctgctcggcgggcgcctcgatgccgcctgggcgcgctggtcgcggccctggacgctggtcgcctgggcctttctcggtatcggcatcgtgctcggctcctggtgggcctattacgagctgggctggggcggctggtggttctgggacccggtggagaacgcttccttcatgccctggctgctgggcaccgcactgttgcactcgctggcggtgacggagaagcgcggggtgttcaagagctggacggtgcttctggccatcgccgccttctcgctgagcctgctcggcaccttcctggtgcgttccggggtgctgacttcggtgcatgccttcgccaacgatccggagcgcggcgtgttcatcctgatcttcctgctggtggtggtcggcagttcgctgaccctgttcgccatccgcgcgccggtggtcaggagccaggtgggcttcgccctccgctcgcgggaaaccctgctgctggtgaacaacctgctgctggtggtggcgacctcgaccatcctgctcggcacgctctatccgctactgctggatgcgctgtccggcgccaagctgtcggtcgggccgccgtacttcaatgcgctgttcctgccgctgatggggctgctgatgctgacgctggcggtcggcgtgctggtgcgctggaaggacacgccgctgcgctggctgtccggcatgctcgcgccggtactgctggccagcgtggcgctggccctgctggccgccttcgtgctcggcgatttcgcctgggcggtgctggcgaccgctttcctggcggcctgggtggttctcgccggggcgcgcgacctgctcgacaagacccgccacaagggactgctcaagggcctgcacgcgctttcgccgagctactggggcatgcaactgtcccacctggggatcgccgtctgcgccctgggcatcgtcctgagcagccaggaaagcgccgagcgcgacctgcgcatggcgccgggcgatgccgtggaactgggcggctaccgcttcgtcttcgagggcacccgccaccatgaggggcccaacttcgtcgccgaccgggccagcgtccgcgtcttcgacggcgacgacgaggtggccgtgctgcacccggagaagcgtctctataccgtgcagcggatgccgatgaccgaggccggcatcgacgcaggtttcacccgcgacttctacgtcgccctgggcgagccgctggaaaacggcgcctgggcggtccgcctgcatatcaagccgttcgtccgctggatctggctggggggcctgatgatggctttcggcgcggcgctggcggcctgcgaccggcgttatcgggtcaaggtcagggcccgcgtgcgcgaggctctgggcctggccggacaaggagcctga

SEQ ID NO: 68081 - protein, 657 aa, Azotobacter vinelandii
MIPELGHLGMILALCLALVQGTLPLIGAWRGDRLWMGLAVPAAWGQFAFLSFAFVCLTQAFLVDDFSVAYVAGNSNSALPWYYKLSAVWGAHEGSLLLWALILSGWTFAVSVFSRQLPEEMLARVLGVMGLISVGFLLFLIVTSNPFARLLPQTPVDGRDLNPLLQDFGLIVHPPMLYMGYVGFSVAFAFAIAALLGGRLDAAWARWSRPWTLVAWAFLGIGIVLGSWWAYYELGWGGWWFWDPVENASFMPWLLGTALLHSLAVTEKRGVFKSWTVLLAIAAFSLSLLGTFLVRSGVLTSVHAFANDPERGVFILIFLLVVVGSSLTLFAIRAPVVRSQVGFALRSRETLLLVNNLLLVVATSTILLGTLYPLLLDALSGAKLSVGPPYFNALFLPLMGLLMLTLAVGVLVRWKDTPLRWLSGMLAPVLLASVALALLAAFVLGDFAWAVLATAFLAAWVVLAGARDLLDKTRHKGLLKGLHALSPSYWGMQLSHLGIAVCALGIVLSSQESAERDLRMAPGDAVELGGYRFVFEGTRHHEGPNFVADRASVRVFDGDDEVAVLHPEKRLYTVQRMPMTEAGIDAGFTRDFYVALGEPLENGAWAVRLHIKPFVRWIWLGGLMMAFGAALAACDRRYRVKVRARVREALGLAGQGA

SEQ ID NO: 68082 - DNA, 1950 bp, Actinobacillus pleuropneumoniae serovar 1 str. 4074
  CDS (1)..(1950)
atggttgcggaattaggtaattacgcattggcacttgcgttcggattgtcaatttttttggcaattttaccgcttgttggtgcacaaaaacagaatagtactcttatggcgttagctcgtccgataacatgggcaatgtttttagcattaacgatttcattcggttcgcttttttatctgtttgcggtaaatgacttcagcgtgcaatacgtagtgaataactccaactcaacattacctatccaatatcgtctttctgcggtttggggatcgcacgaaggatcaatgctgttatgggtttggttgctttcgctttggtctatcgctgtggtggcattttctcgccagatgccggaagaagccgtttcgcgcgtattgagtgtaatgggattaatcagtatcggatttttggttttcttaatctttagttcaaatccgtttaaacgtactttccccgattttcctgcggacggtcgagaattaaatccgatgttgcaagatgtcggactgattttccatccgccgttattatatatgggatatgtcggtttctcggtggcatttgcgttcgcgattgcttcactaatgaccggaagattggataccgcttgggctcgttggtctcgtccttggacaatggcggcttgggtatttttaacacttggtatcgtactcggttcgtggtgggcttattacgaattaggctggggaggctggtggttctgggatccggttgaaaatgcttcgttaatgccgtggattgccggaacggcactgattcactcgttagccgttacggaaaaacgcggtacttttaaagcttggacggttttactggcgatattggcgttctcgctgtgtttattaggcaccttcttagtacgttccggtattttggtttcggtacatgcgtttgcttccgatccgactcgcggtttgtatattcttgcctatttagttttagtaattggcggttcattattactttacgctttacaaggctcgaaaattaaaagtttggataattatgaacgttattcgagagaatcgatgttgttaattaataacgtaatgctgatggcattcttatccgtagtgctgctgggtacattattaccgttagtacataaacaaatcggtttaggcacgatttcgatcggtgcgccgttctttgatcaaatgtttttaattttaatggtaccgttctcgtttattttaggtatcgggccattagtaaaatggcgtagagatcaagtatctgcgattcgaacaccggtaattattgccttaattatgatggtggtactcggtttcggcttaccgtatttactgcacgaccgtattactgccacttcggtattaggcgtgatgatggcatcgattattgtcattttgagcctatatgaattacatcaaagagcgacgcatagacattcatttttagccggtgtgtttaaattatcccgttctcattgggggatggtattggcgcacgtaggtgtcgcaatgacagtattcggaatcgcattcagccaaaactatagcgtagagaaaaacgtacgtatgaatgtcggcgatacggtatcgcttcaaggttacgactttactttcaaaggaatcaaaattaccgacggtgcgaactatcagggcggcacggctgaaattgagatttcgcgtcaagggcaatatgaatcgactctgaatgcggagaaacgcttctataacgtcagtaaaatggggatgaccgaagcggcaatcgactggggctttagaagagacttatatgccgctttaggtgaaaagttggaagacggttcatggggcgtacgtttatattataaaccgtttgttcgctggatctggattggcggcttatttatggtgttcggcggtttgctctgtatgtttgacaaacgttacagattaaacgtagttaaaaaagctgcataa

SEQ ID NO: 68083 - protein, 649 aa, Actinobacillus pleuropneumoniae serovar 1 str. 4074
MVAELGNYALALAFGLSIFLAILPLVGAQKQNSTLMALARPITWAMFLALTISFGSLFYLFAVNDFSVQYVVNNSNSTLPIQYRLSAVWGSHEGSMLLWVWLLSLWSIAVVAFSRQMPEEAVSRVLSVMGLISIGFLVFLIFSSNPFKRTFPDFPADGRELNPMLQDVGLIFHPPLLYMGYVGFSVAFAFAIASLMTGRLDTAWARWSRPWTMAAWVFLTLGIVLGSWWAYYELGWGGWWFWDPVENASLMPWIAGTALIHSLAVTEKRGTFKAWTVLLAILAFSLCLLGTFLVRSGILVSVHAFASDPTRGLYILAYLVLVIGGSLLLYALQGSKIKSLDNYERYSRESMLLINNVMLMAFLSVVLLGTLLPLVHKQIGLGTISIGAPFFDQMFLILMVPFSFILGIGPLVKWRRDQVSAIRTPVIIALIMMVVLGFGLPYLLHDRITATSVLGVMMASIIVILSLYELHQRATHRHSFLAGVFKLSRSHWGMVLAHVGVAMTVFGIAFSQNYSVEKNVRMNVGDTVSLQGYDFTFKGIKITDGANYQGGTAEIEISRQGQYESTLNAEKRFYNVSKMGMTEAAIDWGFRRDLYAALGEKLEDGSWGVRLYYKPFVRWIWIGGLFMVFGGLLCMFDKRYRLNVVKKAA

SEQ ID NO: 68084 - DNA, 2394 bp, Chloroflexus aurantiacus
  CDS (1)..(2394)
atgtatctctttggtacgttcctcctgatggccagtctggggatgaccttgctggcgattatcagttatggactagttttacgtgggcagcgggtagcgcttagttatgcccgtttcggtgtctatgcggcgttagccggcgtgctgatgtcgtggacgctactgattacggtgtttcttgcccgccgctttgatctggactacgtctacaactatagctcccgcgatctggagttcttcttcacgattgcggccagttgggccggtcaaccaggtagttttatgatctggttgctgtgggggtcaattgccagcgcgttgctgattcgccgtaccaagcattttgagtcgtatgtgttaatggttgttatggcgatccaggcagcgatcattgggtttgtgctggtgctcaatccattccagcccctggtcgatcccaataccggcgtcgcacttaccccaggtgacggtcgcggtctcaatccgctgttgcacaacttctggatgatcattcaccccccaatcctgttcgttggctatgcgctttccatgattcccttcgcatttgccctggctgcgctgtggcggcgcgattacgatacatgggtgaaacgggccttgccatggacattggcggcctgggcatttctggggctggcactcttgctcggcggttactgggcttatgagacgctgggctggggtggctattggggttgggatccggttgaaaacttgtcgctggtaccctggctcattctaaccgccctgatccacgggatgcttgtgcaacgcacccacggtggtttgcgaaagaccaacctcgtgttgggtgtggcgacgtacattacggtgttctacgctacctttatgacccgcagcggggtctatgctaacttctctgtccactcatttgtcgccgaagggatttttgagggactggttggctttcagattttcttgctggcggttgccattgtctcgttgctggcccgctggaacgatattcctgcccgtccacttagtgacaaattcttctcgcgtgatagcttcttcgtgctggcgattattaccattgtcatgaccgcgctggtcgttggtatcggcacctcgatgccggtcatttcggctattcctggggtagggcatacgctgcaagagtggatggggcgttatttcgagcttgatgacggcaccctgatgaacccgcaggcgcaaccgtttgaagatggccgtttttcgcttgccccatccttctaccagcgcacagtacctccactcggcgtggtagcaatcgtgttgctgatcgttgggccactccttggctggcgcgacgctaatctcagccacctcctgcgtgcattgcgttggccggcagtgtttgcagtgatagcggctgtcgtggccatgattatcaatgtgcgcgatttgctctccctggcttatgttgccggtggtgtcttcgcgtttggaacgaacctggtgatgattattcgtaccctgcgtggtggctggttacggatcggtggctatcttgctcacctcggttttacagtgatggcgattgggatggttgcctcttcggcctacgctactcccgatactcgcctgacgctatctcccggtgagtcggcccgattgtttggctatgagtttatcttcaacggctatcaacttgatgaccagcagcgtggtgtgctcgatctcacggtgagtgacggatcgggtaccttctcggctcgaccgtatctctactttaatcagcgtatgggcgcaaccatgcaaacgccctcgatccacagctatctctggcacgatctctacatttcaccggcaggttatgacccggaacgtgatccttcgcgaccggtgttaggtgtggatcagagcgcacagatggggccatacacgttgaccttccgcgggttcaatatcgaccgcgaggcaatgatgcgtggtgaagcgaaggttggcgcccgtgtcgaagttacttatgaaggccagaccttcgaggttgagccgcgggtggaagttgtccccaatccgaccacgaatgaaggtgagttgcagttcattccggtcaccctacccggtggccacaccctgcgtctagcggagcttgatccgaccaaccgcatggtgcttctcgaaggtagtggtcccggcctggatgatctgccggtggtgccggccaaggctgtcattgcggtgagtgtcaaaccgctggttgtgctggtctggactggtgttatcatgatggtgatcggcggtgcaatcgcactggtacggcgctaccttgaaggtagtctggcgctggctggtgcacgagtacgactacccaaagcgttgccggaactggcggctcaactgggctggcgcggggccggcgactag

SEQ ID NO: 68085 - protein, 797 aa, Chloroflexus aurantiacus
MYLFGTFLLMASLGMTLLAIISYGLVLRGQRVALSYARFGVYAALAGVLMSWTLLITVFLARRFDLDYVYNYSSRDLEFFFTIAASWAGQPGSFMIWLLWGSIASALLIRRTKHFESYVLMVVMAIQAAIIGFVLVLNPFQPLVDPNTGVALTPGDGRGLNPLLHNFWMIIHPPILFVGYALSMIPFAFALAALWRRDYDTWVKRALPWTLAAWAFLGLALLLGGYWAYETLGWGGYWGWDPVENLSLVPWLILTALIHGMLVQRTHGGLRKTNLVLGVATYITVFYATFMTRSGVYANFSVHSFVAEGIFEGLVGFQIFLLAVAIVSLLARWNDIPARPLSDKFFSRDSFFVLAIITIVMTALVVGIGTSMPVISAIPGVGHTLQEWMGRYFELDDGTLMNPQAQPFEDGRFSLAPSFYQRTVPPLGVVAIVLLIVGPLLGWRDANLSHLLRALRWPAVFAVIAAVVAMIINVRDLLSLAYVAGGVFAFGTNLVMIIRTLRGGWLRIGGYLAHLGFTVMAIGMVASSAYATPDTRLTLSPGESARLFGYEFIFNGYQLDDQQRGVLDLTVSDGSGTFSARPYLYFNQRMGATMQTPSIHSYLWHDLYISPAGYDPERDPSRPVLGVDQSAQMGPYTLTFRGFNIDREAMMRGEAKVGARVEVTYEGQTFEVEPRVEVVPNPTTNEGELQFIPVTLPGGHTLRLAELDPTNRMVLLEGSGPGLDDLPVVPAKAVIAVSVKPLVVLVWTGVIMMVIGGAIALVRRYLEGSLALAGARVRLPKALPELAAQLGWRGAGD

SEQ ID NO: 68086 - DNA, 1962 bp, Paracoccus denitrificans
  CDS (1)..(1962): transl_table=11
atgctggtcgagaccgggcattttgcgctgctggtggccctctgcgtcgcgctgatccagtcggtcattcccctggtgggggcccagcgcggctggtcgggctggatggcggtttcgacccccaccgcgctgggccagtttgggatgatcgcgatcgcgttggcgaccctgatctatgccttcgtgacggccgacttttcgctcaagatgctctacgaaaactcccataccgataagccgctgctctacaaggtggccggggtctggggcaaccatgaggggaacgtgcttctgtgggtgctgatcctggccatgtttacggccgcgtccgcggcctttggcggtgcgatgccggagcggctgcgggcccggctgctcgcggtgcagggctccatcggggtcgcctttctgctctttgtgctttttacctcgaacccattcattcgggtggaagaagcccccttcagcggccgcgacctgaacccgatcctgcaggaccccgggctcgcgttccatccgccgttcctgtacgtcgggtatgtggggttttcgatcggcttcggcttcgccgtggccgcgctgctcgagggcaaggtcgacgccgcctgggcgcgctgggtcaggccatggacgctggcgggctgggtcttcctgaccgtcggcatcgcgctgggttcgtggtgggcctattacgaggtgggctggggcgggttctggttctgggatcccgtggaaaacgccagcttcatgccctggctgatcgccgccggcctcctgcattccgccatcgtggtggaaaagcgcgaggtgctgaaaagctggaccatcctgctggcgatcatggctttcggcttttcgctgatcggcaccttcatcgtgcgctcgggggtcattacctcggtccacagctttgccagcgaccccaagcgcggggtgttcatcctggcgatcctggcgttcttcctcggcgggtcgctgaccctttatgccgcgcgggcgaacgagatccaggcgaagggggtgctgtccatggtcagccgcgaatcgtcgctcatcatgaacaacgtccttatcgcggtggccgcgctggtggtcttgaccggcacggtgtggcccctgctggcggagctgttttgggaccgacgactggcggtgggggcgccgttctttgaaaagacctttaccccattcatggtggggctggccctgcttctccccatcggggcgatggtgccgtggaaacgctcgagcctcggcaagctggtccggccggtgttgcccgcgctggtctttgccggggcggtgatggcgctggtctttgccgtctcgaccggccgttcggcgctggcggtgggcgccgcgtcgctgggcggctggatggtgtttggcgccctgtccgagatctggcaacgcgccaaccggaccccgggacgcctcctgcggctgccgcggaacgattggggcaaggcgttggcgcatgggggcctgggcatcgcctttgcgggcgtcgggctgttgatgatgggccaggtcgaggatgtccgcgtggcgaagacgggggacgcgttcgaggtcgcaggttacaccatctcgctgatctccgtcgaggatctgccggggcccaacttcgccgccaagtccgcgacgatggaggtccggcagggcgggaagctgctgacgaccctgcatcccgaaaagcgcgtctatccggcgcaggcgatgccgaccacggaggccgccatcgacagcggcttttggcgcgatgtctatgcggtcatcggcgacccgcaggaggcggggggctgggcggtgcggtcgtattacaagcctttcgccaactggatctgggcgggctgtctggtgatggcctttggcggcgtgctgagccttaccgaccggcggtaccgtacggccaccggcgcgcggcgcgcggcggtcgccgatgctctggccgcggagtga

SEQ ID NO: 68087 - protein, 653 aa, Paracoccus denitrificans
MLVETGHFALLVALCVALIQSVIPLVGAQRGWSGWMAVSTPTALGQFGMIAIALATLIYAFVTADFSLKMLYENSHTDKPLLYKVAGVWGNHEGNVLLWVLILAMFTAASAAFGGAMPERLRARLLAVQGSIGVAFLLFVLFTSNPFIRVEEAPFSGRDLNPILQDPGLAFHPPFLYVGYVGFSIGFGFAVAALLEGKVDAAWARWVRPWTLAGWVFLTVGIALGSWWAYYEVGWGGFWFWDPVENASFMPWLIAAGLLHSAIVVEKREVLKSWTILLAIMAFGFSLIGTFIVRSGVITSVHSFASDPKRGVFILAILAFFLGGSLTLYAARANEIQAKGVLSMVSRESSLIMNNVLIAVAALVVLTGTVWPLLAELFWDRRLAVGAPFFEKTFTPFMVGLALLLPIGAMVPWKRSSLGKLVRPVLPALVFAGAVMALVFAVSTGRSALAVGAASLGGWMVFGALSEIWQRANRTPGRLLRLPRNDWGKALAHGGLGIAFAGVGLLMMGQVEDVRVAKTGDAFEVAGYTISLISVEDLPGPNFAAKSATMEVRQGGKLLTTLHPEKRVYPAQAMPTTEAAIDSGFWRDVYAVIGDPQEAGGWAVRSYYKPFANWIWAGCLVMAFGGVLSLTDRRYRTATGARRAAVADALAAE

SEQ ID NO: 68088 - DNA, 2145 bp, Pseudomonas fluorescens
  CDS (1)..(2145): transl_table=11
atgacctctacattgtttattcccgagttgggccagttggcgatgatcctcgccctgtgctttgccatcgtccaggccatcgtgccgctgctgggcgcctggcgcggtgatcggctgtggatgagcctggcgcaacccgcgctggggccagttcgcgttcctggcgttcgctttggttgcctgacctacgcctttatgaccgacgacttttccgtcgcctatgtcgccagcaactccaacagcgctttgccctggtactacaagttcagcgccgtctggggtgcccacgaaggctccctgctgctgtgggccttcatcctcggcggctggacctttgcggtgtcggtgttctcccggcagttgccgcaagtgatgctggcgcgggtgctggcggtgatgggcatgatcagcatcggcttcctgctgttcttgatcatgacctccaacccgttcgagcggattctgccgcagattcccgtggacggtcgcgacctcaacccgctgctgcaggatatgggcctgatcgtccacccgccgatgctatacatgggttatgtgggcttctccgtggctttcgcctttgccatcgccgccttgctcggcgggcgtctcgacgccgcctgggcgcgctggtcgcggccgtggaccatcgtcgcctgggccttcctgggtatcggcatcaccctgggctcgtggtgggcctactatgaactcggctggggcggctggtggttctgggacccggtggaaaacgcctccttcatgccctggctggtgggcacggcgctgattcactccctggcagtcacggaaaaacgcggcgtgttcaagagctggacggtgttgctggccatcgccgccttctccctgagcctgctgggcaccttcctcgtgcgttccggcgtgctgacgtcggtgcatgcgttcgctgccgaccctgagcgcggcgtgttcatcctgatcttcctgctgtgcgtggtgggcggctcgctgaccctgttcgccctgcgtgcgccggtggtcaagagccacgtgggcttcaacctgtggtcgcgggaaaccctgctgctggggaacaacctggtcctggtggtcgccgcttcgatgatcctgctgggcaccctgtacccgctggtgctcgatgccctgaccggcgccaaactgtcggtcggcccgccgtacttcaacgccttgttcatcccgttgatgggcctgctgatggtggtgatggcgattggcgtgctggtgcgctggaaagacaccccggtcaaatggctgctgggcatgctcactccggtgctgctgggcagtgccgccttgtcggtgattgccgggattcctacggcgacttcaactgggccgtgctcgcgactttcatgctggcggcctgggtgttactggccgcgtgcgcgatatcttcgacaagacccgccacaagggcctgatcaaaggcctgccgaccctgacccgcagttactggggtatgcagatcgcccacatcggcatcgccgtgtgtgccctgggcgtggtgttgtccagccagaacaggcccgagcgcgacttgcgcctggcccctggcgagtccatggctcgccaggggccaggcgcaagtctgcgctcggcgctgttctggctggacaacaccacgcccagggcacacacggcgatgccgatgtgggcgatctgcataccccagtaactgctgggtcaagggtcggcaggcctttgatcaggcccttgtggcgcatggacctggcgggctaccagttcgtgtttgaaggtgccaagcacttcgaagggccgaacttcacttccgacaaaggcaccgtgcgcgtggtgcgcaacggcaagcaaatcgccgtgctgcacccggagaaacgcctgtacaccgtgcaaagctcgatgatgaccgaagccgggatcgacgccgggttcacccgtgatctctacgtggcactgggcgagccgttgggcgatggcgcctgggccgtgcgcgtgcacgtcaaaccgtttgtgcgctggatctggttcggtggcctgctgaccggcttcggcgggttgctggccgcgatggaccggcgttaccgggtcaaggtcaagagccgggtgcgtgaagcccttggcatgcaaggagccgctgtatga

SEQ ID NO: 68089 - protein, 714 aa, Pseudomonas fluorescens
MTSTLFIPELGQLAMILALCFAIVQAIVPLLGAWRGDRLWMSLAQPALGPVRVPGVRFGCLTYAFMTDDFSVAYVASNSNSALPWYYKFSAVWGAHEGSLLLWAFILGGWTFAVSVFSRQLPQVMLARVLAVMGMISIGFLLFLIMTSNPFERILPQIPVDGRDLNPLLQDMGLIVHPPMLYMGYVGFSVAFAFAIAALLGGRLDAAWARWSRPWTIVAWAFLGIGITLGSWWAYYELGWGGWWFWDPVENASFMPWLVGTALIHSLAVTEKRGVFKSWTVLLAIAAFSLSLLGTFLVRSGVLTSVHAFAADPERGVFILIFLLCVVGGSLTLFALRAPVVKSHVGFNLWSRETLLLGNNLVLVVAASMILLGTLYPLVLDALTGAKLSVGPPYFNALFIPLMGLLMVVMAIGVLVRWKDTPVKWLLGMLTPVLLGSAALSVIAGIPTATSTGPCSRLSCWRPGCYWPRARYLRQDPPQGPDQRPADPDPQLLGYADRPHRHRRVCPGRGVVQPEQARARLAPGPWRVHGSPGARRKSALGAVLAGQHHAQGTHGDADVGDLHTPVTAGSRVGRPLIRPLWRMDLAGYQFVFEGAKHFEGPNFTSDKGTVRVVRNGKQIAVLHPEKRLYTVQSSMMTEAGIDAGFTRDLYVALGEPLGDGAWAVRVHVKPFVRWIWFGGLLTGFGGLLAAMDRRYRVKVKSRVREALGMQGAAV

SEQ ID NO: 68090 - DNA, 2001 bp, Rhizobium etli
  CDS (1)..(2001): transl_table=11
atgatcatcgagatcggccattacgctctggtcgtgcggctggcgacggcgctgatcgtctcgatcgtgcctgtcatcgcggcccgccgtcatgatccggcgctgatggatgtggcgacatcaggttcgctggcgatgtttgcccttgtcgcctttgccttcgccgtcttgacctatgcccatgtcgtctccgacttctccgtcgagaacgtctgggagaattcgcattcgctggtgccgctgatctacaaatattccggcgtctggggcaatcacgagggatcgatgatgctctggctgctgatcctggcgctgttcagcgcgctggtcgcgatcttcggcgccaatctgccggagacgctgaaagccaatgtgcttgccgtgcaggcctggatctcgctcgccttcaccctgttcatccttttgacctccaatcccttcctgcggctcgatccggccccggccgagggccgcgatctcaatccggtgctgcaggatgtcgggctcgccatccacccgccgctgctctatctcggctattgtcggcttttccgttgcttctccttcgccgttgcagccctcattgaaagccgcatcgacgccgcctgggcgcgctgggtccggccctggacgctcgccgcctggacctgcctgacgcttggcatcgccatgggctcctactgggcctattacgagctcggctggggcggctggtggttctgggacccggtggaaaacgcctcgttcatgccgtggctcgccggcaccgcgctgctgcattcggcgctcgtcatggaaaagcgcgaggcgctgaagatctggacggtgctgctcgccatcctgaccttctcgctgtcgctgatgggcaccttcctggtgcgctccggggtgctgacctcggtgcatgcctttgccagcgatcccacccgcggcgttttcatcctgtcgatcctgctgatcttcatcggcggagcgctgtcgctgtttgccctgcgggcgccgaagcttgcggccggcgggctgtttgcgccgatctcgcgcgagggggcgctcgtcctcaacaatctgatcctgacggtcgcctgcggcacggtgctgaccggcacgctctatccgctgctgttggaaacgctgaccggcgacaagatctccgtcgggccgcccttcttcaacctgaccttcggcctgctgatggcgccgctgctcgtcatcgtgccgttcgggccgctgctggcctggaagcgcggcgatctgctcggcgccctgcagcggctctacgttgtcgcggctctcgccttcaccgccgcggtcatcgtcttttatctccaacatggcgggccggtgctctccgtgctcgggctcgggctggcgccgggctgttcctggatcctcggcgccgttgccgatctctggtatcgggccggcatctgcataggtcgccgggcagcatcgcctggcgccgcctttccggcttgccgcgctcggccttcgcacgcgcttgcccatgccggcctcgcggtcacggtgctcggcatcgtcgccgtcaccaccttccagagcgaacatgttgtcgcgatgaagccgggcgagataatcgaggccgggggctacagccttgcgttcgacggcatgcgcccgggcagggacccgaactacaccgaggagcgcggccayttcaccatccgacgcgccggggttgcggtcgccgagacctggtcggccaagcgcctttacaccgcccggcagatgccgacgacggaggccggcatccagaccttcggtctcagccagctctatgtctcgctgggcgacgccaccaaggacggcggcatcgtcgtgcgcatctggtggaagccgttcatcctgtgcatctggggcggcgcgatgatcatggccgccggcggcctcgtctcgctctccgaccggcgcctgcgtgtcggcgcaccgcggagaaaggctaaggcaaaaccgacgacgcctgcgatggagccggcggaatga

SEQ ID NO: 68091 - protein, 666 aa, Rhizobium etli
MIIEIGHYALVVRLATALIVSIVPVIAARRHDPALMDVATSGSLAMFALVAFAFAVLTYAHVVSDFSVENVWENSHSLVPLIYKYSGVWGNHEGSMMLWLLILALFSALVAIFGANLPETLKANVLAVQAWISLAFTLFILLTSNPFLRLDPAPAEGRDLNPVLQDVGLAIHPPLLYLGYCRLFRCFSFAVAALIESRIDAAWARWVRPWTLAAWTCLTLGIAMGSYWAYYELGWGGWWFWDPVENASFMPWLAGTALLHSALVMEKREALKIWTVLLAILTFSLSLMGTFLVRSGVLTSVHAFASDPTRGVFILSILLIFIGGALSLFALRAPKLAAGGLFAPISREGALVLNNLILTVACGTVLTGTLYPLLLETLTGDKISVGPPFFNLTFGLLMAPLLVIVPFGPLLAWKRGDLLGALQRLYVVAALAFTAAVIVFYLQHGGPVLSVLGLGLAPGCSWILGAVADLWYRAGICIGRRAASPGAAFPACRARPSHALAHAGLAVTVLGIVAVTTFQSEHVVAMKPGEIIEAGGYSLAFDGMRPGRDPNYTEERGHFTIRRAGVAVAETWSAKRLYTARQMPTTEAGIQTFGLSQLYVSLGDATKDGGIVVRIWWKPFILCIWGGAMIMAAGGLVSLSDRRLRVGAPRRKAKAKPTTPAMEPAE

SEQ ID NO: 68092 - DNA, 1995 bp, Rhizobium leguminosarum
  CDS (1)..(1995): transl_table=11
atgatcatcgagatcggccattacgcgctggtgctggcgctggcaacggcgctcatcctctccatcgtgccggtaatcggagcccgtcgtcacgaccgggcgatgatggatgtggcgacgatcggctcgctggcgatgttctcgctggtggccttctccttcggcgtgctgacctatgcccatgtcgtctcggatttctcggtcgagaacgtctgggagaattcgcattctctggtgccgctgctctacaaatattccggcgtctggggcaatcacgaagggtcgatgatgctctggctgttgatcctgacgctgttcagcgccctggtcgccgtcttcggccgcaatctgccggagacgctgaaggccaatgtactttccgtgcaggcctggatatcggtcgccttcacgctgttcattctgttgacctccaatcccttcctccggctcgatccggcgccggccgagggccgcgatctcaacccggtccttcaggatgtcggtctggcgatccacccgccgctgctctatctcggctattgtcggcttctccgctgtttctcctttgcggtcgcggccctgctggaagggcggatcgacgccgcctgggcccgctgggtgcggccctggacgcttgccgcctggacctttctgacgcttggcatcgccatgggctcttactcttactgggcctattacgagctcggctggggcggctggtggttctgggacccggtggaaaacgcctccttcatgccatggctcgccggtaccgcactgttgcattctgccctcgtcatggaaaagcgcgaggcgctgaagatctggacggtgctgctggccatcctcaccttttcgctgtcgctgatgggcaccttcctggtgcgctccggcgtgttgacctcggtgcatgcctttgccagcgacccatcccgcggcgttttcattctctgcatcctgctgatcttcatcggcggggcgctgtcgctatttgctttccgcgcgccgcggctgtcggcaggcgggctgtttgcgccgatctcgcgcgagggcgcgctcgttgtcaacaatcctgatctgacggtcgcctgcggcacggtgctcaccggcacgctctatccgctgctcttggaaacgctgaccggcgacaagatttccgtcgggccgcccttcttcaacctgaccttcggcctgctgatggcgccgctgatcgtcatcgtccccttcgggccgatgctggcctggaagcgcggcgatctgctcggtgccctgcagcggctctatgtcgtggcaggtcttgccttccttgccgcagtaatcttcttctacatcgaacatggcgggccggtgctgtcagtgctcggcctcgcgccgggctgttcctggatcctcggcgccgtcgccgatctctggtatcgcgccggcatctgtataggtcgccgggccgtcttgcctggcgccggctttccggcctgccgtgttcgcttcggcaccgcccttgcccatgccggactcggcgtcaccgtgcttggcatcgtcgcggtgacgacgttccagagcgagcatgtcatcgagatgaagccgggtgaggtgaccgaggccggcggttatagcctgcatttcgacggcatgcagccggggaccgaaccgaactataccgaggagcgtggccacttcaccatccgacgtgccggcgtcgcggttgccgatacctggtcggccaagcgcctttataccgcccggcagatgccgacgacggaggccggcatcctgaccttcgggctgaggcagctctatgtctctttgggtgatgccaccaaggacggcggcatcgtcgtacgcatctggtggaagccgttcattctctgcatctggggcggcgcggtgttcatggccttcggcggcctcgtctcgctcagcgaccggcgcctgcgtgtcggcgccccggccaaggcaagcgcaaagccggctcccgcaatggagccggcggaatga

SEQ ID NO: 68093 - protein, 664 aa, Rhizobium leguminosarum
MIIEIGHYALVLALATALILSIVPVIGARRHDRAMMDVATIGSLAMFSLVAFSFGVLTYAHVVSDFSVENVWENSHSLVPLLYKYSGVWGNHEGSMMLWLLILTLFSALVAVFGRNLPETLKANVLSVQAWISVAFTLFILLTSNPFLRLDPAPAEGRDLNPVLQDVGLAIHPPLLYLGYCRLLRCFSFAVAALLEGRIDAAWARWVRPWTLAAWTFLTLGIAMGSYSYWAYYELGWGGWWFWDPVENASFMPWLAGTALLHSALVMEKREALKIWTVLLAILTFSLSLMGTFLVRSGVLTSVHAFASDPSRGVFILCILLIFIGGALSLFAFRAPRLSAGGLFAPISREGALVVNNPDLTVACGTVLTGTLYPLLLETLTGDKISVGPPFFNLTFGLLMAPLIVIVPFGPMLAWKRGDLLGALQRLYVVAGLAFLAAVIFFYIEHGGPVLSVLGLAPGCSWILGAVADLWYRAGICIGRRAVLPGAGFPACRVRFGTALAHAGLGVTVLGIVAVTTFQSEHVIEMKPGEVTEAGGYSLHFDGMQPGTEPNYTEERGHFTIRRAGVAVADTWSAKRLYTARQMPTTEAGILTFGLRQLYVSLGDATKDGGIVVRIWWKPFILCIWGGAVFMAFGGLVSLSDRRLRVGAPAKASAKPAPAMEPAE

SEQ ID NO: 68094 - DNA, 1977 bp, Acetobacter diazotrophicus
  CDS (1)..(1977): transl_table=11
atgacgccggaactgggcaatttcgcgctggcgctggcctgctgcctggccggcgggcaggcgatcctgccgctggtgggcgcgcggcggcgcgacccgcggctgatggcgctggcccccgccctggcggtggggcagatgctggcgctggccttttccttcgcatgcctgatcgatgcggcggtgcgtgacgatttctcggtccagaacgtcgcggccaacagcgccgccgccaagccgctgctgtacaaaatcaccggcgtatggggcaatcacgagggatcggtactgctgtgggcgctgatcctggggatctgcggcggggcggtggcactgttcggccgcaacctgccctctgccctgcgggcgcgggtcatcgcggtcctgggcggcgtttcggccggcttccagctgttctgcctgacgacgtccaatccgttcgaccgcgtctggcccgcgccgatggacggccagggcatgaacccgctgctgcaggacccgggcctggccttccatccgcccattctctacaccggctatgtcggcttcgccgtgcccttcgccttcgccgtcgccgccctgatcgagggacgggtggacgccgcctggggccgctgggtccgcccctgggccgtcgcggcctggtgcttcctgacctgcggcatcgcgctggggtcgtggtggtcgtactacgtgctgggctggggcggctactggttctgggacccggtggaaaacgcgtcgctgatcccgtggctgaccggcaccgcgctggtccattccgccatcgtggtggaaaagcgcgaggcgctgaagatctggaccgtgctgctggcatcggacatttcgttctcgctgtccggcacgttcctggtccgctcgggcattctcaattccgtccatgccttcgccaacgacccggcgcgcggcatcttcatcctgggcctgctggcgctggtcatcggcgggtcgctgctgctgttcgcgatccgcgcgccggcgctggtggcgggcggcctgttcgcgccggtctcgcgcgaggggctgctggtcgtgaacaatatcctgctgtgctcgatctgcgcggtggtgctgaccgggaccatgtatccgcccttcatgtcgctgctgttcggcaagacgatttcggtcggcaagccgttcttcgacgccacggcggcgccgctggcgattccgcttctggccttcatggggttcggcccgatgatgccgtggaagcgcgcccagttctggcccgtgctgcgccggctgtggtgggccgggatcgtcaccgccctcgccttctgcctgatggcctggcgcatccgcgacgtgctgccgctgctggccgcgaccggcgcggtctgggtgatcgcggccagcgtcgccgacattgccgagcgcgtccgcctgttccgcatcccgcccggcgccagcctgcagcgcgcgcgcatgctgccgcgcgcggcgctgggcgcggccctggcccatgccggcgtcggcatcagcgtgctggggctggccgccatgtcgcaggcccagcaccgcatcgtcgaggtccgggtcggccagaccgagatgctggccggcgacgcctggaccctgaccgcgatccgcgcggcccccggcccgaactacacgtccctgatcgcgacgatcgaggtccggcatgacggcaggctggtcaccgtgctgcatccgtccaagcgcaccttccccagccagaaccagacgacgaccgaggtcgccatccataccaacctgatgtccgacctgtacggcgtgctgggcgaccggcacggcaccgacgccgacccgacctacgtgctgcgcctgcactacaatccgctggcgccgtggatctgggctggcgggctgatcatggcgctgggcggggcgctgtcgctgtccgaccggcggacgcgcgtcggcgcgccgcgccgcgccgccgcccccggcatggtggccgcgcaatga

SEQ ID NO: 68095 - protein, 658 aa, Acetobacter diazotrophicus
MTPELGNFALALACCLAGGQAILPLVGARRRDPRLMALAPALAVGQMLALAFSFACLIDAAVRDDFSVQNVAANSAAAKPLLYKITGVWGNHEGSVLLWALILGICGGAVALFGRNLPSALRARVIAVLGGVSAGFQLFCLTTSNPFDRVWPAPMDGQGMNPLLQDPGLAFHPPILYTGYVGFAVPFAFAVAALIEGRVDAAWGRWVRPWAVAAWCFLTCGIALGSWWSYYVLGWGGYWFWDPVENASLIPWLTGTALVHSAIVVEKREALKIWTVLLASDISFSLSGTFLVRSGILNSVHAFANDPARGIFILGLLALVIGGSLLLFAIRAPALVAGGLFAPVSREGLLVVNNILLCSICAVVLTGTMYPPFMSLLFGKTISVGKPFFDATAAPLAIPLLAFMGFGPMMPWKRAQFWPVLRRLWWAGIVTALAFCLMAWRIRDVLPLLAATGAVWVIAASVADIAERVRLFRIPPGASLQRARMLPRAALGAALAHAGVGISVLGLAAMSQAQHRIVEVRVGQTEMLAGDAWTLTAIRAAPGPNYTSLIATIEVRHDGRLVTVLHPSKRTFPSQNQTTTEVAIHTNLMSDLYGVLGDRHGTDADPTYVLRLHYNPLAPWIWAGGLIMALGGALSLSDRRTRVGAPRRAAAPGMVAAQ

SEQ ID NO: 68096 - DNA, 1953 bp, Legionella pneumophila
  CDS (1)..(1953): transl_table=11
atgatagcggaattaggactgttttttttgattttggctttagtggcttctttgatgttagctttgatcccattagctggtttgcaattcaatcggaaagactggattgattcctccaggaattatgtcgtgctgcaatttttatttgtggcatgtgcttacctatgtctcacggcctgttttttgatggatgatttttcggtgatctatgtgctgaataactccagcttattgctcccatggttttataaattttgtgctgtgtggggtgggcatgaaggttccatgctgttatgggttgctatccttagtttttggatgatcctggtttgtttttttagctcaagccttgatacggaaatgcgcgctcgggtattagttattttaggttggctaagcattggttttattctttttttgttaatgacttccaatcctttcttgcgccaatttcaagtattgaatacacagggccgtgatctgaatccattgctgcaagatcctggctttttattccatcctcctatgttgtacatgggatatgtagggttttgtgtcgcttttgcttttgctattgccgccttgtgggcagggaaagtagaaaccagttggtctaaatggaccagaccctggactctggctgcctggtgttgtttaaccgcgggaattactttgggcagttggtgggcttatagagaattaggctggggtggttggtggttttgggatcctgtagaaaacgcttcttttatgccctggctggttggtacggcactattgcattctttggcagttacagagcagcgccagcaatttaaagcgtggaccatgttgcttgcaatcgctgctttttctttaagtttaattggtacttttcttgttcgctctggagttttaacttcagttcatgcctttgcggttgatcctcagcggggattatatattctgggatttttgttattcgtcattgggggttctttaacattgtttcttttcagagcccaaaccttgcaagtcaataaacatcctggcttattatcccgagaaagtgcgttgttgttaaacaatgtgtttttagtggttattatgctgacggtattaatgggcacggtttatccattgctggtggaagggttagggttaggcaaattatccgttggagcgccctattttaatgcagtatttgttccattaataattcctttattattgctaatggggttaggtgtccgtttgaaatggcagaatgattgttggagggatgtcttcagaaaactaaatcgtatttttttgcttagtctgatattgcctgtcattttactattctgtacctcaactgaaatacaccttacagcccttttgggattaattttggcattctgggttttgttgagtactgctaatgcggcgtatcacaaagtcagagatagaggggtggcaggagttggacaggcttattgggggatggttttggctcattgtggtgtcgcagcaacagtgattggcattgctgtttcttcagcttatggcgtacaagatgatgtacgtatgtctcctggcaagcaagtgagtctgctggattatcagattggattcattaatcagactccgttgaatggcccaaattacaaagggacaagggctgagttttcaatacaatatcagaataaaactaggcaaatttttcctgaaaaaagagtgtataccattggacaaatgccaatgactgagtctgcgattgatgtgactcctttccgagatatttacattgctttgggggagccactgtctgaggatgcctggtcggtccgaatttattataaaccgttggtccgctggatatgggctggcggatttatgattttagccggaggcgttttggcattaacagatagaaggtattacagaaaaaggcaagtaacggtaatggcagggcaggagatcaagatatga

SEQ ID NO: 68097 - protein, 650 aa, Legionella pneumophila
MIAELGLFFLILALVASLMLALIPLAGLQFNRKDWIDSSRNYVVLQFLFVACAYLCLTACFLMDDFSVIYVLNNSSLLLPWFYKFCAVWGGHEGSMLLWVAILSFWMILVCFFSSSLDTEMRARVLVILGWLSIGFILFLLMTSNPFLRQFQVLNTQGRDLNPLLQDPGFLFHPPMLYMGYVGFCVAFAFAIAALWAGKVETSWSKWTRPWTLAAWCCLTAGITLGSWWAYRELGWGGWWFWDPVENASFMPWLVGTALLHSLAVTEQRQQFKAWTMLLAIAAFSLSLIGTFLVRSGVLTSVHAFAVDPQRGLYILGFLLFVIGGSLTLFLFRAQTLQVNKHPGLLSRESALLLNNVFLVVIMLTVLMGTVYPLLVEGLGLGKLSVGAPYFNAVFVPLIIPLLLLMGLGVRLKWQNDCWRDVFRKLNRIFLLSLILPVILLFCTSTEIHLTALLGLILAFWVLLSTANAAYHKVRDRGVAGVGQAYWGMVLAHCGVAATVIGIAVSSAYGVQDDVRMSPGKQVSLLDYQIGFINQTPLNGPNYKGTRAEFSIQYQNKTRQIFPEKRVYTIGQMPMTESAIDVTPFRDIYIALGEPLSEDAWSVRIYYKPLVRWIWAGGFMILAGGVLALTDRRYYRKRQVTVMAGQEIKI

SEQ ID NO: 68098 - DNA, 1965 bp, Rhodobacter sphaeroides
  CDS (1)..(1965): transl_table=11
atgattgtcgaattcggccatttcgcgctggtgctgtcgctggctgtggcctttgtgcaagtccgtggtgccgttcgtcggcggcgaatcggcgttgttctggctggatggcggtgccgaacccgcggcggtcaccccagttctgctgatcggttctctttcgccgcgctgacctgggccttcgcgacctcggatttctcggtgcgcctcgtggtgctgaactcgcacacgctgaagcccatgctctacaagatcagcggcgtctgggggaaccacgagggctcgctgctcctgtgggtgctgatcctcgcgctgttcggagcctgcgccgcggtcttcgggcagaacctgccgcccacgctcaaggcgcgcgtgctggcggtgcaggggatgatcggcgcggccttcctggcctttctcctcttcacctcgaacccgttcctgcgcatgggcgaggtgcccttcgacggcgaggatctgaacccgcttctgcaggatccggggctcgccttccacccgcccttcctttacctcggctatgtcggcctctcgatggccttctccttcgcggtggcggccctgatcgagggccgcgtcgatgccgcctggggccgctgggtccggccctggacgctcgccgcctgggtgtttctcaccatcggcatcgcgctcggctcctggtgggcctattacgagctcggctggggcggcttctggttctgggacccggtcgagaacgcctccttcatgccctggctgatcgcggcggcgctgctccactctgccatcgtggtcgagaagcgcgaagcgctgaagagctggacgatcctgctggccatcctcgccttcggcttctcgctcattggcaccttcatcgtgcgctcgggcgtcatcacctccgtccatgccttcgccaacgatcccgagcgcgggatcttcatcctgatgatcctcgcggtcttcatgggcggggcgctcacgctcttcgccgcgcgggcgagcgccatggaggccaagggggtcttcggcatcgtcagccgcgagtcgggcctcgtgctgaacaacgtgctgctgacggtggcctgtttcgtggtcttcatcggcacgatctggccgcttcctgccgaactcctctggggccgcaagctgtcggtgggtgctccgttcttcaacgcggccttcacccccttcatggtggtgatcgccctcgtcctgccttatgggcgccgtcctccctggaagcgggccgagctcggccgcgggatgcggccgctctggggggcgctcgcgctctcggcggccctgggtgcgctggtcttcgcgctgcagacgggccggtcggcgctcgggcccgtcggcctcgcgctcggcgcctggctcgtcttcggcacgctcctcgacctctggggccgcaccgggcgcggcgcgctcggcgggcggctcgcgcgcctccggcgactgccgcgcgcggactggggcaaggccactgcccatgcgggcctcggcgtcacgatcttcgccgtggcggccatcaccgcctggcaggtcgagtcgatccgcgtgatgaagccgggcgagaccttcgccctcggccgctacgacgtcctgctcgagggcgtgcgcgagatcgaagggccgaactaccgctcgaccgtggccgacttccgcgtgacccgcgacgggccgaatggcgaactccatcccgagaagcgcgtctatccggtggccgccatgccaacgacggaagcgccatcgatacggttcacccgcgactcttacctcgtgatcggcgacccgcaggagggcggcggctatgcggtgcgcagctacatcaagcccttcgccaactggatctggggcggcgcgctgctgatggcgctcggcgggctgctgagcctctcggaccgccgctaccgcatcgccgccggggcgcgccggatgccggccgcggtggctgcagaatga

SEQ ID NO: 68099 - protein, 654 aa, Rhodobacter sphaeroides
MIVEFGHFALVLSLAVAFVQVRGAVRRRRIGVVLAGWRCRTRGGHPSSADRFSFAALTWAFATSDFSVRLVVLNSHTLKPMLYKISGVWGNHEGSLLLWVLILALFGACAAVFGQNLPPTLKARVLAVQGMIGAAFLAFLLFTSNPFLRMGEVPFDGEDLNPLLQDPGLAFHPPFLYLGYVGLSMAFSFAVAALIEGRVDAAWGRWVRPWTLAAWVFLTIGIALGSWWAYYELGWGGFWFWDPVENASFMPWLIAAALLHSAIVVEKREALKSWTILLAILAFGFSLIGTFIVRSGVITSVHAFANDPERGIFILMILAVFMGGALTLFAARASAMEAKGVFGIVSRESGLVLNNVLLTVACFVVFIGTIWPLPAELLWGRKLSVGAPFFNAAFTPFMVVIALVLPYGRRPPWKRAELGRGMRPLWGALALSAALGALVFALQTGRSALGPVGLALGAWLVFGTLLDLWGRTGRGALGGRLARLRRLPRADWGKATAHAGLGVTIFAVAAITAWQVESIRVMKPGETFALGRYDVLLEGVREIEGPNYRSTVADFRVTRDGPNGELHPEKRVYPVAAMPTTEAPSIRFTRDSYLVIGDPQEGGGYAVRSYIKPFANWIWGGALLMALGGLLSLSDRRYRIAAGARRMPAAVAAE

SEQ ID NO: 68100 - DNA, 1968 bp, Pantoea citrea
  CDS (1)..(1968): transl_table=11
atgatacctgaaataggcagttttttgttatgcctggcccttggctgggctgtgttactgagtatttacccgctgtggggagccgcgcgacaggacagtcgtttgatgggactggcccggcctttgacttatggtttgtttacctgtattgcggcacgatttctgattctggtgcattcttttattgtcaacgactttactgtggcctatgtcgctgagaactccaataccatgctgccaatctggtaccgcattgcagcaacctggggagctcatgagggatcgttactgctctggttactgatgctcagtggctggacactggcggtacggttgctgagtcgtggtatgccacaggatgccattgcccgggtgctggcggtgatgggcatgattaaccttggcttcctgctgtttattactctgacctccaacccgtttatccggacattacctgatttccccgttgatggcagcgatctcaacccaatgctccaggatatcggactgattttccacccgccattactctatatggggtacgtcggattctcagtggcatttgcgtttgccattgcttcactgatgaccgggcggctcgatacggcatgggcccgctggtcacgtccgtggacgacagcggcgtggattttcctgaccatcgggattgttttagggctcggctgggcttattacgacctgggctggggtggctggtggttctgggatccggttgaaaatgcctcgctgatgccgtggctggccggaaccgcattgattcactcactggcggtgacagagaaacgcgggacctttaaatcctggactgtgttactggctattaccgccttctcactgagtctgttggggaccttcctggtacgttcaggtgtcctggtatcggttcactcgttcgcgtccgatccttcccgtggtatttttattctgatattcctggtgattgtcatcggatgttcgttactgctgtacgctatccgtggtggacaggtgcgtagcagggtacagcctgaaggctggtcgagagagtcgtttctgttaggaaataatgttctgttgattgccgctatgctggtggtattgctggggactttgttacccctggtacacaaggaactgggcctgggcagcatttcgattggtgcgccgttcttcaatactatgtttacctggctgatggcgccgtttgctctgatgttgggtattgggcctctggtacgctggcgtcgtgatgaacctcagaaattgtataagcggttaattattgcggcggttgtcactctgattgcttccgttgtcctgccattactgttgcaggaccgtattgaagcgatgacggtggttggtctgctgatgtcagtctgggtaattgtactgacgctgatggaacttcatgagcgtgcaacccatcgccatacctttttccgtgggctgggacatctgtcccgcagtcactggggaatggttctggggcatcttggcgtggcggtgacggtgattggaatagcgttcagtacccaatacagtgttgaacgcgatgtccgtatgaaagccggtgataacgtcgatatccataattatcattttgttttccgtgatgttcagcgcctggtgggtcctaactataccggcggggtggcaattattgatgtcacccgcaacggaaaacaagaagctgtgctgcatgcagagaaacgtttttataccgccgcccgcaccatgatgacgatggtgcaatcagtggcggttttggccgcgatctttacgcacgcagccctgggtgaagagataggccagggttcctgggccgttcgtctctattacaaaccttttgttcgctggatttggttcggtggtgtgtttatggcggttggcggtattttgtgtctgctcgacccgcggtatcgctcccgcaagaaagcacaggcacaggaggaatcactgtcatga

SEQ ID NO: 68101 - protein, 655 aa, Pantoea citrea
MIPEIGSFLLCLALGWAVLLSIYPLWGAARQDSRLMGLARPLTYGLFTCIAARFLILVHSFIVNDFTVAYVAENSNTMLPIWYRIAATWGAHEGSLLLWLLMLSGWTLAVRLLSRGMPQDAIARVLAVMGMINLGFLLFITLTSNPFIRTLPDFPVDGSDLNPMLQDIGLIFHPPLLYMGYVGFSVAFAFAIASLMTGRLDTAWARWSRPWTTAAWIFLTIGIVLGLGWAYYDLGWGGWWFWDPVENASLMPWLAGTALIHSLAVTEKRGTFKSWTVLLAITAFSLSLLGTFLVRSGVLVSVHSFASDPSRGIFILIFLVIVIGCSLLLYAIRGGQVRSRVQPEGWSRESFLLGNNVLLIAAMLVVLLGTLLPLVHKELGLGSISIGAPFFNTMFTWLMAPFALMLGIGPLVRWRRDEPQKLYKRLIIAAVVTLIASVVLPLLLQDRIEAMTVVGLLMSVWVIVLTLMELHERATHRHTFFRGLGHLSRSHWGMVLGHLGVAVTVIGIAFSTQYSVERDVRMKAGDNVDIHNYHFVFRDVQRLVGPNYTGGVAIIDVTRNGKQEAVLHAEKRFYTAARTMMTMVQSVAVLAAIFTHAALGEEIGQGSWAVRLYYKPFVRWIWFGGVFMAVGGILCLLDPRYRSRKKAQAQEESLS

SEQ ID NO: 68102 - DNA, 1983 bp, Bradyrhizobium japonicum
  CDS (1)..(1983)
atgatcgcggaatccgggcattacgcgctggtgctggcgctcgggctggcactgatccaatccatcgtgccgttgatcggcgcgcggctgcgcgacgatgcgctgatgagcgtggcgcgctccaccgcgctggcgcagctgctgttcgtcggcgcctcgttcgtggcgctggtgatgctgcatgtgaattcggatttctccgtcgccaacgtctacgagaattcgcattcgatgaagccgctgctctacaagatcaccggcgtctggggaaaccatgaaggctcgatgctgctgtgggtgtcgatcctggcgctgttcggcggattggtcgcggcgttcggcaacaatcttccgctgtcgctgcgcgcgcatgtgctcgcggtgcaggcctggatcgccagtgccttctatctcttcatcctggtgacctcgaacccgttcctgcgtatcgccaacccgccgatcgagggacgcgatctcaatcccgtgctgcaggacatcggtctcgccgtgcatccgccgatgctctatctcggctatgtcggattctcgatctcgttctcctttgccatcgcggcgctgatggaggggcggatcgacgccgcctgggcgcgctgggtgcggccgtggacgctggtcgcgtggatcttcctgacgctcggcatcgcgatgggctcctactgggcctattacgagctcggctggggcggctggtggttctgggatccggtcgagaacgcctcgctgatgccgtggcttgccgggacggcgctgctccattcggcgctggtgatggagaagcgcaacgcgctgaaggtctggaccatcctgctgtcgatcctgaccttctcgctatcgctgctcggcaccttcctggtgcgctcgggcgtcatcacctccgtgcatgcctttgccaccgatccgacccgcggcgtgttcattctgctgatcctctgcctgttcatcggcggcagcctgtcgctgttcgcaggccgcgcgacatcgttgaagcagggcggcctgttcgcgccgatctcgcgtgagggcgcgctggtgctgaacaatctgctgctgaccgtcgcctgcgcggtcgtgctgttcggcacgctctatccgctggcgatggagatgctcgccgacttcaagatgtcggttggcgcgccgttctacaacctcaccttcgcaccgctgtttgccctgttgctgctcgccgtgccgttcgggccgatgctggcgtggaagcgcggcgatctgctcggcgtcacccagcggctgctcgcggccggcgttgccgggctcgttgtagtcgcgatcgtctgggcctggacgcgtggcggcagcgcgctcgcaccgctcgcgatcggacttggcgtcttcgtcatcgccggcgccgtcaccgatctggtcgagcggacgggcctggttcgtctgccgctcgcaacagcgctgcagcgggcgcgcggcctgccacgctcggcctggggcgcggcattggcgcatgccggcctcggcgtcgcgctgatcgggatcgtctgcgagaccacctggaacagcgaatatatcgcgacgatgaagcggagcgacgtcgcccatgtcgccggctacgacgtgaagctcgacgggttgtttcagcgtcagggcccgaactaccgcgagatgatcgccgagttcaacgtcagccgcgacggtgagacactgagcgtcatgacgccgtccaagcgcagcttcaccacccgcggctcctccaccacggaggccgcgctgctgacccgcggggcgagccagctctacatctcgctgggcgatgccaatgccgagggcgcgattgccgtgcgcatctatcacaagccgctggtgctgctgatctggtggggtccggtgctgatggccttcggcggcgtgctgtcgctgtccgatcgccgcctgcgggtcggcgcgccaaaaccggcgcgggccaagcagcgcctgcagccggcggagtga

SEQ ID NO: 68103 - protein, 660 aa, Bradyrhizobium japonicum
MIAESGHYALVLALGLALIQSIVPLIGARLRDDALMSVARSTALAQLLFVGASFVALVMLHVNSDFSVANVYENSHSMKPLLYKITGVWGNHEGSMLLWVSILALFGGLVAAFGNNLPLSLRAHVLAVQAWIASAFYLFILVTSNPFLRIANPPIEGRDLNPVLQDIGLAVHPPMLYLGYVGFSISFSFAIAALMEGRIDAAWARWVRPWTLVAWIFLTLGIAMGSYWAYYELGWGGWWFWDPVENASLMPWLAGTALLHSALVMEKRNALKVWTILLSILTFSLSLLGTFLVRSGVITSVHAFATDPTRGVFILLILCLFIGGSLSLFAGRATSLKQGGLFAPISREGALVLNNLLLTVACAVVLFGTLYPLAMEMLADFKMSVGAPFYNLTFAPLFALLLLAVPFGPMLAWKRGDLLGVTQRLLAAGVAGLVVVAIVWAWTRGGSALAPLAIGLGVFVIAGAVTDLVERTGLVRLPLATALQRARGLPRSAWGAALAHAGLGVALIGIVCETTWNSEYIATMKRSDVAHVAGYDVKLDGLFQRQGPNYREMIAEFNVSRDGETLSVMTPSKRSFTTRGSSTTEAALLTRGASQLYISLGDANAEGAIAVRIYHKPLVLLIWWGPVLMAFGGVLSLSDRRLRVGAPKPARAKQRLQPAE

SEQ ID NO: 68104 - DNA, 1944 bp, Escherichia coli
  CDS (1)..(1944): transl_table=11
atgatgccagaaattggtaacggactgctgtgcctggcgctgggaattgcgctgctgctgtccgtgtatccgctatggggcgtggcgcgcggagatgcgcgcatgatggcgtcttcccgcttgtttgcctggctgctgtttatgtctgtggctggcgcatttctggtgctggtcaatgctttcgtggtcaacgacttcaccgtcacctatgttgccagcaactccaatacccagcttccggtgtggtatcgcgtggcggctacctggggcgcgcatgaaggctcgctactgctgtgggtgctgctgatgagcggctggacctttgcggtggcgatttttagtcagcgtattccgctggatattgtggcccgtgtactggcgataatggggatggtcagtgtcggctttttgctgttcattctctttacctctaacccgttctctcgcacgttgccgaacttcccgattgaaggtcgcgatcttaacccgctattgcaggatccggggctgatcttccatccgcctctgctttatatggggtacgtgggtttctcggtggcgtttgcttttgccattgcttctttgctgagcgggcgtctggacagcacttatgcgcgttttactcgtccgtggacgctggcagcgtggatcttcctgacgctcggcatcgtgctcggttccgcatgggcctattacgaactcggctggggtggctggtggttctgggatccggtagaaaacgcctcgtttatgccgtggctggtggggactgcgctgatgcactcactggcggtcactgaacaacgcgccagcttcaaagcgtggacattactgctggcaatcagtgccttctcgttgtgtctgttggggactttcctcgtgcgttccggcgtgctggtatcggtacacgcgtttgcgtctgatccggcgcgcggtatgtttatcctcgcctttatggtgctggtgattggcggttcgctgctgctgtttgccgcgcgtggacacaaagttcgctcacgcgtaaacaatgcgctgtggtcgcgggaatctttgctgttagcgaacaatgttttgctggtcgctgcgatgctggtggtgttgctggggacgctgctgccgttggtgcataagcaactgggactgggcagtatttcgattggcgaaccgttcttcaacaccatgtttacctggctgatggtgccgtttgcgctactgcttggtgtcggtcctctggtgcgctgggggcgggatcgcccgcgtaagatccgcaatttattgattatcgccttcatctctacgctggtgctgtcgctgctgttgccgtggctgttcgaaagcaaagttgtggcgatgacggtgctcggcctggcaatggcctgctggattgcggtgctggcaattgcggaagctgcgctacgtatttcacgcggcacgaaaaccaccttcagttattgggggatggtggcggctcaccttgggctggcagtgacaattgttggcattgcctttagccagaactatagcgttgagcgtgatgtgcgcatgaagtccggcgatagcgtcgatattcatgaatatcgcttcaccttccgtgatgtcaaagaggtgactggcccgaactggcgtggcggtgtggcgactatcggcgtaacgcgcgatggcaagccggaaacggtgctgtatgcggaaaaacgttattacaacactgccgggtcgatgatgaccgaagcggcaattgacggcggcatcacgcgtgacctgtacgcggccctcggtgaagagctggaaaacggcgcgtgggccgtgcgtctttactacaaaccatttgttcgctggatttgggcgggcgggctgatgatggcgttgggcggactgctgtgtctgtttgatcctcgctatcgtaagcgcgtgagtccgcaaaaaactgcgccggaggccgtatga

SEQ ID NO: 68105 - protein, 647 aa, Escherichia coli
MMPEIGNGLLCLALGIALLLSVYPLWGVARGDARMMASSRLFAWLLFMSVAGAFLVLVNAFVVNDFTVTYVASNSNTQLPVWYRVAATWGAHEGSLLLWVLLMSGWTFAVAIFSQRIPLDIVARVLAIMGMVSVGFLLFILFTSNPFSRTLPNFPIEGRDLNPLLQDPGLIFHPPLLYMGYVGFSVAFAFAIASLLSGRLDSTYARFTRPWTLAAWIFLTLGIVLGSAWAYYELGWGGWWFWDPVENASFMPWLVGTALMHSLAVTEQRASFKAWTLLLAISAFSLCLLGTFLVRSGVLVSVHAFASDPARGMFILAFMVLVIGGSLLLFAARGHKVRSRVNNALWSRESLLLANNVLLVAAMLVVLLGTLLPLVHKQLGLGSISIGEPFFNTMFTWLMVPFALLLGVGPLVRWGRDRPRKIRNLLIIAFISTLVLSLLLPWLFESKVVAMTVLGLAMACWIAVLAIAEAALRISRGTKTTFSYWGMVAAHLGLAVTIVGIAFSQNYSVERDVRMKSGDSVDIHEYRFTFRDVKEVTGPNWRGGVATIGVTRDGKPETVLYAEKRYYNTAGSMMTEAAIDGGITRDLYAALGEELENGAWAVRLYYKPFVRWIWAGGLMMALGGLLCLFDPRYRKRVSPQKTAPEAV

SEQ ID NO: 68106 - DNA, 1983 bp, Pseudomonas fluorescens
  CDS (1)..(1983): transl_table=11
atgacgtccgcactgtttattccggagctgggccagttgcggatgatcctcgccctgtgctttgccgtggtccaggctgtggtgccattgctcggcgcctggccgggtgaccgcctgtggatgagcctggcgcagccggcgcgctggggccagtttgccttcctgttgttcgccttcggttgcctgacctacgcctttatgaccgacgacttttccgtcgcctatgtcgcaaacaactccaacagcgccttgccctggtattacttgttcagcgccgtgtggggcgcccacgaaggttcgttgctgctgtgggcgttgatcctcggtggctggaccttcgccgtatcggtgttttcgcgccaactgccgcaagtcatgctggcacgggtgctggcggtgatgggcatgatcagcattggctttttgctgttcctgatcatgacctccaaccctttcagccgcatgctgccgcagatcccggcggacgggcatgacctcaacccgctgttgcaggacatcggcctgatcgtgcatccgcccatgctctatatgggctacgtcggcttctccgtagcctttgccttcgccatcgccgccttgcttggcgggcgtctggatgcggcgtgggcgcgttggtcgcggccatggaccatcgttgcctgggccttcctcggtatcggtatcaccctgggctcatggtgggcctactacgaacttggctggggcggctggtggttctgggatccggtggaaaacgcgtccttcatgccctggctggtgggcactgcgctgattcattccctggcggtcaccgaaaaacgcggcgtgttcaagagctggactgtgttgctcgccatcgccgcgttttccctcacgctgctcgcagccttcctggtgcgttcgggcgtgctgacctcggtgcatgcgttcgcctctgaccccgagcgtggcgtgttcatcctgatcttcctgctgtttgtggtgggcggctcgctgaccctgttcgtgcgcgcaccggtggtcaagagccaggtcggcttcaacctgtggtcgcgggaaaccctgctgctgggcaataacctggtgctggtggtagccgcgtcgatgatcctgctcggcaccctctacccgctggtgctggatgccctcagcggcgccaagctgtccgtcggcccgccgtatttcaatgcgttgttcatcccgctgatgggcctgttgatggtggtgatggcggtcggcgtgctggtgcgctggaaagacactccggtgaaatggctggtgggcatgctcgctccggtgctgctaggcagcgttgcgctggccgtggtcgccggtattgcctacggcgacttcaactgggcagtgctcgccaccttcctgctcgccgcctgggtattactggccggtgtgcgtgacatcttcgacaagacccgtcacaaaggtttgctcaaaggtctgccgaccctgacccgcagctactggggcatgcagatcgcccacatcggcatcgcggtgtgcgccctcggcgtggtgctgtccagccagaacagcgccgagcgcgacctgcgcctggcgccgggcgaatccatggacttggccggttaccacttcatcttcgaaggcgccaagcacttcgaagggccgaactttacctcagacaaaggcacggtgcgcgtggtgcgcaacggcaaggaaatcgccgtgctgcacccggaaaaacgcctttacaccgtgcagagttcgatgatgaccgaagcgggcattgacgccggcttcacccgtgacctctatgtggccctcggagaacccctgggcgacggcgcctgggccgtgcgggtgcatgtcaaacccttcgtgcgctggatctggttcggcggtttgctcaccggttttggcggtttgctcgcggcgctggaccggcgttatcgggtcaaggtcaaaagccgggtgcgtgaagcactgggtatgggagctgcggtatga

SEQ ID NO: 68107 - protein, 660 aa, Pseudomonas fluorescens
MTSALFIPELGQLRMILALCFAVVQAVVPLLGAWPGDRLWMSLAQPARWGQFAFLLFAFGCLTYAFMTDDFSVAYVANNSNSALPWYYLFSAVWGAHEGSLLLWALILGGWTFAVSVFSRQLPQVMLARVLAVMGMISIGFLLFLIMTSNPFSRMLPQIPADGHDLNPLLQDIGLIVHPPMLYMGYVGFSVAFAFAIAALLGGRLDAAWARWSRPWTIVAWAFLGIGITLGSWWAYYELGWGGWWFWDPVENASFMPWLVGTALIHSLAVTEKRGVFKSWTVLLAIAAFSLTLLAAFLVRSGVLTSVHAFASDPERGVFILIFLLFVVGGSLTLFVRAPVVKSQVGFNLWSRETLLLGNNLVLVVAASMILLGTLYPLVLDALSGAKLSVGPPYFNALFIPLMGLLMVVMAVGVLVRWKDTPVKWLVGMLAPVLLGSVALAVVAGIAYGDFNWAVLATFLLAAWVLLAGVRDIFDKTRHKGLLKGLPTLTRSYWGMQIAHIGIAVCALGVVLSSQNSAERDLRLAPGESMDLAGYHFIFEGAKHFEGPNFTSDKGTVRVVRNGKEIAVLHPEKRLYTVQSSMMTEAGIDAGFTRDLYVALGEPLGDGAWAVRVHVKPFVRWIWFGGLLTGFGGLLAALDRRYRVKVKSRVREALGMGAAV

SEQ ID NO: 68108 - DNA, 2031 bp, Rhizobium meliloti
  CDS (1)..(2031): transl_table=11
atgatcatcgaactcgggcactatgcactggttttggcgctcgcgaccgcgatcatccagggcgtcctgcccgtcctgggggtgcggcgcggcgacccttccttgatgggactggcagcaaacgcggcgctcgtctgcttcctgctcgtcgctttctccttcgccgtgctgacattcgcctatgtgacatcggatttctcggtcaagaacgtctgggagaactcgcattccctcaaaccgctgatctacaagatcaccggggtctggggaaaccatgaaggctcgatgcttctctggctgctcattcttgtcttcttttccgcgatggtggcgctcttcggccgcaacctgccggagacgttgaaggcgaacgtccttgcggtgcaggcctggatcgcgaccgccttcgcgttcttcgtcctgctgacctccaatcccttcgcgcggctcgtgccggcaccgggcgagggcagggacctcaaccccgtgctgcaggatatcgggctcgcgatccacccgcccttgctctatctcggctatgtcggcttttccgtatgcttctccttcgcggtcgccgcgctcatcgaggggcggatcgatgcggcctgggcgcgttgggtgcggccgtggacacttgccgcctggacttttcttaccgccggcatcgccatgggctcctattgggcctattacgagctgggctggggcggctggtggttctgggacccggtcgaaaacgcctccttcatgccttggctcgccggaacggcacttctgcactcggccctggtcatggaaaagcgcgaagcgctaaagatatggaccgtgctgctggcgatcatgaccttctcgctgtcgctgctcggcacgttcctggtgcgctccggcgtgctgacatccgtccatgccttcgccaccgacccgacccgcggcgtcttcattctcgccatcctggtcgtcttcatcggcggtgcgttctcgctctttgccttccgtgcctcccatctcaaggccgggggaatattcgcaccggtttcgcgtgagggtgcgctcgtcgtgaacaacctgatcctgacgacggccacggcgacggtgctgaccggcacgctgtatccgctggtactcgaagcgctgaccggcgacaaaatttcggtcggcgcgccgttcttcaacatgacgttcggcctgctgatgctgccgctcatcgccgtcgttcccttcggcccgctgcttgcctggaagcgcggcgaccttgccggtgcggcgcagcgtctgtttgcggctgccgcgctcggcctgctcgccgcggcgatctgttattacgcggtaaacggtggcccggtcctggctcctttcggcctcggcctcggcgtctacctgattctgggagcgctcaccgatctggttctgcgctccgggctcggcaaggtggcggcgggcgtcgcctggagacggctttcgggcctgccgcgttcggctttcggcacggcgctcgcccatatcgggctcggaatcaccctgatcgggatcgtcacggtcacggctttcgaaacggaaacggtcgtcgagatgaaaccgggggcggtggtcgatgtcgggcgttacagcctgcgtttcgacggcatgcgtgaagggcgcgggccgaactataccgaggatgccggccatttcaccgtcagtcgaggcggcgtcgaggttaccgagatctggtcgtcgaaacggctctattcggcgcggcgcatgccgacgaccgaggccggaatccggaccttcggcctgagccagctctatgtatccttgggcgacgacatggcggacggcggcatcgtcgtccgcatctggtggaaaccgctgatcctatgcatctggggcggcgcgctcgtgatgatggccggcggcgtcgtttcgctcagcgaccggcgccttcgcgtcggcgcgccggcgcgtgccagaaaggccctcgccctggatcacgatgatttcaggtcggatcgaccaaaaatcatcaacgtgatcgattctaaaggttag

SEQ ID NO: 68109 - protein, 676 aa, Rhizobium meliloti
MIIELGHYALVLALATAIIQGVLPVLGVRRGDPSLMGLAANAALVCFLLVAFSFAVLTFAYVTSDFSVKNVWENSHSLKPLIYKITGVWGNHEGSMLLWLLILVFFSAMVALFGRNLPETLKANVLAVQAWIATAFAFFVLLTSNPFARLVPAPGEGRDLNPVLQDIGLAIHPPLLYLGYVGFSVCFSFAVAALIEGRIDAAWARWVRPWTLAAWTFLTAGIAMGSYWAYYELGWGGWWFWDPVENASFMPWLAGTALLHSALVMEKREALKIWTVLLAIMTFSLSLLGTFLVRSGVLTSVHAFATDPTRGVFILAILVVFIGGAFSLFAFRASHLKAGGIFAPVSREGALVVNNLILTTATATVLTGTLYPLVLEALTGDKISVGAPFFNMTFGLLMLPLIAVVPFGPLLAWKRGDLAGAAQRLFAAAALGLLAAAICYYAVNGGPVLAPFGLGLGVYLILGALTDLVLRSGLGKVAAGVAWRRLSGLPRSAFGTALAHIGLGITLIGIVTVTAFETETVVEMKPGAVVDVGRYSLRFDGMREGRGPNYTEDAGHFTVSRGGVEVTEIWSSKRLYSARRMPTTEAGIRTFGLSQLYVSLGDDMADGGIVVRIWWKPLILCIWGGALVMMAGGVVSLSDRRLRVGAPARARKALALDHDDFRSDRPKIINVIDSKG

SEQ ID NO: 68110 - DNA, 1962 bp, Rhodobacter capsulatus
  CDS (1)..(1962): transl_table=11
atgatcgtcgagaccggccatttcgccctgatcctggccctgtgcgtggcgctggtgcaggcggtcattcccctggtgggcgcgcaaaagggctggtcgggctggatggccgttgccacccccgcggcgctggcgcagttcgggctgatcgccatcgcctttgccgcgctgacctatgcctttgtgacgtctgacttttcgctgaagctcgtctacgaaaactcgcataccgacaagccgatgctctacaaggtcaccggggtctggggcaaccatgagggctcgatgctgctttgggtgctgatcctcgccatgttcggcgcggcggccgcggcctttggcggtgccttgccggagcggctgcgggcgcgggtgctggcggtgcagggcaccatcggggtcgcgtttctggtctttgtgcttttcacctcgaacccgttcctgcggctggaagaagcgccgttcaacggccgcgacatgaacccgctgctgcaggacccgggtctcgccttccatccgccgttcctgtaccttggctatgtcgggctttcgatggccttcagcttcgccgtcgccgcgctgatcgaggggcgggtcgatgccgcctgggcgcgctgggtccggccctggaccttggccgcctggatcttcctgaccatcggcatcgcgctgggatcgtggtgggcctattacgagctcggctggggcggcttctggttctgggacccggtggaaaacgcctcgctgatgccctggctgctggcggcggcgctgttgcattccgccatcgtcgtcgaaaagcgcgaggcgctgaaaagctggacgatcctgctcgccatcatggccttcggcttttcgctgatcggcacgttcctggtgcggtccggggtgatttcctcggtgcacagtttcgccaatgaccccgagcgcggggtgttcatcctgttcatccttgccttcttcaccggcggggcgctgacgctttatgccgcgcgggcctcggagatgcaggcgaaggggctgttttccatggtcagccgcgaatcggcgctggtgatgaacaacgtgcttttggcggtggcggcgctggtggtgttcaccggcacggtctggccgctgatcgcggagctgttctgggaccgcaagctctcggtgggggcgccgttcttcgaaaaggcctttacccccttcatggtcgggctggcgctgctgttgccgctgggatcgatgatgccgtggaaacgcgcgagcctcggcaagctggtgcggccgctgttgcccgcgcttgtgctgacgctggcggtgctggcgctggtctgggtgatggcgacggggcggccgatgctggcgcttggcgcggcggggctgggcgcctggatcctttttggcgccctggccgagatctggcaacgcgccgggcggacgccgggacgcatcctgcggctgccgcgggcggattggggcaaggccttcgcgcatggcgggctgggcatcgtctttgcgggcgtcggcctcttgatggccgggcaggtcgaggatatccgcgtggcgaaggcgggcgacagtttcgaggtggcaggttacacgatcacgctggtgtcggtcgaggatgtgccggggccgaacttcaccgccaagaccgcgacgatggaggtgcggcagggcggcaagctggtggcgaccctgcatcccgaaaagcgcatctatccggtgcaggcgatgccgacgaccgaggccgatatcgacaacggcttctggcgcgatgtctatctggtgatcggcgacccgcaggagggcggcggctgggcggtgcggacctatgtcaagcctttcgcgaactggatctgggcgggctgtctgctgatggcctttggcggcgggctgagcctgaccgaccggcgttatcgcagcgccgccggggcgcggcgggcgacggtggccgatgctgttgcggcggagtga

SEQ ID NO: 68111 - protein, 653 aa, Rhodobacter capsulatus
MIVETGHFALILALCVALVQAVIPLVGAQKGWSGWMAVATPAALAQFGLIAIAFAALTYAFVTSDFSLKLVYENSHTDKPMLYKVTGVWGNHEGSMLLWVLILAMFGAAAAAFGGALPERLRARVLAVQGTIGVAFLVFVLFTSNPFLRLEEAPFNGRDMNPLLQDPGLAFHPPFLYLGYVGLSMAFSFAVAALIEGRVDAAWARWVRPWTLAAWIFLTIGIALGSWWAYYELGWGGFWFWDPVENASLMPWLLAAALLHSAIVVEKREALKSWTILLAIMAFGFSLIGTFLVRSGVISSVHSFANDPERGVFILFILAFFTGGALTLYAARASEMQAKGLFSMVSRESALVMNNVLLAVAALVVFTGTVWPLIAELFWDRKLSVGAPFFEKAFTPFMVGLALLLPLGSMMPWKRASLGKLVRPLLPALVLTLAVLALVWVMATGRPMLALGAAGLGAWILFGALAEIWQRAGRTPGRILRLPRADWGKAFAHGGLGIVFAGVGLLMAGQVEDIRVAKAGDSFEVAGYTITLVSVEDVPGPNFTAKTATMEVRQGGKLVATLHPEKRIYPVQAMPTTEADIDNGFWRDVYLVIGDPQEGGGWAVRTYVKPFANWIWAGCLLMAFGGGLSLTDRRYRSAAGARRATVADAVAAE

SEQ ID NO: 68112 - DNA, 1908 bp, Haemophilus influenzae
  CDS (1)..(1908): transl_table=11
atgcttccagaacttggctttttccttcttttactcgcaacagctagcgcgtttttccttgcgttagtgcctcaatttgggttattcaaaaaaaatccgactttaattaatgctgcttggccgcttagttatatttttacccttgcgacgacgttatcaattggtttgcttgcttattcttttgcggtggatgatttcacccttgaatatgtagcggcacattctaattcccaattacctacattttttaaagtggctgccacttggggaggacatgaaggttcaatgttgttttggttattttcattgagtttatggcttgctgcttttgctttttttaatcgaaaaaatgaccgcactttttctgctcaatctttatctttattgggattgatttgctttggttttgcggtgtttattttattttattccaatccatttggacgcattttcccagcacccgcagaagggcgcgatctcaatccaatgttgcaagatgtgggattaattttccatccacctttactatatgttggctatgtgggctttgcggtaaattttgcaatgagtttgagtgcgttgatttataaccaatctgcacgacaaattgcccgctcaatgcgtggatgggtgttggtttcttggttatttttaaccattggcattgtgcttggtgcttggtgggcttattacgaacttggctggggcggttggtggttctgggatcccgtagaaaatgcgtctttaatgccttggttgcttggtttggcattattacacagtttaatggcgacggaaaaacaaggcgtatttagttattggacaacgcttttttctctgcttgcttttgcctttagcgtattaggcacgtttattgttcgttctggcgcactcacttctgtgcatgcttttgcattggataacacgcgcggttatgtgttgttattaattttctttgttttgacagcgttagcctttggtttattcgctttacgagcgggaagttcatcagaaagtgcggtgaaatttcagttcatttctaaatcgggtggcattttattactgaatattttgctgaccattgcgacggtttctacctttttaggtaccttttacccgatgttattccaagcgatgaattggggctcaatttcggtgggaagtccttattttaatagtattttcttccccattattacggcgattttaatcttaatggtaattgtgcttagcatacgtaaggggcaatttgatcgcacattattgatacgttgtgggtggttgcttattccgtctttaattcttgcaggcctaatgatttggcaacagctacgaaataattctgcattacatttccatgctttcgcctttgtgttattaactcttgcgatttggcttttattcgtcacgttatggcaaaattggcgacaaattcgcttgtctcaatttgggatgattttagcacactgtggcgtggcgattgtgactattggtgcggtgatgagtgggtattttggcagtgaaattggtgtgcgtttagcaccgcaacaaagtcaaacgttagggcaatatgaatttcattatcgccaattttctaatgaaattgggccaaactttacggcagaagtcgccttttttgacgtaactaaaaatggtaaaccttatgcagaaattatcccagaacgccgttattacgatgtacgaacaatgacaatgagtgaagtggggcttgatggtggtttttggggcgatttatatattgtgatgggcgattctcttggcaaaggggaatttactttccgcttacattataaaccactgattcgttggctttgggcgggcggtattttaatggcctttggcgcactttttagcgttttcggattacgcagaaaacaggaaaaataa

SEQ ID NO: 68113 - protein, 635 aa, Haemophilus influenzae
MLPELGFFLLLLATASAFFLALVPQFGLFKKNPTLINAAWPLSYIFTLATTLSIGLLAYSFAVDDFTLEYVAAHSNSQLPTFFKVAATWGGHEGSMLFWLFSLSLWLAAFAFFNRKNDRTFSAQSLSLLGLICFGFAVFILFYSNPFGRIFPAPAEGRDLNPMLQDVGLIFHPPLLYVGYVGFAVNFAMSLSALIYNQSARQIARSMRGWVLVSWLFLTIGIVLGAWWAYYELGWGGWWFWDPVENASLMPWLLGLALLHSLMATEKQGVFSYWTTLFSLLAFAFSVLGTFIVRSGALTSVHAFALDNTRGYVLLLIFFVLTALAFGLFALRAGSSSESAVKFQFISKSGGILLLNILLTIATVSTFLGTFYPMLFQAMNWGSISVGSPYFNSIFFPIITAILILMVIVLSIRKGQFDRTLLIRCGWLLIPSLILAGLMIWQQLRNNSALHFHAFAFVLLTLAIWLLFVTLWQNWRQIRLSQFGMILAHCGVAIVTIGAVMSGYFGSEIGVRLAPQQSQTLGQYEFHYRQFSNEIGPNFTAEVAFFDVTKNGKPYAEIIPERRYYDVRTMTMSEVGLDGGFWGDLYIVMGDSLGKGEFTFRLHYKPLIRWLWAGGILMAFGALFSVFGLRRKQEK

SEQ ID NO: 68114 - DNA, 22 bp, Primer
atgttgaccccgttgacggcct

SEQ ID NO: 68115 - DNA, 23 bp, Primer
ttattcatcgcgcttcttccccc

SEQ ID NO: 68116 - protein, 954 aa, consensus
  MISC_FEATURE (1)..(954): consensus for the disclosure of xaa see table XV
EXGXXXXXXXXXXXXXXXXXXXXXXXXXXXXXXXXXXXXXXXXXXXXXXXXXXXXXXXXXXXXXXXXXXLXXXXXXXDFSXXXVXXXSXXXXPXXXXXXXXWGXHEGSXLLWXXXXXXXXXXXXXXXXXXXXXXXXXXXXXXXXXXXXXXXLXXXXXXXXXFXXFXXXXSXPFXXXXXXXXXXXXXXXXXXGXXLNPXLQXDXGXXXHPPXLYXGYXGXXXXFXXXXAXLXXXXXXXXXXXXXXXXXXXXXXXXXXXXXXXXXXXXXXXXXXXXXXXRXWXXXXWXXLTXGIXXGSXXXWAYXELGWGGXWFWDPVENASXXPWLXXXALXHSXXXXXXRXXXXXWXXXLXXXXFXXXLXGTFXVRSGXXXXXSVHXFAXDXXXXRGXXXLXXXXXXXXXXXXLXXXXXXXXXXXXXXXXXXXXXXXXXXXXXXXXXXXXXXXXXXXXXXXXXSXEXXXXXXXXXXXXXXXXXXXGTXXPXXXXXXXXXXXXXXXXXXXXXXXXXXXXXXXXXXXXXXXXSXGXPXFXXXXXXXXXXXXXXXXXXXXXXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHXGXXXXXXGXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXRXYXXXXXXXXEXXXXXXXXXXXXXXXXXXXXXXXXXXXXXXXXXXXXIXXXXXXXXYXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXWXGXXXXXXG

SEQ ID NO: 68117 - protein, 43 aa, consensus
  MISC_FEATURE (1)..(43): consensus for the disclosure of xaa see table XV
XXXXXXXXXXXXXXXXXXXXXXXXXXXXXXXXWXXXXGSXXXX

SEQ ID NO: 68118 - protein, 37 aa, consensus
  MISC_FEATURE (1)..(37): consensus for the disclosure of xaa see table XV
GXXXNPXLXXXXXXXXHPXXXXXXXXXXXXXXXXXXX

SEQ ID NO: 68119 - protein, 51 aa, consensus
  MISC_FEATURE (1)..(51): consensus for the disclosure of xaa see table XV
XXXXXWXXLXXXXXXGXXWXYXXXGWGGXWXWDPVEXXXXXXWXXXXAXXH

SEQ ID NO: 68120 - protein, 19 aa, consensus
  MISC_FEATURE (1)..(19): consensus for the disclosure of xaa see table XV
XXXXXXXRSXXXXSXHXFX

SEQ ID NO: 68121 - DNA, 1539 bp, Escherichia coli
  CDS (1)..(1539)
atgcaacaacctgtagttcgcgttggcgaatggcttgttactccgtccataaaccaaattagccgcaatgggcgtcaacttacccttgagccgagattaatcgatcttctggttttctttgctcaacacagtggcgaagtacttagcagggatgaacttatcgataatgtctggaagagaagtattgtcaccaatcacgttgtgacgcagagtatctcagaactacgtaagtcattaaaagataatgatgaagatagtcctgtctatatcgctactgtaccaaagcgcggctataaattaatggtgccggttatctggtacagcgaagaagagggagaggaaataatgctatcttcgcctccccctataccagaggcggttcctgccacagattctccctcccacagtcttaacattcaaaacaccgcaacgccacctgaacaatccccagttaaaagcaaacgattcactaccttttgggtatggttttttttcctgttgtcgttaggtatctgtgtagcactggtagcgttttcaagtcttgatacacgtcttcctatgagcaaatcgcgtattttgctcaatccacgcgatattgacattaatatggtaaataaaagttgtaacagctggagttccccgtatcagctctcttacgcgataggcgtgggtgatttggtggcgacatcacttaacaccttctccacctttatggtgcatgacaaaatcaactacaacattgatgaaccgagcagttccggtaaaacattatctattgcgtttgttaatcagcgccaataccgtgctcaacaatgctttatgtcgataaaattggtagacaatgcagatggttcaaccatgctggataaacgttatgtcatcactaacggtaatcagctggcgattcaaaatgatttactggagagtttatcaaaagcgttaaaccaaccgtggccacaacgaatgcaggagacgctccagaaaattttgccgcatcgtggtgcgttattaactaatttttatcaggcacatgattatttactgcatggcgatgataaatcattgaaccgtgccagtgaattattaggtgagattgttcaatcatccccagaatttacctacgcgagagcagaaaaagcattagttgatatcgtgcgccattctcaacatcctttagatgaaaaacaattagcagcactgaacacagaaatagataacattgttacactgccggaattgaacaacctgtccattatatatcaaataaaagcggtcagtgctctggtaaaaggtaaaacagatgagtcttaccaggcgataaatactggcattgatcttgaaatgtcctggctaaattatgtgttgcttggcaaggtttatgaaatgaaggggatgaaccgggaagcagctgatgcatatctcaccgcctttaatttacgcccaggggcaaacaccctttactggattgaaaatggtatattccagacttctgttccttatgttgtaccttatctcgacaaatttcttgcttcagaataa

SEQ ID NO: 68122 - protein, 512 aa, Escherichia coli
MQQPVVRVGEWLVTPSINQISRNGRQLTLEPRLIDLLVFFAQHSGEVLSRDELIDNVWKRSIVTNHVVTQSISELRKSLKDNDEDSPVYIATVPKRGYKLMVPVIWYSEEEGEEIMLSSPPPIPEAVPATDSPSHSLNIQNTATPPEQSPVKSKRFTTFWVWFFFLLSLGICVALVAFSSLDTRLPMSKSRILLNPRDIDINMVNKSCNSWSSPYQLSYAIGVGDLVATSLNTFSTFMVHDKINYNIDEPSSSGKTLSIAFVNQRQYRAQQCFMSIKLVDNADGSTMLDKRYVITNGNQLAIQNDLLESLSKALNQPWPQRMQETLQKILPHRGALLTNFYQAHDYLLHGDDKSLNRASELLGEIVQSSPEFTYARAEKALVDIVRHSQHPLDEKQLAALNTEIDNIVTLPELNNLSIIYQIKAVSALVKGKTDESYQAINTGIDLEMSWLNYVLLGKVYEMKGMNREAADAYLTAFNLRPGANTLYWIENGIFQTSVPYVVPYLDKFLASE

SEQ ID NO: 68123 - DNA, 1626 bp, Vibrio fischeri ES114
  CDS (1)..(1626)
atggtcgggatctgttttcaaattaatgactggactctagttattgaggaaaataagttatatcgccaagatagggaagtgtcggttgaaccacgtttaattaatttacttcgctttttagcacagcattcaggtgaagtattttgtcgagatgagttaattaaacatgtatgggatggtgcgtttgttaccgatcaagtggtaacacaatcaatatttgaactgcgaaaagtattgcgtgatggtcgtttagataacactcgttatttagttacggtaccaaaacgtgggtataagttggttgcagaaaccaagcaaataagattagaagatacgccttattggaaaccttgcgatacatttacctcaacagaagctgatgaaaatcagaatcataatgttgaattgaacaccgaagagcaagaaaaagaacaagatgagactgcacaactctcttttccagcaggtccattaactcgtgctgtaactaatatttctaatcaagtatcaaacgaaaagaaaaagcagggtgagagttttagctttttacatcgttggaagctattagcgttcgacttttttctcgttggcgtattaattgcggttattttttcagttacttatcagcaaacaaccactcatataaccaaggctgttgatactgatttaattgaatttacctatcacgcaagccgtaactcgaataatgaaacagaatatttggctgatggcattagtcaaaaactgatggcagatttagccagtgttggccattaccgagttcagttaaataaaaccgcatttactaccggtattttgcctggaaaagcggtgaatgtacgagtagaagaacaacaaaataaaacgtatttagatgtagagtatcgcagtaatatttcaaatcgagtgctgtttagtcgtcaatatttaatgaccaatgccaatttagaacatgtgttgcgccaatcatctcaagatttaatgcgagcgttaggggttcaggcatccgaacaagatatgaatagattaatgcttggtttaccaaaggagcatggtttattagagatgttagttcgagctaatcacttcattaatcaaacggatcaaaaaaactttgaaaaagggatagatctgttagagaacattgcattagcagagccgaataatgattatgtgctttcagagttatacattgcttataacgcatattcagcgcttaaccctgaattagagttggacgaaaacaccgctaaaattgaaaagttaagtcaggatcttcaagctagatatgctttatcggatgtcggtgtattgccttctcgtatctatgaagcattagctatgatagcgattaagcaagataacaaagaagatgctagagcttatcttaacctagcatttaagaatagagagtcagcattctcttatatattagaagggaaacttgctgagttagatggcgacttagatcaagcaggggagtcatacagcaaggctttctttatggatacgtcacttgaaacttatatgcttgctgaaaatcttgcattttacagtgatttagaaaccgttgcttattttatgtatcgagccgttaatccaagtgaagttcgcttgatggggtaa

SEQ ID NO: 68124 - protein, 541 aa, Vibrio fischeri ES114
MVGICFQINDWTLVIEENKLYRQDREVSVEPRLINLLRFLAQHSGEVFCRDELIKHVWDGAFVTDQVVTQSIFELRKVLRDGRLDNTRYLVTVPKRGYKLVAETKQIRLEDTPYWKPCDTFTSTEADENQNHNVELNTEEQEKEQDETAQLSFPAGPLTRAVTNISNQVSNEKKKQGESFSFLHRWKLLAFDFFLVGVLIAVIFSVTYQQTTTHITKAVDTDLIEFTYHASRNSNNETEYLADGISQKLMADLASVGHYRVQLNKTAFTTGILPGKAVNVRVEEQQNKTYLDVEYRSNISNRVLFSRQYLMTNANLEHVLRQSSQDLMRALGVQASEQDMNRLMLGLPKEHGLLEMLVRANHFINQTDQKNFEKGIDLLENIALAEPNNDYVLSELYIAYNAYSALNPELELDENTAKIEKLSQDLQARYALSDVGVLPSRIYEALAMIAIKQDNKEDARAYLNLAFKNRESAFSYILEGKLAELDGDLDQAGESYSKAFFMDTSLETYMLAENLAFYSDLETVAYFMYRAVNPSEVRLMG

SEQ ID NO: 68125 - DNA, 1626 bp, Vibrio cholerae O1 biovar eltor str. N16961
  CDS (1)..(1626): transl_table=11
gtgtgtggtgctcgagcatattctgcctcttaccgatgctatcttcctgatacaaagagctattctatgattggaatctgttttcaaatcaatgactgggttctgtgcattgatgagaataagctgtatcgccaagatagggaggtctcggccgagccgcgtcttattaacttgctgcattttcttgcggagcatgccggagaggtattcggccgtgaggaactcattcaacatgtctgggacggggcgattgtcaccgaccaagtggtcactcaatccatttttgagttgcgtaagctattgcgcgatggacgcgaagaaaacctcagctatgtggtgacggtgcctaagcgtggctataagttagtcgcgaatgtgcagcgtctcgatggcaatccctatgtttctcgccaagaagagtcgacagccagtgatgtctgtttggcggacgatatcgacgacgtggaagacgccgttcccgagattgtatttcctgccggcccgttaacgcgcgccgtgtgccaaagtcagcaaccgaagaaatcaagcaagccgaatgtgagccgttggcgcttaaacctgctcaatgcgatctggattggcttagtgattgtagcgatgggcttttttactgtgcagcagtcgcaagtgcgcatcacccaagtggtggatacccatctgattgaatttaaattccaagacggttttcatgctcaggcgctcacgcatgagcttgccgatggtatcgcacaaaagctgatggccgatctgacccaagtgagtgattatcgggtcattctcggtaaaacggcttacagctcaggcattttgcccggtaagtcgatcatggtgcgagtcaatgaccaagatggccatgagtttttagatcttgagcttaagaacaactcttccgatgcggtgctgtttagtcgccaatatccgctcgatagccagcatctggcctctgtgctgaaaagtgccgagtgggatgtgatgcaagcgttgaaaatcccgaatgcagagcagcaagcacagcgtttattggtggattttccgcgtcaacccgcggcgttagggctgtatgtgcgcgccaatcattacttgaatgttgccgatcgtccgcagttccaaaaaggcatttacttattggagcaagtgctgaaattagagccggataaccattatgtccaagccgaattactgattgcgtaccatgtgcagcaagcgatcagcccagatcaggcgctcaatcaagatcggatgctggtgttgagtgagcagttgcagcaggtgagttactcccctcaagcggtggtgcagccacgcatttatgaagcgttagcactgcaagcaacagtcgaaaaccaagtggaaaccgccacgcactatttggcgcaagctcagggtttgcgggaatcggtgctttcatatgtgctgcaaggcaagcatgctgaactcaaaggcgatctggatggcgcaagcgatgcctacagtgaagcgttttatatggacacatcgctggaaacttatctgctgtgcgaaaacttggtgttccactctaacttaaaatccattgattacgccatgtaccgctcggtgcatccttcggtggttcgtttactgtaa

SEQ ID NO: 68126 - protein, 541 aa, Vibrio cholerae O1 biovar eltor str. N16961
MCGARAYSASYRCYLPDTKSYSMIGICFQINDWVLCIDENKLYRQDREVSAEPRLINLLHFLAEHAGEVFGREELIQHVWDGAIVTDQVVTQSIFELRKLLRDGREENLSYVVTVPKRGYKLVANVQRLDGNPYVSRQEESTASDVCLADDIDDVEDAVPEIVFPAGPLTRAVCQSQQPKKSSKPNVSRWRLNLLNAIWIGLVIVAMGFFTVQQSQVRITQVVDTHLIEFKFQDGFHAQALTHELADGIAQKLMADLTQVSDYRVILGKTAYSSGILPGKSIMVRVNDQDGHEFLDLELKNNSSDAVLFSRQYPLDSQHLASVLKSAEWDVMQALKIPNAEQQAQRLLVDFPRQPAALGLYVRANHYLNVADRPQFQKGIYLLEQVLKLEPDNHYVQAELLIAYHVQQAISPDQALNQDRMLVLSEQLQQVSYSPQAVVQPRIYEALALQATVENQVETATHYLAQAQGLRESVLSYVLQGKHAELKGDLDGASDAYSEAFYMDTSLETYLLCENLVFHSNLKSIDYAMYRSVHPSVVRLL

SEQ ID NO: 68127 - DNA, 1545 bp, Salmonella typhimurium LT2
  CDS (1)..(1545): transl_table=11
atgcagcaacctgttgtacgcattggagagtggctggttacaccttctgttaatcagatcagtcgtcagggacgccagattactcttgaaccacggctgatcgatcttctgatgtattttgcgcatcacccggatgaagtgttaagccgggataacattattgatcatgtctggatgcgcaccatcgtgaccaaccatgttgtcacccaaagcatttctgaactacgcaaatcattaagagatggcggagacagcaatgctgaatacatcgttaccgtacctaaacgcggctataagctgacggcgccggttatctggtgcgaagaaaatagcgatgagatcgataattcatcaacgtcgccgccgccgccgatcgcagcgacgaatgcagaaccgacggagggggttactgccgctacgcctgtgccgcccgcctctttgcaaacgccgactaaaaaggcgaaaaagccgcgtattgccgctttctggacgtgggtgatgttcctgctctcgctggcgacgctggtggtgtttatcgtgatgtcggtggtagatcataatgccgcggtaacaaaaacgcggttattacttaacccacgagatatagatgttcgttttgaaggcggcaattcctgtaataactgggtctcgcaggagtcctacgccatcggtctgggcggcttaatcaccgacctgctgaacacctactcgacttttatggtgcacgataaaaccaattaccgggtcaatgagccaagcagctccggtaagacgttaaccattcagtttgtcaatcagcgccactatcgggcgcagcagtgctttatgtctgtagtgctcattgataacgccgatggttcaaccatgctggataagcgttatttcgtcaccaatactaaccagttgtccatccaggatgatctgtttaatagcctgtctttcgttttaacacagccctggcctaatcgtatgcgagaacaactggccctgttcagaacgccgcaaaataccgcactgatgcgtttttatgaggcgcgccagcttattctgagcggcgatgcgcaggcgctaggtaaagccagcgatattctgaatggcattattaaggaaacgcctgatttcaactatgcctatgaatataaagtgctggtagatgtattacggcaatcacagcagccgtttgataaagaacaagtggccgcactgaacgaagagtttaaaaaaatagatcaaattccgggcgttgagaaaacgtctgtttattataaaatcaagaccgtcgatctgttaggcaaaggtgatatcgatgcagcgtatgaggaaatcaataaaagcatcgagcttgaaatgtcgtggtttaactatgtcctgttggggaaagtttacgaaatgaaaggtgagaatcgtctggccgctgatgcctatctgaccgcctttaatttacgtccaggtgaaaacactctgtactggatcgagaacggcgtatttcagacatccgttcagaaaattgtcccttatctgaatagttttctggcagaagattaa

SEQ ID NO: 68128 - protein, 514 aa, Salmonella typhimurium LT2
MQQPVVRIGEWLVTPSVNQISRQGRQITLEPRLIDLLMYFAHHPDEVLSRDNIIDHVWMRTIVTNHVVTQSISELRKSLRDGGDSNAEYIVTVPKRGYKLTAPVIWCEENSDEIDNSSTSPPPPIAATNAEPTEGVTAATPVPPASLQTPTKKAKKPRIAAFWTWVMFLLSLATLVVFIVMSVVDHNAAVTKTRLLLNPRDIDVRFEGGNSCNNWVSQESYAIGLGGLITDLLNTYSTFMVHDKTNYRVNEPSSSGKTLTIQFVNQRHYRAQQCFMSVVLIDNADGSTMLDKRYFVTNTNQLSIQDDLFNSLSFVLTQPWPNRMREQLALFRTPQNTALMRFYEARQLILSGDAQALGKASDILNGIIKETPDFNYAYEYKVLVDVLRQSQQPFDKEQVAALNEEFKKIDQIPGVEKTSVYYKIKTVDLLGKGDIDAAYEEINKSIELEMSWFNYVLLGKVYEMKGENRLAADAYLTAFNLRPGENTLYWIENGVFQTSVQKIVPYLNSFLAED

SEQ ID NO: 68129 - DNA, 1539 bp, Escherichia coli CFT073
  CDS (1)..(1539): transl_table=11
atgcaacaacctgtagttcgcgttggcgaatggcttgttactccgtccataaaccaaattagccgcaatgggcgtcaacttacccttgagccgagattaatcgatcttctggttttctttgctcaacacagtggcgaagtacttagcagggatgaacttatcgataatgtctggaagagaagtattgtcaccaatcacgttgtgacgcagagtatctcagaactacgtaagtcattaaaagataatgatgaagatagtcctgtctatatcgctactgtaccaaagcgcggctataaattaatggtgccggttatctggtacagcgaagaagagggagaggaaataatgctatcttcgcctccccctataccagaggcggttcctgccacagattctccctcccacagtcttaacattcaaaacaccacaacgccacctgaacaatccccagttaaaagcaaacgattcactaccttttgggtatggttttttttcctgttgtcgttaggtatctgtgtcgcactggtagcgttttcaagtcttgaaacacgtcttcctatgagtaaatcgcgcattttgctcaatccacgcgatattgacattaatatggttaataagagttgtaacagctggagttctccgtatcagctctcttacgcgataggcgtgggtgatttggtggcgacatcacttaacaccttctccacctttatggtgcatgacaaaatcaactacaacattgatgaaccgagcagttccggtaaaacattatctattgcgtttgttaatcagcgccaataccgtgctcaacaatgctttatttcggtaaaattggtagacaatgcagatggttcaaccatgctggataaacgttatgtcatcactaacggtaatcagctggcgattcaaaatgatttgctccagagtttatcaaaagcgttaaaccaaccgtggccacaacgaatgcaggagatgctccagcaaattttgccgcatcgtggtgcgttattaactaatttttatcaggcacatgattatttactgcatggtgatgataaatcattggatcgtgccagtgaattattaggtgagattgttcaatcatccccagaatttacctacgcgagagcagaaaaagcattagttgatatcgtgcgccattctcaacatcctttagacgaaaaacaattagcagcactgaacacagaaatagataacattgttacactgccggaattgaacaacctgtccattatatatcaaataaaagcggtcagtgccctggtaaaaggtaaaacagatgagtcttatcaggcgataaataccggcattgatcttgaaatgtcctggctaaattatgtgttgcttggcaaggtttatgaaatgaaggggatgaaccgggaagcagctgatgcatatctcaccgcctttaatttacgcccaggggcaaacaccctttactggattgaaaatggtatattccagacttctgttccttatgttgtaccttatctcgacaaatttctcgcttcagaataa

SEQ ID NO: 68130 - protein, 512 aa, Escherichia coli CFT073
MQQPVVRVGEWLVTPSINQISRNGRQLTLEPRLIDLLVFFAQHSGEVLSRDELIDNVWKRSIVTNHVVTQSISELRKSLKDNDEDSPVYIATVPKRGYKLMVPVIWYSEEEGEEIMLSSPPPIPEAVPATDSPSHSLNIQNTTTPPEQSPVKSKRFTTFWVWFFFLLSLGICVALVAFSSLETRLPMSKSRILLNPRDIDINMVNKSCNSWSSPYQLSYAIGVGDLVATSLNTFSTFMVHDKINYNIDEPSSSGKTLSIAFVNQRQYRAQQCFISVKLVDNADGSTMLDKRYVITNGNQLAIQNDLLQSLSKALNQPWPQRMQEMLQQILPHRGALLTNFYQAHDYLLHGDDKSLDRASELLGEIVQSSPEFTYARAEKALVDIVRHSQHPLDEKQLAALNTEIDNIVTLPELNNLSIIYQIKAVSALVKGKTDESYQAINTGIDLEMSWLNYVLLGKVYEMKGMNREAADAYLTAFNLRPGANTLYWIENGIFQTSVPYVVPYLDKFLASE

SEQ ID NO: 68131 - DNA, 1569 bp, Vibrio parahaemolyticus RIMD 2210633
  CDS (1)..(1569): transl_table=11
atggttggagtctattttcaaatcaatgactgggttttaagcgttgatgaaaataagctgtatcgacaagatagggaagttactgttgagccgcgcttaattaatcttttgcacttcttagctgagcatgcaaatgaggtgttcaatcgcgaggaattgatccagtacgtttgggctggggcgattgtgaccgatcaagtggtgactcagtccatttttgagttgcgtaaattgctgcgtgacggtcgggaagaaaataccagttacgtcattacagtaccgaaacgtggctacaagctggtggcgaacgtgactccgatgacgcatgaagagtttgtcgcaagtcgccaaagtgaagaggaagagaacgcgcctttggttgaagaaccagaagaagagactctgcctatcgcacctgccgttacttttcctgccggccctctgactcgtgcggtctgcgagatgtcgaaagagaaaaaggcccctcagaaaaaaaataaaatcagcccgtggcgcttgggactgatgaacttcatctggatcagtgttttggtcgtggtgatgggcgtgtttacctacaagcaatcggaagtgcgtattacccaagccatcgatactcaccttatcgaattcaagtttcaagataacttcacgagcgaagggttaagctatgacttggcagacgggtttgcccaaaagttgatgtctgacattgctcaagtcagtgattaccgagtcatgctaaagaaggcgtcgtttacttctggcattgtgcctggtaaatccgttgtggtacgagttcgtgagaatgacggtggcagctttttagaggtggaatatcgcaataactcatctgaaaaggtgttgtttagtcgtcaatacgcgttaaccagtagccatttaaagaccgtgcttcaacaagcatcgttggacttgatgcaagtgctgaaagtgccggatgccaaattaaaatctacgatgctggtggcgggaatgcccatgaatcccgatgccttggaattgtttgtgcaagctaaccattatcttaatgtctctgatgccaagcagtttcgtcaaggcatcgatttgatggaaaatattttagaaatcgagccagataatgcttatgttcaagctgaattgctgattgcttaccacgtgcagaaagtgctcgattcgtctctcgaactaaagaaagggcgagtgcaacaactcagcgatgcgctggaaaccaacgtgaaaatgatggttgggccaattcaacctcgaatttatgaagctttggccctacacgaaaccatcgctggtgacatggcgtcagccaagcagcatcttgggcaagcattgaggttacgtgattcggtgctgtcttatgtgattcgcggtaagcacgctgaattggatggtgatctggatttggccagtgagtcttacagcgaagctttctatattgatacgtcggttgagacgtacctgctgtgcgaaaacttggtcttcccaagtaatatgaaggcgattgattacgccatgtatcgcgctgttcacccttctgtcgttcgaatgctttaa

SEQ ID NO: 68132 - protein, 522 aa, Vibrio parahaemolyticus RIMD 2210633
MVGVYFQINDWVLSVDENKLYRQDREVTVEPRLINLLHFLAEHANEVFNREELIQYVWAGAIVTDQVVTQSIFELRKLLRDGREENTSYVITVPKRGYKLVANVTPMTHEEFVASRQSEEEENAPLVEEPEEETLPIAPAVTFPAGPLTRAVCEMSKEKKAPQKKNKISPWRLGLMNFIWISVLVVVMGVFTYKQSEVRITQAIDTHLIEFKFQDNFTSEGLSYDLADGFAQKLMSDIAQVSDYRVMLKKASFTSGIVPGKSVVVRVRENDGGSFLEVEYRNNSSEKVLFSRQYALTSSHLKTVLQQASLDLMQVLKVPDAKLKSTMLVAGMPMNPDALELFVQANHYLNVSDAKQFRQGIDLMENILEIEPDNAYVQAELLIAYHVQKVLDSSLELKKGRVQQLSDALETNVKMMVGPIQPRIYEALALHETIAGDMASAKQHLGQALRLRDSVLSYVIRGKHAELDGDLDLASESYSEAFYIDTSVETYLLCENLVFPSNMKAIDYAMYRAVHPSVVRML

SEQ ID NO: 68133 - DNA, 1581 bp, Vibrio vulnificus YJ016
  CDS (1)..(1581): transl_table=11
atgattggaatctattttcaaatcaatgactgggttttgtgcattgatgagaacaagctgtatcgacaagatagggaagtctccgtcgagccacgtctaataaatttactgcatttccttgctgaacacgttggagaggtgtttggtcgcgaggaactgatccagcacgtttgggatggggccattgtcaccgaccaagtggtgacgcaatccatttttgagctccgcaaattactgcgcgatgggcgagaagaaaatctcagctatgtggtgaccgtaccaaagcgcggttacaagctggtggccaatgttgagcgtttaacggccaatccttatttgttgcgtcaggcagaatctaccgaggttgagttgttggagccggcaatgaccgagccattgaacgcggtgccagaagccgaagcccccagcgcaaatgaaatggtttttccagcagggccgctcacacgcgccatgtgccaaagtcagcaacagaaaaaaccgaatcgacccaatatctctcgttggcgtgtaaatgcattcaacgcgctgtggattggtttggtgatcattgcgatgggcttttttactatcaaacaatcacaagtgcgcattacgcaagtcgtggatactcatctgattgaattcatgtttcaagatgactatcacgcccaagcgttaagccacgatctggccgatggtattgcacagaagctgatggccgacatcactcaagtgaccgactatcgcgtgatgttgagtaaaaccgcgtttacgtctggcattttgcccggtaaatcgatcatggttcgagtgagcgataaagaaggtcacgcctttattgaactggagttaaaaaacaactcctcgggcgcggtgttgtttagccgccaatacccgttggacgcctcgcatcttgcgtcggttttgcaccgagcggaagtcgacattatgcaggcgttacgtttgccaaacgcagagcaacaagcgcaaatcttgttggtggattttcctcagcagccagcagcgttggccttgtatgtgcgagcgaatcactacctcaatctctctgatcagcagcaggtacaaaaggggattgatttgcttgaacaggtgcttaacttagagccgaacaatcattacgttcaggcggagctcttgattgcttaccatgttcagcaagccttgtctgacatgccgacgctaaaccaagaacgcattttattgctgagcagcaaattgcaaagcgccagtgatgcgctggacgcagtggttcaacccagaatttacgaagcgttagcgctgcaagcgacggtggatgaagatctgccctcggctgagcgttatttggccaaagcgcagcaattgcgtgagtcggtgctctcttatgtactgcaagggaaacacgctgaattgcgtggtgatcttgatggcgccagtgatggttacagcgaagccttctatatggatacgtcactagaaacctatttgttgtgtgagaggctggtatttgaatcgaatctaaaatcgattgactacgccatgtatcgctcagtacatccttcggtggtgcgtttgatgtaa

SEQ ID NO: 68134 - protein, 526 aa, Vibrio vulnificus YJ016
MIGIYFQINDWVLCIDENKLYRQDREVSVEPRLINLLHFLAEHVGEVFGREELIQHVWDGAIVTDQVVTQSIFELRKLLRDGREENLSYVVTVPKRGYKLVANVERLTANPYLLRQAESTEVELLEPAMTEPLNAVPEAEAPSANEMVFPAGPLTRAMCQSQQQKKPNRPNISRWRVNAFNALWIGLVIIAMGFFTIKQSQVRITQVVDTHLIEFMFQDDYHAQALSHDLADGIAQKLMADITQVTDYRVMLSKTAFTSGILPGKSIMVRVSDKEGHAFIELELKNNSSGAVLFSRQYPLDASHLASVLHRAEVDIMQALRLPNAEQQAQILLVDFPQQPAALALYVRANHYLNLSDQQQVQKGIDLLEQVLNLEPNNHYVQAELLIAYHVQQALSDMPTLNQERILLLSSKLQSASDALDAVVQPRIYEALALQATVDEDLPSAERYLAKAQQLRESVLSYVLQGKHAELRGDLDGASDGYSEAFYMDTSLETYLLCERLVFESNLKSIDYAMYRSVHPSVVRLM

SEQ ID NO: 68135 - DNA, 1581 bp, Vibrio vulnificus
  CDS (1)..(1581): transl_table=11
atgattggaatctattttcaaatcaatgactgggttttgtgcattgatgagaacaagctgtatcgacaagatagggaagtctccgtcgagccacgtctaataaatttactgcatttccttgctgaacacgttggagaggtgtttggtcgcgaggaactgatccagcacgtttgggatggggccattgtcaccgaccaagtggtgacgcaatccatttttgagctccgcaaattactgcgcgatgggcgagaagaaaatctcagctatgtggtgaccgtaccaaaacgcggttacaagctggtggccaatgttgagcgtttaacggccaatccttatttgttgcgtcaggcagaatctaccgaggttgagttgttggagccggcaatgaccgagccattgaacgcggtgccagaagccgaagcccccagcgcaaatgaaatggtttttccagcagggccgctcacacgcgccatgtgccaaagtcagcaacagaaaaaaccgaatcgacccaatatctctcgttggcgtgtaaatgcattcaacgcgctgtggattggtttggtgatcattgcgatgggcttttttaccatcaaacaatcacaagtgcgcattacgcaagtcgtggatactcatctgattgaattcatgtttcaagatgactatcacgcccaagcgttaagccacgatctggccgatggcattgcacagaagctgatggccgacatcactcaagtgaccgactatcgcgtgatgttgagtaaaaccgcgtttacgtctggcattttgcccggtaaatcgatcatggttcgagtgagcgataaagaaggtcacgcctttattgaactggagttaaaaaacaactcctcgggcgcggtgttgtttagccgccaataccctttggacacctcgcatcttgcgtcggttttgcaccgagcggaagtcgacattatgcaggcgttacgtttgccaaacgcagagcaacaagcgcaaatcttgttggtggattttcctcagcagccagcggcgttggccttgtatgtgcgagcgaatcactacctcaatctctctgatcaacagcaggtacaaaaggggattgatttgcttgaacaggtgcttaacttagagccgaacaatcattacgttcaggcggagctcttgattgcttaccatgttcagcaagccttgtctgacatgccgacgttaaaccaagaacgcattttattgctgagcagcaaattgcaaagcgccagtgaagcactggacgcagtggttcaacccagaatttacgaagcgttagcgctgcaagcgacggtggatgaagatctgccctcggctgagcggtatttagccaaagcgcagcaattgcgtgagtcggtgctctcttatgtactgcaaggaaaacacgctgaattgcgtggtgatcttgatggtgccagtgatggttacagcgaagctttttatatggacacatcactagaaacctatttgttgtgtgagaggctggtatttcaatcgaatctaaaatcgattgactacgccatgtatcgctcagtgcatccttcggtggtgcgtttgatgtag

SEQ ID NO: 68136 - protein, 526 aa, Vibrio vulnificus
MIGIYFQINDWVLCIDENKLYRQDREVSVEPRLINLLHFLAEHVGEVFGREELIQHVWDGAIVTDQVVTQSIFELRKLLRDGREENLSYVVTVPKRGYKLVANVERLTANPYLLRQAESTEVELLEPAMTEPLNAVPEAEAPSANEMVFPAGPLTRAMCQSQQQKKPNRPNISRWRVNAFNALWIGLVIIAMGFFTIKQSQVRITQVVDTHLIEFMFQDDYHAQALSHDLADGIAQKLMADITQVTDYRVMLSKTAFTSGILPGKSIMVRVSDKEGHAFIELELKNNSSGAVLFSRQYPLDTSHLASVLHRAEVDIMQALRLPNAEQQAQILLVDFPQQPAALALYVRANHYLNLSDQQQVQKGIDLLEQVLNLEPNNHYVQAELLIAYHVQQALSDMPTLNQERILLLSSKLQSASEALDAVVQPRIYEALALQATVDEDLPSAERYLAKAQQLRESVLSYVLQGKHAELRGDLDGASDGYSEAFYMDTSLETYLLCERLVFQSNLKSIDYAMYRSVHPSVVRLM

SEQ ID NO: 68137 - DNA, 1539 bp, Salmonella typhimurium
  CDS (1)..(1539): transl_table=11
atgcagcaacctgttgtacgcattggagactggctggttacaccttctgttaatcagatcagtcgtcggggacgccagattactcttgaaccacggctgatcgatcttctgatgtatttcgcgcatcacccggatgaagtgttaagccgggataacattattgatcatgtctggatgcgcaccatcgtgaccaaccatgttgtcgccaaagcaatttctgaactacgcaaatcattaaggagatcggcagacagtaatgctgaatacatcgttaccgtacctaaacgcggatataagctgacggcgccggttatctggtgcgaagaaaatggcgatgagatcgataattcatcaacgtcgccgccgccaccgatcgcagcgaacaaatgcaaaccgacggagggggttactgccgctacgcctgtgccgcccgcctctttgcaaacgccgactaaaaaggcaaaaaagccgcgtattgccgctttctggacttgggtgatgtccctgctctcgctggcaacgctggtggtgtttatcgtgatttcggtggtaaatcataatgccgcggtaacaaaaacgcggttattacttaacccacaaaatataaattttcgttttgaaggcggcaatccctgtaataactgggtctcgcaggattcctacgccatcggtctgggcggcttaatcaccgacctgctgaacacctactcgacttttatggtgcacgataaaaccaattaccgggtcaatgacccaagcagctccggtaagacgttaaccattcagtttgtcaatcagcgccactatcgggcgcagcagtgctttatgtctgtagtgctcattgataacgccgatggttcaaccatgctggataagcgttatttcgtcaccaatactaaccagttgtccatccaggatgatctgtgtaatagcctgtctttcgttttaacacagccctggcctaatcgtatgcgagaacaactggccctgttcagaacgccgcaaaataccgcactgatgcgtttttatagaggcgcgcagcttattctgagcggcgatgcgcaggcgctaggtaaagccacggatattctgaatggcattattaaggaaacgcctgatttcaactatgcctatgaatataaagtgctggtaaatgtattacggcaatcacagcagccgtttgataaagaacaagtggccgcactgaacgaaaagtttaaaaaaatagatcaaattccgggcgttgagaaaacgtctgtttattataaaatcaagaccgtccatctgttaggcaaaggtgatatccatgcagcgtatgaggaaatcaataaaagcatccagcttgaaatgtcgtgggttaatactcctgttggggaacgtttacgaaatgaagtgagatcgtctgccgctgatgcatatctgaccgcctttaatttacgtccaggtcaaaacactctgtactggatcgagaacggcgtatttcagacatccgttcagaaaattgtcccttatctgaatagttttctggcagaagattaa

SEQ ID NO: 68138 - protein, 512 aa, Salmonella typhimurium
MQQPVVRIGDWLVTPSVNQISRRGRQITLEPRLIDLLMYFAHHPDEVLSRDNIIDHVWMRTIVTNHVVAKAISELRKSLRRSADSNAEYIVTVPKRGYKLTAPVIWCEENGDEIDNSSTSPPPPIAANKCKPTEGVTAATPVPPASLQTPTKKAKKPRIAAFWTWVMSLLSLATLVVFIVISVVNHNAAVTKTRLLLNPQNINFRFEGGNPCNNWVSQDSYAIGLGGLITDLLNTYSTFMVHDKTNYRVNDPSSSGKTLTIQFVNQRHYRAQQCFMSVVLIDNADGSTMLDKRYFVTNTNQLSIQDDLCNSLSFVLTQPWPNRMREQLALFRTPQNTALMRFYRGAQLILSGDAQALGKATDILNGIIKETPDFNYAYEYKVLVNVLRQSQQPFDKEQVAALNEKFKKIDQIPGVEKTSVYYKIKTVHLLGKGDIHAAYEEINKSIQLEMSWVNTPVGERLRNEVRSSAADAYLTAFNLRPGQNTLYWIENGVFQTSVQKIVPYLNSFLAED

SEQ ID NO: 68139 - DNA, 23 bp, Primer
atgcaacaacctgtagttcgcgt

SEQ ID NO: 68140 - DNA, 26 bp, Primer
ttattctgaagcaagaaatttgtcga

SEQ ID NO: 68141 - protein, 525 aa, consensus
  MISC_FEATURE (1)..(525): consensus for the disclosure of xaa see table XV
MXXXXXXXXXWXXXXXXNXXXRXXRXXXXEPRLIXLLXXXAXHXXEVXXRXXXIXXVWXXXIVTXXVVTQSIXELRKXLXDXXXXXXXYXXTVPKRGYKLXXXVXXXXXXXXXXXXXXXXXXXXXXEXXXXXXXXXXXXXXXXXXXXXXXXXXXXXXXXXXXXXXXXXXXXXXXXXXXXXXXXXXWXXXXXXXXXXXXXXXXXXXXXXXXXXXXXXXXXXXXXDXXXXXXXXXXXXXXXXXXXXXXXXXXXXXXXLXXXXXXXVXDXXXXXXXXXXXSGXXXXXXXXXXXXXXXXXXFXXXXXXXNXXXXXXXXXXYXXXXXXXXXXXXXXXXXXXXXLXXPXXXXXXXXLXXXXXXXXXXLXXXXXAXXXXXXXDXXXXXXXXXXLXXXXXXXPXXXYXXXXXXXXXXVXXXXXXXXXXXXXXXXXXXLXXXXXXXXXXXXXXXXXXXXYXXXXXXXXXXXXXXXXXXXXXXXXXLXXSXXXYXXXGKXXEXXGXXXXAXXXYXXAFXXXXXXXTXXXXEXXXF

SEQ ID NO: 68142 - protein, 100 aa, consensus
  MISC_FEATURE (1)..(100): consensus for the disclosure of xaa see table XV
MXXXXXXXXXWXXXXXXNXXXRXXRXXXXEPRLIXLLXXXAXHXXEVXXRXXXIXXVWXXXXVTXXVVXXXIXELRKXLXXXXXXXXXYXXTVPKRGYKL

SEQ ID NO: 68143 - protein, 81 aa, consensus
  MISC_FEATURE (1)..(81): consensus for the disclosure of xaa see table XV
XXXXXXXXLXXXXXXXVXXXXXXXXXXXXXXGXXXXXXXXXXXXXXXXXXXXXXXXXXNXXXXXXXXXXYXXXXXXXXXXX

SEQ ID NO: 68144 - protein, 56 aa, consensus
  MISC_FEATURE (1)..(56): consensus for the disclosure of xaa see table XV
LXXXXXXXXXXLXXXXXXXXXXXXXDXXXXXXXXXXXXXXXXXXPXXXYXXXXXXX

SEQ ID NO: 68145 - protein, 111 aa, consensus
  MISC_FEATURE (1)..(111): consensus for the disclosure of xaa see table XV
LXXXXXXXXXXXXXXXXXXXXYXXXXXXXXXXXXXXXXXXXXXXXXXXXXSXXXXXXXXXXXXXXXXXXXAXXXYXXAFXXXXXXXTXXXXEXXXFXXXXXXXXXXXXXXX

SEQ ID NO: 68146 - DNA, 1398 bp, Escherichia coli
  CDS (1)..(1398)
atgaggaaggcatatcttatggaatctattcaaccctggattgaaaaatttattaagcaagcacagcaacaacgttcgcaatccactaaagattatccaacgtcttaccgtaacctgcgagtaaaattgagtttcggttatggtaattttacgtctattccctggtttgcatttcttggagaaggtcaggaagcttctaacggtatatatcccgttattctctattataaagattttgatgagttggttttggcttatggtataagcgacacgaatgaaccacatgcccaatggcagttctcttcagacatacctaaaacaatcgcagagtattttcaggcaacttcgggtgtatatcctaaaaaatacggacagtcctattacgcctgttcccaaaaagtctcacagggtattgattacacccgatttgcctctatgctggacaacataatcaacgactataaattaatatttaattctggcaagagtgttattccacctatgtcaaaaactgaatcatactgtctggaagatgcgttaaatgatttgtttatccctgaaaccacaatagagacgatactcaaacgattaaccatcaaaaaaaatattatcctccaggggccgcccggcgttggaaaaacctttgttgcacgccgtctggcttacttgctgacaggagaaaaggctccgcaacgcgtcaatatggttcagttccatcaatcttatagctatgaggattttatacagggctatcgtccgaatggcgtcggcttccgacgtaaagacggcatattttacaatttttgtcagcaagctaaagagcagccagagaaaaagtatatttttattatagatgaaatcaatcgtgccaatctcagtaaagtatttggcgaagtgatgatgttaatggaacatgataaacgaggtgaaaactggtctgttcccctaacctactccgaaaacgatgaagaacgattctatgtcccggagaatgtttatatcatcggtttaatgaatactgccgatcgctctctggccgttgttgactatgccctacgcagacgattttctttcatagatattgagccaggttttgatacaccacagttccggaattttttactgaataaaaaagcagaaccttcatttgttgagtctttatgccaaaaaatgaacgagttgaaccaggaaatcagcaaagaggccactatccttgggaaaggattccgcattgggcatagttacttctgctgtgggttggaagatggcacctctccggatacgcaatggcttaatgaaattgtgatgacggatatcgcccctttactcgaagaatatttctttgatgacccctataaacaacagaaatggaccaacaaattattaggggactcatag

SEQ ID NO: 68147 - protein, 465 aa, Escherichia coli
MRKAYLMESIQPWIEKFIKQAQQQRSQSTKDYPTSYRNLRVKLSFGYGNFTSIPWFAFLGEGQEASNGIYPVILYYKDFDELVLAYGISDTNEPHAQWQFSSDIPKTIAEYFQATSGVYPKKYGQSYYACSQKVSQGIDYTRFASMLDNIINDYKLIFNSGKSVIPPMSKTESYCLEDALNDLFIPETTIETILKRLTIKKNIILQGPPGVGKTFVARRLAYLLTGEKAPQRVNMVQFHQSYSYEDFIQGYRPNGVGFRRKDGIFYNFCQQAKEQPEKKYIFIIDEINRANLSKVFGEVMMLMEHDKRGENWSVPLTYSENDEERFYVPENVYIIGLMNTADRSLAVVDYALRRRFSFIDIEPGFDTPQFRNFLLNKKAEPSFVESLCQKMNELNQEISKEATILGKGFRIGHSYFCCGLEDGTSPDTQWLNEIVMTDIAPLLEEYFFDDPYKQQKWTNKLLGDS

SEQ ID NO: 68148 - DNA, 2103 bp, Thermococcus kodakaraensis
  CDS (1)..(2103)
atgggcagatttgagatttccgaaaacgctctggaaaaaatagctgaaagcctcagggaagaatacgagggcagcaacgttgattacgttatagaggacatgagaatttcagagaacggggaatacctctcggtactcataagggacgactacgactccaggtttctccacatctttgatacgaaggggaacccgcttctggggtggaagagtggggttgggattccctgccaggaggacgttgtcgtttttccgggcgttgaaaacgtggctgtatttatgaagtgcggtactggggaaatagcactctatccgtttcaggatgaaaacccaaaagagcacgccctaagggtaactttctcaaggcttcccatctacgtgagcctgaccaacatggagagggtggttatttttggcgacatgagactcgacttcagtgcccccgccgaccttgagacagtcttcatacctcgccttcagggaggctacgcctttttccatgccatccatgacaccgacgatgaaatctacatactccacaccttcaaagagcccgggatgaaaaaccccaccctcaggatagggaggataaactatccgcctcacccatattattcgccgattgaattctgggacggagtagagacgatttcggcccattccccagcgcccccgacaaaaggcgcaataggggacatcgtactgagggacaacgagccaatagcggtcctcgggacgaagctcgggaaggagctctacatcctcacatccaagaaagcgcggataattcccctgccgggagagctcgtgttcacgaagttcaccgaaaagggccttttcctgcttataggccagttcaggggctatctgtacgggggctttgtcacgtacgaagacctccttcaaaagggctctctaaaactggatgacattgtggacagaacagtcttcggcaggtacaacccagaagcctttgacccaaagttctcgggaatatctaggagcggagacgttctcgttctgggcaaatcctctggaaaagtaagcgccagcggcaggttctactattacgttcgcccggattcgaactatctatactcttacgtctccacgcaggccgcccctggggagggggacattacttacgaccagttcacccagctcgaagaggttctcagaaggttcggcggcgtaatcctctacggaccccctggaaccggaaaaacgaagcttgccctggatctctcaagagatgccgataaggttgaggtcgttacgttccaccagtcgtacagctatgaggacttcgttgaaggttttaggcccgttgaaaaggagggcaaactgctctatgtcgttgaggacggcattttaaagaggcttgcagtcgaggcgattttccgcggcctccacccggacgagggagaggccgattacaagaagaaaaaggaagccgtccttgaataccttcaaacaggaaaaggcgagttcaaaccccgcgggaagttctacctaataatagatgagataaacagaggaaacatctcaaggatcctcggtgaggtcataaccctactcgatcccgataaaaggctcggaatggagtacgagacaaaaataaccctgccgtattccagagagcccttcgcccttccccccaacctctacataatcgggacaatgaactccacggacaggagcatagctttccttgacatggccctcaggaggcgctttgcgttccttgagatactgccccgccctgaggagctcggggatatcgaagtcggcggtgtaaaccttcagcacctcctctcgacgctcaacagggttatcgaggaagagcgcgggaaggactacacgataggccacggctacttcagggaggtcataaaggctaagccggaggagagggcaaaggcactcaaggacgtcttctactacaagatactccctcttctccaggaatacttctacggcaactgggaggcaataaggcgctccctgccggggttcgggttcatagacgagaaagggcgtataatcgagatggacgacgacgagttcattgaagccctccgcaagctggtgacagagaaatga

SEQ ID NO: 68149 - protein, 700 aa, Thermococcus kodakaraensis
MGRFEISENALEKIAESLREEYEGSNVDYVIEDMRISENGEYLSVLIRDDYDSRFLHIFDTKGNPLLGWKSGVGIPCQEDVVVFPGVENVAVFMKCGTGEIALYPFQDENPKEHALRVTFSRLPIYVSLTNMERVVIFGDMRLDFSAPADLETVFIPRLQGGYAFFHAIHDTDDEIYILHTFKEPGMKNPTLRIGRINYPPHPYYSPIEFWDGVETISAHSPAPPTKGAIGDIVLRDNEPIAVLGTKLGKELYILTSKKARIIPLPGELVFTKFTEKGLFLLIGQFRGYLYGGFVTYEDLLQKGSLKLDDIVDRTVFGRYNPEAFDPKFSGISRSGDVLVLGKSSGKVSASGRFYYYVRPDSNYLYSYVSTQAAPGEGDITYDQFTQLEEVLRRFGGVILYGPPGTGKTKLALDLSRDADKVEVVTFHQSYSYEDFVEGFRPVEKEGKLLYVVEDGILKRLAVEAIFRGLHPDEGEADYKKKKEAVLEYLQTGKGEFKPRGKFYLIIDEINRGNISRILGEVITLLDPDKRLGMEYETKITLPYSREPFALPPNLYIIGTMNSTDRSIAFLDMALRRRFAFLEILPRPEELGDIEVGGVNLQHLLSTLNRVIEEERGKDYTIGHGYFREVIKAKPEERAKALKDVFYYKILPLLQEYFYGNWEAIRRSLPGFGFIDEKGRIIEMDDDEFIEALRKLVTEK

SEQ ID NO: 68150 - DNA, 2487 bp, Thermococcus kodakaraensis
  CDS (1)..(2487)
atgaatcaatcagttataatagatggaaaaagatatggcgttgaagggcacataaaaaatattgtaatttcaccagattcgcgatatttattagtagaggaaggagaacatgaaactttttctaagttgcacttatacgagatacacgataatgggattaaaagagtctttgaccctatactaaaaaacgaaaagggggtattttattcttttgtagggggaggtaaatttatagtctcatatattccatccaacagatttttcatctatgatttcattgacaaagactacaatgagctgtattttaccaatatgggcaaaatattctttaggccaacagtcccagatcacaaaattgtcgtcatatatgccccaagtggtgcattattccctcatagaaataggaaatatgtgaatttaatccaagaaataaatttcaatcaatatatcggtgagtacaagtactatttggaaaaagtcccaaataccattgtctcactacgagatggaagcttttatctacctgtgatagtaaaaacccaagatactggaaaaaaacaacttatgattctaagatctacccaaaataaacaacaacctcttcggataattgatatcaatgatcacgatatagatttcaaagactgggacattcagtattatcacgagaatgacaacgaactgataattggagctgttaatttatcttttaagaacacacttcttgtatatattatcaatcttgttggagaacctaaagtatcatcttttgatattgagtatcaagggaaaattaagtatgtaaaaatgacaaataaaaatctgtatttagtctatgttgactcccaagacgaaaaatatttgctacaaattccaaataaggaactagtagattatattagacattctaaaacatcaattacattagatacgagattagaaaaatacataaaagcgtccttaaaagaatacaatattacaatccctgatgatgagaaactttcaattttatggagctggaatacgcctaaaataataatcactccaatttctgaacttttaagtgctccagtagattatatagaaaattatcaaatagtagagaacagtgaattcacaaactattctagcaccaatcaaaccaatcaaaacagtagtagttcttataaacatgacataagtaataaaaatagtaacggtggatattgcaacgaggataagataagcactatccaagttcttttagatgaatacaagcaagttatcttatatggaccaccaggaacaggaaaaacatttatggcccgaatgtttttgagatgtattaatgtacccaatacacactactcttttgttacattccataagtcatatagctacgaggattttgtcgaagggtatcgcccactcactcgcgaaggtaaaatagaatatgctgtaaaagatggcatattcaaaaaactcgcaattaaagctatttatgaactcatgtcagacactatcaaagaacaattattacccaactatgaaacacaaatagaaaatcatgctaaaaagattgcttgggaacgcctaatttcagacttgaaagctaatcgtataatccggaatgatattcgggttgacgacaaaggaagaatgtatgttgctgaatataccatatatgatggggacgatctaataacaaaagcagagaagcttagagagcttcttggtgatttagaatcaattttcatgacatataaagaagaagctgaatatgagggcgttaagttcctcgttcagagatttcttggaattctagattcaaaaatttcaaatggtgctcttagcacagaggacatcaataacttattcactaacaaccccaagaaattttatttggttatagacgaaattaatagagcagatgttagtcatgtttttggtgagttgataactcttcttgaaaaagataagagaattagcgaggacaacaaaaatcccataatagtccaactgccctactccagagagctttttgcagtacccagcaatctctacataatcggaaccatgaattccgcggataggggaatatccctattagatgtagcactaagacggagatttgcatttttggaagtacaaccagactataatgtgctggaagaattaaatctctatgggataagaatcgacaagttgctcaaagcaataaatgacaggataattcactcaaaaggcagcaaagactatcaaatagggcactcttatttccttgaacttaaagaagcgttatcaaatggaaatgaggatgatgccctgcaaaaactcatacgtatatggtataacaggatacttccattacttcaagactattattactcaagatgggatgaactagatatgcctgaatttatagatggcacagggcaaataaatttcgaactaatgaaatctccagagaggttcattgaagctctgagaggtatattgggagaataa

SEQ ID NO: 68151 - protein, 828 aa, Thermococcus kodakaraensis
MNQSVIIDGKRYGVEGHIKNIVISPDSRYLLVEEGEHETFSKLHLYEIHDNGIKRVFDPILKNEKGVFYSFVGGGKFIVSYIPSNRFFIYDFIDKDYNELYFTNMGKIFFRPTVPDHKIVVIYAPSGALFPHRNRKYVNLIQEINFNQYIGEYKYYLEKVPNTIVSLRDGSFYLPVIVKTQDTGKKQLMILRSTQNKQQPLRIIDINDHDIDFKDWDIQYYHENDNELIIGAVNLSFKNTLLVYIINLVGEPKVSSFDIEYQGKIKYVKMTNKNLYLVYVDSQDEKYLLQIPNKELVDYIRHSKTSITLDTRLEKYIKASLKEYNITIPDDEKLSILWSWNTPKIIITPISELLSAPVDYIENYQIVENSEFTNYSSTNQTNQNSSSSYKHDISNKNSNGGYCNEDKISTIQVLLDEYKQVILYGPPGTGKTFMARMFLRCINVPNTHYSFVTFHKSYSYEDFVEGYRPLTREGKIEYAVKDGIFKKLAIKAIYELMSDTIKEQLLPNYETQIENHAKKIAWERLISDLKANRIIRNDIRVDDKGRMYVAEYTIYDGDDLITKAEKLRELLGDLESIFMTYKEEAEYEGVKFLVQRFLGILDSKISNGALSTEDINNLFTNNPKKFYLVIDEINRADVSHVFGELITLLEKDKRISEDNKNPIIVQLPYSRELFAVPSNLYIIGTMNSADRGISLLDVALRRRFAFLEVQPDYNVLEELNLYGIRIDKLLKAINDRIIHSKGSKDYQIGHSYFLELKEALSNGNEDDALQKLIRIWYNRILPLLQDYYYSRWDELDMPEFIDGTGQINFELMKSPERFIEALRGILGE

SEQ ID NO: 68152 - DNA, 2910 bp, Deinococcus radiodurans R1
  CDS (1)..(2910): transl_table=11
atgagcgacgctgccatttcgtgttcttggaagccttttttccgcgagttggcgacccggcttctggactatgaagaccgccagcctgaactgcttgctgcgctgcgtgacgcgagcatcagcatcaaccatgacgaaggggagcccctgcgtgaagtagacccattcacgttcttctctttggtcctcaagcacacctcagacgccacagctttgccgctgtttgccagggttggggccgctctgggggttcaggctccttctcctacagacctgataggcgtgccgtggagcaaccccatgaatgcctggttttttgcttatcgcagtcagcgtcaaccgggggacgtaccgctcctctggcgactggcgcggcaggcagtggccggtattctggacgctcagacctttgaggacgccctgaagattcgcaaggtggcgctgcccaagctgacccagggtcttttctggctcaaccccgagcgattcctggccctcaatgctgtcaatgtgccttatctgcaggcgcgtggtcttcaggcggctggtcaggttcagactcttgcagagtatgagaccgttctggaggcggctcacaagctcaaccctgactttgcggctttgtcgcaccgggcgtggctcaacagccagacggcggctctggaaggcaatcatttcccgtttgcccggtatcaagccgacgcgcaggaatttgcgggggacaaagtcaagggcaacctcgtgcttgaccgccgttacgcgccactgctgctggacttgatggccggcgagtgggagacgctgaagccctcacgctcgccctacagcggtcgggagcaactcgccgtcaaagtggcgctgggcggcggcgtcaagaccgatggcggcgcctttgcgcgggcgctgctgttcgccgacgacagtgggttcgagtacgtgcctttctcagcggggctgaccctggaagccgggctgcctgatggccggggagacgggccccggcaggcgctgcaggagcccgctcgccagcacaccctgctgacggcgctcaatgcccctttgccggctggcctggaagcgaccctcaccctgaatacagattttggggccctgtttttgttgccgctgggacccgggcgagaagccgaggccgcgcagcagcttcagcagtacatgtcgggcgtgggccgcagtcgccgcttgcgcgtgggcctgagcctgcttcccgagcacctcgaatccgacaagttccccgagctgctggacgcggccctgacataccttgacgcccttgtggacctgctcgacggcctgatgcgtcccagcgaggagacatcgactgaggaaattggggttcccggcacccggcctgtcgccccgacaccagcggccttcgttccagtgccgggcgtgccgctcaaccagattctttatggccctcccggcaccggcaagacctaccgcgtggtggacgaggcgctctcggtccttgacccggctttcttatctgctcaccccggcagcgagggccgcgcggcccgtaaagcccgctacgacgagctggccgcgcaaggtcagatctccttcgtgaccttccaccagtctttcggttacgaagacttcattgagggcatcaagccggtgatgtccggcggggccctctcttacgtgctgcaagacggcgtgtttctggaagcggtgcggtctgccggtggtgccctcgcgccggcggcaccggaagctggtccctcgactgaaacacagccgctggtgcgcccggacgcgcaggtctggcgaatgtacattgacggcacagcgccggtcagccgcatccgtgacctgagtctgggccgtggcgagctgaggatgggcagttacgggaagccgccgcgcgatttgacccaagcgggcgttgaggacctcagcgggcgacagcttctttttaaggagagcgttcgtgtaggggaccttatgctgctcgccactgccgccgaccgcatcggggcggtgggcgtggtgactggcgactaccgctttgacccgcacagtgacccgacgtttgccaccgattacgcccacacccgctctgtgaagtggttggcccaagacctgaatgtcggcgccaccgagacgcttggaaaatcgttcgcccccccgaccctgcagcgggtggccgatgtgaccccggcacaagtgcttcaggccctcggtgtgtctacggcaggcggagagaccgctcatgcgcccacgccgcgcccgcacgtcctgatcatcgacgagatcaaccgcggcaacatctccaagatttttggggaactgatcaccctgctcgaaagcggcaagcggaccggggcgccggaagccctgaccgtcaccctgcccctgagccgccgccccctcagcgtgccgcagagcctttacgtcatcggcaccatgaacaccgccgaccgcagcctgaccctgcttgacgccgcgctgcgccgacgcttcgtcttccggcccgtgtggccccagcccgaggttctgccggtgctcgaccttggcggcacggccctggacctgcgcaagttcctgcacgtcatcaacgaccgcatcgagcgccttctcagccgcgagcaggtcattggacacgcctacttgctggggctgcccgccacgctgggcggcgtatccagtgctctacgcgagcgcattttgccgctgctggaagagtatttctttgaggactggagcaagatccgtgaggttctcggcgatgagagcaaggcggaagcgctgcagttcattcaccgcagcggctcagggcccgagctgcgttaccgcctgaatcctgaggccttcgagaacattgaagccttcaccggagtttatgcgggcgtcagcgatcaagatttcccgtttgacgcctga

SEQ ID NO: 68153 - protein, 969 aa, Deinococcus radiodurans R1
MSDAAISCSWKPFFRELATRLLDYEDRQPELLAALRDASISINHDEGEPLREVDPFTFFSLVLKHTSDATALPLFARVGAALGVQAPSPTDLIGVPWSNPMNAWFFAYRSQRQPGDVPLLWRLARQAVAGILDAQTFEDALKIRKVALPKLTQGLFWLNPERFLALNAVNVPYLQARGLQAAGQVQTLAEYETVLEAAHKLNPDFAALSHRAWLNSQTAALEGNHFPFARYQADAQEFAGDKVKGNLVLDRRYAPLLLDLMAGEWETLKPSRSPYSGREQLAVKVALGGGVKTDGGAFARALLFADDSGFEYVPFSAGLTLEAGLPDGRGDGPRQALQEPARQHTLLTALNAPLPAGLEATLTLNTDFGALFLLPLGPGREAEAAQQLQQYMSGVGRSRRLRVGLSLLPEHLESDKFPELLDAALTYLDALVDLLDGLMRPSEETSTEEIGVPGTRPVAPTPAAFVPVPGVPLNQILYGPPGTGKTYRVVDEALSVLDPAFLSAHPGSEGRAARKARYDELAAQGQISFVTFHQSFGYEDFIEGIKPVMSGGALSYVLQDGVFLEAVRSAGGALAPAAPEAGPSTETQPLVRPDAQVWRMYIDGTAPVSRIRDLSLGRGELRMGSYGKPPRDLTQAGVEDLSGRQLLFKESVRVGDLMLLATAADRIGAVGVVTGDYRFDPHSDPTFATDYAHTRSVKWLAQDLNVGATETLGKSFAPPTLQRVADVTPAQVLQALGVSTAGGETAHAPTPRPHVLIIDEINRGNISKIFGELITLLESGKRTGAPEALTVTLPLSRRPLSVPQSLYVIGTMNTADRSLTLLDAALRRRFVFRPVWPQPEVLPVLDLGGTALDLRKFLHVINDRIERLLSREQVIGHAYLLGLPATLGGVSSALRERILPLLEEYFFEDWSKIREVLGDESKAEALQFIHRSGSGPELRYRLNPEAFENIEAFTGVYAGVSDQDFPFDA

SEQ ID NO: 68154 - DNA, 1347 bp, Helicobacter pylori J99
  CDS (1)..(1347): transl_table=11
atgaaagtttatttaaggaaaattgataatcaaatattacataataaacgaatcagtattaaaaaaggtattttagagcatttttttgataaagccaacaaccaagatgaagtagatatgagtggtatcttatccaactataacgataaagttagcatcctcttagcaacagaccctagacttggtggaggcattaagagaatcatcagtgcagaagttgataaaataaaagaaaaccgattggattatgagttaaaaattgatgatattctgctttttacttacatatcttataaaaaatacacattagaaatcattttactagctgatacaagatacaatgttttaaatggcttaatcaataatagcaagcatttattggtttttagcgagaatgaaacgagaactttagatgatggtaaaataaatgaaagcgttagaatagatgggggaaaaaatatcatcctttatggtgttcctggtagcggcaaaagttatactttgcaaagagattattgcaataatagcgtggtagaaaagatagtgttccaccctgattattcttatagtgattttgtgggacagattatgccaagtgtagatgatagcggtatcgttagttataaatttaatcctggaccttttacaaatatccttaaaaaagcgtatcataacccacaaactaagcatgttctagtgattgatgaaataaatcgtggtaatgtgcctgccatatttggagaaatttttcaacttcttgacagacttaaacatgacaaagatggctttaagaaaggctctagtgagtatgctatcaataatacggatattgccaatattgtccataacgataaaaatgcaagtataagaatcccgtcaaatttatggatagtcgctacaatgaatacgagcgatcaaaatgtattcacactagatactgcttttcagcgtagattttctatgcaactcgttgaaaattcctttgaaaatgttgatgatgattttaaaaatatgaaaattttagatactgatatgacttggcaaaaattttgcaccaccatcaatgaaaaaatagctcaaaataacgaggggctgagttctatggaagataagcgatttggcgtttattttgtaagtattgatgatctaaagagcaaagaaaattttgcacataaagttataaaatacctttgggacgatgtttttaaatttgatagaaatataatatttaacactacaaaatttaatacacttgaagctgttgtaaaaaattttatcaaagaaaaagatagaacccaatttgatgtttttagcgatgatataaaagaacttttattcaatgtttaa

SEQ ID NO: 68155 - protein, 448 aa, Helicobacter pylori J99
MKVYLRKIDNQILHNKRISIKKGILEHFFDKANNQDEVDMSGILSNYNDKVSILLATDPRLGGGIKRIISAEVDKIKENRLDYELKIDDILLFTYISYKKYTLEIILLADTRYNVLNGLINNSKHLLVFSENETRTLDDGKINESVRIDGGKNIILYGVPGSGKSYTLQRDYCNNSVVEKIVFHPDYSYSDFVGQIMPSVDDSGIVSYKFNPGPFTNILKKAYHNPQTKHVLVIDEINRGNVPAIFGEIFQLLDRLKHDKDGFKKGSSEYAINNTDIANIVHNDKNASIRIPSNLWIVATMNTSDQNVFTLDTAFQRRFSMQLVENSFENVDDDFKNMKILDTDMTWQKFCTTINEKIAQNNEGLSSMEDKRFGVYFVSIDDLKSKENFAHKVIKYLWDDVFKFDRNIIFNTTKFNTLEAVVKNFIKEKDRTQFDVFSDDIKELLFNV

SEQ ID NO: 68156 - DNA, 1641 bp, Methanothermobacter thermautotrophicus str. Delta H
  CDS (1)..(1641): transl_table=11
gtgaacttgatcagatacgttaatctcagaataatatcagacagggatgagatagaatctcagcagaaaaggctggaaaatattctgaaggagagagcagataaggtcgttgaggggggtgccggttttcaggggggtgaggagaagggtaaggtatactggatgtctgaccttggcatatggtacatgacccgattcatagaggggagcaggtactggaatggcttcgggacagaggagccagaggagggaggtaacaggacaatcgtgtgtgagataaactttcccccggagggtataaaccgtagggttggggctgctatagcgcgtgatcccacaggaaactactatgtggtgcacaggggcaaactaggtgggaattacagtaaaagaatatttgaggagaactaccacggtgaatggacaacagtcattgacggtgatcggcaagaaaaggttgtggtcataggaaaaattgatgagacaatccctgagaaaataaggaactttgtatatgaggtccagaggataaagggcatgaaagccgattctaatcttgaagaaaattttaagaaagaaagtgggacagacatttaccagcatcttgacaaaggaacaggaacagacttttaccagtacctgcagattcatggttatcacttcagaccggaactcgttgagaacttcctcctctccctcaaggtcaagcccttcgtgatactgaccggtaactcgggtacaggtaagacgaagcttgcacagctctacggcagttacatatccacagagaatgacaaaaggtacctggtcgtcccggtgggtgccaactggaccgagacgaggcacatcttcggctacctcaacataatgacgggggaataccagagcaccccggccctggacttcatcatgagggcctccagggaccctgacaacccctacatcctgatactcgatgagatgaacctatcacacgttgaacgctacttctctgacttcctctcagccatggagagcggcgaaccagtaccactccatgatgaccccaactctgagttcccatccatgatagagatacccgagaacctcagggtcgtgggaacagtcaacgtggatgagaccacctacatgttctcaccgaaggtccttgaccgggcaaacaccatagaattcgaaaccctcaggccaggggagtatcttaacggcaccccccacgaccagggcccagcaggggacacagaattccttgaagacatcatggaatacagcaatgataacatgaaggacgacctccacatggtatgggatgaacttgtggctgaacttgacttcttccatgaaaccctcacaaccccaggattcgacttcggcttcagggtgacagatgagatcctcagattcatgcatgcagcctggatctacgagaaaagaccccgggaatgggaaaactgggagcgctaccttgacgcccagatcaaacagaagatcctccccaagatccacggccccgaaagactcctcagggacacactcgataaactcaaagaacactgccagggcagattccctgaatcagagaagaagcttgaggagatgcagaacaccctgaaaacccagcgctacgcctccttcatcaggtag

SEQ ID NO: 68157 - protein, 546 aa, Methanothermobacter thermautotrophicus str. Delta H
MNLIRYVNLRIISDRDEIESQQKRLENILKERADKVVEGGAGFQGGEEKGKVYWMSDLGIWYMTRFIEGSRYWNGFGTEEPEEGGNRTIVCEINFPPEGINRRVGAAIARDPTGNYYVVHRGKLGGNYSKRIFEENYHGEWTTVIDGDRQEKVVVIGKIDETIPEKIRNFVYEVQRIKGMKADSNLEENFKKESGTDIYQHLDKGTGTDFYQYLQIHGYHFRPELVENFLLSLKVKPFVILTGNSGTGKTKLAQLYGSYISTENDKRYLVVPVGANWTETRHIFGYLNIMTGEYQSTPALDFIMRASRDPDNPYILILDEMNLSHVERYFSDFLSAMESGEPVPLHDDPNSEFPSMIEIPENLRVVGTVNVDETTYMFSPKVLDRANTIEFETLRPGEYLNGTPHDQGPAGDTEFLEDIMEYSNDNMKDDLHMVWDELVAELDFFHETLTTPGFDFGFRVTDEILRFMHAAWIYEKRPREWENWERYLDAQIKQKILPKIHGPERLLRDTLDKLKEHCQGRFPESEKKLEEMQNTLKTQRYASFIR

SEQ ID NO: 68158 - DNA, 2352 bp, Campylobacter jejuni subsp. jejuni NCTC 11168
  CDS (1)..(2352): transl_table=11
atgtggaatttagatgaaaaaaaattacaagaaatgcttgatggctttttaaattttcaagaagtatggactttagaaaaagttaaaaatatgactcttgaagaatatactaacattaaaaaagataatccaaatagagatgattttactttttggatagaaagtaaattggataatctaggaagtatttggggtggctcagcttttaaatttggtatatatagaagaaatgatgaaagtcagaaagaatcttctagcggtagattatatagtcaaaattatgcttggattgctaaatatggcaataatgaaaatgaagcatttaataatatcaaagaaaaaatcatacaaataatacaagcaagtcaagataataatttaaaaactatagaaaaaatagattttggggatgcaattaaatggaaaatagcttttcattatcaagatgtaaagaatataaaaatagttaatattttttctaaaaatgttttagatttaatatctttaaatgaatttaaagaaaaattaaaaatatatcaaatacataaaaaattattagagaataaaaatttatcattagttaaaatgatagaaaatatagctattcctttatggaataaatatggcatggatagtcaaaattatatagataaaatgaaaaatttatttagtgaatatttaaataaaaagaaattagataaaaatactataaataaatatattcaagttatagaaaatatatcaaaagaatttttaaaagaaaatctatatagttgtgatttatttagttttgatcaaaatataaataaattaaataaaaatgaagaatttaagttaaaaaatagcaatggacacaatatgtattctagtgcattgaattattatagagcttttttgattgattattatgaacaagatatttttataactgaaagagtgcaatctgaggaatcaaatatgaaaattataccattaaatcaaattctttatggacctccagggacaggaaaaacttatcatactatagataaagctttagaaattttaggtgaaaatttagaaagtagagatgagaaaaaagcaaaatttgatgagtatgtaagaaagggacaaatagtatttaccacttttcatcaaagctatggatatgaagaatttgtagaaggtataaagcctataatagacaatgatgaaaattctcaagaagtaaaatatgatgtaaaagatggaatttttaaagaattatgtgataaatctttgaaaaattatattttatcaatgcaaaatgaaaatgaaattgatttagataaattaatttttgaatttgctaattatattaatcaagattttttaaataaaggaaatgaatttcctttagaaaataaagttagtattaaaaaaattcttttaaactttaaagatgaatatcgttctttttcattgggtggttcaattaaaagtcctcaaagcttaactatagatattataaaaagagattatctaaattttaaaaataaaaaaattctatcttttaaagatattaaaccaaaatatgatagtcaaagtgattatcatggtaatgcaatttactattttatgttttataataaattaaaagaatttgaaaatatacaaaatgaaaaatttaaaataaaaaaagaaattttaaaatcttacataatcatcatagatgagattaatcgcggtaatgtgagtaagatttttggtgagcttataaccttgatagaacctagtaaaaggataggtgaaaaagaagagttaaaagtgactttgccttatagcggtgaaaaatttggagtgcctaaaaatgtttatatcataggcactatgaatacagccgatagaagcataacttctcttgatacagctttaagaagaagatttgaatttgtagagatgatgcctgatgtgagcaaattatctatggattgcgaaggtattaatttacaagaattattaaaagctataaacactcgtatagaatatttactagatagagaaaaaaccataggtcatgcattttttgtaagtgttgaaaatttagaagatttaaaaaaagtttttcaaaataaaattattccgcttttgcaagagtatttttataatgattatgctttgattaatgcggttttaaatgataatgatatgatttttgaagataaaaaagacgataaatatcttcaaaaaataaaaaatctagatagtgttaatagcgagagaagtatttataatattgcttcatttgatgataaaatttgggataaaatagaaatatatcaagcaatttataatgatgaaatagcaaataaattaaaaaacgaaaatgaatag

SEQ ID NO: 68159 - protein, 783 aa, Campylobacter jejuni subsp. jejuni NCTC 11168
MWNLDEKKLQEMLDGFLNFQEVWTLEKVKNMTLEEYTNIKKDNPNRDDFTFWIESKLDNLGSIWGGSAFKFGIYRRNDESQKESSSGRLYSQNYAWIAKYGNNENEAFNNIKEKIIQIIQASQDNNLKTIEKIDFGDAIKWKIAFHYQDVKNIKIVNIFSKNVLDLISLNEFKEKLKIYQIHKKLLENKNLSLVKMIENIAIPLWNKYGMDSQNYIDKMKNLFSEYLNKKKLDKNTINKYIQVIENISKEFLKENLYSCDLFSFDQNINKLNKNEEFKLKNSNGHNMYSSALNYYRAFLIDYYEQDIFITERVQSEESNMKIIPLNQILYGPPGTGKTYHTIDKALEILGENLESRDEKKAKFDEYVRKGQIVFTTFHQSYGYEEFVEGIKPIIDNDENSQEVKYDVKDGIFKELCDKSLKNYILSMQNENEIDLDKLIFEFANYINQDFLNKGNEFPLENKVSIKKILLNFKDEYRSFSLGGSIKSPQSLTIDIIKRDYLNFKNKKILSFKDIKPKYDSQSDYHGNAIYYFMFYNKLKEFENIQNEKFKIKKEILKSYIIIIDEINRGNVSKIFGELITLIEPSKRIGEKEELKVTLPYSGEKFGVPKNVYIIGTMNTADRSITSLDTALRRRFEFVEMMPDVSKLSMDCEGINLQELLKAINTRIEYLLDREKTIGHAFFVSVENLEDLKKVFQNKIIPLLQEYFYNDYALINAVLNDNDMIFEDKKDDKYLQKIKNLDSVNSERSIYNIASFDDKIWDKIEIYQAIYNDEIANKLKNENE

SEQ ID NO: 68160 - DNA, 1680 bp, Sulfolobus solfataricus P2
  CDS (1)..(1680): transl_table=11
gtgtatggtgattggttagtagtcagagacaagttcaaaaaattactagactctcaagatagtgcgcaaacttttctcgattatattgaaaaaggaaattttgttccttgcttctttataggtgaaaaatctcattgggtagaatctataaaatattctttttatggagaattaggatatactttatggggtgcttcggctgaaaatcgtagcaatattagtagcattttaaacaggtatgacgaaatctattttggagaagataagaagagaaaagataagaaaaatgatacagagaataaaaataaaatagaaattaagaacgataaaatactggtagcccttctaagaacaaaagagctaggcattattggattcggagtagtaacggatatcacaaaggacgcgatgaggaattttaaaggatggaaggaaggtgacaaagtctggatagtaagatttagaataaaaatattttggcttcacgaaagcataagaaaaaactataatgacagtaataaatgggtgggagaagattataagttagaaggggttaataatcaatcaaaccaatgctatacagaagacaataatgatgcagttaaagcttttcaacaatttattctatcgaagaaagaggaaattaggtctactttagaattttattctaagtttcgtttcagtactcagaaagaatacctatcagaggaagtagtttgtaataaaaacgcacaaatagatcttaatggtttctatattcctcaagattcagttaacattatactgaaagctctacaaactactaatgtactcctagctggcccacctggtactggaaaaactagcttagctataaggactgtgagagctttaactggtaataatgataactgttatgaagtagctactgccaattcactttggtttagaaggaatttgataggaggagaaagtataagagagggatctgtaatgtggaagagcgggcttttcattgaagcttacgtaaatgctgcaagaataaaggatgggaactattacgtcgtaattgatgaattgaatagggctgacgttgataaggcatttggagaattaatgacaatattttctactccatatcctagcgaatggtcaattcccaatgctctaatagaggaaattaagagttatggagataatatagataatgtaaccaagagtttcttagaaatatatgagaagttaaagagggagagtagagagaatgaaccattaaaaagaatacgaattattgctacaataaacttagtcgatgctagaaatctgttttatgttggagatgcgctggcaagaaggttcgtgataatttactttgattatccgaaagaaaccgaagatttagatgaatttcttaaaacttacgcttcttttagtgaggactttaagaataaagttaaggatcttgtaaaatatcttagagttaatctaaatgaaaaagaagataaggtaataaagtttaatatctcaccggctagcttaaagacagcgctggatatatattcccgtcttgatgacaacaattctgatatatataagttcgttgaagttttaagatccactatagggacactaaatccagataatataaataaatttaatagattaatagaaaaatggaaaaaagaaaaaggaggacaataa

SEQ ID NO: 68161 - protein, 559 aa, Sulfolobus solfataricus P2
MYGDWLVVRDKFKKLLDSQDSAQTFLDYIEKGNFVPCFFIGEKSHWVESIKYSFYGELGYTLWGASAENRSNISSILNRYDEIYFGEDKKRKDKKNDTENKNKIEIKNDKILVALLRTKELGIIGFGVVTDITKDAMRNFKGWKEGDKVWIVRFRIKIFWLHESIRKNYNDSNKWVGEDYKLEGVNNQSNQCYTEDNNDAVKAFQQFILSKKEEIRSTLEFYSKFRFSTQKEYLSEEVVCNKNAQIDLNGFYIPQDSVNIILKALQTTNVLLAGPPGTGKTSLAIRTVRALTGNNDNCYEVATANSLWFRRNLIGGESIREGSVMWKSGLFIEAYVNAARIKDGNYYVVIDELNRADVDKAFGELMTIFSTPYPSEWSIPNALIEEIKSYGDNIDNVTKSFLEIYEKLKRESRENEPLKRIRIIATINLVDARNLFYVGDALARRFVIIYFDYPKETEDLDEFLKTYASFSEDFKNKVKDLVKYLRVNLNEKEDKVIKFNISPASLKTALDIYSRLDDNNSDIYKFVEVLRSTIGTLNPDNINKFNRLIEKWKKEKGGQ

SEQ ID NO: 68162 - DNA, 1935 bp, Streptococcus pneumoniae R6
  CDS (1)..(1935): transl_table=11
ttgatgaataaaagaaaagttagtttagaagatttttataaatggtatagtctaaataaagaagagttattaaataaggcaactgttggtgaaaagtttaatgataaattaaaagaagagtttctccaggaatggcctttggataggattttaacaatgtcaatcgatgaatatgtaataggaaagggacagcaaaataagtctttatgctacgctcttgagaagggaaaatacaaaaatctatttcttggaatttctggtggctcagcttcaaaatttggtatttattggaataaaaaaacaaacaaatataaagatcaagctaataatgagatttcagagttggatcagcgattttcaaaattaaaatcagatttgtatgaaattatcaaagaaggtattcgttttaactttgaaaatcctatttttgatatgaaaagatcaacaaatgaatttattggtcgttctgctatggtgacaaaattactttgtatctatactgagggagatcctttctttggtgtaaatattaatagtcagaaagaattttggaaccactttgtttctcagacaaatcaaggtggaccttatctgcaaaatcataaaataattgaactggtgtccaaaacttatcctgagttggagccatcgaaattaggaactatgctttttgagtattctaagctttttatggaaaataaggaagacaatagtacaatggattcatcaaacaattttagtcatcaattaactcaatctctattaaagtctccaaaccttatccttcgtggtgctcctggcacaggaaagacttatcttgctaaagaaattgccaaagaattaacggatggtaacgaagaccaaatcggatttgtacaatttcacccatcctatgattatacggattttgtagaaggtttaagaccagtatcaaatggggatggagctattgagtttaggctacaggacggtatttttaaagatttttgtcagaaagcaaaagaaacccaattgattggaggacaagataattttgatgaggcttgggattcttacttagaatatataaatgttgctgaagaaaaagaatatataacaaaaacatctgacttatctgttaatagtagacaaaatttgtcagtaaattatgatagtggtgttccaggatggtcactacctagcaaatatgtttacgagttgtataaagataaaaattataataagcaagaatactacaaaagtggtggaaaaactgtcctagaaacattgagaaagagatttggtttgaaagactatatttctccagaagaggttgaaacagacaagaaatttgttttcatcatcgatgagatcaatcgtggggagatttctaagatttttggcgaactctttttttctatcgaccctggctatcgtggtgaaaaaggaagtgtttctacccaatatgcaaatctacacgaaactgatgaaaagttctatatccccgaaaatgtttacatcatcggaactatgaatgatattgatcgttcagtggatacctttgattttgctatgcgtcgtcgttttcgttttgttgaagttactgccgagggtcaagttggcatgttggataaagatctgaatatccatgcagaagaagcaaaaattcgtctaagaaacttgaacgctgctatcgaaaatgttcaggaattaaacagtcattatcatattggaccaagttattttcttaagttgaaggatgtagattttgactatgaattactctggtctgattatattaagcctctcctagaagactacttgcgaggttcttatgatgaggttgaaactttggaaactttgaaaaaagcatttgaactgacaaataatgagcaaaaagatcaggcagtagctgatgacaatgaaggtgatgaaaacgatgatgcggattactga

SEQ ID NO: 68163 - protein, 644 aa, Streptococcus pneumoniae R6
MMNKRKVSLEDFYKWYSLNKEELLNKATVGEKFNDKLKEEFLQEWPLDRILTMSIDEYVIGKGQQNKSLCYALEKGKYKNLFLGISGGSASKFGIYWNKKTNKYKDQANNEISELDQRFSKLKSDLYEIIKEGIRFNFENPIFDMKRSTNEFIGRSAMVTKLLCIYTEGDPFFGVNINSQKEFWNHFVSQTNQGGPYLQNHKIIELVSKTYPELEPSKLGTMLFEYSKLFMENKEDNSTMDSSNNFSHQLTQSLLKSPNLILRGAPGTGKTYLAKEIAKELTDGNEDQIGFVQFHPSYDYTDFVEGLRPVSNGDGAIEFRLQDGIFKDFCQKAKETQLIGGQDNFDEAWDSYLEYINVAEEKEYITKTSDLSVNSRQNLSVNYDSGVPGWSLPSKYVYELYKDKNYNKQEYYKSGGKTVLETLRKRFGLKDYISPEEVETDKKFVFIIDEINRGEISKIFGELFFSIDPGYRGEKGSVSTQYANLHETDEKFYIPENVYIIGTMNDIDRSVDTFDFAMRRRFRFVEVTAEGQVGMLDKDLNIHAEEAKIRLRNLNAAIENVQELNSHYHIGPSYFLKLKDVDFDYELLWSDYIKPLLEDYLRGSYDEVETLETLKKAFELTNNEQKDQAVADDNEGDENDDADY

SEQ ID NO: 68164 - DNA, 1656 bp, Sulfolobus tokodaii str. 7
  CDS (1)..(1656): transl_table=11
gtggtaattttttccgtgtatggggactggcttacagtaagggacgcgtttaagaacttgttaggcttttctgaagaagcagttagcacattcctagattatgtgcaaaatggaaaatttataccttgtcttttcataggttccaaagagcactggatagagtctataagatattcttttgagggagaaataggctatacactttggggatctgcagataagtcatcaatttctggtattttaagcagatatcagatggtatatttaaatactgataagagcagatatattccagataataacaaaattcttattgcaatgctatatatgacaggttctggaataataggattcggagtagtaactgacgtggaaatggatgctattagaaactttaagggatggaaagaagtttctggtaaattctgggtactcagatttagaataaaagtcttttggcttcatgagagtataaggaaaaataaggacataaatgcatggactggagaaagctatgaattaaaaggaacaaattcgcaggcaaatatgtgctacagccaagagaataacgatgctataaatagcttcaagagttttattttatcaaagaaggacgagatcaaacccactcttgacctttatctaagcttgctaggcagtaaacctaaagaagttgaggaaaataaaaaagaagtaatatgtaagggagcaggacaaataaatgtgaatgacctatatcttcccccaaacgctctggatttaattttaagttcagtaaagagaactaacgtgcttttagtaggccctccaggtactggtaagacaagcttggctgtaagagtagctaagtcacttactgggaatgacgagtgttacgaagtcgccactgcgaattcgttatggtttaggaggaacttagtaggtggagaaagcattagaggagggagtgtaatatggaagagcggtctctttatccaagcttatgtaaatgcatataaagtgaaggagggaaactatttccttattatagatgaaataaatagggctgatgtggataaagccttcggagagttaataacaatattctcaagcccttctccagatgaatggtcaattcccagatcacttatagacgaaataaaaagctatggagataatgtagatagtactgcaaaggaatttctcagaatatatgaagatctgaaaaaggagaatagggaaaacgagccattgagaaaaatgcgaattatcgctacaatgaacctggtagatgctagaaacctcttttatataggagatgcactagctagaagatttgtaattattaaatttgattatccagaggggacagaagatctagataaactcattgacaggtataacctcagagatgatgaaaagaatgagataagaaacttaataggatgtctaagagccaaactgaaaaaagacgaaaaggatgcgttagtgaaatttaacgtatctccagcaagtataaagacagcacttgacatttactcttctttagagaacaagggaatagataagttcatagaagtgctcgagtcaacccttggtactttagatcaaaagaatattagtagagttaaaagtaaaatagaagaatgcagaaaaggcgaaaatcgtaaaatctaa

SEQ ID NO: 68165 - protein, 551 aa, Sulfolobus tokodaii str. 7
MVIFSVYGDWLTVRDAFKNLLGFSEEAVSTFLDYVQNGKFIPCLFIGSKEHWIESIRYSFEGEIGYTLWGSADKSSISGILSRYQMVYLNTDKSRYIPDNNKILIAMLYMTGSGIIGFGVVTDVEMDAIRNFKGWKEVSGKFWVLRFRIKVFWLHESIRKNKDINAWTGESYELKGTNSQANMCYSQENNDAINSFKSFILSKKDEIKPTLDLYLSLLGSKPKEVEENKKEVICKGAGQINVNDLYLPPNALDLILSSVKRTNVLLVGPPGTGKTSLAVRVAKSLTGNDECYEVATANSLWFRRNLVGGESIRGGSVIWKSGLFIQAYVNAYKVKEGNYFLIIDEINRADVDKAFGELITIFSSPSPDEWSIPRSLIDEIKSYGDNVDSTAKEFLRIYEDLKKENRENEPLRKMRIIATMNLVDARNLFYIGDALARRFVIIKFDYPEGTEDLDKLIDRYNLRDDEKNEIRNLIGCLRAKLKKDEKDALVKFNVSPASIKTALDIYSSLENKGIDKFIEVLESTLGTLDQKNISRVKSKIEECRKGENRKI

SEQ ID NO: 68166 - DNA, 2052 bp, Sulfolobus tokodaii str. 7
  CDS (1)..(2052): transl_table=11
atgacagatcttagtgagttattacttaaatatttccttacttccttaaatctcatagaagttgagcctagaggtaatgcagaagaaactaacaataaagaggtaatgaagatgttgaatgagggatatataccgcttttttcggctgaaaaaataaagttcataaagaatctttctccagtttatgcacaactcaaagatatggctgatgcaatattcaatgagctaaacataaggactgaacttccggcttcttacaaagttgcaattgcattacaactctccatattggagacgtggcggaaagtgatagtagaaaaggcaatgttagacgaaagaattgttatagacgaggaaaataaactggatatctccccttatgctttactactgttatatagattcattgcaatttcgaaatttatgtgtactggtaacgaaatagtgaagctttttagcaaagtcttggaaacacagaaagaagataatgctattgtggatattaaaaggcttgaggagtatatagagaagaagaggcaagacagaaacgaacaaagaagggcatatacaatgtataatacgctttttgctccattaatactttcatatgctttaagcggtgcgagtttacttaaatactataggggactaacacagaatcagctatcttatacctctacgacactcatggaaattctagagtcttatttctttagagtaatttacgatgataatcgctccactttaatttctctagctaaagaattagtagactatttttcagttttacacgaaattgtttctaacaaggaactaaaatctattataaaagaaggttccctatattcttacgtgttgtctaaggctaatgaacgtggtattactgatatgagtaaaatttccgtaatatggggtttaataaatgatgctgtgattgctgcattagtctctttagagctttacgataatgaagaacttaaaactgcttataggaacttagttggagatatcactatttatgaatatgtaattaaatatccacagaaaaacaaagctcaacaaatacaagctcaatattctcaaatctctacagtcctatgtaataagggttcacagatcaaggttgacgacctatatcttccccaaaataattccctcaatattatattaagttcggtaaaaaacgggaacgtgttgttcataggtcctccgggaactggaaagactactttagcaataagaatagctgaagggattactggaaatagagagtgttaccaaatagttaccgcaaatgcattatggttcagaaggcacttaatcggtggggaaagcctagagaaagaaaccgttgtttggaagagcggtttgctcctacaagcttacgtaaaagcatctaagataaaagacggatattattttataattatagatgagctgaatagagccgacattgataaagcttttggggagctgtttacaatattctccagcccgtcagcagatgactggtcaatgcctaacagtatttacgaggaaattgaaagatatggagataacattgatgaaattgcaagagaatttaagagagtatattcaaagttaaagagtgagggaagagagaacgaaccgttaagaaaaataagggtaataggaacgctcaatttgatagatgccagaaacctcttctatgtaggagatgcgttaactaggaggtttgttacaatccaatttgaatatccaaaagatgtggaagatctggagaagttctttacctattatcaccttaatgagaatgaaaaacaagagattagggagctagtaatggaacttagacaagaattcggtagaagtaagaccgttaagttcaacatttcacctgcaagtttaaggatagcattaaagctttactcctctcttgaggagagggatataaacgcatttataaacatcttgaaaagtacactaggaacactgaatcaggatgtaattaggatgtttgataatattgtagaggagtatgaaaagaagaaaaaaggtattattagttaa

SEQ ID NO: 68167 - protein, 683 aa, Sulfolobus tokodaii str. 7
MTDLSELLLKYFLTSLNLIEVEPRGNAEETNNKEVMKMLNEGYIPLFSAEKIKFIKNLSPVYAQLKDMADAIFNELNIRTELPASYKVAIALQLSILETWRKVIVEKAMLDERIVIDEENKLDISPYALLLLYRFIAISKFMCTGNEIVKLFSKVLETQKEDNAIVDIKRLEEYIEKKRQDRNEQRRAYTMYNTLFAPLILSYALSGASLLKYYRGLTQNQLSYTSTTLMEILESYFFRVIYDDNRSTLISLAKELVDYFSVLHEIVSNKELKSIIKEGSLYSYVLSKANERGITDMSKISVIWGLINDAVIAALVSLELYDNEELKTAYRNLVGDITIYEYVIKYPQKNKAQQIQAQYSQISTVLCNKGSQIKVDDLYLPQNNSLNIILSSVKNGNVLFIGPPGTGKTTLAIRIAEGITGNRECYQIVTANALWFRRHLIGGESLEKETVVWKSGLLLQAYVKASKIKDGYYFIIIDELNRADIDKAFGELFTIFSSPSADDWSMPNSIYEEIERYGDNIDEIAREFKRVYSKLKSEGRENEPLRKIRVIGTLNLIDARNLFYVGDALTRRFVTIQFEYPKDVEDLEKFFTYYHLNENEKQEIRELVMELRQEFGRSKTVKFNISPASLRIALKLYSSLEERDINAFINILKSTLGTLNQDVIRMFDNIVEEYEKKKKGIIS

SEQ ID NO: 68168 - DNA, 1032 bp, Bacillus subtilis subsp. subtilis str. 168
  CDS (1)..(1032): transl_table=11
atggaaatatccaaacaaacttcagatttattattgagcctagaaaagaaaaaaggcactttaccaaaattcagcgttttacgcagtattcctaggaataggattatttatggtgcaccaggaacagggaagagtaattatctagaaagggaagtgggaaagatctttggtgataatccatatgtattcacccgagttacttttttccctggttatacatatggacaatttataggtgcttataaaccggttcctatatataaaaaattaagcggtgaggaagagatatttagttcaaactttagggataagatggaaaactttgagccaatgattgattatcaatttgttcctggcccatttatcgatgtattaattaaagctctgaaaaatagatacactaattttatattaattatcgaagaaattaatcgtgccaatgcagcaagtgtttttggtgatatttttcaattattagacagaaataaaaacggtgaaagtgattatcctgttacattcgggccggacattatgaattatttagcgagaaacggaattaaagatgaaatgattaagctaccatccaatttctttatttgggcaactatgaataatgcggatcagggtgttttaccgctcgataccgcttttaagagaaggtggtcatttgaatatttagagttggaaaagtatagaaaggcagtggactcttggaagctgagcctcagatataaaggtcataataaagtaattatgtggaatgatttccgagacattattaataagcgtcttaaaggaaaagtaccagaggataagctgcttggaccttttttcctgaaagaaagtgaactgtggaatcagaatgtatttaaaaataaactgctttattatttgaaggaagatgttttcaagcataatccaacgattgattttttaaatgctagtactttctctgagctaattgaaaaatatgatggctcggataacatttttacttttgacatagatgattcgtcttttgtgagtgattaa

SEQ ID NO: 68169 - protein, 343 aa, Bacillus subtilis subsp. subtilis str. 168
MEISKQTSDLLLSLEKKKGTLPKFSVLRSIPRNRIIYGAPGTGKSNYLEREVGKIFGDNPYVFTRVTFFPGYTYGQFIGAYKPVPIYKKLSGEEEIFSSNFRDKMENFEPMIDYQFVPGPFIDVLIKALKNRYTNFILIIEEINRANAASVFGDIFQLLDRNKNGESDYPVTFGPDIMNYLARNGIKDEMIKLPSNFFIWATMNNADQGVLPLDTAFKRRWSFEYLELEKYRKAVDSWKLSLRYKGHNKVIMWNDFRDIINKRLKGKVPEDKLLGPFFLKESELWNQNVFKNKLLYYLKEDVFKHNPTIDFLNASTFSELIEKYDGSDNIFTFDIDDSSFVSD

SEQ ID NO: 68170 - DNA, 2064 bp, Yersinia pestis CO92
  CDS (1)..(2064)
atggttcaggattcctctgcgttagcctctttctttcgttctcatatcgcaaaaaataatcaatacagccccgactggggcaaacactatcgtcagctcgtagaacaggtccaagccgaaaaacccaacttctctgcggatacaattcggcagatttggtacgaacgtagcaatggtatctccagcctcaggcagggcggtatgtcccagtttgaattcgaaacggcgcaaaaacagctgctcgctctcacccgtcagatggcagatgagtgtacgcaggagaactacgatcgggtgattgagcgccttgttaaacttaaaacagatgggatattaaacaaagtatattgggcactttgccatcgtgcctttgccgcgctctacccgtcgaaaattaccaacgttgtgaatgtcagcaattttttcagcagttataactattgcaataaccattttcaacttgacctttctgaggatcaggagtggttcgctcgcaaccttgatctcaagaaagtgttgcatcgagcattgggcgatgatgtcgatcctatcgaactgaatatgtcgctctggcatctctacacgcaggtgattcagaagaagaatgatattgggttaatcggtagtgagactgccttgccagaggatgagcaagacgaggaggttaccactccgcaactgccaaaaaatactatcctctacggacctccaggtaccggtaaaacttactgtaccatcgagctagccgtacgcgcctgcgaaccagcagcctactcgctgcaggaaggcaaagaagagaacgaaaaacgccgtgagctgaaaaaggtttatgaccgactgattgctgaaaagcgggtgcgctttatcaccttccatcagagttttggctatgaagagtttatcgaagggctaagagcagaaaccaccgatgatggcaatgtacgctatgaagtcaaagcgggcatttttaagcaaatttgtgaagatgctgcttttggtcacgccggtgttcagcagaagcttgacgaggcgcttgcccgcctacaagaacgtttatctgaaagtggaagcattacccttgaaacgctgcagggcaaagccttccaactggcttacaagagccagaccacctttggtattttcccgtcgcaatcgaaaaaagaggatttagggcagggttacaatgcttacctcaagaatatcagtctggtttaccaaaaccctcaggcaaaggtacacaatccttcatatgtacgtagtatccttaattacctcattaaacaggaaggtttgccttccaacccacaggaatctgtatctgaaaaacggcaaaactacgttctgattattgacgagattaaccgtggcaacatctccaaaatcttcggcgaactgatcaccctgatagaaacctctaaacgtgccggggaaccggaggcgcttagcgtgattctgccttactcttccagttcgttcagcgtaccgaataatctctatttaatcggcaccatgaacactgctgaccgttcgctcaccgcactggataccgccctgcgtcgccgattcgagtttgaagcgatgctgccggatatcaccgttctaaaagaaactgttgtcaaaggtattgatctgccacgtctactgcagaccttgaatgaccgcattgaggtgctgtacgacagagaacatacactaggccatgcctttttcatcccagtagttcaggtaaaagaggacgaagacctggcatttgaaaggcttaagcggatcatgcgaaacaaggtgctgcctctgttggaggagtacttctacaacgactggcaaaaaattcgtatggtgttgggcgacaatcagaaaagcggaaacccgcagctacagttcgtgtgcgaggtgaaagaccagaaacagtttgccgatctttttggcaataacggaactgaagatctgcatgatataggtgccagtttccatctagcccctgaggacgacaaggtttgggataacccgctcgcctggcaacaaatttatgcgccacataaaggtaacccggtgagtggggaatga

SEQ ID NO: 68171 - protein, 687 aa, Yersinia pestis CO92
MVQDSSALASFFRSHIAKNNQYSPDWGKHYRQLVEQVQAEKPNFSADTIRQIWYERSNGISSLRQGGMSQFEFETAQKQLLALTRQMADECTQENYDRVIERLVKLKTDGILNKVYWALCHRAFAALYPSKITNVVNVSNFFSSYNYCNNHFQLDLSEDQEWFARNLDLKKVLHRALGDDVDPIELNMSLWHLYTQVIQKKNDIGLIGSETALPEDEQDEEVTTPQLPKNTILYGPPGTGKTYCTIELAVRACEPAAYSLQEGKEENEKRRELKKVYDRLIAEKRVRFITFHQSFGYEEFIEGLRAETTDDGNVRYEVKAGIFKQICEDAAFGHAGVQQKLDEALARLQERLSESGSITLETLQGKAFQLAYKSQTTFGIFPSQSKKEDLGQGYNAYLKNISLVYQNPQAKVHNPSYVRSILNYLIKQEGLPSNPQESVSEKRQNYVLIIDEINRGNISKIFGELITLIETSKRAGEPEALSVILPYSSSSFSVPNNLYLIGTMNTADRSLTALDTALRRRFEFEAMLPDITVLKETVVKGIDLPRLLQTLNDRIEVLYDREHTLGHAFFIPVVQVKEDEDLAFERLKRIMRNKVLPLLEEYFYNDWQKIRMVLGDNQKSGNPQLQFVCEVKDQKQFADLFGNNGTEDLHDIGASFHLAPEDDKVWDNPLAWQQIYAPHKGNPVSGE

SEQ ID NO: 68172 - DNA, 2103 bp, Methanosarcina acetivorans C2A
  CDS (1)..(2103): transl_table=11
atgagagaagatgagatcaaaaaaggtatccagctagtatgtgatacatctaaagagatatccaaactttatgaggataaaaatgccttaatcgaaaaactcaatagtctatctaatgaggatctggctccactagattatgagtatagatcgaaatcagggccggttacagatctacgtaaagatgtgttaaaatatctgctagatgggaataaactggatgaacaaacatttgatgagtttattcttaaacatcgtaccggaaatgaagggaaatttgtagcgtatcaaaagccattttctatatttcatccattcattacttcttacgggcacaaatcggtcagggaatttatagagcaattcataaatgagataatcgaacgattacagttaaaaggaaaagttaatcaaaagtttgtcgactttcagggcgccagatattcagggaccgatagattatggttggcaatttataacagtaaacacaaatcacagtctacagcaatacagctttttgtcaattttctagatgggaagattgagtatggtgtttatcatcatcctaataattatataaaagggccagaagaaagagattcttccaattttgactttgaagcattaatttctctttttgaagaaaataaagaattggtcctgaaagatgggcctgaagaaaatatattaactgtgccgtcagcaggtgaaaataatcaagacatattaacgattccattagaaggtaaaaaactgtataaaatgtctcatggggaatttaaagctaaaaaatatgcaagtattcttaatacatttaaacaaaataactgggctgttcttcatgaaactactaaaaagggtcaagctgagagatttaaaaatggactacatgtgggtgattacttatatatcactgtaggcggggatgaactttttgcaatagcaaaagtcaaatccgactcatgggaatatgttccagaatatattataaatgagaagaattggctctacagagaagtagaatacattaaaactgcaataaagacaaatccgtatgagttgaaagaacaaagaaaatttttctaccccagcgcaaatagtactttatttgaaattactcctgaaaatctcaacgaagcaaatgagaatctttttaagccttattttggagtggagtttgtttcagataataaagaccctcccgaaataaatgtaaaatttccaaagttcccctgcaacatcatattatatgggcctccgggtactggaaagacatacaatacgatcgacctctcagttgaaattataactggaaataaagcaagtcaccaggaaaataaaaaagtatttgatgttctgagggaagaaggacaaattgagtttattacttttcatcaaaactacagttatgaagacttcatgattggcattcggcctgaccttgatgaagcttcaactttgaaattccggcgcaaagaaggcatattctacaggatttgtaaaagggcaaagcagaattatctgcaatctctggatcagccagaagttcccttggagagatatgttctcataattgatgaaatcaacagagccaatatctcaaaagtatttggagagctcatcacattgttagaggaagataaacgcctcggggctaaaaacgaactgaggctcagtatccctggggaagaaacaggttttggaatcccgcctaatgtttacgtcataggaaccatgaataccgccgacaaatcaatagcaatgattgatatcgcattgcgaaggcgctttgaattccagggttatttccctgattacagtaaagtagacgggctcagcggagagattctgagatacatcaataatgagatatataaccgtaagaagtctgcagattacttaattggccacgggtatttcatgaacggtgacgaacctccggaaacttccaaagtgcttcagaacaaagtgatacccctgcttatggaatatttctctggcaaaacagagattgtcgaagaaatattcaaagggagtaaatggttcgttaagtacgatactgagaaatatggctgggaaatcaaaccgcagatcaagcagtaa

SEQ ID NO: 68173 - protein, 700 aa, Methanosarcina acetivorans C2A
MREDEIKKGIQLVCDTSKEISKLYEDKNALIEKLNSLSNEDLAPLDYEYRSKSGPVTDLRKDVLKYLLDGNKLDEQTFDEFILKHRTGNEGKFVAYQKPFSIFHPFITSYGHKSVREFIEQFINEIIERLQLKGKVNQKFVDFQGARYSGTDRLWLAIYNSKHKSQSTAIQLFVNFLDGKIEYGVYHHPNNYIKGPEERDSSNFDFEALISLFEENKELVLKDGPEENILTVPSAGENNQDILTIPLEGKKLYKMSHGEFKAKKYASILNTFKQNNWAVLHETTKKGQAERFKNGLHVGDYLYITVGGDELFAIAKVKSDSWEYVPEYIINEKNWLYREVEYIKTAIKTNPYELKEQRKFFYPSANSTLFEITPENLNEANENLFKPYFGVEFVSDNKDPPEINVKFPKFPCNIILYGPPGTGKTYNTIDLSVEIITGNKASHQENKKVFDVLREEGQIEFITFHQNYSYEDFMIGIRPDLDEASTLKFRRKEGIFYRICKRAKQNYLQSLDQPEVPLERYVLIIDEINRANISKVFGELITLLEEDKRLGAKNELRLSIPGEETGFGIPPNVYVIGTMNTADKSIAMIDIALRRRFEFQGYFPDYSKVDGLSGEILRYINNEIYNRKKSADYLIGHGYFMNGDEPPETSKVLQNKVIPLLMEYFSGKTEIVEEIFKGSKWFVKYDTEKYGWEIKPQIKQ

SEQ ID NO: 68174 - DNA, 2529 bp, Xanthomonas campestris pv. campestris str. ATCC 33913
  CDS (1)..(2529): transl_table=11
atggccttcagcacggacgacactttgtggcgtgagtttcttcaggtgtggccgctggagcggttacgcgagatgactctggccgagtacaccacggcgggagacaaagactgttttgtctactggctggagttccggctggttgattacggcagtatcgccggggggtccgctttcaaatttgcaatcttttcccgcaaggaaacgggggcgcgtgagggcgatacgtccttggcttacgacgaccgctacggctggtaccgccgattcggcacatctcccgaagaggcatttcagaccattcgtggacatgtggtggccgttgctgaggctgctcgtgacggtcgactggacgaaatcgacaacagcccgcttggcgctgcctaccgctggaagatcgcctttcactatcagccgctgcgaaacccgagtactccttgcgtctacgtgcgtaagcctcttttgcactttctcggcctatcggctgcggacactacaacacctcaaagtgagctttaccaagccctcgcaagactgcgtcaggcggatgagagtatcttcgtgttcagtgaacggctatggaaagactgggtcgccgacacaccgtttgtcgtcaagctgagcgagggtgcaatcaagcacggctatctcccggtcaatctcatctccgccccctttccggagaccatgtacggcggcaagacaccgaatgaagcagccgacgtggcgcatttccgcaccgatacaggtctggagttcgacaccgacctacgcgtctctagccccggtagcgctcgtctgcgtcacagactgggcggttatttcgaagacattggtgcagcggccggggacctcatcactttgactcaggatggcgatgggacctaccttttgtcctcaaagttagcggtccatgcgatcggtccgactgcgtctgcggcaacaatcaccgcacgggcatcagtgaaggaggctgccgccgtgcgcccccctttaaaccagatccttttcggaccgccggggacaggaaagacctacgaggctatcgagaaggctttggagattctcgacccttcctttctcttgcagttgggcgatgacgagagcaacgagcgccggagggcgctcaaacggcgctatgacgaactcgcgaaggaaggccttgtgcagttcgtaacgttccaccagagcttcagctacgaaaacttcgttgagggcttgagcgccagctccgatccggataccaagcaggtccgctatgaggtggaagacggtgtcttcaaggagctttgcgagtctgcgcgcacccgactggtccgcaggagcgatgacgccccactggaactctcgggccggcgcatctggaagctttcgctgggcgactcgatcactgagggacacatcttcgaggagtgcatggagaaaggtcttgccctgatgggctttggcaacaacgcagacttttcgcagtgccagtcccgcgaagatatccagaagatgtttgctgcctcgggtgaacccctctcgcttggcgcctatccaatcacagcgatcaagacgtttgtctgccagatgaagttgggtgatctcattgtcgtcagtgaaggcaacttgaaattccgcgccattggcgagattaccggcgactatcagttgctgccacgggatagtgacacctattcacaagcgaggcctgttcgctggttgcgcggctacaagccagcgttaccgtacggcgcgctgatggaaaatcggttcagccagatgaccgtgtacgaacttcgagcgggatcgattgaccacgacaagtttcgggagctcctgaaatccgaatgcatcgcgaccggtgctgacagaccacacgtgttgatcatcgatgagattaatcgaggtaacgtctcgcgaatcttcggcgagttgattacgctgattgagccatctaagcgctcaggtgctgccgaggcactggaggtattgctgccctactcgaaagatccattcagcgtgccggacaacgtgtatctgatcgggaccatgaacacggcagaccgttcattggccggcctcgacatcgcacttcgtcgacgcttcgactttgtggagatggcacccaggccggacaagcttaccggggtcaaagttgccgaaatcgacatttcggctgtacttgagacgatgaatcggcgtatcgaggtcttgctcgatcgcgagcaccggcttgggcatgcctattttatgtcgcttgaaaacagcaacgacctttcgaggttgtcgaatatctttcggcagcaaatcatcccgctgcttcaggaatacttcttcgaggactggcagcgcattgcgtggatacttaacgatcatcgcaaagacgagcgattccgtttcatcgtacccgccccttattcggtggactcgttgttcggcgataccggtcaggtagcacaggattccaaggcatggcgaatgaacgaagaagcctttcacaagccgcagagctatctaggcatcgtcggtgacggcaaggtctga

SEQ ID NO: 68175 - protein, 842 aa, Xanthomonas campestris pv. campestris str. ATCC 33913
MAFSTDDTLWREFLQVWPLERLREMTLAEYTTAGDKDCFVYWLEFRLVDYGSIAGGSAFKFAIFSRKETGAREGDTSLAYDDRYGWYRRFGTSPEEAFQTIRGHVVAVAEAARDGRLDEIDNSPLGAAYRWKIAFHYQPLRNPSTPCVYVRKPLLHFLGLSAADTTTPQSELYQALARLRQADESIFVFSERLWKDWVADTPFVVKLSEGAIKHGYLPVNLISAPFPETMYGGKTPNEAADVAHFRTDTGLEFDTDLRVSSPGSARLRHRLGGYFEDIGAAAGDLITLTQDGDGTYLLSSKLAVHAIGPTASAATITARASVKEAAAVRPPLNQILFGPPGTGKTYEAIEKALEILDPSFLLQLGDDESNERRRALKRRYDELAKEGLVQFVTFHQSFSYENFVEGLSASSDPDTKQVRYEVEDGVFKELCESARTRLVRRSDDAPLELSGRRIWKLSLGDSITEGHIFEECMEKGLALMGFGNNADFSQCQSREDIQKMFAASGEPLSLGAYPITAIKTFVCQMKLGDLIVVSEGNLKFRAIGEITGDYQLLPRDSDTYSQARPVRWLRGYKPALPYGALMENRFSQMTVYELRAGSIDHDKFRELLKSECIATGADRPHVLIIDEINRGNVSRIFGELITLIEPSKRSGAAEALEVLLPYSKDPFSVPDNVYLIGTMNTADRSLAGLDIALRRRFDFVEMAPRPDKLTGVKVAEIDISAVLETMNRRIEVLLDREHRLGHAYFMSLENSNDLSRLSNIFRQQIIPLLQEYFFEDWQRIAWILNDHRKDERFRFIVPAPYSVDSLFGDTGQVAQDSKAWRMNEEAFHKPQSYLGIVGDGKV

SEQ ID NO: 68176 - DNA, 1704 bp, Streptococcus mutans UA159
  CDS (1)..(1704): transl_table=11
atgatggaagaaaatagaaaatattattttgtcggtacaaaatttggagaatatgacaaccttgaacattataaagaagaagggaaatgggagctaggttggtataatgatgaagaaaatgcacagtatcaaaagatgcttaaagtgttcaataaaataaagtctggagatattttattagccaagacatcatatacaaaaaagaacaatttgccttttgaaaaaaagaatgatatgacagtttcagtgatgaaaattcgtggtatggcaattgtcaaagaagttttagatgataaacatacagtaattgttgattggaaggaaaattattcagaacgagaatggtatttctttacaggtcaagagactatctgggtaccttctaatattaaaaatcgagaaaaggaaacatcgcaattaattgattttgcaacaagtgaaaaaataaaagagcaaaattacgattattttttaaatcacccatattggaataaatataaaaaaattgaaactgaggagaatcttaaattgcaaaattataaagatatattaaaaacttccaaaaacctcatcctccgcggtgcgccgggtactggaaagacttatctggctaagcagattgctgaggaactgactgacggtaatgaagaccagattggctttgttcaattccacccgtcttatgattatacggattttgtagaagggttgcgtccttcttcgggtgatgatggtcagattggttttaagttgcaggatgggatttttagggagttctgtaaaaaagcgaaaaaagctactgaatctggtggacaagataattttgatgaggcttgggataaattctttgaagcagtgaacgatgttgatcctgatggttcttatgatattaagacgttaacggggaaaccaatgcacctcatagcatatatgcgtaatgaaatgtctggtgtcatggaaaaaggttctgctagtctcttttataataaagcacaatgttataatatttataaaggtgattcaggtgttccaaaagggggattagataattatcgtaaagctgttgttaaacacttaaaagagaaatatggtcttgtcaattatgttaaaccaactgaaacaacaactgacaaaaaattcgtctttattatcgacgaaatcaaccgcggggagatttccaagatttttggtgaactgttcttctctattgacccagactatcgcggggaaaagggagccgtttcaacgcaatatgccaatttacatgaaacggatgagaaattttatatccctgaaaatgtctatattatcggcaccatgaacgatattgaccggtctgttgatacctttgattttgccatgcgccgtcgtttcaggtttgttgagataaaggcagcagatactatgggaatgtgggaaaataatgacgaatttgataatgataaaattgaagaagctagaatccgtttgacaaatttaaataaggctatttcaaatacagaagggctgaacagtcattatcatattgggccatcttatttcttgaaactgaaagatcttgattacgattatgacattctttggtctgattacttagagccgcttttaaaagattatttgcgcggttcctatgatgaaacagatagtcttgataaattaaaagatgcttataataatgaggaagaaacagatgagactcactga

SEQ ID NO: 68177 - protein, 567 aa, Streptococcus mutans UA159
MMEENRKYYFVGTKFGEYDNLEHYKEEGKWELGWYNDEENAQYQKMLKVFNKIKSGDILLAKTSYTKKNNLPFEKKNDMTVSVMKIRGMAIVKEVLDDKHTVIVDWKENYSEREWYFFTGQETIWVPSNIKNREKETSQLIDFATSEKIKEQNYDYFLNHPYWNKYKKIETEENLKLQNYKDILKTSKNLILRGAPGTGKTYLAKQIAEELTDGNEDQIGFVQFHPSYDYTDFVEGLRPSSGDDGQIGFKLQDGIFREFCKKAKKATESGGQDNFDEAWDKFFEAVNDVDPDGSYDIKTLTGKPMHLIAYMRNEMSGVMEKGSASLFYNKAQCYNIYKGDSGVPKGGLDNYRKAVVKHLKEKYGLVNYVKPTETTTDKKFVFIIDEINRGEISKIFGELFFSIDPDYRGEKGAVSTQYANLHETDEKFYIPENVYIIGTMNDIDRSVDTFDFAMRRRFRFVEIKAADTMGMWENNDEFDNDKIEEARIRLTNLNKAISNTEGLNSHYHIGPSYFLKLKDLDYDYDILWSDYLEPLLKDYLRGSYDETDSLDKLKDAYNNEEETDETH

SEQ ID NO: 68178 - DNA, 1554 bp, Pseudomonas syringae pv. tomato str. DC3000
  CDS (1)..(1554): transl_table=11
atgccttcgctcaatcagattttcttcggtccgcccggtacggggaaaacctacgccacagtcgaagcgacgttgcagatccttgatcagccttttcttgctaaaaatgctggtagccgatcagctctgaaggctcgtttcgacgaactgctcgcagcaggcgacgtgcgctttgtgacttttcatcagagcttcagctatgaagacttcgtggaagggctacgcgctacaactgacgagcaaggtcagatccgttacgaagtggtatctggcgtcttcaggagcctgtgcgagtcagtcgcgactgaactgagtggaaagtaccgtgcattcaaggtcggtgatcgctacggcacaggctacaaagtgacccgcgccacgcctgacgtcgttgagatagagaagcctcaaggtaaacatctccccatcggcatgagcctgctgaatacgctcgcttcttatgtagacgccggcacgttcactatcgaagaactgggcaatggtcgctgggacaagaaagtgccgggctccgtccttgatccgtttttggtgaacggctacaagaacttcttgccatcaatggtcgagcacatgctgggcaaaaacgaggagggcttatttgagcctgcccccgttcaacatagcgacgccaaggtgctgatcattgatgagatcaatcgtggcaatgtctcgcgcatctttggcgagctgattacgctcattgaaccttccaagcgagcaggcgcagacgaggctttagaagtcacgctgccttactcaaaagaacgtttcagcatccccggcaacattcacctgattggcactatgaacaccgctgaccgatccttggccgcgctggatatcgccctgcgtcgtcgcttcaccttcatcgaagtcccgcctaatccagagttgcttgatgaagtagaagttgatggcatcgccatcgacgaattgctcagcttgatgaatcaacgcatagcggccctgcttgatcgagaccactgccttggccacgcgtacttcatgccgctcaaggatgagcctacgttggagcggttggaaggcatcttccgcgagcaaatcctgccgctgcttcaagagtatttcttcgaagattggcagcgcattcagtgggttctcaacgatcaacgcaaggctccggaaaatagttttctgattcaactgagccaagacctcattgcgttgtttggggatacggtcacggttggccagagcaatgagcgttgggagttgaatctgccagcgttccagaagattgaatcgtacctgggtgtgattgatcacaacctgaaagtcggtgcgccgctggaagcaaaaaacgttagaacagacgggatagatataaggcagtctgccgatggttgtatcgatgtgtatcgcggaggtcagcacattaagcccacaaagccgctgttgcgcgaacttgcgagcaagcacggcatctccagtacgtccgcgtcgggtagcgagctgaatacgcgaagcctcggacgcaagatcattaagtttctcagcgagcagcaggggtga

SEQ ID NO: 68179 - protein, 517 aa, Pseudomonas syringae pv. tomato str. DC3000
MPSLNQIFFGPPGTGKTYATVEATLQILDQPFLAKNAGSRSALKARFDELLAAGDVRFVTFHQSFSYEDFVEGLRATTDEQGQIRYEVVSGVFRSLCESVATELSGKYRAFKVGDRYGTGYKVTRATPDVVEIEKPQGKHLPIGMSLLNTLASYVDAGTFTIEELGNGRWDKKVPGSVLDPFLVNGYKNFLPSMVEHMLGKNEEGLFEPAPVQHSDAKVLIIDEINRGNVSRIFGELITLIEPSKRAGADEALEVTLPYSKERFSIPGNIHLIGTMNTADRSLAALDIALRRRFTFIEVPPNPELLDEVEVDGIAIDELLSLMNQRIAALLDRDHCLGHAYFMPLKDEPTLERLEGIFREQILPLLQEYFFEDWQRIQWVLNDQRKAPENSFLIQLSQDLIALFGDTVTVGQSNERWELNLPAFQKIESYLGVIDHNLKVGAPLEAKNVRTDGIDIRQSADGCIDVYRGGQHIKPTKPLLRELASKHGISSTSASGSELNTRSLGRKIIKFLSEQQG

SEQ ID NO: 68180 - DNA, 1737 bp, Bacillus cereus ATCC 14579
  CDS (1)..(1737): transl_table=11
ttgtatttttcagcaactttatttaataaatattataaacttcttggaacaaatgatgaaggtaaattaaatcttgaaagaacatcttctttagcatattttttagcattagatcaaatgcaaaaagatgaggaagaacccaatgcagttattaatatgtataaagattctctttcaagaaaaaatttcatggaaaaagtaggagaaatttttgtcattgctaaaaatggaagttttgaatatcaagcaaatatcttagggtgtatcaacaaggtggaaggtggaggcaattctatgtcttctaagactggtaaaaactttctttctacacaggtaatatcagcttcttctagccctaatccagtcgggtatcctaaacgaccagcagcgagctttattctcgaattaggatttgaaattgaagggcataaacatggtattaaaaaatctgatagttggaaaaataacttgatgaaatttatcgaatttaggaaatgtggaactgatacgtttcccttaattgtctttcttttaagggataagcagttgaataataacttggattttaataatgctataagagaagggttaggaagtgcatatacacaagctgtagtagattacctcatagtaaatgctcaggttccaagtttagtatgggatgatttacaaaactttgctactgccccgtttacgatagatgaattagatacagaattattcatgcaagatcaaccagaaacaaataacttgcaaccaactgttcaagtcaaagagtttaaagaaatagaaattccaaatgatatctcaagaaatagaatagtttatggagcgcctggaacgggaaaaagttataaacttaataaggacgctaaagaatttttcccggatgatgatttatacataagggttactttatatcctaattacagttatagtcaatttgttggtacatataagcctactccaatatataaagatgttgaaggagaattttataaatctgatatggtaacatcaataggacatggtaaagaacccttaattgattacacatttgtacctggaccattccttattcaattggttaatgctttaaaataccccaaatcaaattttgtcataattattgaagaaataaatagagcaaatgctgctgctgtatttggtgatgtgtttcaacttttagaccgcaaggatgacggagagagcgaatacactattacttttaatgcagatgtgacaaattatttgcgaaaagaaggtatttttgatttgcagataaaaataccaaaaaatttatatatttgggctactatgaacagtgctgatcagggagtaacccctttagataccgcctttaagagaagatggtcatttgagtacatgcctattgatgcaggggaaggagcagtttcgagccttgaaatggaattgaaatttttagagaatccgatactatggaataaattccggaaaattttaaaccaaaaattaaaagaacttatggttcctgaagataaactaatcgggccgtttttcatgaaatcatacgaattaagtaatccagagagttttaaaaacaaacttcttctttacttaagagatgatgttcttaggcataatgcgacaaaattctttaagcatcaaactttctcggatatcgtcactgcttacgatcaaggtggtaatatcttcagaactatttcaaaggaagagttagtaagaagtgaataa

SEQ ID NO: 68181 - protein, 578 aa, Bacillus cereus ATCC 14579
MYFSATLFNKYYKLLGTNDEGKLNLERTSSLAYFLALDQMQKDEEEPNAVINMYKDSLSRKNFMEKVGEIFVIAKNGSFEYQANILGCINKVEGGGNSMSSKTGKNFLSTQVISASSSPNPVGYPKRPAASFILELGFEIEGHKHGIKKSDSWKNNLMKFIEFRKCGTDTFPLIVFLLRDKQLNNNLDFNNAIREGLGSAYTQAVVDYLIVNAQVPSLVWDDLQNFATAPFTIDELDTELFMQDQPETNNLQPTVQVKEFKEIEIPNDISRNRIVYGAPGTGKSYKLNKDAKEFFPDDDLYIRVTLYPNYSYSQFVGTYKPTPIYKDVEGEFYKSDMVTSIGHGKEPLIDYTFVPGPFLIQLVNALKYPKSNFVIIIEEINRANAAAVFGDVFQLLDRKDDGESEYTITFNADVTNYLRKEGIFDLQIKIPKNLYIWATMNSADQGVTPLDTAFKRRWSFEYMPIDAGEGAVSSLEMELKFLENPILWNKFRKILNQKLKELMVPEDKLIGPFFMKSYELSNPESFKNKLLLYLRDDVLRHNATKFFKHQTFSDIVTAYDQGGNIFRTISKEELVRSE

SEQ ID NO: 68182 - DNA, 2223 bp, Nitrosomonas europaea ATCC 19718
  CDS (1)..(2223): transl_table=11
atgaccactcagacgatagatagtgcaccgcatgcaacctggtttgtcggcgccagctacggcggtaccgatgatcagatgccgcgatttcttgcggaaggaatttgggagaacggctacgacgacaagctcctcgaagtggtgcgttccatgcgcccgggagagcggatcgccatcaagtcgtcttacacgcgaaagcacggtctgcctttcgatagccgaggccgagcggtttcggttatgggcatcaaggcggtcggcacgatcactgaaaacctgaacgacgggaagcgggtgaaggtggactgggccaaggtcgagccagtacgggagtggtacttctacactcaccgagcaacgatctggcgtgtgctgcccggcgaatggatgaacgatgcgctgattgcatttgcgtttgacggcaagccgcaggatgtagatcgctttcgcaacgagcccttttggcgggagcgttacggcacgacttcgccagaaaagcagcgcttcgagtggacggacttctacgaggcagtggccgaaaagctgctggcccacgcagacgatcgaactccgctcatcgagggcatccacgagatcgcgtcccgggtgccggggctgacctatctccaggataagtttcctgatggaaccagtggtccgctgcgggacatttgcccattcaccacgatgggcacctttaaccgatccatgaccgatgccaaccgcaagaccctcgcgggtgaacttgccaagctgctgggtgtcacggtgccggtcccgccttcattcgagggcatccccgtcctcaacaaccaacgctcctggtttttcgcctatgccgacaagcgtggtgcgggcgacatcgacgcgctatggaaggtattcgttgccgcgagcaagatggtcgatggcgaccagttggacactcgcgatgccttcatccgggcttatgatgaggcaacccaagtgtggggtgtcgcatggaacctttcgacaggtctctactgggcgcatccgtgggaattcctgaccttggatagccagtcgcgccactacatcaacaagcggctcggcctgaatgtcgccatcagtggtcagcaaggcccatgtgatggtcgggcctatttgaagctgctggacgatttgcgttcgcgcttcggcgaagacggctatcccgtccacagtttcccggacttgtctcttgcgtcctggatgtacaaagacccggttgacgagcctgtgccggctggcgatatcggtaccaatgccggagccgaacaggaaactgaaggcgaagttcgcgaagcctttcaggtggcagcgccaatcgttccctactcggtggaggacatcctcaaggacggctgtttcctggagcgggccgagattgaccgcttgctcgatcgtctgcgcacaaaaaagaacctcatccttcaggggcctccgggcacgggcaagacctggctggccaaacggctcgcgttcgcgctcatgggccagaaggacgacagcaaggtccgtgcagtgcagttccaccccaacctgtcctacgaggactttgttcgagggtggcgccccactggcgaaggcaagttgtcgctggcggacggcgtcttcatggaagctatcaaggccgcatcgaaggacccttcgtcgaagtttgtcgtggtgatcgaggagatcaaccgtggcaacccggcgcagatcttcggcgagttgctgacgctgcttgaggccggcaaacggacacccaacgaagcgctggaactctgctatccggatgcggacggcaaacgccgtcccgtccatattcccgagaatctctatgtggtcggcaccatgaatatcgccgaccgatcacttgcactggtcgatctggcattgcgtcgccgctttgctttcgttgggctggagccaagactgggccaggtttggcgggattgggtggtcaaggagtgtgctgtcgatccgggtttggtcgcggatatcgagcgccgtatcgccgagctgaacgaccagatcgcggcggacgcgcgccttggcaagcaattccgaattggtcacagctatgtgacccctgcacatcgactggaagccggagacacgaagaagtggttcctgcaggtcgtggaaacggagatcggcccgttgctggatgaatactggttcgacgcgcccgacgaagcacaaaaggcgattgcacggctgacgcagggctggtga

SEQ ID NO: 68183 - protein, 740 aa, Nitrosomonas europaea ATCC 19718
MTTQTIDSAPHATWFVGASYGGTDDQMPRFLAEGIWENGYDDKLLEVVRSMRPGERIAIKSSYTRKHGLPFDSRGRAVSVMGIKAVGTITENLNDGKRVKVDWAKVEPVREWYFYTHRATIWRVLPGEWMNDALIAFAFDGKPQDVDRFRNEPFWRERYGTTSPEKQRFEWTDFYEAVAEKLLAHADDRTPLIEGIHEIASRVPGLTYLQDKFPDGTSGPLRDICPFTTMGTFNRSMTDANRKTLAGELAKLLGVTVPVPPSFEGIPVLNNQRSWFFAYADKRGAGDIDALWKVFVAASKMVDGDQLDTRDAFIRAYDEATQVWGVAWNLSTGLYWAHPWEFLTLDSQSRHYINKRLGLNVAISGQQGPCDGRAYLKLLDDLRSRFGEDGYPVHSFPDLSLASWMYKDPVDEPVPAGDIGTNAGAEQETEGEVREAFQVAAPIVPYSVEDILKDGCFLERAEIDRLLDRLRTKKNLILQGPPGTGKTWLAKRLAFALMGQKDDSKVRAVQFHPNLSYEDFVRGWRPTGEGKLSLADGVFMEAIKAASKDPSSKFVVVIEEINRGNPAQIFGELLTLLEAGKRTPNEALELCYPDADGKRRPVHIPENLYVVGTMNIADRSLALVDLALRRRFAFVGLEPRLGQVWRDWVVKECAVDPGLVADIERRIAELNDQIAADARLGKQFRIGHSYVTPAHRLEAGDTKKWFLQVVETEIGPLLDEYWFDAPDEAQKAIARLTQGW

SEQ ID NO: 68184 - DNA, 2013 bp, Helicobacter hepaticus ATCC 51449
  CDS (1)..(2013): transl_table=11
atggatattgataaatctttgtttgaaaacacattaaaagagtttaaagaacaggttgataaatgcgtgcaaagaggggatggaaaaacaacaggtgctacaccaaaagaaatagagaagagtttagacacttcattaaaaaataataattatgagtcgtgcgttagttttggtagtggtaaattagcagatacttgtggaattgcttttgtgcggaaagatattttgggggagcaatatgttaatagcgaaaaattccaacaatcaaaaggaatttatatttatattggttataaacataaaaatggagaatggtatatttgcttagggaatagtgagaattgcaaagaatgtgaggctaaaatttttatagaaaataaaaaatattttaataagggtaataaaaattttgatgttaaaaaactatatggagattttgtaaaactaatgaaggaattcaataaaataccaaaagaacattttgtaatacaaaacattaaagataaaggagaaaatatgtcaaatactcaagctcaaaacacaatccctttgaatcaaatcctctatggacctccagggacaggaaagacttatagtactatcaataaagctttggagattttggctggtgataaatacaaagattctttagaaccaaccaaaagagatgaaatcttacaaatcttaaaagaattaaaagaaaatcctagcgacaaagaaagcagacaaaaagcaagagggatttttaatgtctttaaagataagggacaaatcgcttttatcacctttcatcaaagcttttcttatgaggagtttatagaggggataaagccaaacactgataatccgcaaaatatgacttatgaagtgcaaaatggaatctttaaagagatttgcgaggaggcattaaaaaattatcaagaacatcaaatatctaacaacaaaacccgagatctccaaataaatgctaaagagatttttcaatcttatgctttggagttgaagcaaaaattggacaatggagaatccattaattttttaaataaaatgaaaattcaatctgttaatatcaatcaaaatggagaaataaaatctataagcattggagtagatgaaagcccttttcaaagcctaactcaagaaattatttcaagagattatttaaatttcaaaaataacaagataaaaacttacaaggatattaaaccaagatacgaatcacaatcacaatggcacgggaacgctatttattactttgagctatataaaaagcttcaagaatttgaggagacagagtataagcaggattttaagcctatgcaaaaagtctcacttaagccctatattcttatcattgatgagattaatcgcgggaatattagcaagattttaggggaactcatcacactccttgagccaagcaagagaatcgggagtaaggaagagctaagtgtaaccttgccttatggtaaagaaaactttggtgtgccaaaaaatctctatatcatcggcacgatgaatacagcagataggagcatagccttgcttgatacggcattgcgtaggagatttgaatttattgagatgatgccagattttacacttttaaataaggattgtgagggtatggatttacaagagttattacaaaaaatgaacgcgagaattgaatttctacttgatagagaacataccataggacattcattctttatggaaatacaatctataaatgaacttaaaggagtttttaccaaaaagattatcccgcttttgcaagaatatttttacgaggattatgccaagattgacgctgtgctaaatggcaatggaatgatagagattcaaaaaaattctaactttagcgagttatttgataataaatttagtaatttggacactgaaaaagttatttataaaatcacaaattctagcgattggaatataaaacattttcaaaaaatttatgataacactataaaattagatgacaaaaaagacaatgaagcataa

SEQ ID NO: 68185 - protein, 670 aa, Helicobacter hepaticus ATCC 51449
MDIDKSLFENTLKEFKEQVDKCVQRGDGKTTGATPKEIEKSLDTSLKNNNYESCVSFGSGKLADTCGIAFVRKDILGEQYVNSEKFQQSKGIYIYIGYKHKNGEWYICLGNSENCKECEAKIFIENKKYFNKGNKNFDVKKLYGDFVKLMKEFNKIPKEHFVIQNIKDKGENMSNTQAQNTIPLNQILYGPPGTGKTYSTINKALEILAGDKYKDSLEPTKRDEILQILKELKENPSDKESRQKARGIFNVFKDKGQIAFITFHQSFSYEEFIEGIKPNTDNPQNMTYEVQNGIFKEICEEALKNYQEHQISNNKTRDLQINAKEIFQSYALELKQKLDNGESINFLNKMKIQSVNINQNGEIKSISIGVDESPFQSLTQEIISRDYLNFKNNKIKTYKDIKPRYESQSQWHGNAIYYFELYKKLQEFEETEYKQDFKPMQKVSLKPYILIIDEINRGNISKILGELITLLEPSKRIGSKEELSVTLPYGKENFGVPKNLYIIGTMNTADRSIALLDTALRRRFEFIEMMPDFTLLNKDCEGMDLQELLQKMNARIEFLLDREHTIGHSFFMEIQSINELKGVFTKKIIPLLQEYFYEDYAKIDAVLNGNGMIEIQKNSNFSELFDNKFSNLDTEKVIYKITNSSDWNIKHFQKIYDNTIKLDDKKDNEA

SEQ ID NO: 68186 - DNA, 1716 bp, Porphyromonas gingivalis W83
  CDS (1)..(1716): transl_table=11
atgaataatcattcaaacaaacattggcatcttcaaatgtaccttcctgaagggaaaaagggagtgcaaattcgatcagaagatatgcttaaagagccacagcctgttattggtacaggggaatggaataatagacaatgccaagatttcaaggagttgcatattggaactattattttagttcgagaaggtaaaaaagctatagcgttatgtgaagtcactagtggctgctatactgataaagaactacacgagaaataccgacactccaattttagaaatgtgaaagtacttgattttattgcagaaaaggatcaacctccccctagattgttttctcagggaacattaaaatcatgtggagaatggactcatcaatgggaatatattgataaattaatatcgcttatggataagaataaccctatagaagaatatagccaactcaaagaatacgcgcaacttttagagtcaaaaaagaacatcattttgcaaggtgcaccagggactggcaagacctatacaacagcttctatcgctgtgcatatgtgcaacaagaactttacagattataccgaccacagcaaagtcatagaagagtacgaacgcctgagagatactggtcaaatagcattctgtaccttccaccagtcaatggattatgaggattttgtggaaggattgaagccagaagtgaaaagtaacaatgtggaatacaatgtggaaaatggaatcttcaaatccatctgtgaacaggcaaagacaaaggaagaagcagatatcattacttgtattgacaagtatctgcagtctatcaagggttatgaaaacaagaagaaaattccaacgatttccggtaggtcagatctgtgggtatggtggatagagggtaatgacacaataagcactcgcagtgccatttctaaaagtgaaaaaggggagcagtattcactatcaccacttaacattgagaaagtcaagctgcaggcaattggtgaagctatagagaataactggcgacagtatgcacaagcatttatcaatgccgtaaagaaagagtaccaacttgacaaacaaatttcagacaaaccttatgttctcattattgacgagataaacagaggtaatgtgtccaaaatattcggagaacttatcaccttacttgaagctgataagcgtagtggtgcaggcagtgacagtaatcactgtatcagtttaatactaccatactcaaaagagaatttctctgtcccctccaatctatatatcattggcacaatgaacactaccgatcgatctactggcaccattgattatgctgttcgccgtcgcttcgcatttgttacattgaagtcaagtgataaagttatcaaggagtatgcggaaaaacaatcagttgaggataatgtccgtgatgcatcacttgctttgtttacacagattaatggaaatcttaaaaacgataaggaatcatttattgccaaacataaggcagctgactttgaacttgaggacttgaaggtaggacatagctacttcatggctaaggatattgacatgcttaagatgaagatgcgttacgaagtagtgcctctcatcaaagaatacattaaagatggtatcctaagagggatgcaaggcgatgaatcgtattttgagaaatggatgaatgcagaatgttttcaccagtctgagcctactacaaatgataactaa

SEQ ID NO: 68187 - protein, 571 aa, Porphyromonas gingivalis W83
MNNHSNKHWHLQMYLPEGKKGVQIRSEDMLKEPQPVIGTGEWNNRQCQDFKELHIGTIILVREGKKAIALCEVTSGCYTDKELHEKYRHSNFRNVKVLDFIAEKDQPPPRLFSQGTLKSCGEWTHQWEYIDKLISLMDKNNPIEEYSQLKEYAQLLESKKNIILQGAPGTGKTYTTASIAVHMCNKNFTDYTDHSKVIEEYERLRDTGQIAFCTFHQSMDYEDFVEGLKPEVKSNNVEYNVENGIFKSICEQAKTKEEADIITCIDKYLQSIKGYENKKKIPTISGRSDLWVWWIEGNDTISTRSAISKSEKGEQYSLSPLNIEKVKLQAIGEAIENNWRQYAQAFINAVKKEYQLDKQISDKPYVLIIDEINRGNVSKIFGELITLLEADKRSGAGSDSNHCISLILPYSKENFSVPSNLYIIGTMNTTDRSTGTIDYAVRRRFAFVTLKSSDKVIKEYAEKQSVEDNVRDASLALFTQINGNLKNDKESFIAKHKAADFELEDLKVGHSYFMAKDIDMLKMKMRYEVVPLIKEYIKDGILRGMQGDESYFEKWMNAECFHQSEPTTNDN

SEQ ID NO: 68188 - DNA, 1815 bp, Methanococcus maripaludis S2
  CDS (1)..(1815): transl_table=11
atgaatggccatacgaatgcagtatattttttaaattgttcagacgatgaagagaattttaatctttgtttggagcatgatgttgcaggttttacaagcacaggctatgaaataggggatttagcatatattatacttaagaaaggtagaatatggtatctaggtggtaagggtgttcttgaaaaagaaacagatctaaaaccctggaaagatgcagcaagatacaattcggtattcaaaattaactgggatgtttgtaatctgactccaatcactgaaggtttacaacatatttatgataattttggattggcaatacaggggaaaaaggatttaagaaattttttaggaaaaggggatgaaatagtttcttatttggacagtgttatctctaaaaatcgtacaacaagacgcaatgttgtcaggagggatactataatcaataatccgatcaatataggcgaagatgaaactgataaggaatacgccctgaatacaattctttatggccctccaggaacaggtaaaacctaccgggtaattgaggaggctgtagcgattattgatgggaaaatacctaagggcagggtaaatctcgttaaaagatacaaggaattaaaagaaaggggacagattgaatttataacatttcaccagtcttactgttacgaagactttattgaaggaattaaacctgttttagaaaattcggacgaaaattcaatcgaatacaaaattgaagatggaatttttaaaaaaatggtaaataaagctatcgaagttaaaagttcaagtaatttcgatgaaaaatatgctaaatttgtggaagatgtccttgaacaggatggaattgaattagaaacgttggcccaaaaaaaaccatttagggttaggattaatagcaatgaaaccgcggttgcaatacctaaaacagaagctgctacaagattgagtgttactaaagaaatgttacgagattatattgttaatgataatattcaggggtggaaaccttatactcctgcaattggtgagtatttaaaaaataaatatggtatcactgttgaaaatacggataatactaataaaaagttcgttttgataatcgacgaaataaatcgtggaaacatttctaaaatatttggagaattaattacattgattgaaccagataaacgaattggggaattaaatgaacttactgtaacacttccatactctaaaaaggattttggattaccttccaatttatatattctaggaacaatgaatactgccgacagatcaattgcattagttgatactgcccttagacgacgatttgaatttaacgaaatgatgcctgatgttaaaaaattaggatttgatataaaaggtattcaaatagatataatgctcgaatcgataaataagagaattgagtatttcagaggaagggatcataccataggacatgcttacttcatggatcttatcaatgagaccaatgaacaagtacgatttaaaaaattacaggaaattttccaatataaagtaattccacttttacaggaatatttctacgaaaattgggaaacaattcagtatattcttggggatcatcctgatcaattaaaacgatttaaagataatcctgagttaacaattgtccaaagagataataccaatttaagaaacttatttggggcggatatgggcgattcggaaaatccaaatggatattttatcaatccacgattaaaagatggagaaatgcatccaaatgcatttattaagatatataattccaaggtaaacgaatctttggagtactaa

SEQ ID NO: 68189 - protein, 604 aa, Methanococcus maripaludis S2
MNGHTNAVYFLNCSDDEENFNLCLEHDVAGFTSTGYEIGDLAYIILKKGRIWYLGGKGVLEKETDLKPWKDAARYNSVFKINWDVCNLTPITEGLQHIYDNFGLAIQGKKDLRNFLGKGDEIVSYLDSVISKNRTTRRNVVRRDTIINNPINIGEDETDKEYALNTILYGPPGTGKTYRVIEEAVAIIDGKIPKGRVNLVKRYKELKERGQIEFITFHQSYCYEDFIEGIKPVLENSDENSIEYKIEDGIFKKMVNKAIEVKSSSNFDEKYAKFVEDVLEQDGIELETLAQKKPFRVRINSNETAVAIPKTEAATRLSVTKEMLRDYIVNDNIQGWKPYTPAIGEYLKNKYGITVENTDNTNKKFVLIIDEINRGNISKIFGELITLIEPDKRIGELNELTVTLPYSKKDFGLPSNLYILGTMNTADRSIALVDTALRRRFEFNEMMPDVKKLGFDIKGIQIDIMLESINKRIEYFRGRDHTIGHAYFMDLINETNEQVRFKKLQEIFQYKVIPLLQEYFYENWETIQYILGDHPDQLKRFKDNPELTIVQRDNTNLRNLFGADMGDSENPNGYFINPRLKDGEMHPNAFIKIYNSKVNESLEY

SEQ ID NO: 68190 - DNA, 1572 bp, Picrophilus torridus DSM 9790
  CDS (1)..(1572): transl_table=11
atggacgatcgttggtcgcaaatattaagggaattcatattaaacgcaaaatattccaatactaatctaaatacctcttcttataattcccgttggaagaagctaattgatgggaaacctgaaaaatggcctagcttgaagctaaaagtatcttttggtcaggggaaagtggcaaaaataccttggattgcttttttggcagaaaatatgaaggttagcaaaggtatttatccagtttatctctactataaagacatagatatattagttctatcttatggaataagcgagaaagagaagtcaagcattgactggccagagaaagtaaaaggaaatgataaggtagatagggtagatcaggctatatacaagttgttcattaataagaaaagaccagaaatacgtcactatggtagatcttatgtctttaaattatatcagattgatatagacaaaaatcaaaatgtaaactttttgaccaaagatcgcaaaaacatatcggatgacgaattagaaaacgatcttttggagttattaaaatactattatgattatatgaagaataaatcgaaaataaatgtctctaactcaaacgtctatctaatgacaaaaaatattattctccatggacctgttggaacaggaaagacaagaatggcaaggctaattgccagtggcataatatcaggcaaaataagaagctttcaggatttagatagggaaataaagggagattacgagatggatcttgaagatagcaacacatacgacgataagataagatttgtgacgttccatcagtcatattcctatgaggactttattggaggtctatctgtagattcgcaagatggacagataagatatttcgctaaaccggggatcttcatggatttctgtgagaaggccagtaatgatattaataacaattatgttatgataatagatgagataaatagaggagacatttcgagaatatttggggaactcattacactaatagatgaggataaaaggtcagatgacagttctggtggattctctataaaacttcctatctttcaaaaggatttctctgtaccgaaaaatctttatataattggcacaatgaacgatactgacagaagtattgcgttgctagatttagcattgagaagaaggttcgttttccttaaaattgagcctgacataaatgttgtgaagaaatggacaggaatttatgacgacaaatatccaggattttcagaaactgtatctaaattttttatgacattaaatgagatgatattgaaaaccaaaggatcggatttccttataggtcatggctttttcaaagatttgacattaaaagcagatgacccgtatagaattctacgttatatattcgtttataagataattccgcttcttcaggagatatattatggaagtaacgacatactttacgaaattgtcctgaaaggaaagttctttgaaaaaaaggaaaacgatggaaattattactaccaaccaaagtcttctctggaatctgaggatgaattcaagaatgagctgaagaaattcataggataa

SEQ ID NO: 68191 - protein, 523 aa, Picrophilus torridus DSM 9790
MDDRWSQILREFILNAKYSNTNLNTSSYNSRWKKLIDGKPEKWPSLKLKVSFGQGKVAKIPWIAFLAENMKVSKGIYPVYLYYKDIDILVLSYGISEKEKSSIDWPEKVKGNDKVDRVDQAIYKLFINKKRPEIRHYGRSYVFKLYQIDIDKNQNVNFLTKDRKNISDDELENDLLELLKYYYDYMKNKSKINVSNSNVYLMTKNIILHGPVGTGKTRMARLIASGIISGKIRSFQDLDREIKGDYEMDLEDSNTYDDKIRFVTFHQSYSYEDFIGGLSVDSQDGQIRYFAKPGIFMDFCEKASNDINNNYVMIIDEINRGDISRIFGELITLIDEDKRSDDSSGGFSIKLPIFQKDFSVPKNLYIIGTMNDTDRSIALLDLALRRRFVFLKIEPDINVVKKWTGIYDDKYPGFSETVSKFFMTLNEMILKTKGSDFLIGHGFFKDLTLKADDPYRILRYIFVYKIIPLLQEIYYGSNDILYEIVLKGKFFEKKENDGNYYYQPKSSLESEDEFKNELKKFIG

SEQ ID NO: 68192 - DNA, 2544 bp, Bacillus anthracis str. Sterne
  CDS (1)..(2544): transl_table=11
gtggggatgaaaatgttagagcaactcataattgaattagctaaatcaatgaagcaggctgaagatataaatggtgataaaaattatttaattataaataaggatgatgaaggattagacgttgaagtgaaaatttcatgtggacaatatgaagatgaagtgtcttattttaaagtgagctttgaacttcttaaaaacactttggaaaagtttatggctatgcgtacggtaaaaagtgagaatttcggacaaacaagtgaatgtaatgctttcttgttagccttcttttcacagctgccatttgtgaatgtaatggaatcaggagctattacatttaaagaattccaaaccgataacctgccaagcgaaaaatatgataaagtcatgctctttttagaagagataatgaatggtacatataatccaagtatgttacgtcaacaaacggatgaaaatttatatagaatgaaatctaatgcgcgccaggatttaaggttgttgggctttttgaatgaatctcatgaaatgaatcagcttctattaaatgaatatgttcagtcggaagataagaatgtttacattgctcagttaattttaaagcaggaatatttccgacatgttctatttattcttggattgttagagaagtattcaaaggatgaaaagaaagaagctttagtaggtttgggaatgacgattgtccaaaattcattaggtgataatttaatggttgaatcggtagcgaagcggcgtacgggtaacttactagattggcttgaacaagtaggactaattaatgatgaatggattcctgttgaacaatatgtaaaagatgatggggaaaagggcggtagcatgaacagtaatttacgtgaaaagtttttaacggttatgaatgagtatttacaggcaagaacagaaagatttgcgggacataaaatgggatcggttgttaggaatgagatgacaacggaaataacgaggttaccatttattgatcatagtcagtatgttgttacagggtcagttggacaagggaattgggctgctgttccatggcttgcgattatgaataaagatattacgacatctacgcagagaggttattatatcgtttatttgtttagtgaagatatggagcgattatatttaacgctggcgcaaggtgtgacagaaacaactaaagaagagatgcaaaaaattaaagaagagattcgtgaacaaatacatatgtctcaaaaggtgaaaaaagatgatgatattttcctagggacaagccctaaagcaaaaggatatgcgaattcaacagcggcttatattgcgtatgatgttaataaaatgccaagtgaaaaagagttagtagaggacctagaagaaatgcttcgctattatgagggattcatagcttataaagaggaaggaacgaaatatgaaatgatttatgaaaggaaagaagtgtatttagatcaacaatcaattatcgatcatgtgtcctcttatattcaaagtaaaggtttcttttatgagaaaaaggatcttgttaatttcttcctttcattaaaaacaaagccatttgtaattttatcaggtatttcaggtacaggaaaaacgaaaattgtgcagtggtttgcagagagtttaggggccacggaagagaatgggcaatttacacttattccggttcgacctgattggagtgatagctctgatttactcggttatgtgaacctccaaggggagtttcaagaaaggccattaatcaaagttcttgaaaatgcagatgcaaatccaaataggccgtattttgtagtgttggacgagatgaacttagctcgagtggaatactactttagtgattttttaagtgtaattgaaagtcgtaaatggaaagatggaaaaattgttacgttacctgttcttcctgagtcaattgcgaataagcatattacgattccatcaaatgtatatattatcggaacggtaaatatggatgaaacgacacatccgttaagtaagaaagtattagatcgtgcgaatacaattgagtttaataccgttaacttagattattttaatttcttaatggatgtagaggagaaggaagctgaaattgcttcgaatcgctctttagaaaccgagtatcttcatctaaaagaatgttttaaagacaacgaagatcttgtgagaaatatctcaactattttaatagaaataaataaaatacttgaatcagttggagctcaagttggatatcgtatacgagatgaaatttgtttctatatggcatataacgaacaagggaagttattttcattcgatgaagcactcgattatcaaatatatcaaaagattttaccgcgtcttgcagggagtgacggcagaacagaagaggtattaaagcagttgtatgtattatgtgcaaatgaagaatatgatagcggcaataatgacgcttcctatgctaaatatcctcgttcagctaacaagctgtctcatatgttaaggaggttcgagtatgatggtttcacctctttctggatctaa

SEQ ID NO: 68193 - protein, 847 aa, Bacillus anthracis str. Sterne
MGMKMLEQLIIELAKSMKQAEDINGDKNYLIINKDDEGLDVEVKISCGQYEDEVSYFKVSFELLKNTLEKFMAMRTVKSENFGQTSECNAFLLAFFSQLPFVNVMESGAITFKEFQTDNLPSEKYDKVMLFLEEIMNGTYNPSMLRQQTDENLYRMKSNARQDLRLLGFLNESHEMNQLLLNEYVQSEDKNVYIAQLILKQEYFRHVLFILGLLEKYSKDEKKEALVGLGMTIVQNSLGDNLMVESVAKRRTGNLLDWLEQVGLINDEWIPVEQYVKDDGEKGGSMNSNLREKFLTVMNEYLQARTERFAGHKMGSVVRNEMTTEITRLPFIDHSQYVVTGSVGQGNWAAVPWLAIMNKDITTSTQRGYYIVYLFSEDMERLYLTLAQGVTETTKEEMQKIKEEIREQIHMSQKVKKDDDIFLGTSPKAKGYANSTAAYIAYDVNKMPSEKELVEDLEEMLRYYEGFIAYKEEGTKYEMIYERKEVYLDQQSIIDHVSSYIQSKGFFYEKKDLVNFFLSLKTKPFVILSGISGTGKTKIVQWFAESLGATEENGQFTLIPVRPDWSDSSDLLGYVNLQGEFQERPLIKVLENADANPNRPYFVVLDEMNLARVEYYFSDFLSVIESRKWKDGKIVTLPVLPESIANKHITIPSNVYIIGTVNMDETTHPLSKKVLDRANTIEFNTVNLDYFNFLMDVEEKEAEIASNRSLETEYLHLKECFKDNEDLVRNISTILIEINKILESVGAQVGYRIRDEICFYMAYNEQGKLFSFDEALDYQIYQKILPRLAGSDGRTEEVLKQLYVLCANEEYDSGNNDASYAKYPRSANKLSHMLRRFEYDGFTSFWI

SEQ ID NO: 68194 - DNA, 1704 bp, Staphylococcus aureus subsp. aureus MRSA252
  CDS (1)..(1704): transl_table=11
gtgatgaagtgtatagataaaacgtgggttagctattataaagaattagctgataagttaacagattatcaaaataaacgttatgaattaattgaaatagtgaaggaagtatataaaaaaacgggaataaaattccctactttagcaagtgataatgtattgatggacatagatccttttacaatatttgcattatttaataaaaattccatgagagaaactaataaggtaaaaatattaacagaattagcttcggaattgaatattaagtccaaaattccgtcagtttttgacagtattccaacagtcaataatctgaatgctacatattataattttaaagattatggaaaagataatgatatagagaccttgtggaccttatttactgctgcattaaattttgcgaattatccttcagaagataataaattaaaatttatacatagttttgataagaatattactaaaacaggaaatgggaatagtaagattacgagtggtttgtactggattgcacctgaaacttttgctaactttgattcacgttcaatttggtacatttttgatacatataaactccctaaagaattgattaatgaacaacttaaaccaaaagaaaaactaacaggtcgacattatttagaattgataaatatgttaaagcaagttttgaagtgccaggaagtagagattaatgattttattgatttaagttatgagtcttggcattattcagaaatgataaatgaagctaatagaaacaaatttgattctaatatcaaagaaattgttgtcagtgaaaatgacaatataatacaaaatagaagtagaacaactaaagttataccatatggaaaacaagaattcttagatgaagtttttattgatgaaagtgattatgataggttagtacaacttttaagaagaaagcgaaatgtcattctacagggaccgcctggtgtaggaaaaacttttcttgcaaaacgtcttgcttattcattgattggcagtaagtgtaaagaacgaattaaattaattcaatttcatcaaagttattcatatgaagattttattatgggatatagacctactagttcaggttttgaactgactacagggacgttctatgatttttgtaagaaagctgataaagaccgcgataatgaatattttttaattattgatgaaattaataggggtaatctgagtaaaatttttggtgaattatttatgttgattgaaagtgataaaagagatgaagaactaatattactttatagcggtgagagattttctgtacctagaaatatttatattgtgggaatgatgaatacagcagatcgtagtttagcaattttagattatgcattacgcagacgctttgcgttttataatatgcaaccggcgtttcatacaactaaattcaaaaaacttcttaaagcaattaataatactgaattagagtcagtaattaattgtattgaaggattaaataaagagattgttcaagacgatatgttaggtaatggctttgttattggtcatagttattttagcaatattgaatgtatcgacaaagatgagctttctaatattatagaatttgagattattcctatgttagaagaatattggtttgatgaaccttcaaaaataaatgtatggtctgaaaagttaaggaattcaataaataatgattaa

SEQ ID NO: 68195 - protein, 567 aa, Staphylococcus aureus subsp. aureus MRSA252
MMKCIDKTWVSYYKELADKLTDYQNKRYELIEIVKEVYKKTGIKFPTLASDNVLMDIDPFTIFALFNKNSMRETNKVKILTELASELNIKSKIPSVFDSIPTVNNLNATYYNFKDYGKDNDIETLWTLFTAALNFANYPSEDNKLKFIHSFDKNITKTGNGNSKITSGLYWIAPETFANFDSRSIWYIFDTYKLPKELINEQLKPKEKLTGRHYLELINMLKQVLKCQEVEINDFIDLSYESWHYSEMINEANRNKFDSNIKEIVVSENDNIIQNRSRTTKVIPYGKQEFLDEVFIDESDYDRLVQLLRRKRNVILQGPPGVGKTFLAKRLAYSLIGSKCKERIKLIQFHQSYSYEDFIMGYRPTSSGFELTTGTFYDFCKKADKDRDNEYFLIIDEINRGNLSKIFGELFMLIESDKRDEELILLYSGERFSVPRNIYIVGMMNTADRSLAILDYALRRRFAFYNMQPAFHTTKFKKLLKAINNTELESVINCIEGLNKEIVQDDMLGNGFVIGHSYFSNIECIDKDELSNIIEFEIIPMLEEYWFDEPSKINVWSEKLRNSINND

SEQ ID NO: 68196 - DNA, 1668 bp, Streptococcus pyogenes MGAS10394
  CDS (1)..(1668): transl_table=11
atgatattagtcaatttaggaggcctaattatgctaaaggatttaggagttatttttgatgagcaaagcagaatagcatcggaatttctatcaaaaaatgacactgaggtaattctctctactgaatttaaagagaattataaaaaacatattgatatgttaggtgatgaaatttattttgaacagtataattcaaaatatcacactaatagtaagtttattataattccgaatcagtggttttatcttgcttttattgcagcgccatattataaagaattccttaaatataaatcaatcctgttggacacactatcgggcgatgattttaaagaattttgccaaacagctagaaatggtgaattagatgaaaatttatttgatactatctcagtagatcttactgaaactgatacgttatttctaaagaaatttgttaccgattatcattggtggcatggcgggaaggaaatccacaggggggatagttttatatcaccaattttagctttattaaagttaattaatgcttcttctgaacatgtagcaataattgtaaagtatctcgttgatgcagattttgatttaagtgatgtaaataagtactttgaacttgttgaaatggacagccgaagtgtagttactaccaattatgacaatacgaaccttgtgggtgataatattcttctctatggggttcctgggtctggaaaaagttttaaaattgctaccgaatattgcaatgatgaaaatagaatggagcgattagtctttcatccggactatatgaatactgactttgtcggacaaataatgcctactgtaaaagaaaatggagatattacctatcttttttcacctggaccttttacaagaattgtgaaaaaggcaattgataaccctagtgaacactattatcttgtaattgaggagttaaatcgaggcaatgctcccggaatatttggagaaatctttcaattattggatagaagtgctagcggtgaaagcgtctacggtattaacaattcaatacttgctacggaaatttatggtgataagtctcatcaaattaaaatcccttctaacttatcgttacttgcaacaatgaataccgcagaccaaaatgtattcactcttgatacagcatttcaacgtcgatggacaatggaaatgattgaaaatgatgttgatttatcggaatatgggaattattttattgctgatacacaatattcttggaaagtattcaacaaagttatcaataaaaaaattcttgagactagtagccagactctaacttcagaagataagcgaatgggagcatattttatttctggtaatgtattgaatattgaacggatacatcaagtaccagcaggtgattccggtaatgaattcaataaaaaaaataaacgctttgcagaaaaagttttgaaatatctttgggatgatgccttcaagtttaatcgtgaagatatctttgatgttgctttgtatccaagtttagaggcaattattaagcgattcacggataatgataatcctgaaaatgggcgttttgatgttttcgccaaagatatcaaagaggagttagaaaatcttaaggaagcaactttaatagataataacaacgacacaggagaagaagatgttgacagtaccgaataa

SEQ ID NO: 68197 - protein, 555 aa, Streptococcus pyogenes MGAS10394
MILVNLGGLIMLKDLGVIFDEQSRIASEFLSKNDTEVILSTEFKENYKKHIDMLGDEIYFEQYNSKYHTNSKFIIIPNQWFYLAFIAAPYYKEFLKYKSILLDTLSGDDFKEFCQTARNGELDENLFDTISVDLTETDTLFLKKFVTDYHWWHGGKEIHRGDSFISPILALLKLINASSEHVAIIVKYLVDADFDLSDVNKYFELVEMDSRSVVTTNYDNTNLVGDNILLYGVPGSGKSFKIATEYCNDENRMERLVFHPDYMNTDFVGQIMPTVKENGDITYLFSPGPFTRIVKKAIDNPSEHYYLVIEELNRGNAPGIFGEIFQLLDRSASGESVYGINNSILATEIYGDKSHQIKIPSNLSLLATMNTADQNVFTLDTAFQRRWTMEMIENDVDLSEYGNYFIADTQYSWKVFNKVINKKILETSSQTLTSEDKRMGAYFISGNVLNIERIHQVPAGDSGNEFNKKNKRFAEKVLKYLWDDAFKFNREDIFDVALYPSLEAIIKRFTDNDNPENGRFDVFAKDIKEELENLKEATLIDNNNDTGEEDVDSTE

SEQ ID NO: 68198 - DNA, 1635 bp, Haloarcula marismortui ATCC 43049
  CDS (1)..(1635): transl_table=11
atggcaatagttctgcttgtacttcatgtatgtacaggtttaagaggatcaccggtctctggacgggtacgaatggctgttgattcgggtatttatctcgctccgtgcagcaataacgatgcacaggagcatctcaagcgcaccgtgatcaatggtgtcgaccgggatgattatggacaatatacgaacgttgggttcggagattccgtctctatttggggcgttaagggagggaacgaatcacattggcaggatatcgatgcgggagactatctcttcttttatacaggtgatgagacgtattcacaggttgcagaagttttagccacagaccaaaacgaggggctagcagagcatctgtggcctggttttgaggatacctgggaattcatcatttacctcaatgagcccattccggtcaatattgactcaaatgagattgccgattacgctggttacaagcagaattatattctagggtttcagtcgcttcgcggcagcgccgtcgacgagatcaacgacgaatatggtagtatcgagggatacattaacgccaatcgaacagacggcaaccacatccagacatccggcgggtcacaagatcctgacgagggcgatgattccgtagtcgatgaagttcttgatgaagcagatcgcgatgaggaggcatatgcgaatattgcacgacaattagaagaagtaggtcaagtcgttttttatggccccccagggaccgggaagacatacaatgcacagcagtttgctcgctggtggctccataacctacagtctgaaccgagagaaagtcaagtccgttcggttaccttccatccatcgtatacctacgaggacttcattgaagggctgactgcaaatgctaccgaaaatagcgtcagctatgatatcaagcctggaaaattcaaagccatttgtgaagatgccagggtcgcatatcaggagacagggccaaacgaagagcctcctcgttacgtattactgatcgatgagattaatcgggggaacctggctcaaatcttcggtgaaacaatcactctattagaagaagacaaacggggtacattacacgtcgatctcgctcattcaggagggtctttcactattcctccaaatctgtatgtgattggaacgatgaacactgccgataggtcagttgcacttgtcgacgcggccctacgtcgacgcttccgatttatcgactttccacctgactacggagttgctcgatcacggtttggtttcgacactgagtatgatcttacgtctgcagccagaggagaacggtctgatcttgagcaactccaagcgctttcaattcaagcagtcgagcagctcaacgagacgattatcgaactccctgatctaggaaagggaaaacagatcggacattcatatctgttagtcgacccagacgacgagcaggcgctggtcgatgcttggcggtatgagattctcccccttctcgaggagtacttctacgggcaattaagccgcatcaggcaggagctattcaatcaaaacggagatagtctggtcgactgggagcgcgaacaaatcaaagacttcgaccccgaaacactcagagagtcgcttcaagcaatcgttaatgcggggtaa

SEQ ID NO: 68199 - protein, 544 aa, Haloarcula marismortui ATCC 43049
MAIVLLVLHVCTGLRGSPVSGRVRMAVDSGIYLAPCSNNDAQEHLKRTVINGVDRDDYGQYTNVGFGDSVSIWGVKGGNESHWQDIDAGDYLFFYTGDETYSQVAEVLATDQNEGLAEHLWPGFEDTWEFIIYLNEPIPVNIDSNEIADYAGYKQNYILGFQSLRGSAVDEINDEYGSIEGYINANRTDGNHIQTSGGSQDPDEGDDSVVDEVLDEADRDEEAYANIARQLEEVGQVVFYGPPGTGKTYNAQQFARWWLHNLQSEPRESQVRSVTFHPSYTYEDFIEGLTANATENSVSYDIKPGKFKAICEDARVAYQETGPNEEPPRYVLLIDEINRGNLAQIFGETITLLEEDKRGTLHVDLAHSGGSFTIPPNLYVIGTMNTADRSVALVDAALRRRFRFIDFPPDYGVARSRFGFDTEYDLTSAARGERSDLEQLQALSIQAVEQLNETIIELPDLGKGKQIGHSYLLVDPDDEQALVDAWRYEILPLLEEYFYGQLSRIRQELFNQNGDSLVDWEREQIKDFDPETLRESLQAIVNAG

SEQ ID NO: 68200 - DNA, 1680 bp, Geobacillus kaustophilus HTA426
  CDS (1)..(1680): transl_table=11
atgtcattgcacgatcttttccgccaagtgatggccatttacgaacaagaaaaacgcgaaaaactgtcaaaagagcgacggtcgtttcagctggtgacacgagcgattccagaggcgttgaaaacattgcctttcttaccgcctgaccggtatgtggtgaaaggttctgtcggtcaaggggtgtggaccgacgtgccgtgggtggcggtgatggatcaagaggtgacggattcgacgcaacgcgggtattatatcgtctacttattcagtgaagatatgcgccggctctatttgacgctcgcccaaggagtgacggagacgccgagagacgaaatggagcgggtgaagcggggcatccgccaactcattcccgctgaagaacgcgtgcggacgaatgatgacatccgtcttggcgaaagcaaacgggcgaaagactacgaacggtcggtggcggcgtatatcgcctattcgtttgacgatctgccatccaatgaacaactcgcgcgcgacctcgaaacgatgatcggttattaccgacagtatgtggagcgaacagaaccgatggcaccgcccgagcaggccctttcctatcgggaggcggttgagcatattcattcatacatatccgccaaagggttttactatacgaaagaggaagtgaccaacctctttctatcgttaaaaacaaaaccgtttgtcatcttgtccggcatttctggaaccgggaaaacaaaaattgttcaatggctcgccgagagcgtcggcgcgacggaagacaacggtcgcttcaccttaattcccgtccgcccggattggcacgacggctcggacttgcttggctatgtcgacattaaaggcgatttcaagcccgggccgctcaccaacgtcatcatcgaagcggggaagcatccggacaagccgtatttcgtcgtgttggatgagatgaacctcgcccgcgttgagcattatttcagcgatgtcttaagcgtcatggaaagccgccgctgggaagacgggcgcatcacctcgtcacggttgctgccgagagaaacagcagggtgcgatctttttctcccgccgaacgtctacatcatcggcacggtcaacatggacgagacgacccaccccttcagcaaaaaagtgctcgaccgggcgaacacgatcgagttcaaccgcgtccgtctcgaccatctcgattttttgcgcgacttgccgaccgtcgcgcccctgtcagtcggacaggagctgttcgcggcgcggtatttgcatttgaaagatgtgtacgcacgctgcccagagcttgttgaaacggtgacgaaacagctcgtggagatcaaccgcatcctcgcgccgctcggggcgcatatcggttaccgcgtccgcgatgaaatttgtttctaccttgcgtataacgaagaaggaaagctgatggaatttgacaaggcgttcgactattgcctgatgcaaaaaattttgccgcgcctttcgggaagcgacgtgcggctcgaaacagcgctcaagcagctgtttgtcctgtgcgccgtttttgaaccggacggggactacagcggcgtgcttgatgtttcgtatgcccgttatccaaaaagtgcggagaaaatttggcagatgctgcggaggttagaggacgatggcttcacttcgttctggctcggggcgtga

SEQ ID NO: 68201 - protein, 559 aa, Geobacillus kaustophilus HTA426
MSLHDLFRQVMAIYEQEKREKLSKERRSFQLVTRAIPEALKTLPFLPPDRYVVKGSVGQGVWTDVPWVAVMDQEVTDSTQRGYYIVYLFSEDMRRLYLTLAQGVTETPRDEMERVKRGIRQLIPAEERVRTNDDIRLGESKRAKDYERSVAAYIAYSFDDLPSNEQLARDLETMIGYYRQYVERTEPMAPPEQALSYREAVEHIHSYISAKGFYYTKEEVTNLFLSLKTKPFVILSGISGTGKTKIVQWLAESVGATEDNGRFTLIPVRPDWHDGSDLLGYVDIKGDFKPGPLTNVIIEAGKHPDKPYFVVLDEMNLARVEHYFSDVLSVMESRRWEDGRITSSRLLPRETAGCDLFLPPNVYIIGTVNMDETTHPFSKKVLDRANTIEFNRVRLDHLDFLRDLPTVAPLSVGQELFAARYLHLKDVYARCPELVETVTKQLVEINRILAPLGAHIGYRVRDEICFYLAYNEEGKLMEFDKAFDYCLMQKILPRLSGSDVRLETALKQLFVLCAVFEPDGDYSGVLDVSYARYPKSAEKIWQMLRRLEDDGFTSFWLGA

SEQ ID NO: 68202 - DNA, 1065 bp, Azoarcus sp. EbN1
  CDS (1)..(1065): transl_table=11
atgggattccctgtccagacaatcggggccacctctctgtctctggcttcctggctctacaaagatcccgccgacgaggctgttccagccggtaatcttgtcgatgatgtcgcggaggatcaggcagctgtaggtgaggttggcgaagccgtccaagtggctgcgccgatcgttccgtattcggtcgaggacattctcaaggacggatgcttcctcgagcggcccgagatcgatctgctgctcgatcggctgcgcaccaagaagaacttgatccttcagggccctccgggcacgggcaagacctggctcgccaagcggctggcgtttgcgttgatgggacagaaggacgacagcaaggtccgcgctgtgcagttccatcccaacctgtcctacgaggacttcgttcggggctggcgcccgaccggcgaaggcaagttgtcgctggcggacggcgttttcatggaggcgatcaaggctgcgagcaaagacccgtccgctaggtttgtagtggtgatcgaggagatcaaccgtggcaacccggcgcagatcttcggggagctgttgacgctgctggaggctgggaaacgcacgcccaacgaggccttggaactctgctatcccgatgcagatggcaagcgtcgtcccgtccacattcccgagaatctctatgtggtcggcaccatgaacatcgccgaccgatcacttgcgctggtcgatctggcactgcgtcgccgctttgctttcgttggactggagccgaggttgagccctgcttggcgggattgggtggtcaaggagtgtgctgtcgatccagccctggtggcggatatcgaacgccgaatcgccgagctgaacgaccaaatcgcggcggatgcgcgtcttggtaagcagttccggattggccacagctatgtcacacctgcgcatcggctggaagcaggagacacgaagaactggttccggcagatcgtggagacggagatcggcccgctgttggatgaatattggttcgacgcgcccgacgaagcacaaaaggcaattgcacggctgacgcagggctggtga

SEQ ID NO: 68203 - protein, 354 aa, Azoarcus sp. EbN1
MGFPVQTIGATSLSLASWLYKDPADEAVPAGNLVDDVAEDQAAVGEVGEAVQVAAPIVPYSVEDILKDGCFLERPEIDLLLDRLRTKKNLILQGPPGTGKTWLAKRLAFALMGQKDDSKVRAVQFHPNLSYEDFVRGWRPTGEGKLSLADGVFMEAIKAASKDPSARFVVVIEEINRGNPAQIFGELLTLLEAGKRTPNEALELCYPDADGKRRPVHIPENLYVVGTMNIADRSLALVDLALRRRFAFVGLEPRLSPAWRDWVVKECAVDPALVADIERRIAELNDQIAADARLGKQFRIGHSYVTPAHRLEAGDTKNWFRQIVETEIGPLLDEYWFDAPDEAQKAIARLTQGW

SEQ ID NO: 68204 - DNA, 1989 bp, Campylobacter jejuni RM1221
  CDS (1)..(1989): transl_table=11
atgaatattgctgaatttcatttttcaaatggaaataaaatacaagcacaaatagaagattcaaatgagaaaatttttaagatatttttggaaaaaagactaaaaaattacaatcaatatatcaaagctacaaaagacataattaaagaatgtaaaagattaaatattgtcaatagagatgattttgatacgtttcaaataaattctatagaagttttaacaaatttgttatttgaattaaaaaatgggctattgcgagaatatgatcttaagagcagcaatcgatgtccgcatgcttgtattaaatctcattatttggaatttgtaaaatatgtcaatgcttataaaaattatgtttcaaaagatatggttaagtatttgaagacaagaggtggtgagaaagaatttaaagtagaaataaaaaatcaaaagatagaaattattgctagtattaataatattagaaaatactcttcgaatagatttttggaatatagtgttttaggtaaaaatgaagttgagtcatatgctaaaccattatttgaagatatattaagcaactcaaatcttagtgcgattaagcaaagcgaaaatgaaaagatactaattgaaaatcaaaatatacctttaaatcaaattctttatgggcctccagggacaggaaaaacttatcatactatagataaagctttagaaattttaggtgaaaatttagaaaacagagatgagaaaaaagcaaaatttgatgagtatgtaaaaaatggacaaatagtttttaccacttttcatcaaagctatggatatgaagaatttgtagaaggcataaagcctcgcatagatagcaaagaaaattctaaggaagtagaatacgaaataaaagacggaatttttaaagaactttgtaaaaaagctttggataattacaaagtatctttattaacacaagaagaatttgtaaagagtgaagatttagaaaacaaaatagaaatttttttagatgaattagtagatcaacaaaaatttatagaaaaaattcaaagtggtggatttaaattagaagaatataatgaaaaatatagaattatcacagatgatactaatgcaaatttgtatttaaatttagaaatttttaaaacgcttttggaaaataaagataagattataaacggaagaagcattaagcaaattttaaataataaacatagaagacaaatcgatagttactattttcagctagttaaattgtttaaagaacgagaacaagattataaagtagataataatcctagtgaaaagccagaattaaaaccttatataatcatcatcgatgaaatcaatcgtggtaatgtaagtaagatttttggtgagcttataaccttgatagaacctagtaaaaggataggtgaaaaagaagagttaaaagtgactttgccttatagcggtgaaaaatttggagtgcctaaaaatgtttatatcataggcactatgaatacagccgatagaagcataacttctcttgatacagctttaagaagaagatttgaatttattgagatgatgcctgatgtgagcaaattatctatggattgcgaaggtattaatttacaagaattattaaaagctataaacactcgtatagaatatttactagatagagaaaaaaccataggtcatgcattttttgtaagtgttgaaaatttagaagatttaaaaaaagtttttcaaaataaaattattccgcttttgcaagagtatttttataatgattatgctttgattaatgaggttttaaatgataatggtatgatttttgaagataaaaaagatgataaatatcttcaaaaaataaaaaatctagatagtgttaatagcgagagaagtatttataatattgcttcatttgatgataaaatttgggataaaatagaaatatatcaagcaatttataatgatgaaatagcaaataaattaaaaaacgaaaatgaatag

SEQ ID NO: 68205 - protein, 662 aa, Campylobacter jejuni RM1221
MNIAEFHFSNGNKIQAQIEDSNEKIFKIFLEKRLKNYNQYIKATKDIIKECKRLNIVNRDDFDTFQINSIEVLTNLLFELKNGLLREYDLKSSNRCPHACIKSHYLEFVKYVNAYKNYVSKDMVKYLKTRGGEKEFKVEIKNQKIEIIASINNIRKYSSNRFLEYSVLGKNEVESYAKPLFEDILSNSNLSAIKQSENEKILIENQNIPLNQILYGPPGTGKTYHTIDKALEILGENLENRDEKKAKFDEYVKNGQIVFTTFHQSYGYEEFVEGIKPRIDSKENSKEVEYEIKDGIFKELCKKALDNYKVSLLTQEEFVKSEDLENKIEIFLDELVDQQKFIEKIQSGGFKLEEYNEKYRIITDDTNANLYLNLEIFKTLLENKDKIINGRSIKQILNNKHRRQIDSYYFQLVKLFKEREQDYKVDNNPSEKPELKPYIIIIDEINRGNVSKIFGELITLIEPSKRIGEKEELKVTLPYSGEKFGVPKNVYIIGTMNTADRSITSLDTALRRRFEFIEMMPDVSKLSMDCEGINLQELLKAINTRIEYLLDREKTIGHAFFVSVENLEDLKKVFQNKIIPLLQEYFYNDYALINEVLNDNGMIFEDKKDDKYLQKIKNLDSVNSERSIYNIASFDDKIWDKIEIYQAIYNDEIANKLKNENE

SEQ ID NO: 68206 - DNA, 1590 bp, Nostoc punctiforme PCC 73102
  CDS (1)..(1590)
atgaatcaaaaaaatattcttacttggggtgatgtagcttacgcttcccgaattgcgactggaggctcaaagcaggaatgggaggctttagaactgatttggcaagcatgggaaataataatctacaccggacttgcaacttattctaataaacgtgagcttttgctagtagttataagattttttgctattgtaagtttttacctggaattttttaatgattattattgggaatactatattaataattacagtagagagtggcttaaaggtattcacataattcccgattacaatgaatatataatcgactgtgtaaatggtttatgctgtcctatactgccaaaatccgaaccaaataatctacttttgtactttgtcgagaatgctttacagcaagtaatgcaagtaccgatggatagcctaaatagtgactcaatgatatttaaatctgtatgggaaattagtcaccagcagtttcaattagatggagatatatatgagttgcagagaagagaagctgaactaattagtgagagtatatttttggataagatcataaacttagccgaaatacatgagaattataatcaaaacaatgaatttattagagatgaagctgcaatcatagaaatattttttgacgaagataatacagacttagaatggatgaaatgcacaaatcatatagattttcaaaaatctcaagaagttatagatgctactaataaatttatagcttttttttcctgttatcaaataaagcctaacttttctctgaagcattgttctgaaataattgggtttaatgaaacagatttaaaacggtggatacgtacaattaatcgcaaaaaacaaataattttaagcggttcacctggaacaggaaaaacctttattgctaaacaccttgcagaacatttaataggtggtagtgatggcttctcagaacttctgcaatttcaccccacatactcttatgaagactttattcaaggtatacgtcctcaaagccaagatggacaattaacataccctttggttccaggccgttttctaaaattctgcaaagaagcagagtaccatcaaggaacttgcgttttaattatcgatgaaataaaccgtgctaatctcgcacaagtttttggcgaactaatgtacttacttgagtaccgaaatagagaaattccactagctggtggtaacacctttcgcattccagaaaatgtccgcattattggcacgatgaatacagcagataggtctattgccaatatagatcatgcgctacgccgccgctttgcatttatcgaacttcgtccaaattatgatgtcctgcgacgttatcaccaaaaaagaggttttgcagtagaaggattaattaatattttacagcaattaaatcaggcgattgcagataaaaattacgaaattggtatttcattcttcttaacagacaacctacgtgaagatatggatgatatatggcctatggaaattgaaccatatttagaagagtacttttttaatcagctagcaaaagtagatgagtttcgctgggataaaataaaagataaactatggatataa

SEQ ID NO: 68207 - protein, 529 aa, Nostoc punctiforme PCC 73102
MNQKNILTWGDVAYASRIATGGSKQEWEALELIWQAWEIIIYTGLATYSNKRELLLVVIRFFAIVSFYLEFFNDYYWEYYINNYSREWLKGIHIIPDYNEYIIDCVNGLCCPILPKSEPNNLLLYFVENALQQVMQVPMDSLNSDSMIFKSVWEISHQQFQLDGDIYELQRREAELISESIFLDKIINLAEIHENYNQNNEFIRDEAAIIEIFFDEDNTDLEWMKCTNHIDFQKSQEVIDATNKFIAFFSCYQIKPNFSLKHCSEIIGFNETDLKRWIRTINRKKQIILSGSPGTGKTFIAKHLAEHLIGGSDGFSELLQFHPTYSYEDFIQGIRPQSQDGQLTYPLVPGRFLKFCKEAEYHQGTCVLIIDEINRANLAQVFGELMYLLEYRNREIPLAGGNTFRIPENVRIIGTMNTADRSIANIDHALRRRFAFIELRPNYDVLRRYHQKRGFAVEGLINILQQLNQAIADKNYEIGISFFLTDNLREDMDDIWPMEIEPYLEEYFFNQLAKVDEFRWDKIKDKLWI

SEQ ID NO: 68208 - DNA, 1458 bp, Psychrobacter sp. 273-4
  CDS (1)..(1458)
atgcctgatgtgtctaatgataagccgaccaatattatttatacgggcgtcgcgggtacgggtaaaacctaccgattactccaaatctctaaagaatatacggattatctgaccagagccaatgatgaggatttgctcaagcagttattgcaagatttgagctggcgtgacgttgtctgtttagtatttttagattttcaatcgcaaaaacaagacttagtaaaagtacctgaaatcgtcaatcatgagttttttgtcgccaaagcggcgcaaaacgcacgtgagaagaatttaagtaatacggcatggactgtgctgcaaatgcacagtccaaccagctcacaaaccgttacgtataaaaatagagccagccaagcttactttgataaagatcatagcggtgcttggtatttattgcctgacagcatgatgttattaagcgcattgtcagagcaattgtcagaatttcagcaggcgcagtatgacaataatgccagccaacatgcgccctctcagcagcagcgctttagtatggtcagctttcatcaagcgtatggttatgaagagtttgtcgaaggcattcgcccaatgatggcagcctctaatcagtcgaataacagcctgtctcaaatgagctacggcattatagacggcgcatttttaaaattgtgccagcgcgctgctaatgatcctcagcagcgttatgccatgctgattgatgagatcaatcgtgccaacgtctcacgcgtttttggtgaattactcagccttattgaacctgataaacgagtgggtacagccaatgcgatgacggtgaatttggcatactctgggcgaacatttggtgtgcctgccaatgttgatatttatgcgaccatgaatacccaagatcattctttagcaccactagacatggcactgcgtcgacgttttcgatttattaactgcccgtcgcagcctgagctgctgccgattataagtcttagcaaagcgtcaaaaataccaaacgcagcggagtccatcgatttagccaaagtattgacgggtttaaatcttcgtattagccaaacactagggattgaggcgcaattgggtcatgcgtttttgttctctgtgcatagtcttgagcagttacaaatagtattggttgaacaaatcattccgcaattagcccaagcagcaggtgggcaagttgccaccttgcaatatatctttaaagatgaacagcagccgatgcaggcgcaatttattcatgatagccaaacgttaatgaataatgatatatccaatcgaatagctagccagaatactatagccgctcaacactcaatgtttgcaggacagcaatcctattttgctcagtctatgcatacaggtagttatgcaattaatactgaccttattgccaagactggcgagtttgccaataccgccgtctatcagcgcttatatccatga

SEQ ID NO: 68209 - protein, 485 aa, Psychrobacter sp. 273-4
MPDVSNDKPTNIIYTGVAGTGKTYRLLQISKEYTDYLTRANDEDLLKQLLQDLSWRDVVCLVFLDFQSQKQDLVKVPEIVNHEFFVAKAAQNAREKNLSNTAWTVLQMHSPTSSQTVTYKNRASQAYFDKDHSGAWYLLPDSMMLLSALSEQLSEFQQAQYDNNASQHAPSQQQRFSMVSFHQAYGYEEFVEGIRPMMAASNQSNNSLSQMSYGIIDGAFLKLCQRAANDPQQRYAMLIDEINRANVSRVFGELLSLIEPDKRVGTANAMTVNLAYSGRTFGVPANVDIYATMNTQDHSLAPLDMALRRRFRFINCPSQPELLPIISLSKASKIPNAAESIDLAKVLTGLNLRISQTLGIEAQLGHAFLFSVHSLEQLQIVLVEQIIPQLAQAAGGQVATLQYIFKDEQQPMQAQFIHDSQTLMNNDISNRIASQNTIAAQHSMFAGQQSYFAQSMHTGSYAINTDLIAKTGEFANTAVYQRLYP

SEQ ID NO: 68210 - DNA, 1521 bp, Crocosphaera watsonii WH 8501
  CDS (1)..(1521)
atgaaacaagaaaaagaacatataattaaaaatttatttgaggagtttattgattcttatttttatagtcctgaatttctagaaactcagaatatttatgatcataatcataaaacaatacataatagttttcaaaatattgaaacaaaattagaattaataaacgaagaagattttattaatggagtcttgaaagatttactttgtttaagtgatcaggaaacttggataaaatcatgtaaaacttataagatagatcaaacttttactaatgacagggaacaatggaatatattagcggaaaaagtatataattttattcatgatttgttaatataccctgaaaatttgcagattatttgtaatagatatctaagctacgatttatttaaaagtattcctctctgtttaattactcgaatcttaaatgctttaaatcgtcaaaaattttttatggttattccaacttctctaaaattaattaattatttatcagaaagttcctataatctatctcttagggattatccatctattaattttttaagtcaaaaaataattacaattctgaaatactctaaaaatttgtctagtattccatttctatctgacagtgaaattttttactacttttgtgattggttatatagaattaaaaaaattgataagacttcactactattggataaaaacccgacaaaacaatacacaatgatgcagcttattgaagatactaacttagaagaaaatgaattaaaccaatacatcaaaactctaaaacgtaaaaaacatattatctttcaaggttcaccaggaacaggaaaaacctacttagcgaaacatattgctaatcatttaaccagtagtgaaaacaatggattttatgaactgatacaatttcatcctagttatagttatgaagactttatacaaggtattcgtccccaaacttcaaccgatggaaacctagaatattccatgatacctggacgttttttaaacttctgtgaaaaagcaaaagactgtgaagggatgtgtattttaatcattgatgaaattaaccgtgctaacctctctcaagtgttcggagaattgatgtatttactagaatatagagaagaagaaatacaacttgcaggaagcgatcaaactttcaaaatacccgaaaatgtttatataattggaactatgaatactgccgatcgctcaattgctttagtagatcatgctttgcgtcgtcgctttgcatttattcccatcaaacctaactatgacatcctcagaaaataccatcaaaaaaatagcccaaactatgatattgaatccttaatcaacattttaattgaactcaataaaactattaatgatcctcattatgaaattggtgtttctttcttcttaactgaaagcttactagatgagctcgaggatatttggacaatggaaatagaaccctatttagaagaatacttttttgacgaaaccgataagattgagcaatttcgttggaaaaatagatga

SEQ ID NO: 68211 - protein, 506 aa, Crocosphaera watsonii WH 8501
MKQEKEHIIKNLFEEFIDSYFYSPEFLETQNIYDHNHKTIHNSFQNIETKLELINEEDFINGVLKDLLCLSDQETWIKSCKTYKIDQTFTNDREQWNILAEKVYNFIHDLLIYPENLQIICNRYLSYDLFKSIPLCLITRILNALNRQKFFMVIPTSLKLINYLSESSYNLSLRDYPSINFLSQKIITILKYSKNLSSIPFLSDSEIFYYFCDWLYRIKKIDKTSLLLDKNPTKQYTMMQLIEDTNLEENELNQYIKTLKRKKHIIFQGSPGTGKTYLAKHIANHLTSSENNGFYELIQFHPSYSYEDFIQGIRPQTSTDGNLEYSMIPGRFLNFCEKAKDCEGMCILIIDEINRANLSQVFGELMYLLEYREEEIQLAGSDQTFKIPENVYIIGTMNTADRSIALVDHALRRRFAFIPIKPNYDILRKYHQKNSPNYDIESLINILIELNKTINDPHYEIGVSFFLTESLLDELEDIWTMEIEPYLEEYFFDETDKIEQFRWKNR

SEQ ID NO: 68212 - DNA, 963 bp, Pseudomonas syringae pv. syringae B728a
  CDS (1)..(963)
atgctcagcaagcgaaatgaagatttccggacggcagaggtcgctcagagtgaacggccaaaagtgctgatcattgatgagatcaaccgaggcaacgtctcgcgcatcttcggcgagctgattaccctcatcgaaccttccaagcgtgcgggcgcatcagaggcactcgaggttacgctgccctactcgaaagagcgcttctgcatccccagcaacatccacttgatcggcaccatgaacacatctgaccgatcattggccgcacttgatattgccctgcgtcgtcgcttcacgttcattgaggtgccgcctaacccggagctgcttgaagacatagaggttgacggcatcgctatcgacgaattgctcagtgtgatgaaccagcgtatagccgtcctgcttgatcaagatcattgcctgggtcacgcgtactttatgcctctcgagagcgatccgaccttggagcggctggcaggtatttttcaagagcaaatcctgccgctacttcaggagtatttcttcgaagattggcagcgtatccagtgggtcctcaacgaccaacgcaaagctccagaaaataggttcttgatccagccgagccaagacttcagcgtgctgtttggagatgctgtcacagtggggcagaacaacgaacgttgggaattgaatctgcctgcattcgacaatatcgagtcatatctgggcgtgatcgatcacaacctgagcgtcagcgcgccgctggaagcgaagagcgtcagaacggaaggcgtagacatacgacaagccgccaatggcagtattgaggtctatcgtggaggccagcaggtcaaacctgccaagccacatttgcgagagattgccagcaaacatggcctacctattacatcagcgtcgggcatcaagctgaacacgcggagcctcgggcgtaagatcatcaagttccttagcgaacagcaaaggtga

SEQ ID NO: 68213 - protein, 320 aa, Pseudomonas syringae pv. syringae B728a
MLSKRNEDFRTAEVAQSERPKVLIIDEINRGNVSRIFGELITLIEPSKRAGASEALEVTLPYSKERFCIPSNIHLIGTMNTSDRSLAALDIALRRRFTFIEVPPNPELLEDIEVDGIAIDELLSVMNQRIAVLLDQDHCLGHAYFMPLESDPTLERLAGIFQEQILPLLQEYFFEDWQRIQWVLNDQRKAPENRFLIQPSQDFSVLFGDAVTVGQNNERWELNLPAFDNIESYLGVIDHNLSVSAPLEAKSVRTEGVDIRQAANGSIEVYRGGQQVKPAKPHLREIASKHGLPITSASGIKLNTRSLGRKIIKFLSEQQR

SEQ ID NO: 68214 - DNA, 2535 bp, Bacillus cereus G9241
  CDS (1)..(2535): transl_table=11
atgttagagcaactcataattgaattggttaaattaacgaagcaggttgaagaaataaatgatgataaaacttatttagttataaataaagatgatgaaggattatacgttgaagctaaattttcacgtgagcaatatgaagaggaagcatcaccttattttaaagtgagctttgaaattcttaaggatgcttggagaaaatttatcgctgtgcgtacagtaaagagtgaagattttggacaagcgggtgaatgtaatactttcttggtaactttcctttcacagcttccatttgtggatgtaaaggaatcgggagctattacatttaaagaattcaaaaccgataatctaccaagcgaaaaatacgataaagtcatgctctttttagaagagatcatgaatggtacatataatccaagtacgttacgtgaacaaacggatgaaaatttatatagagtgaaatctaatgcgcgccaagatttaagattattgggctttttgaatgaatctcatgaaatgaatcagttgctattaagcgaatatgttcaatcggaagataagaaaaactacatggcacagctagttttaaaacaagaatatttccgtcatgttttatttgttcttggattgttagagaagcattcaaaggatgaaaagaaagaagctctagttgattttggaatgacgattgttcgaaattcattaggggataatttgatggttgaatcagtggcgaagaggcgtacgggtaacttactggattggctggaacaagtagggctgattaatgatgaatggattcctgttgaacaatatgtaaaagatgatggggaaaagggcggtagtatgaacagtaatttgcgtgaaaagtttttaacggttatgaatgagtatttacaggcaagaacagaaagatttgcgggtcataaaatgggatcgtttgttaggaatgaaatgataacggaaataacgagattaccatttattgatcatagtcagtatgttgttacagggtcagtaggacaagggaattgggctgctgttccatggcttgcaattatgaataaagatattacgaaatccacacagagaggttattatatcgtttacttatttagtgaagatatggaacgattatatttaacgatagcgcaaggtgtgacggaaacgtctaaagaagagatgcaaaaaattaaagaagagattcgtgagcaaatacatatgtcccaaaaggtgaaaaaagatgatgatattttcctagggacaagcccaaaagcgaaaggatatgcgaattcaacagcggcttatattgcgtacgatgctaataaaatgccaagtgaaaaagagttagtagaagatctagaagaaatgcttcgttattatgagggatttattgcttacaaagaggaaggaacgaaatatgaaatgatttatgagaggaaagaagtgtatttagatcagcaatccattattgatcatgtgtcttcttatattcaaagtaaaggtttctattatgaggaaaagaatcttattaatttcttcctttcattaaaaactaaaccatttgtaattttatcaggtatttcaggtacagggaaaacgaaaattgtgcagtggtttgcggagagtttaggggctacggaagagaatggacaatttacacttattccggttagacctgattggagtgatagttctgatttgcttggctatgtgaaccttcgaggggagtttcaagaaaggccgttaattaaagttcttgaaaatgcagatgcaaatccaaataggccttattttgtagtattggatgagatgaatttagctcgagtcgaatactattttagtgattttttaagtgtaattgagagccgtaaatggaaagatggaaaaattgttacgtcaccagtacttccagaatcaattacgaataagcatattacgattccatcaaatgtatatattatcggaactgtaaatatggacgaaacgacacatccattaagtaagaaagtattagatcgagcgaatacgattgagtttaatactgttagcttagattattttaatttcttaatggatgtagaagagaaggaagctgaaattgtttctaatagctctttagaaaccgagtatcttcacctaaaagaatgttttaaagaaaacgaagatcttgtgagaaatatatcgaacgttttaataaaaataaataaaatacttgaatcagttggagctcaagttgggtatcgtatacgagatgaaatttgtttctatatggcatacaacgaacaagggaagttattgtcattcgatgaagcacttgattatcaaatatatcaaaagattttaccgcgcattgcaggaagcgatggaagaacagaagaggtattaaagcagttgtatgtaatatgtgcaaatgaagaatatgatagtggcaataatgatgcttcctatgctaagtatcctcgttcaactaacaagctgtctcatatgttaaggaggttcgagtatgatggtttcacctctttctggatctaa

SEQ ID NO: 68215 - protein, 844 aa, Bacillus cereus G9241
MLEQLIIELVKLTKQVEEINDDKTYLVINKDDEGLYVEAKFSREQYEEEASPYFKVSFEILKDAWRKFIAVRTVKSEDFGQAGECNTFLVTFLSQLPFVDVKESGAITFKEFKTDNLPSEKYDKVMLFLEEIMNGTYNPSTLREQTDENLYRVKSNARQDLRLLGFLNESHEMNQLLLSEYVQSEDKKNYMAQLVLKQEYFRHVLFVLGLLEKHSKDEKKEALVDFGMTIVRNSLGDNLMVESVAKRRTGNLLDWLEQVGLINDEWIPVEQYVKDDGEKGGSMNSNLREKFLTVMNEYLQARTERFAGHKMGSFVRNEMITEITRLPFIDHSQYVVTGSVGQGNWAAVPWLAIMNKDITKSTQRGYYIVYLFSEDMERLYLTIAQGVTETSKEEMQKIKEEIREQIHMSQKVKKDDDIFLGTSPKAKGYANSTAAYIAYDANKMPSEKELVEDLEEMLRYYEGFIAYKEEGTKYEMIYERKEVYLDQQSIIDHVSSYIQSKGFYYEEKNLINFFLSLKTKPFVILSGISGTGKTKIVQWFAESLGATEENGQFTLIPVRPDWSDSSDLLGYVNLRGEFQERPLIKVLENADANPNRPYFVVLDEMNLARVEYYFSDFLSVIESRKWKDGKIVTSPVLPESITNKHITIPSNVYIIGTVNMDETTHPLSKKVLDRANTIEFNTVSLDYFNFLMDVEEKEAEIVSNSSLETEYLHLKECFKENEDLVRNISNVLIKINKILESVGAQVGYRIRDEICFYMAYNEQGKLLSFDEALDYQIYQKILPRIAGSDGRTEEVLKQLYVICANEEYDSGNNDASYAKYPRSTNKLSHMLRRFEYDGFTSFWI

SEQ ID NO: 68216 - DNA, 1272 bp, Pseudomonas fluorescens PfO-1
  CDS (1)..(1272)
atgctgttcgtgcaagcgaatcgtgtgtcggtcaggtgggtctcattcggtgacgtgagtacgatatcgaaaaacctggaactgagtgaggagctggtggcatcggtcgaagcggtaaacgcccagaagactggtgtctggccccagcaaattcaacaatccaatcgtcctggcttctggccggatgattacagcagcgaagaagaagccggcggggaggagggcgagcagccagttggcctcgtattgaccgtgggagctaccgccccacgcaatgaaatctattttggtcctccgggcactggcaagacccgcacgctgcaacatttgctcagtggcaaatacacatctgccgatgggataaaacgctatgagtttgtgacctttcaccagtcctacggctacgaagaattcgttgaaggcctgcgcccggtgctggtcgattcagaggggccgacggttgatggaaacgctgaatcagccgcttcaaaggatgtacgatacgagatcaaaaaaggtgcctttcttcgactgtgcgaaaaggcccaggccgatccacaccagcaatacgcgatggtgattgacgagatcaatcgcggcaacatcagcaagatcttcggtgagttgatcacgctgatcgaagccgacaagcgcaagggtggcgagtatgaggtgacactaacattgccttactcgggcaaatcgttcagcgtcccctcaaacgttgacgtaatcggcacaatgaacaccgctgatcgttcgctggcgctagttgatacggcattgcgccggcgctttgagttcgtcgaattgatgcccgatcctcgtgtgctgaccgaaatcaaggttgtcagtggagagcatgaaatacagcttgatcgtttgctgacggcacttaacgcacgcatcgaggcgttgtatgaccgtgaacatacgatcggacacgcgtacttcacaccgttgaaaaaccttgtccctgaggcacgtttcgaggcgctcgtcaccattttccggacacgtatccttccactgctggaagaatactttttcgaggattggcagaaagtccgcctggtactgggcgataaccagaaaaccgacgaagcgcttcagtttgtccacgagcgaaacgccgacaggggttccaaaacgctgttcggcacccgtgatgatctggatgaatactcgttgcggcctcaataccgcttgaataaggaggtgtttggtagcccgccagcctatgtcggtgtctatgcgacgtttgctgaatga

SEQ ID NO: 68217 - protein, 423 aa, Pseudomonas fluorescens PfO-1
MLFVQANRVSVRWVSFGDVSTISKNLELSEELVASVEAVNAQKTGVWPQQIQQSNRPGFWPDDYSSEEEAGGEEGEQPVGLVLTVGATAPRNEIYFGPPGTGKTRTLQHLLSGKYTSADGIKRYEFVTFHQSYGYEEFVEGLRPVLVDSEGPTVDGNAESAASKDVRYEIKKGAFLRLCEKAQADPHQQYAMVIDEINRGNISKIFGELITLIEADKRKGGEYEVTLTLPYSGKSFSVPSNVDVIGTMNTADRSLALVDTALRRRFEFVELMPDPRVLTEIKVVSGEHEIQLDRLLTALNARIEALYDREHTIGHAYFTPLKNLVPEARFEALVTIFRTRILPLLEEYFFEDWQKVRLVLGDNQKTDEALQFVHERNADRGSKTLFGTRDDLDEYSLRPQYRLNKEVFGSPPAYVGVYATFAE

SEQ ID NO: 68218 - DNA, 2118 bp, Methanosarcina barkeri str. fusaro
  CDS (1)..(2118)
atgagagaagacgaaatcaaaaagggtattcagttaatttgtgatacgtctaaagagatatcaagactttatgaggataaaaatgccttaattaataaactcaatagtctatctaaagaagacctggctctattagaatatgagtacagatcaaaatcagggccagttacagatctacgtaaagatgtgttaaaatatctgctcgatgggaataaactggatgaaaaggcatttgatgaatttattcttaagcatcgtactggaaatgaggaaaaatttatagcgtatcaaaagccgttttctatctttcatccattcatcacttcttacgggcacaaaccactcagagaatttgtacaacaattcatagatgagataattgaaagattacagttaaaaggactagttaatcaaaagtatgtcgactttcaaggtgctagatatttaggaaccaacagatcatggtttgcaatttataacagtaaacataaatcccaatctacagcaatacagctttttgttgatcttcaggatggtaagattgagtatggtgtttatcgttacccgaatgagtatataaaaggaccagtaaaaagagattctaccacttttgattttgaatcattaatttccttttttgacgaaaataaagaattgatcctgaaagactaccctgacacagaaaaagtattaactgctctgccaacaggtgaaaataagcaaggcgttttaactattccgttagcaggtaataagctgtataaaatatcacatggggaatttaaagctaaaaaacatgcaaatattctcaacacatttaaacaaaatcactgggttggtcttcatgaaaataccggaaaaaggcagggtgagcgatttaaaaatgacctgcggctgggtgactatttatatatcactgtaggtgctgatgaactttttgcgatagcaaaaatcaaatccgattcatgggaatatgttccagagagtattgtatttgagagtggttggatctaccgagaagtagaatatgttaaatatgcaataaaaacagaccctcatgaattaaaaaaactaaaaaaacatttctatcctagcgcaaacagtactttgtttgagattacttctgacaacctcaatgaagcaaatgagaatctttttaagccttattttggagttgaatttgtttcggataaaacagatcctgaaatagaagatgaaaacgcggcaaacattccggaaaagttcccccgcaacatcatattatatggacctcctggcactggaaagacatacaatacaattgacctagcggttgaaattataacagaaaatgaagccagtcatcaggaaaacaaaaaaagatttgatgttctgagagaagaagggcagattgagtttattactttccatcaaaactatagctacgaagactttatgattgggattcggcctgacctaagtgaaacttcaaccttaaaattcaggcgtagagaaggtgtattttataagatttgtaaaagggcagagcagaattatttgcaatcacagaataaagaaaacacacctgaacctcttaaaaaatacgtgctcatcattgacgaaatcaacagagccaatatttctaaagtatttggtgagcttattacactgttagaagaagataagcgtctgggagctaaaaacgaacttagagtcagtattcctggcgaagaaactgattttggagtcccgcctaatctttacgtcatcggaaccatgaataccgccgacaaatcgatagcaatgattgatatcgcattgcgaaggcgctttgagttcagaggctatttccctgattacgacaaagtagatgagcttagtgggaagatcctgaagcatataaataaacaaatatacgagcgaaaaaaatctgctgattatttaattggccacgggtatttcatgaacggggacaaaactccagaaacctttaaagtgattgagaataaggtgatacccttgctaatggagtatttttctggcaaaaccgatgttgttgaagaaatattcaagggaagcgaatgggcagtaaaatacgatactgagaagtattgttggcaaatcaaaccagtaaattaa

SEQ ID NO: 68219 - protein, 705 aa, Methanosarcina barkeri str. fusaro
MREDEIKKGIQLICDTSKEISRLYEDKNALINKLNSLSKEDLALLEYEYRSKSGPVTDLRKDVLKYLLDGNKLDEKAFDEFILKHRTGNEEKFIAYQKPFSIFHPFITSYGHKPLREFVQQFIDEIIERLQLKGLVNQKYVDFQGARYLGTNRSWFAIYNSKHKSQSTAIQLFVDLQDGKIEYGVYRYPNEYIKGPVKRDSTTFDFESLISFFDENKELILKDYPDTEKVLTALPTGENKQGVLTIPLAGNKLYKISHGEFKAKKHANILNTFKQNHWVGLHENTGKRQGERFKNDLRLGDYLYITVGADELFAIAKIKSDSWEYVPESIVFESGWIYREVEYVKYAIKTDPHELKKLKKHFYPSANSTLFEITSDNLNEANENLFKPYFGVEFVSDKTDPEIEDENAANIPEKFPRNIILYGPPGTGKTYNTIDLAVEIITENEASHQENKKRFDVLREEGQIEFITFHQNYSYEDFMIGIRPDLSETSTLKFRRREGVFYKICKRAEQNYLQSQNKENTPEPLKKYVLIIDEINRANISKVFGELITLLEEDKRLGAKNELRVSIPGEETDFGVPPNLYVIGTMNTADKSIAMIDIALRRRFEFRGYFPDYDKVDELSGKILKHINKQIYERKKSADYLIGHGYFMNGDKTPETFKVIENKVIPLLMEYFSGKTDVVEEIFKGSEWAVKYDTEKYCWQIKPVN

SEQ ID NO: 68220 - DNA, 1620 bp, Trichodesmium erythraeum IMS101
  CDS (1)..(1620)
atggcaattcaacaactaactttatttgttcaactttttcaagaattttctgactcatatccctatagcttagaaggattaaatcatagagcatcttatgaaaaacaacgtcaacaaggtcgccggaattttgaagaaataactactgctgctaaggcaggggaagacataacagagttgattatatggaaacttttacctcatactaatactcccagtaatcgacaaaagggtgtatggatttacttgagtgaatctagcaatactgatttaagtgaatggtttcaatggttggaaaagcaagaagattggtctgttattactagagcaatttataattttgtaacttcctgtattacagattatcataaatttttagtagcttgtaaaaatttttctaaattaccatattctagagaatttaaaataggaataataacacctattctgaatgcagtcaaaccagatgattttcttttaattaataataaatccagaaaagtaattaattatttaagtaacacaaaacatactcaaaagctaactgaatacccatatattaatctcactggccataatctaattttagaattagctgaagaaatgcagaagcaaaatatacctgcaatgcgagatgatgatttgtttgatatgttttgttattggttggtagatgtaaaaaaatacaattttattagtgaaaatataaagagtacagacaatatctataaaactaatcaagatcaagatcaaaaaataaatgtgattaatttacaaccagaatacactctaactcaatgctcccaagaaacaaacttcacagaaacagaactcacccaatggatacgcgctatcaaccgtaaaaaacaggctattttccaaggtccacctggtacaggcaaaactttcctctctcaaaaactcgcccaacacttaatcagtcgaggtgacggcttctgggaactgatccaatttcattctgcttatacctacgaagactttattcaaggtattcgaccccaaagccaagatggtaaactcacctaccctgttgttcccggtcgcttcctacaattttgtcaaaaagcagcacttaatcaagatatttgcgtactcatcattgatgaaattaaccgggctaacctctcccaagttttcggcgaacttatgtacctcctggaataccgcgacgccaaaattccccttgctggtagtgcagaattattcagcattcctaaaaatgttcgcatcattggcactatgaatactgccgatcgctccattgctttagtagaccatgcacttcgtcgtcgctttgctttcatcactctctcccctaagtatgaaatattgcttcaatactacaaggaaatagaaacaaatttttcagtggaggggttaactcaacttttagaagcagtcaaccaagaaataaacgaccccaactatcaagtcggtgtttccttctttctccgaaaaaatattgcagaggaaattccagatatttggcaaatggaaattgaaccatatttagaggaatatttctttgctcaaccagaaaaagtcaatgattttcggtgggaaaaaattcaacatcggatgtcaaagacaatttgttag

SEQ ID NO: 68221 - protein, 539 aa, Trichodesmium erythraeum IMS101
MAIQQLTLFVQLFQEFSDSYPYSLEGLNHRASYEKQRQQGRRNFEEITTAAKAGEDITELIIWKLLPHTNTPSNRQKGVWIYLSESSNTDLSEWFQWLEKQEDWSVITRAIYNFVTSCITDYHKFLVACKNFSKLPYSREFKIGIITPILNAVKPDDFLLINNKSRKVINYLSNTKHTQKLTEYPYINLTGHNLILELAEEMQKQNIPAMRDDDLFDMFCYWLVDVKKYNFISENIKSTDNIYKTNQDQDQKINVINLQPEYTLTQCSQETNFTETELTQWIRAINRKKQAIFQGPPGTGKTFLSQKLAQHLISRGDGFWELIQFHSAYTYEDFIQGIRPQSQDGKLTYPVVPGRFLQFCQKAALNQDICVLIIDEINRANLSQVFGELMYLLEYRDAKIPLAGSAELFSIPKNVRIIGTMNTADRSIALVDHALRRRFAFITLSPKYEILLQYYKEIETNFSVEGLTQLLEAVNQEINDPNYQVGVSFFLRKNIAEEIPDIWQMEIEPYLEEYFFAQPEKVNDFRWEKIQHRMSKTIC

SEQ ID NO: 68222 - DNA, 1698 bp, Streptococcus suis 89/1591
  CDS (1)..(1698)
atggatgaacaaaatcaattcaattgggtaaacttttataaggaatttgcttggaaattactagactataaagataatagagcagagctggttgagaaagtaaaagctatctataccaaaacaaagatacatatgcccacgttagaaaaggacaatcacctgatagatattgatccttttacgatatttggactcttcaacaagcaaataaaagaggagaatcgcattaaaattctgacagctatagcagaattattcaacctccaaacggaaatcccatcctcttttgaaagtataccagtactgatgaatcagaatgcgactttctattattttatcggagatcgtgatgagaaagatattgatgacttatgggaacttttcattgctgctttgacctatagcaaggagcctacggctgagaagaaagaaaaattttcacactattttgatttggctataaacaagaaaggaaatggcaacagcaagattacgatggccttgtattggattgctcctgactttttcttgaacttagatagcagaaataagtggtatgtatacgaatctggggagattcctactgatgtcatcaaaaaactaccaaagatgaagtcaaaaatttctgccgatgattatttttatatctcggactctatgcatcattatttaaacagtgcagagagcaaactgaaagattttaaagaattatcatccatggcttggaaatactctaaacagatcaatcaagaagagaaggaaagaagtgctggagcaatttctccactggctgatgaaactgatactggaaacgagataggtagtgaagaggtagtagaagatagctatacgaaaaatcacttcctatcagaagtctatatgacagaagaagagtatgatcaattaacctccatactccaaatgaaaaagaatatcatcttacaaggagcgccaggagttggaaagacgtttgttgcagaacgcctagcattttcattaatgggtaaaccagatttagaaagggtcatgacaattcagtttcaccaaagctattcctacgaggacttcatcatgggctttagaccttcgacaagtggctttgagctgagaagaggggcattctatactttctgcaaaaaagcagagtctgacaagagtcatgattatttctttattatcgatgaaataaacaggggaaatttgagcaaaatttttggtgaattgtttatgctgatagaaaatgacaaacgaggcaagtctttacagctcctctactcggatgagcaattctcaattccagaaaatctatatatcatcggcatgatgaataccgcagataggagtttagccctacttgattatgcactgagacgacgctttgccttctttgacatcaagccaggtttttcaactgcgggattcaaagattatcaaacaaatctgaaaaacgaaaaattcgatagactcatttcctgtatagaaaagctaaatcaggccatttcaacagaggaagtactgggagatagcttctgtattgggcatagttacttctgcggtttatcggcagaagtactggaccaaggtttgctagaagccattgttgaatatgaactgattcccctcttgaaagaatattggtttgatgaaccgacaaaaattcatgattggagtagtaagttaaggagtgccatccagtga

SEQ ID NO: 68223 - protein, 565 aa, Streptococcus suis 89/1591
MDEQNQFNWVNFYKEFAWKLLDYKDNRAELVEKVKAIYTKTKIHMPTLEKDNHLIDIDPFTIFGLFNKQIKEENRIKILTAIAELFNLQTEIPSSFESIPVLMNQNATFYYFIGDRDEKDIDDLWELFIAALTYSKEPTAEKKEKFSHYFDLAINKKGNGNSKITMALYWIAPDFFLNLDSRNKWYVYESGEIPTDVIKKLPKMKSKISADDYFYISDSMHHYLNSAESKLKDFKELSSMAWKYSKQINQEEKERSAGAISPLADETDTGNEIGSEEVVEDSYTKNHFLSEVYMTEEEYDQLTSILQMKKNIILQGAPGVGKTFVAERLAFSLMGKPDLERVMTIQFHQSYSYEDFIMGFRPSTSGFELRRGAFYTFCKKAESDKSHDYFFIIDEINRGNLSKIFGELFMLIENDKRGKSLQLLYSDEQFSIPENLYIIGMMNTADRSLALLDYALRRRFAFFDIKPGFSTAGFKDYQTNLKNEKFDRLISCIEKLNQAISTEEVLGDSFCIGHSYFCGLSAEVLDQGLLEAIVEYELIPLLKEYWFDEPTKIHDWSSKLRSAIQ

SEQ ID NO: 68224 - DNA, 1917 bp, Campylobacter lari RM2100
  CDS (1)..(1917): transl_table=11
atgagtgatttaaaaactagtttagatgcaattaaagataaaaattttggttatttttttgataaagataaatgctatatttatcatactaaatttggtagggagagaaaagaagagattttaaaaaatgaagatattaaaacaaaatttgaaaaattaaccgaaaacatttataaagaaaatggtgatacatttggtacattaaaaaaagcttttaaggaatatttacaatattttggtgataaagatactattcatattaaattttatgaaaatggaaaatttttacgaacaaaaagcgaaattgtgaataaatttagcgaaacatttggtaaaaaaatagacgagatagatttcaatcaaggtaattttaatgatgaaacttttaaacaatggtgggataaaagtataaatagtgctagaatgcaaggtaatgccacaaatttattaaaagataaaggtaaattaattgaaaatcttaagaaaataaaagaagcagcaaagagtgaaactttaacaaaattatttgaagcgcttagtaaagtagaaggtatgagtgctactgctagagaactagcatattttttacaatttaacttagaaagtaatgataaatttccacttgcaaatgatgctatgataaatatggctaaatatatctttgaaatgctaaatgaagattcaaaaaagaagcttgaagatataaaaaaagagacaactaaaactagaaatgaagaaatatactttaactttgttttggatgaacttaaaataaatgaaaattcatataatcttccaaaatactatattttagatcaatttttaaatttgattgataagataaaaaaatctgatttggctttgattgcaaaagaaaaattagctgaaaatgatttagatcaaagtgcgtattataaactttacaaagcagcttatgattttgcaaatttatgtggcaaagcagatataaaaagcaatgatttagaaggctttaaaaagcttttaaaaacgcataaaaacatcatttttcatggaattcctggaactggaaaaacctacactatagtaaataatgtaaaaaatatcattaaaaatgaaaatcaaatgctcattactcaatttcacccaagtttttcttatgaggattttatagaaggtattaaacctgcagggattgaaaatggacaattaaaacttgagcttaaaaatggaatttttagagaattttgtgataaagcaaaagaagaagaaaaaggatttttggaaaaactcgaaaaaggaaattttaatgaagctctaagtgatcatgggtatttttttatagctgatgagattaaccgtgcggaattatctagggtttttggagaattactttatgcacttgagtatagaggagaaaaaggcaagataaaaacacaatatgcctctatgagaaatgatgaggatttttatgtgcctgaaaatgtatttttcttagggactatgaatgatttagataaaagtatagatagttttgacttagcgcttagaagacgttttatatggcaagaaatggagtgtgattataatgtaataagagatgaaatttatgcaaataatattgaagaatacgcacaagcttgtaaaaaattaaacgataaaattagtaaaaatataggtgaaaaatatcaactcggacattcttattttctaaaaattgaatttaaaaatgatgagattaaagatagtgatatgaaaaaactttttagcaaccgctttgaagcgcttttaaaagagtatttaagaagcgaatatagtgaaaaagaaatacaaaaacacttggatggtttaaaaaaactttttgttatagaaaaaccaaatgaaccaaaaccaaatgaaccaaaaacaaatgaaaaaaacaatgataaaaataaatga

SEQ ID NO: 68225 - protein, 638 aa, Campylobacter lari RM2100
MSDLKTSLDAIKDKNFGYFFDKDKCYIYHTKFGRERKEEILKNEDIKTKFEKLTENIYKENGDTFGTLKKAFKEYLQYFGDKDTIHIKFYENGKFLRTKSEIVNKFSETFGKKIDEIDFNQGNFNDETFKQWWDKSINSARMQGNATNLLKDKGKLIENLKKIKEAAKSETLTKLFEALSKVEGMSATARELAYFLQFNLESNDKFPLANDAMINMAKYIFEMLNEDSKKKLEDIKKETTKTRNEEIYFNFVLDELKINENSYNLPKYYILDQFLNLIDKIKKSDLALIAKEKLAENDLDQSAYYKLYKAAYDFANLCGKADIKSNDLEGFKKLLKTHKNIIFHGIPGTGKTYTIVNNVKNIIKNENQMLITQFHPSFSYEDFIEGIKPAGIENGQLKLELKNGIFREFCDKAKEEEKGFLEKLEKGNFNEALSDHGYFFIADEINRAELSRVFGELLYALEYRGEKGKIKTQYASMRNDEDFYVPENVFFLGTMNDLDKSIDSFDLALRRRFIWQEMECDYNVIRDEIYANNIEEYAQACKKLNDKISKNIGEKYQLGHSYFLKIEFKNDEIKDSDMKKLFSNRFEALLKEYLRSEYSEKEIQKHLDGLKKLFVIEKPNEPKPNEPKTNEKNNDKNK

SEQ ID NO: 68226 - DNA, 1398 bp, Escherichia coli
  CDS (1)..(1398): transl_table=11
atgaggaaggcacatcttatggaatcaattcaagcctggattgaaaaatttattgagcaagcacagcaaaaaagttcacaatccaccaaagattatccaacgtcttaccgtaacctgcgagtaaaagtgagtttcggttatggcaattttacatctattccctggtttgcatttctgggagaaggtcaggaagtttctaacggtatatatcccgttattctctattataaagattttgatgagttggttttggcttatggtataagcgacacgaataaaccacatgcccaatggcagttctcttcagacatacctaaaacaatcgcagagtatttccagacaacttcaggtgtttatcctaaaaaatacggacagtcctattacgcctgttcccaaaaagtctcacagggtcttgattatacccggtttgcctccatgctggacaacataatcaacgactataaattaatatttaattctggcaagagtgttattccacctatgtcaaaaactgaatcatactgtctggaagatgcgttaaatgatttgtttatccctgaaaccacgatagagacgatactcaaacgattaaccatcaaaaaaaatattatcctccaggggccgcccggcgttggaaaaacctttgttgcacgccgtctggcttacctgctgacaggagaaaaggctccgcaacgcgtcaatatggttcagttccatcaatcttatagctatgaggattttatacagggctatcgtccgaatggcgtcggcttccgacgtaaagacggcatattttacaatttttgtcagcaagctaaagagcagccagagaaaaagtatgtttttattatagatgaaatcaatcgtgccaatctcagtaaagtatttggcgaagtgatgatgttaatggaacatgataaacgaggtgaaaactggtctgttcccttaacctattccgaaaacgatgaagaacgattctatgtcccggagaatgtttatattatcggtttaatgaatactgccgatcgctctctggccgttgttgattatgccctgcgcagacgattttctttcatagatattgagcctggttttgatacaccacagttccgtaattttttactgaataaaaaagcagaaccttcatttgttgagtctttatgccaaaaaatgaatgagttaaaccaggaaatcagcaaagaggccactatccttgggaaaggattccgcattgggcatagttacttctgctccgggttggaagatggcacctctcctgatacgcaatggcttaaggaaattgtgatgacggatatcgcccctttactcgaagaatatttctttgatgacccctataaacaacagatatgggccgacaaattattaggtgactcatag

SEQ ID NO: 68227 - protein, 465 aa, Escherichia coli
MRKAHLMESIQAWIEKFIEQAQQKSSQSTKDYPTSYRNLRVKVSFGYGNFTSIPWFAFLGEGQEVSNGIYPVILYYKDFDELVLAYGISDTNKPHAQWQFSSDIPKTIAEYFQTTSGVYPKKYGQSYYACSQKVSQGLDYTRFASMLDNIINDYKLIFNSGKSVIPPMSKTESYCLEDALNDLFIPETTIETILKRLTIKKNIILQGPPGVGKTFVARRLAYLLTGEKAPQRVNMVQFHQSYSYEDFIQGYRPNGVGFRRKDGIFYNFCQQAKEQPEKKYVFIIDEINRANLSKVFGEVMMLMEHDKRGENWSVPLTYSENDEERFYVPENVYIIGLMNTADRSLAVVDYALRRRFSFIDIEPGFDTPQFRNFLLNKKAEPSFVESLCQKMNELNQEISKEATILGKGFRIGHSYFCSGLEDGTSPDTQWLKEIVMTDIAPLLEEYFFDDPYKQQIWADKLLGDS

SEQ ID NO: 68228 - DNA, 885 bp, Escherichia coli
  CDS (1)..(885): transl_table=11
atgtcaaaaactgaatcatactgtctggaagatgcgttaaatgatttgtttatccctgaaaccacaatagagagcgatactcaaacgattaaccatcaaaaaaaatattatcctccaggggccgcccggcgttggaaaaacctttgttgcacgcgtctggcttacttgctgacaggagaaaaggctcgaacgaaatatggttcagttcatcaatcttatagctatgaggattttatacagggtatcgtccgaatggcgtcggcttccgtaaagacgcatatttacaatttttgtcagcaagctaaagagcagccagagaaaaagtatatttttattatagatgaaatcaatcgtgccaatctcagtaaagtatttggcgaagtgatgatgttaatggaacatgataaacgaggtgaaaactggtctgttcccctaacctactccgaaaacgatgaagaacgattctatgtcccggagaatgtttatatcatcggtttaatgaatactgccgatcgctctctggccgttgttgactatgccctacgcagacgattttctttcatagatattgagccaggttttgatacaccacagttccggaattttttactgaataaaaaagcagaaccttcatttgttgagtctttatgccaaaaaatgaacgagttgaaccaggaaatcagcaaagaggccactatccttgggaaaggattccgcattgggcatagttacttctgctgtgggttggaagatggcacctctccggatacgcaatggcttaatgaaattgtgatgacggatatcgcccctttactcgaagaatatttctttgatgacccctataaacaacagaaatggaccaacaaattattaggggactcatag

SEQ ID NO: 68229 - protein, 294 aa, Escherichia coli
MSKTESYCLEDALNDLFIPETTIESDTQTINHQKKYYPPGAARRWKNLCCTRLAYLLTGEKARTKYGSVHQSYSYEDFIQGIVRMASASVKTHIYNFCQQAKEQPEKKYIFIIDEINRANLSKVFGEVMMLMEHDKRGENWSVPLTYSENDEERFYVPENVYIIGLMNTADRSLAVVDYALRRRFSFIDIEPGFDTPQFRNFLLNKKAEPSFVESLCQKMNELNQEISKEATILGKGFRIGHSYFCCGLEDGTSPDTQWLNEIVMTDIAPLLEEYFFDDPYKQQKWTNKLLGDS

SEQ ID NO: 68230 - DNA, 1758 bp, Lactococcus lactis
  CDS (1)..(1758): transl_table=11
atgggaaaaatcgtattaccaaaacattcatctgataaaagcgattttgttactgctcttaaaatttattatgaaaaaaaagggtgggttgaaaatcaagattttgtagatgatttaaagagggagataggtgatggtcaatacccatcttcctataataaaaaggcacagctgccaaaatatttcggatttgttataactgaaaatattaatggaagatcaccaagacaaaaaataacttctttaggtaaaactttatatgaagcattacaaaacaatgaccaactagcgatagataatgcatttatgatttcaatggaaaacattcagtttggaagaaacaaccttggaagtccatcgagtgattcggatattgaagctccaaatgttgccatgcatgcaattaaagatttaggctatattacttatttagaattagcatttattctgcagaatctagatgacaataatttagattacaatagttgcatcacagagattactaatagcagattaagtgggaattttgtgtttgatgatacgaatcgatattctgataataaacctatcatgttacttgttaacctaggaatactaactgctgatgaagtgaattctcatggacgtgttaagtcaattactttctcaactcaattcagagacagctatttaaacgatattccagatttaaagatgtacaataaaaaagaaaaatatattgtatttgaagaaacagaacgaagttttgaaaatgaatcggactatgattttgtagaacggctacaagtaggtacaaatactcttttatatggtgtacccggtgcgggaaaaagcttcactattgagcatgagtatattaatgagggctctcctcgtgaacgcttagtttttcatcctgactacacgtactctgattttgtagggcaaattttaccggtcgtaactgaagacaatgatggaaacaagaatgtgagttatgaatttacccctggtcccttcactactctattgaaagaggcctattacaatccaaaggttgaacacttccttgtcattgaagaaataaatcgtggaaatgctcctgcaatatttggagaaatttttcagctattagaccgcaaaattaaaaaaaatagcagtagttttcctattgggacaagtgagtacgagattagtaacacagatatagctaaatttgtttataataatcctaaacataaggtgcatattccatcaaatatgtctataattggaacaatgaacacttcagaccaaaacgtctttacactagatactgctttccaacgtagatggagtatgcgtttgattgaaaatacatttaagaaagatgatgtagaattagccaatactaagatattggatacttcagtaacatggaaaaaattctgtgaaacaattaatgagatcattttggataaaaatgcacgcatgacatcttctgaggataaacgtttggggactcactttattcaaattagtgatttgcagcctacggtagaaagtgaaaggtataatcgcctttttcctgaaaaggtaattaaatatctatgggatgacgctttcaaatttactagagaagaaatctttgatattgtgaattacaacagcctagagaaggtaataagagcctttattgatgcagaaggtgataaacgttttagtttttttgttgctggtgtaaaaaatttactggtgtcttcaagttctaacgatgataatgttagcactgaagaatag

SEQ ID NO: 68231 - protein, 585 aa, Lactococcus lactis
MGKIVLPKHSSDKSDFVTALKIYYEKKGWVENQDFVDDLKREIGDGQYPSSYNKKAQLPKYFGFVITENINGRSPRQKITSLGKTLYEALQNNDQLAIDNAFMISMENIQFGRNNLGSPSSDSDIEAPNVAMHAIKDLGYITYLELAFILQNLDDNNLDYNSCITEITNSRLSGNFVFDDTNRYSDNKPIMLLVNLGILTADEVNSHGRVKSITFSTQFRDSYLNDIPDLKMYNKKEKYIVFEETERSFENESDYDFVERLQVGTNTLLYGVPGAGKSFTIEHEYINEGSPRERLVFHPDYTYSDFVGQILPVVTEDNDGNKNVSYEFTPGPFTTLLKEAYYNPKVEHFLVIEEINRGNAPAIFGEIFQLLDRKIKKNSSSFPIGTSEYEISNTDIAKFVYNNPKHKVHIPSNMSIIGTMNTSDQNVFTLDTAFQRRWSMRLIENTFKKDDVELANTKILDTSVTWKKFCETINEIILDKNARMTSSEDKRLGTHFIQISDLQPTVESERYNRLFPEKVIKYLWDDAFKFTREEIFDIVNYNSLEKVIRAFIDAEGDKRFSFFVAGVKNLLVSSSSNDDNVSTEE

SEQ ID NO: 68232 - DNA, 25 bp, Primer
atgaggaaggcatatcttatggaat

SEQ ID NO: 68233 - DNA, 26 bp, Primer
ttatgagtcccctaataatttgttgg

SEQ ID NO: 68234 - protein, 421 aa, consensus
  MISC_FEATURE (1)..(421): consensus for the disclosure of xaa see table XV
GXXGXGKXXXXXXXXXXXXXXXXXXXXXXXXXXXXXXXXXXXXXXXXXXXXXXXXXXXXXXXXXXXXXXXXXXFXXXXXYXXFXXXXXXXXXXXXXXXXXXXXXXXXXXXXXXXXXXXXXXXXXGXFXXXXXXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIDEINRXXXXXXFGEXXXXXXXXXXXXXXXXXXXXXXXXXXXXXXXXXXXXXXXXXXXXXXXXXXXXXXPXNXXXXGTMNXXDXXXXXXDXALXRRF

SEQ ID NO: 68235 - protein, 88 aa, consensus
  MISC_FEATURE (1)..(88): consensus for the disclosure of xaa see table XV
XXXEXNXXXXXXXXXXXXXXXXXXXXXXXXXXXXXXXXXXXXXXXXXXXXXXXXXXXXXXPXXXXXXXXXNXXXXXXXXXXXXXXRXX

SEQ ID NO: 68236 - DNA, 354 bp, Saccharomyces cerevisiae; identical to SEQ ID NO: 55425
  CDS (1)..(354)

SEQ ID NO: 68237 - protein, 117 aa, Saccharomyces cerevisiae; identical to SEQ ID NO: 55426

SEQ ID NO: 68238 - DNA, 28 bp, Primer
atgatagttgaactttattcaaatatca

SEQ ID NO: 68239 - DNA, 25 bp, Primer
tcacttggattgattggttctagtg

SEQ ID NO: 68240 - DNA, 11449 bp, Unknown
  Unknown
gtttacccgccaatatatcctgtcaaacactgatagtttgtggaattcgagctcggtacccggggatcctctagagtcgacctgcaggcatgcaagctttgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacccccggggatccactagttctagaaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgatccccgcaagggcgccgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgcggcctccggctacgcgcgctcctcgggccgcgtcggcgtctgcatcgccacctccggccccggcgccaccaaccttgtctccgcgctcgccgacgcgctgctcgattccgtccccatggtcgccatcacgggacaggtgccgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccggggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcccggcgccctgttctttatgttggcggtggctgcgcagcatctggtgaggagttgcgacgctttgtggagctgactggaatcccggtcacaactactcttatgggcctcggcaacttccccagcgacgacccactgtctctgcgcatgctaggtatgcatggcacggtgtatgcaaattatgcagtggataaggccgatctgttgcttgcacttggtgtgcggtttgatgatcgtgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggccaacccaggtgttactgttgttgacatcgatggagatggtagctttctcatgaacgttcaggagctagctatgatccgaattgagaacctcccggtgaaggtctttgtgctaaacaaccagcacctggggatggtggtgcagtgggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctaatggtggggctttcaaggatatgatcctggatggtgatggcaggactgtgtactgatctaaaatccagcaagcaactgatctaaaatccagcaagcaccgcctccctgctagtacaagggtgatatgtttttatctgtgtgatgttctcctgtattctatctttttttgtaggccgtcagctatctgttatggtaatcctatgtagcttccgaccttgtaattgtgtagtctgttgttttccttctggcatgtgtcataagagatcatttaagtgccttttgctacatataaataagataataagcactgctatgcagtggttctgaattggcttctgttgccaaatttaagtgtccaactggtccttgcttttgttttcgctatttttttccttttttagttattattatattggtaatttcaactcaacatatgatgtatggaataatgctagggctgcaatttcaaactattttacaaaccagaatggcattttcgtggtttgaggggagtgaaaaaaaatgaggcatttgactgaattagttacctgatccattttcgtggtttggatcattggaattaaattccattctaataatagtaattttggcatatatcaattaagttaattcggttttatgcaaaatatatttgtatactattattatcaagatgtcggagatatttatatgctacatttttactatacaggagtgagatgaagagtgtcatgtaagttacacagtagaaacaaattctattaatgcataaaatcatttccatcatccaccctatgaatttgagatagacctatatctaaactttgaaaagtggttgaatatcaaattccaaattaaataagttattttattgagtgaattctaatttctctaaaacgaagggatctaaacgccctctaaagctaatttggaaactcaaactttcttagcattggaggggattgagaaaaaatattaattcattttcatctcaatcattcaatctccaaagagatttgagttccttattagtctgttccatgcatcaaatcggctcaatgtgtcattatttgccatgacgattgacgagttgttctggggcctagcgctttccacgccgatgtgctggggcctggtcctggagaagacagcttgatatttaaagctatcaattgtttcaattgattcccacttcatttttctaaatgtagaaaacggtgacgtataagaaaaagaatgaattaggacttttattccgtacactaatctagagcggccccttaaggcgctgcgatcgcgttaacagcttgctgaggaggcctcggaccgttaattaacacgtgggcgcgccactagtcaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcagggggggggggggggggggacttccattgttcattccacggacaaaaacagagaaaggaaacgacagaggccaaaaagcctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtcccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgtacggaatgccaagcactcccgaggggaaccctgtggttggcatgcacatacaaatggacgaacggataaaccttttcacgcccttttaaatatccgttattctaataaacgctcttttctcttag

SEQ ID NO: 68241 - DNA, 4510 bp, Unknown
  Unknown
acacaggaaacagctatgaccatgattacgccaagctatcgtttaaaccttaaggcgatcgcgctgaggcggaccgcacgtggaattagcttggcgcgccaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctccaccgcggtggcggccgctctagaactagtggatcccccgggctgcaggaattcgatatcaagcttatcgataccgtcgacctcgagggggggcccggtaccttggtgaactaccgatgatcgtaagagcttacagacggtgccttatataggcagagcgtcggaaggggggtggtgtcacacacgcactgcgatccttgcttacaagctaagcaaaggcatcgtggcagacaaggaataaagtggcacaggtgccaaaagaaagtggacagcacacttgtccgaaaagcacacaataatacaactcagtggagcatccactgaatgggcccagtactctccgctgcggtcatccctgacgtcaatgcctcctcaatcgtcattgcttacgtcttggagatctagcacatcttctgcggctactggcgacatagcccttggtgtggcctggtattcctcgaactcctgctcttctatcttcagcttggtgacttccttcataagttcctcctccattgtttgcacgccaccggtcttcagaacttcaagattcttgagaaattcatcaattctgtcttgaatgtgttcttcaatgagatctgcccagtaccagcaatggcatttgttcattgcgcacttgaagaatttccttcctgggttggcagatgttctggacactaactgaattgcaggcttcctgcatgcacagagtagaactggttcctctgttagcataaaagcttgctctgttctttcgaacatgtccttcttgaatgtggggaatggatccagaattttgtttccccattctctgagttgctcagtgtatggatgatctggataaggaattacttcccttatggcttgtgtaagcaggatcatctcttccgttggttcattctgagctaatttggctttgagcctggacaagatgtcagctaaaccattgctcttcccttttatgtgttcaatgactatctctggtcctgcaccagtgatgtagtccatgaacctgatccatctgatctcagaaggcttgtgttcagcactcttgttgtagaacctttcgattgcactactgtcagttctgactgtgatctctcttttgtccaagtagaacaatctcatcttttctaagccattcataaccccatagatttctgcatcacaggttccttttggcttatcaaattttccactggcatacctacagatttgctctgtatttcttgggtctgccttgtttttcttccacttgcatactgctccccatccagttgcacatgcatctgtttcaatgataatgtatgcatcttctggtggaatagtgagatttggaagcgttctcaccattgtcttgatcctattgatcagcttccaatcttctgaattgagccttcgctcacctttctctgaggtctttggatataatgggccaagaagcttgcccatatctttgatgtggtttctggcatagttcagtgttgctagccaggattaattaaaggcctgttaacagcgctgggcccgataattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttc

SEQ ID NO: 68242 - DNA, 13170 bp, Unknown
  Unknown
gtttacccgccaatatatcctgtcaaacactgatagtttgtggaattcgagctcggtacccggggatcctctagagtcgacctgcaggcatgcaagcttccggctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcagggtacccccggggatccactagttctagaaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgatccccgcaagggcgccgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgcggcctccggctacgcgcgctcctcgggccgcgtcggcgtctgcatcgccacctccggccccggcgccaccaaccttgtctccgcgctcgccgacgcgctgctcgattccgtccccatggtcgccatcacgggacaggtgccgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccggggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcccggcgccctgttctttatgttggcggtggctgcgcagcatctggtgaggagttgcgacgctttgtggagctgactggaatcccggtcacaactactcttatgggcctcggcaacttccccagcgacgacccactgtctctgcgcatgctaggtatgcatggcacggtgtatgcaaattatgcagtggataaggccgatctgttgcttgcacttggtgtgcggtttgatgatcgtgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggccaacccaggtgttactgttgttgacatcgatggagatggtagctttctcatgaacgttcaggagctagctatgatccgaattgagaacctcccggtgaaggtctttgtgctaaacaaccagcacctggggatggtggtgcagtgggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctaatggtggggctttcaaggatatgatcctggatggtgatggcaggactgtgtactgatctaaaatccagcaagcaactgatctaaaatccagcaagcaccgcctccctgctagtacaagggtgatatgtttttatctgtgtgatgttctcctgtattctatctttttttgtaggccgtcagctatctgttatggtaatcctatgtagcttccgaccttgtaattgtgtagtctgttgttttccttctggcatgtgtcataagagatcatttaagtgccttttgctacatataaataagataataagcactgctatgcagtggttctgaattggcttctgttgccaaatttaagtgtccaactggtccttgcttttgttttcgctatttttttccttttttagttattattatattggtaatttcaactcaacatatgatgtatggaataatgctagggctgcaatttcaaactattttacaaaccagaatggcattttcgtggtttgaggggagtgaaaaaaaatgaggcatttgactgaattagttacctgatccattttcgtggtttggatcattggaattaaattccattctaataatagtaattttggcatatatcaattaagttaattcggttttatgcaaaatatatttgtatactattattatcaagatgtcggagatatttatatgctacatttttactatacaggagtgagatgaagagtgtcatgtaagttacacagtagaaacaaattctattaatgcataaaatcatttccatcatccaccctatgaatttgagatagacctatatctaaactttgaaaagtggttgaatatcaaattccaaattaaataagttattttattgagtgaattctaatttctctaaaacgaagggatctaaacgccctctaaagctaatttggaaactcaaactttcttagcattggaggggattgagaaaaaatattaattcattttcatctcaatcattcaatctccaaagagatttgagttccttattagtctgttccatgcatcaaatcggctcaatgtgtcattatttgccatgacgattgacgagttgttctggggcctagcgctttccacgccgatgtgctggggcctggtcctggagaagacagcttgatatttaaagctatcaattgtttcaattgattcccacttcatttttctaaatgtagaaaacggtgacgtataagaaaaagaatgaattaggacttttattccgtacactaatctagagcggccccttaaggcgctgcgatcgcgttaacagcttgctgaggaggcctcggaccgttaattaatcctggctagcaacactgaactatgccagaaaccacatcaaagatatgggcaagcttcttggcccattatatccaaagacctcagagaaaggtgagcgaaggctcaattcagaagattggaagctgatcaataggatcaagacaatggtgagaacgcttccaaatctcactattccaccagaagatgcatacattatcattgaaacagatgcatgtgcaactggatggggagcagtatgcaagtggaagaaaaacaaggcagacccaagaaatacagagcaaatctgtaggtatgccagtggaaaatttgataagccaaaaggaacctgtgatgcagaaatctatggggttatgaatggcttagaaaagatgagattgttctacttggacaaaagagagatcacagtcagaactgacagtagtgcaatcgaaaggttctacaacaagagtgctgaacacaagccttctgagatcagatggatcaggttcatggactacatcactggtgcaggaccagagatagtcattgaacacataaaagggaagagcaatggtttagctgacatcttgtccaggctcaaagccaaattagctcagaatgaaccaacggaagagatgatcctgcttacacaagccataagggaagtaattccttatccagatcatccatacactgagcaactcagagaatggggaaacaaaattctggatccattccccacattcaagaaggacatgttcgaaagaacagagcaagcttttatgctaacagaggaaccagttctactctgtgcatgcaggaagcctgcaattcagttagtgtccagaacatctgccaacccaggaaggaaattcttcaagtgcgcaatgaacaaatgccattgctggtactgggcagatctcattgaagaacacattcaagacagaattgatgaatttctcaagaatcttgaagttctgaagaccggtggcgtgcaaacaatggaggaggaacttatgaaggaagtcaccaagctgaagatagaagagcaggagttcgaggaataccaggccacaccaagggctatgtcgccagtagccgcagaagatgtgctagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccaaggtacgcccgggtcgctcctacgcgtcaatgatccgcggacgccgagcccgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgcgccactagtcaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcagggggggggggggggggggacttccattgttcattccacggacaaaaacagagaaaggaaacgacagaggccaaaaagcctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtcccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgtacggaatgccaagcactcccgaggggaaccctgtggttggcatgcacatacaaatggacgaacggataaaccttttcacgcccttttaaatatccgattattctaataaacgctcttttctcttag

SEQ ID NO: 68243 - DNA, 16 bp, Primer
gggtcgctcctacgcg

SEQ ID NO: 68244 - DNA, 46 bp, Primer
gggtcgctcctacgcgtcaatgatccgcggacgccgagcccgagct

SEQ ID NO: 68245 - DNA, 42 bp, Primer
cgggctcggcgtccgcggatcattgacgcgtaggagcgaccc

SEQ ID NO: 68246 - DNA, 16 bp, Primer
ctcgggctcggcgtcc

SEQ ID NO: 68247 - DNA, 1278 bp, Brassica napus
  CDS (11)..(1096)
agaaaccacaatggcttcaatgactctaggttcattggttcaccaccatcatccttctatctttacccgatcttcttccctcacgactcttaaacccatcgtcatcaactcaaaacgcaccgtttcatcatcatcatcttcctacatcgtctcctcttccatcgtcactaaaaaagacaaccacaattacaaatcatcatccttcgacttcatgtcttacatggtcagtaaagccgagtccgtcaacagagccttggacttggccgttcctctccaagaaccactcaagatccacgaagccatgcgctactctctcctcgccggaggcaaacggatcaggccccttctctgcatcgccgcttgcgagctcgtcggaggcgaagcatccgtcgctatgccggcagcttgcgccgtcgaaatgctccacaccatgtccttaatccacgacgatctcccgtgcatcgataacgacgatctccgccgcgggaaacccacgaaccacaaagtcttcggcgaaaacgtcgcccttttggccggagacgcgcttcttccctttgccttcgagcatttagtgtcggcgacgagtcccgtggtttctccggtgagactggttcgaggcgtgggagaattggctaaagccgttggcgtcgaaggcgtcgcggctggacaagtggcggatataagcagcgaagggttggacccaaacgacctcggtttggagcatttggagtttatccatttgcataaaacggcggcgttgcttgaagcctctgcggtgttgggtgggatcgttggaggagggagtgacgatgagatcgagaggctgaggcaattcgcgaggtgtgttggtttgttgtttcaggtggttgacgacatcttggacgtcacgaaatcgtctcaagaattaggtaaaactgctgggaaagatttggttgctgataagctgacgtatccgaagattatggggttggagaaatcgagagagttcgctgagaagttgagtagagatgctcgtgaacagcttttagggtttggttccgaccaggtggctcctttgttggctttggctaattacattgccaatagacagaactgatgtgtgttttctttcttacttgttagaatcattcgagattttattctctggtcttgtttcagattgaattgtataaaatattggagaagctgaaacagattcttgtgcttgtttgttggtgtaacctctatgtttccgtgtactacaagatagttatgtgtttaaaagaaaaaaaaaaaaaa

SEQ ID NO: 68248 - protein, 361 aa, Brassica napus
MASMTLGSLVHHHHPSIFTRSSSLTTLKPIVINSKRTVSSSSSSYIVSSSIVTKKDNHNYKSSSFDFMSYMVSKAESVNRALDLAVPLQEPLKIHEAMRYSLLAGGKRIRPLLCIAACELVGGEASVAMPAACAVEMLHTMSLIHDDLPCIDNDDLRRGKPTNHKVFGENVALLAGDALLPFAFEHLVSATSPVVSPVRLVRGVGELAKAVGVEGVAAGQVADISSEGLDPNDLGLEHLEFIHLHKTAALLEASAVLGGIVGGGSDDEIERLRQFARCVGLLFQVVDDILDVTKSSQELGKTAGKDLVADKLTYPKIMGLEKSREFAEKLSRDAREQLLGFGSDQVAPLLALANYIANRQN

SEQ ID NO: 68249 - DNA, 1915 bp, Glycine max
  CDS (345)..(1625)
gaattcccgggtcgacttcgctgtcgagccatcctaagcaagcagcatgagtcacagatttcattctctctccaactgataagaaacgtagttccatgtgggctcttaggatccactcacttaactctaaactcgtcgtgtgtgttccttctttccacttcaaacttgtgacccagaaaaaagaccctttccattctcctccttttcttcctcctccactggctgcacctcgctgccgtgtctctgcctagcgtgaaattggcctcatttcccatctgggtcctgtgaattgcgattggaaccgcgttttccccgcttctgggcttggctcagaagtagtcagaatgatgtctgtcacaggcaaaagcattgattttgctggcaaaaacttggtctcttgtggctgctcttccaatgcttcttcgtttgataggtacactgtgaggaactatgccaagctgaatagtaataattctaaagggtgtggcagagatcatggggctcgtaaattggtttgttgtaagaagaggagcactcattgtcgggtttcttctatgaagactgcacagcctacggtgaatggggggactcatgcatttgaaggccttaccacaggattggacttgaagggttattcagaagaccccatttcccctgctaggctttttgaagtggttgccgatgatctgctaactctcaataaaaatcttcagtcgattgtaggagcagaaaatccagttttgatgtctgcagctgagcagatttttagtgctggtggaaagaggatgagaccagctttggtgttcttggtgtcaagggcgactgcagagttacttggcttgaaggaacttactgcaaagcatcgacgtttagcagagataattgaaatgattcatactgcaagtttgatacatgatgatgtactagatgagagtgaccttcgacgagggaagaaaactgttcatcaaatgtttggaacaagagttgcagtgctggctggagacttcatgtttgcacagtcatcatggtatctagccaaccttgaaaatattcaagtcattaaactcatcagtcaggtgataaaagattttgcaagtggggaaataaagcaggcttcaagcttgtttgattgtgatgtacaacttgacgagtatctaattaagagctattacaagacagcatccttgattgctgccagcacaaaaggagccgcgatctttagtggtgctgacagcagcgtgactgagaaaatgtacgaatatggaaggaatcttggtctatccttccaagttgtggatgacatattggatttcactcaatcagccgagcaactgggaaagcctgctggcagtgaccttgccaagggcaacctgactgcaccagtaattttcgcactggagaaagaaccgaaattgagggatatcatcgagtctgaattcagtgaggttggttcccttgaggaagccatcaatttggtcaagagttgtgggggcattgaaagagcacaagagttagcaaaagagaaagccgatcttgcaattcaaagtctccaatgcctacctcagagtgtatttcgtttagcccttgaagatatggtggcatataaccttcaacggattgcataagcttgtgcatgctgatgacacattgttaaagaaaaaacacaaaaagattcttttggtcctaatatagggatgagagagccttgaactttttgtcatttcaagaatttcaagcaaatctacacttgtgctacttttggggtacttttatagtcattgaagggcaaagcaagcgcgcattctcatcatttaatatatttgcagcttcctgcaaagtacaagaacataatatattccattattgtatcaatacaagtctgcagtatattctttccccccaaaaaaaaaaaaaa

SEQ ID NO: 68250 - protein, 426 aa, Glycine max
MMSVTGKSIDFAGKNLVSCGCSSNASSFDRYTVRNYAKLNSNNSKGCGRDHGARKLVCCKKRSTHCRVSSMKTAQPTVNGGTHAFEGLTTGLDLKGYSEDPISPARLFEVVADDLLTLNKNLQSIVGAENPVLMSAAEQIFSAGGKRMRPALVFLVSRATAELLGLKELTAKHRRLAEIIEMIHTASLIHDDVLDESDLRRGKKTVHQMFGTRVAVLAGDFMFAQSSWYLANLENIQVIKLISQVIKDFASGEIKQASSLFDCDVQLDEYLIKSYYKTASLIAASTKGAAIFSGADSSVTEKMYEYGRNLGLSFQVVDDILDFTQSAEQLGKPAGSDLAKGNLTAPVIFALEKEPKLRDIIESEFSEVGSLEEAINLVKSCGGIERAQELAKEKADLAIQSLQCLPQSVFRLALEDMVAYNLQRIA

SEQ ID NO: 68251 - DNA, 1548 bp, Zea mays
  CDS (239)..(1219)
gccgagccggggtctgctcagcctgtaagcgtcagcgtgttccagttccagcttctatttttgctccaaacaagtcgtgctccactagggatcctatccagattcgtggggacacccccgtccagttccagccttccaacttccaaccctctcctctccgcaggctgtagcatttgtcgggttggattgggttgttccgcttgggtagcctggtgggatcgaaatctgtgtgggatccatggcggcggtcgaggggacgacgaagaagaaggtaatcatcgacaccgaccccggaattgacgacgcgatggccatcttcgtggcactgcggtcgccggagctggaggtgctgggcctcaccactaccttcggcaacgtccacaccgccctcgccacgcgcaatgcgctccacctgttggaggctgttggaaggactgacatccccgtcgcagagggatcccatgtaacaatcaagaaagccaccaagctgaggatcgcaagctttgtccacggttctgacggcctgggaaaccaggatttccctccaccggctaccaagcctgtagatcagtcggctgctgccttcctggttgagcaagcaaatctgtaccctggacaagttaccattgtcgccctcggtccactgaccaaccttgctctggcagtggagcttgacccttcgttcccaaagaagatagggcagattattattcttggaggtgcgtattcagttaatggaaatgtgaaccctgcagctgaggcaaatatctttggggatcctgatgcggcagatattgtgttcacctgcggtgctgatattttggccgtgggactaaatgtaacccaccaagtagttctaactgatgctgacagggagaagcttgaacagtgtgatagcaaatatgcccgctacttatgcaagataatgggcatttattttgattaccacaaggatgcctacttcattaaaggagtgtatcttcatgatccaacaacggttattgctgctgtgaatccatcgctgctgacttacacagaaggtgttgtgagggtacagacggttggaatcacaaagggccttactgtttttgataacaccaagaaaaggtacggagagatcacagcctggagtggcatgcccaccgtgaaggttgctgtcaccgtcgatgcccctgccgtggtagagctgatgatgcagaggttgatgactgatgactagcagcaataccagctaattggcagcgccaccattaagacaatttccagttcttaagggagaaacaaatgttggaacatggaagtgcatttgttgttcaccagaaatttggtcgtcttgtcatcaaaacaccagaattgcattattgcacgctagctactcatttctttggtaattatgtgcgtgcttggtgtttatgtacagttttatgtgcttgataatgggcacatggccagttcgacaatgtcatacagttatactatactagtacattgcttatgcttgtgagagaacagaataaagttaaatgaagagccaaaaaaaaaaaaaaa

SEQ ID NO: 68252 - protein, 326 aa, Zea mays
MAAVEGTTKKKVIIDTDPGIDDAMAIFVALRSPELEVLGLTTTFGNVHTALATRNALHLLEAVGRTDIPVAEGSHVTIKKATKLRIASFVHGSDGLGNQDFPPPATKPVDQSAAAFLVEQANLYPGQVTIVALGPLTNLALAVELDPSFPKKIGQIIILGGAYSVNGNVNPAAEANIFGDPDAADIVFTCGADILAVGLNVTHQVVLTDADREKLEQCDSKYARYLCKIMGIYFDYHKDAYFIKGVYLHDPTTVIAAVNPSLLTYTEGVVRVQTVGITKGLTVFDNTKKRYGEITAWSGMPTVKVAVTVDAPAVVELMMQRLMTDD

SEQ ID NO: 68253 - DNA, 1401 bp, Linum usitatissimum
  CDS (220)..(1224)
tgcttttctggattttcaagattggggtggcccagctcctcacattcaccttaataatcatccatcctcatcgacgtcgcagccgcagtaacttcctcgtcgcggttgccgttgtctccccctcgccgttgttaaagcaatttcttcacgtttctctgatcgtcgttccggtttctggtctgagatccccaagaagaattttgatcgtttttctccggaatggcgcaaaccaatggtgtagttcccgacggcctatttgcttcttctgctaagcctgggaagcttattatcgatacagaccctgggatcgatgatagcatggcaattttgatggcttttcaaactcctgaagtagaaatcttaggcttcacaacagtatttggtaatgttgccacagaagatgccactcgcaatgctttgcttctgtgtgagattgctggccgtcctgatattccggttgcagagggctctcatgaacctctaaagggagggaagccccgtgttgctgactttgtccatggctctgatggtctgggaaacacatacttgtctcccccaaacgcagagaaaagtccaaagactgctgctcaatttttagttgacaaggtgtcagagttccctggtgaagtatcggtccttgcgcttgggccattgacaaatgtggccttggcaatcaaaagggactcctcatttgcaagcaaagtaaaaaagattgtagttcttggcggagccttctttgctttgggaaatgtaaaccctgctgctgaagcaaatatctatggagatccagaagcagcagatgtcgtgtttacatctggagcagacattgttgtcgtgggaataaacattacaactcaagtaaaactaacggatgctgaccttcttgagttgaggcagtcgaaagggaagtatgctcaggtaatatgcaatatgtgcaagttctacagggattggcatgtgaagtctgatggaatccacggcatttttcttcatgatccggtgagctttgtggcggtagttcggcctgatctgttcacatataggaagggagttgtgagggtggagactcagggaatctgtgtagggcacaccctaatggaccaagggctcaaaaactggaattcaagcaacccgtggtctggatactcgccggtgtcagtagcgtggacggttgacgtggacaaagttcttgcatatgtgaagaagcagctgacaaaagcatgaatgagggttgaatcccttttgtaaaaaagtagcaatggcagggatggacatggtggtagttgatgctgaagcttgaagcaatagttgatggattacgggtcggctccttcccactgtgattgatataaaaaaacattccatttaaatttgaactttttctgtaaaaaaaaaaaaaaa

SEQ ID NO: 68254 - protein, 334 aa, Linum usitatissimum
MAQTNGVVPDGLFASSAKPGKLIIDTDPGIDDSMAILMAFQTPEVEILGFTTVFGNVATEDATRNALLLCEIAGRPDIPVAEGSHEPLKGGKPRVADFVHGSDGLGNTYLSPPNAEKSPKTAAQFLVDKVSEFPGEVSVLALGPLTNVALAIKRDSSFASKVKKIVVLGGAFFALGNVNPAAEANIYGDPEAADVVFTSGADIVVVGINITTQVKLTDADLLELRQSKGKYAQVICNMCKFYRDWHVKSDGIHGIFLHDPVSFVAVVRPDLFTYRKGVVRVETQGICVGHTLMDQGLKNWNSSNPWSGYSPVSVAWTVDVDKVLAYVKKQLTKA

SEQ ID NO: 68255 - DNA, 1317 bp, Hordeum vulgare
  CDS (105)..(1079)
ccgctcatccacttggctctgctcgcatcttccttgtcgattccatttcggttccccttgccttgctaagggaagggaagggaagggaagggatccggacggcgatggggcaggacgggcagatccgccgcgacagggtcatcatcgacacggatcccggcatcgatgacagcatgacgatcctaatggcttttggagaaccaagtgtggagatcattgggctgacaaccatattcggcaatgtcactacagagtatgctacacgcaatgcgctcttgctgtgtgagagagcagggcatcctgaggttccagtagcagagggcagccctgagcctcttaagggaggagagccacgcgttgctgactttgttcatggatccgatggtcttggtaatttgtctcttcctgcacctaccagtaagaaggttgaggaaagtgctgccgagttcatggttaataaggtctctcagtttcctggagagatatctgtacttgcattgggacccctgacaaatgtcgcattggccatcaaaagggactcgtcatttgcaagcaaggtcaaaaaaatagttgtgctgggtggagctttcttcgcagctggaaatgtcaaccctgctgctgaagcaaatatctatggagatccggatgcagcggatgtagtttttacatcaggagcagctattgatgtggttggcattaacataacaactcaatgctgttttacagacgaggatctcttggaactgaaaaactcaaaaggggtgcacgcacagttcttgtgtgacatgtgcaagttctacagagattggcatgcgaagtctgacagctttcatgggattttcctacatgatcctgtgagctttacagccttagttcatcccgagtacttcacattcaagaagggtgttgtgagagtcgagacccagggcatttgcaccggccatactttgatggatcatggattgaaaaagtggaattcagaaaatccatggtcgggttatgcaccaatttcagttgcatggacagtcaatgtgccaaaggtccttgcatatgtaaagaagctgctgatggcaccctgagaatagaaccagaggtctattctgaatctttgagccgaagtgtaatggttcaggtcaactctcatggccaaagtatatttttctgtttttagaagcaagcataggaggaagggaagcttcctagtgcaaagcaaccaatgggggtaaattctgcacatgacagacagcattgtgacagcattgattccaaacatttatatatacaactacatttcaaatttggaaaaaaaaaaaaaaa

SEQ ID NO: 68256 - protein, 324 aa, Hordeum vulgare
MGQDGQIRRDRVIIDTDPGIDDSMTILMAFGEPSVEIIGLTTIFGNVTTEYATRNALLLCERAGHPEVPVAEGSPEPLKGGEPRVADFVHGSDGLGNLSLPAPTSKKVEESAAEFMVNKVSQFPGEISVLALGPLTNVALAIKRDSSFASKVKKIVVLGGAFFAAGNVNPAAEANIYGDPDAADVVFTSGAAIDVVGINITTQCCFTDEDLLELKNSKGVHAQFLCDMCKFYRDWHAKSDSFHGIFLHDPVSFTALVHPEYFTFKKGVVRVETQGICTGHTLMDHGLKKWNSENPWSGYAPISVAWTVNVPKVLAYVKKLLMAP

SEQ ID NO: 68257 - DNA, 1209 bp, Helianthus annuus
  CDS (1)..(975)
atgttcaactgcaatggtggaatctctgaaaagattatcattgatacggatccgggcatcgatgatagcatggcgatcatgatggcttttcagacaccaaatttggagatcttaggattgacaacgatatttggtaacgtttctacaagggatgcgactcgaaacgccttgcttctgtgtgagattgcaggatatccaagtgttcctgttgccgagggtagtccagaaccgttaaagggaggggagccagagattcaagattttattcacggatccgatggattagggaacctaaatctaccgccccccaaatcgaagaaagtagaaaaatcagcatcagaatttttagttgataaagtttcggaatatcccggtgaagtatctatacttgcacttggcccgctaacaaatttggctttggcaatcaaaagggactcctcgtttgtaaccaacgttaaaagaatcgtcatactcggtggtgctttctttgcaagtggaaacattaatccggccgctgaagcaaacatatatgaggatcctgaagcagcagatattgtattcacttctggcgcaaatatcgacgttgttggcataaacatcacaacacaagtgaaaatgtcagatgaggatcttgatgaacttaagcgatcgaacgggaggcatgctcggtttttgtgggatagttgtaaattctaccgcgattggcatgtgaaatctgatggtgtttatggaattttccttcatgaccctgtttgtttcgtggcactagttcgacccgatcttttcaccttcaagaaaggggtcgttagggtcgaaacacaaggtctctgtgttggacataccctaatggaccaagggttgaagagatggaattctgaaaatccttggacaggctataaaccagtttcagttgcgtggacggtgaacgttgacagggttcttagttacattaaaaacgtgttaatgatggcgtgatttaaaaagatcacgagttaaaaaaaaataaacaatatttatgtgttcctcttggtctttgtttaatccttatttatggaaatatggggaactaagattattagattttcaccatgaacaatcacatttaatatcactatatgtaaggggtagttgttggtggaactcttatatgaggtacaacctagtacccttgtaatatgattttctcttacttttaaaaaaaaaaaaaaa

SEQ ID NO: 68258 - protein, 324 aa, Helianthus annuus
MFNCNGGISEKIIIDTDPGIDDSMAIMMAFQTPNLEILGLTTIFGNVSTRDATRNALLLCEIAGYPSVPVAEGSPEPLKGGEPEIQDFIHGSDGLGNLNLPPPKSKKVEKSASEFLVDKVSEYPGEVSILALGPLTNLALAIKRDSSFVTNVKRIVILGGAFFASGNINPAAEANIYEDPEAADIVFTSGANIDVVGINITTQVKMSDEDLDELKRSNGRHARFLWDSCKFYRDWHVKSDGVYGIFLHDPVCFVALVRPDLFTFKKGVVRVETQGLCVGHTLMDQGLKRWNSENPWTGYKPVSVAWTVNVDRVLSYIKNVLMMA

SEQ ID NO: 68259 - DNA, 769 bp, Brassica napus
  CDS (43)..(588)
gggtttcgtttttttcagagagatagagagaatctggaagagatgagttacggacaagacaccggtgttgagaggcgcaagggctctgtcaagtggttcgacacacagaagggattcggcttcatcactcccgacgatggcggcgacgatctcttcgttcaccagtcctccatcagatctgaggggttccgaagcctcgccgcggaggagcctgtcgagttccaggtcgagaacgacaacaacggccgtcccaaggcgatagaggtgtctggacccgacggcgctcctgtccaaggcagcagcggtggtggctcgtcaggaggacgcggcggatttggaggcggtggaagaggtggaggtcgtggattcggcggcggaagaggtggtggtcgaggaggaagcgactgttacaagtgtggtgagccaggtcacattgcgagagactgttccgaaggtggaggaggatacggaggaggaggagggagaggtggttatggaggtggtggtggaggtggcggcggagggagctgttacagctgtggcgagtcggggcatttcgccagggattgcactagcggtggacgttgatcagatcgagaagcattctcgtagcttattatctatttattgttcgcttttttgcttgtgatggatctctttcgtttcttggtttattttcggttatcggtttaatcacgttgatggttattttgtttatgcgttttgacggtttaatgtggtgtttgtgatggataaaaaaaaaaaaaaa

SEQ ID NO: 68260 - protein, 181 aa, Brassica napus
MSYGQDTGVERRKGSVKWFDTQKGFGFITPDDGGDDLFVHQSSIRSEGFRSLAAEEPVEFQVENDNNGRPKAIEVSGPDGAPVQGSSGGGSSGGRGGFGGGGRGGGRGFGGGRGGGRGGSDCYKCGEPGHIARDCSEGGGGYGGGGGRGGYGGGGGGGGGGSCYSCGESGHFARDCTSGGR

SEQ ID NO: 68261 - DNA, 565 bp, Glycine max
  CDS (34)..(330)
ggaaaaaaaaaaacttgtgtttcttgggaagccatgagcaccaccgagagtcaaagatataagggcacagtgaaatggttcaacgaggagaagggtttcggtttcataactcccgaagatggtggctctgatctcttcgttcactacagtgcgatccaaaccgacggcggcttccgcaccttggcggagggtcagtcagtagagttcctcgtcactcaggacgacagcgggcgagccgcggccgtcaacgtgacgaccaccatggttaaatctagtgacagcggtaacggggaaaactctggtggtgatgctgccaatgttgagaaataagtgagaatgaattattggagtttcctgaattgcgagtatgatatttatattgatagttggacaatatactagtccattggtattttatattttattatattatctctggttattggcatttggttccaaacttgtaatacatttatcatgtgtttgacgtggttatgtagtaagttgttggatgtgtcgaattaatgtcaaataaaaatatatttatactaaaaaaaaaaaaaaa

SEQ ID NO: 68262 - protein, 98 aa, Glycine max
MSTTESQRYKGTVKWFNEEKGFGFITPEDGGSDLFVHYSAIQTDGGFRTLAEGQSVEFLVTQDDSGRAAAVNVTTTMVKSSDSGNGENSGGDAANVEK

SEQ ID NO: 68263 - DNA, 1065 bp, Linum usitatissimum
  CDS (36)..(650)
gggtttttcaaattgatctgatcggcggccaaaaaatgagtgacagactatcggggaaggtgaagtggttcaatgaccagaagggctatggcttcatcactcaggatgacggcggcgaggatctcttcgttcaccagtcctccatccgcaccgaaggcttccgcagcctagccgagggagaagaagtcgagtaccagatcgagaactccgatgacggacgcaccaaggccgtcgatgtctccgggcccaaaggagctcctgttcagggcggatctggcggcggaggaggcggtagaggcggcggaggtcgcggatacggaggaggcggctattcaagcggcggctacggaggtggcggcggatatggaggaggtggcggtggatacggtggcggaggaggtggatatggtggtggtggaagaagcgggggcggtggtaacgggtgctacagctgtggcgagtctggccacatggctagggactgccctaccggaggcggcggtggtgacaggtacggaggaggtggcggcggtggaaggtatggaggaggtggcggcggaggacgcggtggtggtgaccgtggttgctacaactgtggcgagagtggccacttcgccagggagtgtcccactgccggcggtggacgttgatctccttccgatcaagtgtgtttgatttcaggttgtgaatcttatttcacatcttgcaaatctgttgttccaaatcgttagtgattggcctttgttttttaaatttcagtatgtttggattatgaacttgtgcttttgtctctcggatgtttggatcgatgttggtttttgatcttgtgattgcttatgctctgtgaagaaagatctcttaaaggtcttttctctgatgggtgtttaagctttttgttagggttagtagtcagcagtatagagagatcaatggagttgaatgtgatgtgatgtggatcttgatctttggtaaaagaaaactctcgactgttcttctgaagtgttatcatacacagattctatatatatgggaatggttatcagcttgtccaaaaaaaaaaaaaaa

SEQ ID NO: 68264 - protein, 204 aa, Linum usitatissimum
MSDRLSGKVKWFNDQKGYGFITQDDGGEDLFVHQSSIRTEGFRSLAEGEEVEYQIENSDDGRTKAVDVSGPKGAPVQGGSGGGGGGRGGGGRGYGGGGYSSGGYGGGGGYGGGGGGYGGGGGGYGGGGRSGGGGNGCYSCGESGHMARDCPTGGGGGDRYGGGGGGGRYGGGGGGGRGGGDRGCYNCGESGHFARECPTAGGGR

SEQ ID NO: 68265 - DNA, 816 bp, Brassica napus
  CDS (8)..(697)
cccaaccatgtctccatggaaccctccaacccctcgtctcctcctcaaaaacgtctcctgcatgagaaacgcccagcagatcctccgacacgtcaacgtatccctccacgacggcggcgcgctcgtcctaaccggaaccaacggatccggcaaatcaaccttcctgagaatgctcgccgggttctcaaagccctccgcgggagaaatcctctggaacggccacgacatcacgcaatcaggggtcttccagcagtacaaactccagctcaactggatctctctgaaagacgcaatcaaggagaggttcacggtcctcgacaacgtccagtggttcgagctcctcgagaacaagatcgggaaagcgcagccggcgctggagctgatggggctagggaggctggtgaaggagaagtcgaggatgctgtcgatgggccagaggaagaggctgcagctcgcgaggctgttggcgattgataggcccatttggcttttggatgagccctccgttgcgttggatgatgaaggggttaggttgcttgagtatgttatcggggagcataggaagaaaggtgggattgtgattgttgcgactcatcttccgattgagattgaagatgctatgatcttgaggctccctcctaggtttcctaggaagatgactttgattgatatgcttgatcgtgctgacatttcttagccttagatgctatgggattgttttttgttttgtgttgttttttgttttttttgtttgtacttgtgtaatggaatcaaataatggatttgggacgagttaaacgtaaaaaaaaaaaaaaa

SEQ ID NO: 68266 - protein, 229 aa, Brassica napus
MSPWNPPTPRLLLKNVSCMRNAQQILRHVNVSLHDGGALVLTGTNGSGKSTFLRMLAGFSKPSAGEILWNGHDITQSGVFQQYKLQLNWISLKDAIKERFTVLDNVQWFELLENKIGKAQPALELMGLGRLVKEKSRMLSMGQRKRLQLARLLAIDRPIWLLDEPSVALDDEGVRLLEYVIGEHRKKGGIVIVATHLPIEIEDAMILRLPPRFPRKMTLIDMLDRADIS

SEQ ID NO: 68267 - DNA, 1211 bp, Glycine max
  CDS (111)..(893)
gaattcccgggtcgacatttcgtggcaggctgtttctggtttcaacttgttatgatggtgtcatcttctccattctcattctcattctctgtcgctcacggctagcaatcatgtcttctcgcttagatgagtgcttgttggaggtggatgggtacggtgatggcgatggaaaggcgaaacccaaattcctgataaggaatctcagcagagtttcggaggatggggttcccatcctcaaaggcataaatcttgagatcccagagggtgtgatcgtgggagtgataggccccagtggtagcggcaagtcaacgttcttgagggcccttaaccgcctctgggagccaccctccgcctccgtcttcctcgacgcccaagacatctgccatctcgatgtcctctctctccgccgtaacgttgccatgctctttcagctcccggccctctttgaaggcagcgttgcggacaatgtgaggtacggaccacaactcagagggaaaaagctaagcgatgatgaggtgcgcaagttgcttctaatggccgacctggatgcttctttcatggataagtccggggctgaactctctgtcggtcaagctcaaagagttgcacttgctaggactttagctaattcaccccaggttttgttgctggatgagccaactagtgccttagatccaatatcgacagaaaacatagaggatgccctggtgaagctgaacaagaatcagggcatgacagtcatcatggtctctcatagcatcaagcaaatccaaaggatcgctcacatagtgtgcctgcttgttgatggtgaaattgttgaagttctcaaccctcataatctctctcaggccaaccatcccatggctaagaggtttcttcaactcagttcttaaagccaagataaatctacttgcacctgctcgtttatcggccacatatatatgttcacctctcctcgattcatatctttcaatcaattatcttccacatatgttgctttaatttcaagacgtgcaggttgatgacatatatatgattttatgatagtggaggtttagttaccaatatgatattgcaaaatgctactatagaataggaatttcgtttttcaccaaaacaaaactattgtccacagttttttctatttgcaatacaaccaattggatgtaagcgtactctttggtacaagtttcgtgaaaaaaaaaaaaaaa

SEQ ID NO: 68268 - protein, 260 aa, Glycine max
MSSRLDECLLEVDGYGDGDGKAKPKFLIRNLSRVSEDGVPILKGINLEIPEGVIVGVIGPSGSGKSTFLRALNRLWEPPSASVFLDAQDICHLDVLSLRRNVAMLFQLPALFEGSVADNVRYGPQLRGKKLSDDEVRKLLLMADLDASFMDKSGAELSVGQAQRVALARTLANSPQVLLLDEPTSALDPISTENIEDALVKLNKNQGMTVIMVSHSIKQIQRIAHIVCLLVDGEIVEVLNPHNLSQANHPMAKRFLQLSS

SEQ ID NO: 68269 - DNA, 1996 bp, Glycine max
  CDS (506)..(1768)
ttgcttcacgttcccaaaagaaaaagtttaagagtattactacaataaaactaggaacttgttaagattcagaaaacattttttagttttcaattttggtttatacaattattaattttttttatttaattcaaaggtttctgaagataaaaaataaaaatacaaaaccaaacatgtcccaagtgtttctaatgttcttgtctttttgtttaggtgtactttgaatattttttggtgtactcatgttcttgtctatttcactgtttgtatcaatgtggaatgttagtaacacattctataacatattattatttcttaaaatttatctgaaactacaaaatcataaccgagactcattcaatatagagtgaaacctacaaaattcttaataagttttagtcattaataatgtgttttgctagcatttttctgatttcaaataatttaatcttagaagttagaacatcctaggaatctaacttggtttgtgtagaattagaacattatgctgttgattaagtgccaatggaatgattttctctgtctttggattctgcagcaactatctctaaaagggtttgctggagacacagccaaggctcatgcaaagacaagtatgatagcaggagagggagtgagcaacatcagaacagttgcagcattcaatgctcagaacaagatgttatcggtgttctgccacgagctccgagtgcctcagagccagagcctgcgccggagcctgacatccggcttcttgttcggtctctctcagcttgccctctatgcctccgaggctctcattctatggtatggtgcacatttggtcagcaaaggtgtttcaaccttctcaaaggtcatcaaggtgtttgtggtcctagtgatcactgcgaattcggtggctgaaaccgtgagccttgcaccggagattattcgcggtggcgaagctgttggttcagtgttctcaatcctcgatcgatcaacaagaattgaccctgatgatcctgatgctgatccggttgaatcgcttcgcggggaaattgagctcagacatgttgattttgcatacccttctaggcctgatgtgatggtgttcaaggattttaaccttaggatccgtgcaggccagagtcaggctcttgtgggggcaagtggttcggggaagagttctgttattgcattgattgagagattctatgaccttattgctggaaaagtgatggtggatggaaaggacattaggaagttgaacttgaagtctttgaggcttaaaattgggttggtgcagcaagagccagcactttttgcagcaagcattttcgagaacattgcatatgggaaagaaggtgcaaccgaggctgaggtgattgaggccgcgcgtgctgcgaacgtgcacggatttgtgagtggtttgcctgaaggttacaagacaccggttggcgagagaggcgtgcaactctctggagggcaaaagcaaaggattgccattgcaagagccgtgcttaaggaccccacaattcttctactagatgaggccacaagtgcacttgatgctgagtccgagtgtgtgctacaagaggccttggagaggctaatgaggggtcgcaccacggtgctcgtggctcatcgtttgtcaaccattagaggggttgattgcattggtgtggttcaagatgggcgcattgtggagcaaggtagccattctgaacttgtcagcaggcatgagggggcatattctagactcttgcagctacaacatcatcacatatgagaatatgagagaaagagattattgttttttttgtatttgataaatatgaccttgtgggggtgataattatgtttgggtcccattaacctcatgctttggtttttctttttttctttcttttagatgtagatatgtgggatatgaggtttgtagcttgagttcaaagtgatctatttccaatggggtatcaattattatatttaatcacatgtcaaaaaaaaaaaaaaa

SEQ ID NO: 68270 - protein, 420 aa, Glycine max
MLLIKCQWNDFLCLWILQQLSLKGFAGDTAKAHAKTSMIAGEGVSNIRTVAAFNAQNKMLSVFCHELRVPQSQSLRRSLTSGFLFGLSQLALYASEALILWYGAHLVSKGVSTFSKVIKVFVVLVITANSVAETVSLAPEIIRGGEAVGSVFSILDRSTRIDPDDPDADPVESLRGEIELRHVDFAYPSRPDVMVFKDFNLRIRAGQSQALVGASGSGKSSVIALIERFYDLIAGKVMVDGKDIRKLNLKSLRLKIGLVQQEPALFAASIFENIAYGKEGATEAEVIEAARAANVHGFVSGLPEGYKTPVGERGVQLSGGQKQRIAIARAVLKDPTILLLDEATSALDAESECVLQEALERLMRGRTTVLVAHRLSTIRGVDCIGVVQDGRIVEQGSHSELVSRHEGAYSRLLQLQHHHI

SEQ ID NO: 68271 - DNA, 1513 bp, Brassica napus
  CDS (82)..(1320)
gcttggaagatttcaagctctctaagaaagtctttcacttttgttctcaatctctctccatcctactcactctcccaagtcatggcaggatcagcacctgaaggcacccagttcgatactcgtcagtttgaccagaggctcaatgaagtccttgagggacaggatgagttcttcacctcctatgatgaggtccatgagagctttgatgccatgggtttgcaagagaaccttcttaggggtatctatgcctatggttttgaaaagccttctgctattcagcaaagaggaatcgttcccttctgcaagggtcttgatgtgatccagcaggctcagtctggtactggcaaaaccgccactttctgctctggtgtcttgcagcagcttgacttctccctcgtccagtgccaggctctcgtcttggctcccaccagagagcttgctcagcagatcgagaaggtcatgcgtgctctcggagactaccttggcgtcaaggtccatgcttgtgttggtggaaccagtgtccgtgaggatcagcgcattctccaggccggtgttcacgttgtggttggaactcccggtcgtgtctttgacatgctccgaagacagtctcttcgctctgactccatcaagatgtttgtccttgacgaagctgatgagatgctctcccgtggtttcaaggatcagatctacgacatcttccagcttctcccaccaaagattcaggtcggagtgttctcagctacgatgccaccagaggctctcgagatcacgaggaagttcatgagcaaaccggtgagaatcctggtgaagcgcgacgagctcacgcttgagggtatcaagcagttctacgtgaacgtggagaaggaagagtggaagctcgaaactctctgcgacctctacgagaccttagccatcactcagagcgtcatcttcgtcaacactcgccgcaaggtggactggctcactgacaaaatgaggagccgtgaccacacggtgtcagccactcacggagacatggaccagaacacgagagacatcatcatgagagagttcaggtctggttcctcccgtgtcctcatcacgacggatctcttggctcgtggtatcgatgtgcagcaagtgtctctggtcatcaactttgacctcccgactcagccggagaattaccttcaccgtatcggaagaagtggaaggtttgggaggaaaggtgtggcaattaactttgtgacgaaggatgatgagagaatgctttttgatattcagaaattctacaatgttgttgttgaggagcttccctcaaacgtcgccgacctgctttgaagaagaagaaaagaaaaccactgttgttcgccgttgaagaagaaaaggttacttgttttgcaagcttcttattttgatttttgacccatctttgtctgttcctctctctctatctactcatcgatacctctcgtctcattttcgaacatatatgtctcatctgaacatgtttcttcttaaaaaaaaaaaaaaa

SEQ ID NO: 68272 - protein, 412 aa, Brassica napus
MAGSAPEGTQFDTRQFDQRLNEVLEGQDEFFTSYDEVHESFDAMGLQENLLRGIYAYGFEKPSAIQQRGIVPFCKGLDVIQQAQSGTGKTATFCSGVLQQLDFSLVQCQALVLAPTRELAQQIEKVMRALGDYLGVKVHACVGGTSVREDQRILQAGVHVVVGTPGRVFDMLRRQSLRSDSIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTKDDERMLFDIQKFYNVVVEELPSNVADLL

SEQ ID NO: 68273 - DNA, 1766 bp, Brassica napus
  CDS (57)..(1556)
cgatttgtaaaaccctaacgactagatttgggctccttaatcggagaaattggattatgagtcgctacgatagccggaccggcgactccacctcctaccgtgaccgtcgaagtgactcagggtttggtggagcttcagcatacggaagctcagctagtaaaagggagagtagtagtgttggcgatgagtctccaaagaagcctgatttggatggtttgactcctttcgagaagaatttttatgttgagtctccctctgtggcggctatgacggaggcggaagtggaggagtatcgaaagaagagggagattactgttgaaggtcgtgatattcctaaacctgtcaaaagctttcgtgatgttggctttcctgattatgttttggaagaggttaagaaggctggttttactgaacctacacctatacaatcacaagggtggccaatggcgttgaagggacgtgatctcattggcattgctgaaactggctctggaaagactctttcttacttgctacctgccatagtccatgtgaatgctcaaccaattttagctcctggagacggcccaatagtcttggttcttgctcctacacgtgaactggctgtgcagatacagcaagaagcgtctaagtttggttcatcgtcaaagattaagagcacttgcatttacggtggtgttccaaaagggcctcaagtgcgtgatctccagaaaggtgtggagattgttatagctactcctgggaggttaatagacatgatggaatcgaacaacacaaacttgcggagggttacgtatcttgttttggatgaggctgatcgaatgctggatatggggtttgaccctcagatccggaaaattgtctcacatattcggccagaccgtcaaactttgtactggagtgctacttggccaaaggaggtggaacaactctctaagaagtttctttataacccatacaaagtgataataggttcttcagatttaaaagctaaccgtgctatccgtcaaattgttgatgtcatctccgaaagccaaaagtataacaagttggtgaagttgcttgaagacataatggatggaagcaggattcttgtcttccttgacaccaaaaagggctgtgaccaaatcactcgacagcttcgcatggatggttggcctgctttgtcaatacatggtgataaaagtcaagccgagagagattgggttctctcggagtttagatcaggcaaaagccctataatgactgctacagatgttgcagctcgtggattagacgttaaagatgtgaagtatgtgataaactatgacttccctggatcactggaggattatgttcacaggattggacgaactggtagagctggggccaaaggaacagcttacagtttcttcacagctgcaaatgcgagattcgccaaagagcttatcagcatactagaagaagctggacagaaagtgagccacgaattagcttcaatgggtcgcagcactgctcctcctcctccagggcttggaggatttagagaccgtggaagcagaagagcttggagctgatctctctgtttatgtatgtgttattggcttttagggctcagtggttttctttttatttcatgcctcactctctttctgaaacatttgacattggcatcaaaacgttaaacgtgtaagataacatttgatccgatggtatgctttgtggttaagaacaaaaccaaagatttctaatttagtttttgacaaatcaacaaaaaaaaaaaaaaa

SEQ ID NO: 68274 - protein, 499 aa, Brassica napus
MSRYDSRTGDSTSYRDRRSDSGFGGASAYGSSASKRESSSVGDESPKKPDLDGLTPFEKNFYVESPSVAAMTEAEVEEYRKKREITVEGRDIPKPVKSFRDVGFPDYVLEEVKKAGFTEPTPIQSQGWPMALKGRDLIGIAETGSGKTLSYLLPAIVHVNAQPILAPGDGPIVLVLAPTRELAVQIQQEASKFGSSSKIKSTCIYGGVPKGPQVRDLQKGVEIVIATPGRLIDMMESNNTNLRRVTYLVLDEADRMLDMGFDPQIRKIVSHIRPDRQTLYWSATWPKEVEQLSKKFLYNPYKVIIGSSDLKANRAIRQIVDVISESQKYNKLVKLLEDIMDGSRILVFLDTKKGCDQITRQLRMDGWPALSIHGDKSQAERDWVLSEFRSGKSPIMTATDVAARGLDVKDVKYVINYDFPGSLEDYVHRIGRTGRAGAKGTAYSFFTAANARFAKELISILEEAGQKVSHELASMGRSTAPPPPGLGGFRDRGSRRAWS

SEQ ID NO: 68275 - DNA, 1593 bp, Brassica napus
  CDS (98)..(1381)
gaaccctaatcgaactcgagatctctagctcgactctgctcatctctctcaggaatcttaagtgaagcttctgtgcagcttttagaattagccagctatgggagacgttagggacaacgaagcatatgaggaggagctcctagactatgaggaagaggacgagaaggtcttggattctgggaataaagttaacggcgatgccgtgaagaaaggttacgtggggatacacagttctggattcagagacttccttttgaaacctgagcttctccgagctattgttgactctggttttgaacatccatccgaagtgcaacacgaatgtatccctcaagctatcttggggatggatgttatctgccaagctaaatctggtatggggaagactgctgtctttgttctttcgactctgcaacagatcgagccagctcctggccaggtgtctgcgcttatactgtgccatacaagagagttagcttatcagatctgcaatgagttcgtgcgtttcagtacctatctgcctgatactaaggtttcagtgttctatggaggagtcaacaacaaaattcacaaagacttgctgaagaacgaatgtcctcacattgttgttggaacacctggtcgtgtgcttggactcgccagggacaaagatctctcgttgaagaatgttaggcattttattcttgacgagtgcgataaaatgctggagtctctcgacatgcggagggatgtgcaggagattttcaagatgactcctcacgagaaacaagttatgatgttctcagcaactctcagcaaggagatacgcccagtctgcaagaaatttatgcaagatccaatggaaatatatgttgatgatgaagccaagttgactcttcatgggcttgtccagcattacatcaaactgggcgagatggagaaaaaccgcaagttgaatgaccttcttgacgcactggacttcaatcaagttgtcatatttgtgaagagcgttagcagagctcgggagctgaacaagctgcttatcgaatgcaatttcccctcaatatgcattcactctggcatgtctcaggaagagaggctgactcactacaaaagtttcaaggaagggcacaagagaatactggtggcgacagacttggtagggagaggcattgacattgagcgtgtcaacattgtcatcaactatgacatgccagactctgctgatacatatcttcacagggttgggagagctggtaggtttggaacaaagggtctagcaatcacatttgtggcatctgcttcggactcggaagttcttaatcaggtgcaagccaggttcgaggttgatataaagcaacttcctgagaatattgatacttctacttacatgccgtcctaaaatgactttgagattacaaagaagctgcttttgtgtgtttttgatttttagactgtttgtaaccttttaaaaaggagagagtgctttctaggtttttacactatcatcttaaattcttaacgtttctctagaagcgaatatgatactttatgttgttagagctttcatgtagcttataatgaatgaaactacctcttaaaaaaaaaaaaaaa

SEQ ID NO: 68276 - protein, 427 aa, Brassica napus
MGDVRDNEAYEEELLDYEEEDEKVLDSGNKVNGDAVKKGYVGIHSSGFRDFLLKPELLRAIVDSGFEHPSEVQHECIPQAILGMDVICQAKSGMGKTAVFVLSTLQQIEPAPGQVSALILCHTRELAYQICNEFVRFSTYLPDTKVSVFYGGVNNKIHKDLLKNECPHIVVGTPGRVLGLARDKDLSLKNVRHFILDECDKMLESLDMRRDVQEIFKMTPHEKQVMMFSATLSKEIRPVCKKFMQDPMEIYVDDEAKLTLHGLVQHYIKLGEMEKNRKLNDLLDALDFNQVVIFVKSVSRARELNKLLIECNFPSICIHSGMSQEERLTHYKSFKEGHKRILVATDLVGRGIDIERVNIVINYDMPDSADTYLHRVGRAGRFGTKGLAITFVASASDSEVLNQVQARFEVDIKQLPENIDTSTYMPS

SEQ ID NO: 68277 - DNA, 1955 bp, Brassica napus
  CDS (13)..(1797)
gcggcggccgtcatggattcatcatcgtcgaacacaaacaaagcgttaacggagacgcgtttctccgacctcgaacctccgctctccgaagacatcatcgaggccctcgaacggtccggtttcaagttctgcactccggttcaagccgcgacgatccctttgctctgccgccacaaggatgtcgccgtcgacgccgccaccggctcgggaaaaaccctagctttcgtcttacccttaatagagattctccgtcgctccacctcttaccctcccaagcctcaccaggttatgggagtgattatatcgccaacgagagagctatcaacgcagatatacaacgtggcacagccatttgtctccactttgccaaatgtgaactctgtgctgctcgttggaggccgtgaggtgaagtccgacatgagcactatagaagaaggaggatgcaatctcttgatcggcactcctggaaggctctctgacataatggaacgaatggagattcttgatttcagaaaccttgagattcttatcttagatgaagcagataggcttttggagatgggattccagaagcaggtgaacagcattatatctcgcttgccgaagcagcggaggactggtctcttttcagctacacagaccgaaggtgttgaggagcttgccaaggctgggcttaggaaccctgtgagagttgaagttcgagctgagtcaaagtctgaatcatcatcccagcaattaacaaactccaaagtgccttctggtcttcaccttgagtatttggtatgcgaagcagataagaagtcatcacagctagtggatctcctcgttgagaatgcaaagaagaaacttatagtatactttatgacttgtgcttctgttgattactggggactagtactttcgaaagtccctgccttgaagtccatttctttgatccctatccatggagatatgaagcagaatgcaagagacaaggcgttagcttcgtttactgaagcatcaagcggtgtccttttgtgcactgatgtggctgcacgtggactagatattccggggattgattacgttgttcagtatgatcctccacaagacccaaatatgttcaaccatagagttggcagaactgcgagattgggaaaagaaggaagggccatcgtttttttactgcctgaggaagaagattatgtagagtttatgcggagaagaggggtcccttgtcaagagaaaaatttatctgaggaagcatctgacgtcatcccaataatacggtcactagccatgaaggacagggcagtgttggagaagggactaaaggcgtttgtttcctttgtccgtggttataaggagcatcactgctcttacattttcagatggaaaagcctagaaataggaaagttagcaatgggatatggactcttgtatcttccttcaatgtctgaagtcaaacaacacagactctccagtgagggtttcacacctgttacagacgtcaagtttgaggacatcaagttcaaggacaaatctagggaaaagcaaaggaagcagaacatgcaagcaaggaaagagaaacggcaacaagagaaaaaggagaaaggcaagaagaactcgaaaaaggcggttgttgctgctgccacagattctaacaaaaggaagttaacaggaaaacagagacagaccatccaaacagcggaagacgaagaggagatggctcgagattatcggttacttaagaaactcaagaaaggttctattaaagaagatgattttgctaaacttacaggagctgatgacttttaatttcattagaagaagaaaacaaacctttttgaaattttgcagaaaacctctcctgtctcagctttgtaacctcacacacttcccctccttttataacgacatcaacggtcatgatttaatttacaaagttgagagagagaccgacacgcagcggccgc

SEQ ID NO: 68278 - protein, 594 aa, Brassica napus
MDSSSSNTNKALTETRFSDLEPPLSEDIIEALERSGFKFCTPVQAATIPLLCRHKDVAVDAATGSGKTLAFVLPLIEILRRSTSYPPKPHQVMGVIISPTRELSTQIYNVAQPFVSTLPNVNSVLLVGGREVKSDMSTIEEGGCNLLIGTPGRLSDIMERMEILDFRNLEILILDEADRLLEMGFQKQVNSIISRLPKQRRTGLFSATQTEGVEELAKAGLRNPVRVEVRAESKSESSSQQLTNSKVPSGLHLEYLVCEADKKSSQLVDLLVENAKKKLIVYFMTCASVDYWGLVLSKVPALKSISLIPIHGDMKQNARDKALASFTEASSGVLLCTDVAARGLDIPGIDYVVQYDPPQDPNMFNHRVGRTARLGKEGRAIVFLLPEEEDYVEFMRRRGVPCQEKNLSEEASDVIPIIRSLAMKDRAVLEKGLKAFVSFVRGYKEHHCSYIFRWKSLEIGKLAMGYGLLYLPSMSEVKQHRLSSEGFTPVTDVKFEDIKFKDKSREKQRKQNMQARKEKRQQEKKEKGKKNSKKAVVAAATDSNKRKLTGKQRQTIQTAEDEEEMARDYRLLKKLKKGSIKEDDFAKLTGADDF

SEQ ID NO: 68279 - DNA, 1609 bp, Brassica napus
  CDS (140)..(1504)
ttctctagaactcgcgccgatttgcttaacgctgctggattggtctaaagctctaaactttgtactgcacttcgtccccggaagtcctacacacgcgagcactcttattcacgcgcgaatttgatggtgggtattgagaatggaggaagagaacgaagtggtgaagacgtttgaagagcttggtgtgcgtgaggagcttgtgaaagcttgcgagaggctgggatggaagaaccctactaagattcaaactgaagctcttccttatgctcttgaagggaaagatgtaattggacttgcgcagaccggctctggtaaaaccggagcctttgcgttgccgatattgcaagctcttcttcagtatgttaatgatgctgagcctaagaaaggacgtagacctgatcctgccttcttcgcctgtgttttgtctccaactagagagctagcaatccagattgctgagcagtttgaagctctaggatctgatataagtcttagatgtgctgtgcttgttggaggtattgacaggatgcagcaaactattgctcttggaaaacggcctcatgttattgttgcgacacctggtcgtctatgggatcacatgtctgacactaaaggcttttctctcaagacgttgaaatttctggttcttgatgaagcagatagactgctgaatgaagattttgagaaatctcttaatcagattttggaagagatccctcgtgaccgtaaaacgtatctcttttcagcaactatgactaaaaaggttcggaaacttcagagagcatgcttaaggaatcctgtgaagattgaggctgcctccaaatactccacagttgatactctaaaacagcagtatcggtttgttcctgctaaatacaaggactgctaccttgtgtacattctgaccgaaatgcctgactcaacatcgatgatattcacccgaacttgtgacggtactcgttttatggctttgatgcttcggagccttggttttagagccattcctatcagtggtcagatgactcagtcaaagagattaagagcgttgaataagttcaaagcaggggaatgtaacatcttggtttgcactgatgtggctagcagagggctcgatatcccatctgttgatatggttattaattacgacattcccacaaattcaaaggattacatccatagagttggaagaacagctcgtgctggacgttctggtgttgggatatcacttgtaaaccagtatgaactcgaatggtacttgcaaattgaaaaactcataggcaagaagctgcctgagtatccagctgaggaggacgaagtcttgtcattgttggagagagtctcagaagccaaaaagttatccgcaatgaatatgaaagaatcaggaggtaggaagaagagaagaggagaagatgatgaagagagtgagaggttcttggatggtaacaaaggtggtaacaaaggaggtaacagggacaagaaatcttccaagaagttcaaacgataaacttttgaactctttgtattgttttctaataattttgaacttttttgtatccgagatatttgccatgttaacttaaagaacttgaaagctaaaaaaaaaaaaaaa

SEQ ID NO: 68280 - protein, 454 aa, Brassica napus
MEEENEVVKTFEELGVREELVKACERLGWKNPTKIQTEALPYALEGKDVIGLAQTGSGKTGAFALPILQALLQYVNDAEPKKGRRPDPAFFACVLSPTRELAIQIAEQFEALGSDISLRCAVLVGGIDRMQQTIALGKRPHVIVATPGRLWDHMSDTKGFSLKTLKFLVLDEADRLLNEDFEKSLNQILEEIPRDRKTYLFSATMTKKVRKLQRACLRNPVKIEAASKYSTVDTLKQQYRFVPAKYKDCYLVYILTEMPDSTSMIFTRTCDGTRFMALMLRSLGFRAIPISGQMTQSKRLRALNKFKAGECNILVCTDVASRGLDIPSVDMVINYDIPTNSKDYIHRVGRTARAGRSGVGISLVNQYELEWYLQIEKLIGKKLPEYPAEEDEVLSLLERVSEAKKLSAMNMKESGGRKKRRGEDDEESERFLDGNKGGNKGGNRDKKSSKKFKR

SEQ ID NO: 68281 - DNA, 1762 bp, Zea mays
  CDS (185)..(1471)
ggaaaccctactcgtccccttccgcagccggtactcaaccccaaccctatcctgtccgccgccgtcgcccggcgcctcctcccccacctagaaacccagaggctctaatcctagttctttctgtgcagtcgccgcccaattcccccacccaattcccactctccgctcgacagatccatacatgatgggagaggccaaggagaacgacgtttatgaggaggagctcctggactacgaggaggacgacgacaagacggtcgatggctccgctgctaagcccaccggagaggtcgcaaagaagggctacgtcgggatccacagttccggtttcagagacttcctgctcaagccagagctgctccgtgctatccaggattgtggttttgagcatccttccgaagtgcaacacgagtgtatccctcaagccattcttggaatggatgtcatctgtcaagctaaatctgggatggggaaaactgctgtttttgtcctttcatccctccaacaaattgaccctgttgcgggtcaggtagcagcacttgtactgtgccacacaagggaactggcttatcagatatgccacgaatttgagaggttcagcaaatatcttactgaagttaaagttgctgtcttctatggaggtgttcacatcaggaagcataaagatttgttgaagaatgaatgccctcatattgtggttggcacgcctggtaggatacttgctcttgccagggataaggatctctccttgaagaatgtgaggcacttcattcttgatgaatgtgacaaaatgctggaatcacttgacatgcggagagatgttcaggagatcttcaaaatgactcctcatgataagcaagtcatgatgttttcagcaacgctcagcaaggagatccgtcctgtatgcaagaaatttatgcaagatccgatggaaatatatgttgatgatgaggcaaagttgaccctccatggtcttgtacagcactatataaaacttagcgaggcagagaagaaccggaaactgaatgatctcttggacgctcttgatttcaaccaagttgtgatattcgtgaagagtgttagcagagctgccgaactgaataagttactttgtgaatgcaacttcccatcaatctgcattcattctggaatgactcaggaagaaaggctaacaagatataagaacttcaaggaaggccacaagagaattcttgtggctacagatttagttggcaggggcattgacattgagcgtgtcaacattgtgataaactatgacatgccagactcagctgatacttatttgcacagggttggaagggctggacgttttggcacgaagggacttgcaattacctttgtttcctctgcttcggattctgatgttcttaaccaggtgcaagaaaggtttgaggtagacataaaggaactgcctgagcaaattgacacctcgacctacatgccatcataaatgggaaggacaactgagaagagaggaggataggggagtgagcagccgtctggagatggttacctttgaactatccgatctggaggatttgatttgcctcctttgtgtactttaaaaagggcagccaggatgatgatctgtattttaagacaatgctgtctgtttgggtttaggattttgctttgtcgaaaactagcacacttattgtactactgagcagcatatttgttttcatccctgggttaaatgatgcgtctaaacacttctgctggcctgaaaaaaaaaaaaaaa

SEQ ID NO: 68282 - protein, 428 aa, Zea mays
MGEAKENDVYEEELLDYEEDDDKTVDGSAAKPTGEVAKKGYVGIHSSGFRDFLLKPELLRAIQDCGFEHPSEVQHECIPQAILGMDVICQAKSGMGKTAVFVLSSLQQIDPVAGQVAALVLCHTRELAYQICHEFERFSKYLTEVKVAVFYGGVHIRKHKDLLKNECPHIVVGTPGRILALARDKDLSLKNVRHFILDECDKMLESLDMRRDVQEIFKMTPHDKQVMMFSATLSKEIRPVCKKFMQDPMEIYVDDEAKLTLHGLVQHYIKLSEAEKNRKLNDLLDALDFNQVVIFVKSVSRAAELNKLLCECNFPSICIHSGMTQEERLTRYKNFKEGHKRILVATDLVGRGIDIERVNIVINYDMPDSADTYLHRVGRAGRFGTKGLAITFVSSASDSDVLNQVQERFEVDIKELPEQIDTSTYMPS

SEQ ID NO: 68283 - DNA, 2825 bp, Glycine max
  CDS (207)..(2402)
gaattcccgggtcgacagcgaagagggccatacattcccaaacaacaacgtggcctctctgcaaaaccccttatcatctctctctttatctctttgtctccaaaaatggcttctatcataggcgtttcctccatttaccaaacaccttctctcgaactataccagaggccaaatactgctgcctccacttcctccgttaggttgcaatgtttagactccaagtctcacttcaacaacgtcctcgagcccaccaacgccactccactgggccgggcctcaagcccacaccgactactttcgtcccctccgccgtcgccacgcccaattcctccctcctcagcgaagaagccttcaaaggacttggccgcgacttcgacgaattcgaccacgcctccgattccgactccgccgccgaatccgttcaccccgacgagcttgacatttccaagctcgacttgccctcgcgcctcgtcgagtctctccagagccgtggaattactcaacttttccccattcagagagcggtgttagtacctgcactagaaggtagagatatcattgcgcgagccaagaccggtaccggaaagacgttagcgttcggaattcctattattaaaggcctcactgaagatgaacacgcaccttctcacaggaggtctggtaggcttccgagatttttggtgcttgcgcctacgagagagttggcgaagcaagtggagaaggagataaaggaatctgcgccttacctgagcactgtttgtgtttacggtggtgtttcttatgttactcagcagggtgcgctttcgcgtggtgttgacgtggtggttgggacaccagggagaataattgacttgataaacgggaacagccttaagctcagtgaggttcagtatttggttctcgatgaagcggaccagatgcttgctgttgggtttgaggaagacgtggaaatgattctagagaatcttccagctcaaaggcagagcatgcttttctctgctaccatgcccagttgggtgaagaagttggcgagaaaatatttgaacaatccactcacaattgatttggttggtgatgaagaggaaaagcttgctgaagggataaaactttatgctatagcagccactgccacttcaaagcggacaattctttctgatcttgtaactgtttacgcaaagggtgggaagactatagtttttacacagacaaaaagagatgctgatgaagtatcattgtcattaacaaatagtataatgtctgaagcactgcatggtgatatatctcagcatcagagagagagaacactgaatggtttccgtcaaggaaaattcacagtgcttgttgccactgatgttgcagctcgtggactggatattcccaatgttgatttgattatccattatgagcttcccaatgatcctgagacttttgtgcatcgctctggtcgtactgggcgtgctggaaaacaaggtaatgccattctgctgtacaccagtagccagaggagaacagttagatccctcgaacgtgatgtcggatgcaagtttgaatttgttagtgcaccggctatggaagaggttttggagtcatctgctgagcaggttgttgccacacttggtggagttcatcctgagtctgttcagtttttcaccccaactgcacagagactgatcgaagaacaaggaacaagtgcccttgcagctgcactcgcacaactgagtggattttcccgaccaccatcatcccggtctcttatcacccatgaacagggatggattacattgcaactaactcgagattcagatagtagaagatatttttcagcaagatcaatcactgggtttctttctgatgtttatcctgcagctgctgatgaagttggaaaaatccatttaattgcagatgaaaaggttcaaggagctgtttttgatcttcctgaggagattgctaaagaattacttaatagggacataccacctggaaacaccgtttccaagatcaccaagctacctcctttgcaagatgatgggcctccaagtgatttctatgggaggttctctgacagagatagaagtagccgaagaggttctacttctaggggaggttccgcttctagggaccggagaggttttaaatcctcacggggctgggatgtggaagactccggtgatgactttggtgatcaatccagtaggagaggtggtagaaattttaaaactggcaacagctggtctcgagcagcaggtaaaagcagtggcgatgattggctaattggaggtggtagacgatcaagcaggccttcatcatcagacagatttggagggacctgttttaattgcggggaatctgggcatcgtgcatcagattgtccaaacgtttcaaacagacgaagctttttttaagttcccacatatatatgtttgggcaccacttttgtccaaacgtttcaagacgtgagctgctgccactgtttttgacctaatgggttccggaaaattgaaagatgtttcccaaaacagttacagaatcaattttaatttgcatctctcgtgttggcgtgatctccaaagggacctctgtttttcgtggagtctcaatgaaatttagtatttgttttgggaagtggtattggataaagaatagcgttaacagtatgattatgttatcttatttttggggtgagtttgggggattgtatgggcctgtattctatttaaccatgttactagtatttaatatctttctgaaccttcctggtttaggaacagacaggaaaaatgaatgaaagatgaaatcccaaaggtttatccaaaaaaaaaaaaaaa

SEQ ID NO: 68284 - protein, 731 aa, Glycine max
MFRLQVSLQQRPRAHQRHSTGPGLKPTPTTFVPSAVATPNSSLLSEEAFKGLGRDFDEFDHASDSDSAAESVHPDELDISKLDLPSRLVESLQSRGITQLFPIQRAVLVPALEGRDIIARAKTGTGKTLAFGIPIIKGLTEDEHAPSHRRSGRLPRFLVLAPTRELAKQVEKEIKESAPYLSTVCVYGGVSYVTQQGALSRGVDVVVGTPGRIIDLINGNSLKLSEVQYLVLDEADQMLAVGFEEDVEMILENLPAQRQSMLFSATMPSWVKKLARKYLNNPLTIDLVGDEEEKLAEGIKLYAIAATATSKRTILSDLVTVYAKGGKTIVFTQTKRDADEVSLSLTNSIMSEALHGDISQHQRERTLNGFRQGKFTVLVATDVAARGLDIPNVDLIIHYELPNDPETFVHRSGRTGRAGKQGNAILLYTSSQRRTVRSLERDVGCKFEFVSAPAMEEVLESSAEQVVATLGGVHPESVQFFTPTAQRLIEEQGTSALAAALAQLSGFSRPPSSRSLITHEQGWITLQLTRDSDSRRYFSARSITGFLSDVYPAAADEVGKIHLIADEKVQGAVFDLPEEIAKELLNRDIPPGNTVSKITKLPPLQDDGPPSDFYGRFSDRDRSSRRGSTSRGGSASRDRRGFKSSRGWDVEDSGDDFGDQSSRRGGRNFKTGNSWSRAAGKSSGDDWLIGGGRRSSRPSSSDRFGGTCFNCGESGHRASDCPNVSNRRSFF

SEQ ID NO: 68285 - DNA, 2189 bp, Glycine max
  CDS (45)..(1832)
atttcagtgtcgtagggtttcgctttccattttctcaccacaccatgttaaccgcagtcctcagaagaaccagttccaccctctcaaggcgcggtttccccgccgccttaatctctgcctccaccgccaccgccaccgccaccgccggcaaccacttccggctactctccgctgccgtcaattccagaaccttccactccaaccctggccccttgaatttccgcgcctcttcatgtcaccgcgcggaatacgccgtggacgatttcccttacgaagaagggtccaaaggaaacgccgacgaaggcctcgagatcgcgaagctcggaatttcgcaggatattgtctccgctttggccaagaaaggcatcaccaagctcttccccattcagagggctgtgttggaacctgctatgcaaggtcgtgatatgattggtcgagctagaactggaactgggaagactcttgcttttgggatacccatcatggataaggtcattcagtttaatgctaagcatgggcgggggagggatcctttggctttggtgttggctccgaccagagagcttgcgcgacaggttgaatcagagttctgtgagtcggcacctaatttggatacaatttgtgtttatgggggtacacccatttctcagcagatgaggcagcttgattatggggttgatattgctgtggggacgcctggtcggattattgaccttctcaacagaggtgcgctaaatttgaaggatgttcagtttgttgttcttgatgaagctgatcagatgcttcaggtgggctttcaggaagacgtggagaagatcttggagaggttgcccccaaaacgtcagactcttatgttctctgcaacaatgccatcttggataaagcagatttcgcgcaattacttgaataatcccctaaccattgatcttgttggagattctgatcagaaattggcagatggaatttcactgtactccattgcaactgatttgtatgttaaagcgggaattcttgcacctctaataacagaacatgcaaaaggaggaaagtgtattgttttcactcaaacaaaacgtgatgctgatcgattatcgtatgccatggcaagaagtgttaaatgtgaggctttgcatggagacatatcacaagctcaaagggagaaaactcttgctggcttcagaaatggccattttaatgttttagtggcaactgatgttgcctcacgtgggcttgatatacctaatgttgatcttgtaatacattatgatcttcccaacaattcagagatatttgttcatcgttctggacgaacaggtcgtgctggtaagaaaggaactgcaattcttgtgtatacagaagatcaatcgagggctgttaagcttatagagcgtgatgtaggcagtagattttcagagctgccacggattgctgttgatagtgcatcagcggtcatggttgatagcatgggtggcgggcgatttggttcttttggaggtaacagggatcgtcgatacggtgatatgggttttggatctggccattctgggggttacagtaaccctggttctggccgctctagctttggaaattccggtgaaaggtttggtggacagaattataatcgttttggctcatctggtggctttggttctggtcaatcaggaagtagatctggtggatcatccagcaggtctaggtttagtcgctcagatgattttgggggatttggtggttcagatcgttcgggtggttttggagattttggctcaggtcagtctagtggcttcggtggttctcgtggtagtaagcagaacaatagaagacctttttaacttaaataaatataaatataaaaaaatgcaccatccttatttcttggtggcttagctcttgtagagttttcttctgtcatttcctctaaaattcgagtcctcttggctaatccttgtattactaaggattttagaagacagcagttctacggccactggaattttcttttctgggacttttggctcagtctcagctgtattgttcctttggaaacatttataaaaaaaagagagagagagagaaaaaagggagggggctgtattcagcgggttttcatcatctgccatggctcattacttccatgatcttgaatatgcttgtacgtcaccatgggcagttctaaaaaaaaaaaaaaa

SEQ ID NO: 68286 - protein, 595 aa, Glycine max
MLTAVLRRTSSTLSRRGFPAALISASTATATATAGNHFRLLSAAVNSRTFHSNPGPLNFRASSCHRAEYAVDDFPYEEGSKGNADEGLEIAKLGISQDIVSALAKKGITKLFPIQRAVLEPAMQGRDMIGRARTGTGKTLAFGIPIMDKVIQFNAKHGRGRDPLALVLAPTRELARQVESEFCESAPNLDTICVYGGTPISQQMRQLDYGVDIAVGTPGRIIDLLNRGALNLKDVQFVVLDEADQMLQVGFQEDVEKILERLPPKRQTLMFSATMPSWIKQISRNYLNNPLTIDLVGDSDQKLADGISLYSIATDLYVKAGILAPLITEHAKGGKCIVFTQTKRDADRLSYAMARSVKCEALHGDISQAQREKTLAGFRNGHFNVLVATDVASRGLDIPNVDLVIHYDLPNNSEIFVHRSGRTGRAGKKGTAILVYTEDQSRAVKLIERDVGSRFSELPRIAVDSASAVMVDSMGGGRFGSFGGNRDRRYGDMGFGSGHSGGYSNPGSGRSSFGNSGERFGGQNYNRFGSSGGFGSGQSGSRSGGSSSRSRFSRSDDFGGFGGSDRSGGFGDFGSGQSSGFGGSRGSKQNNRRPF

SEQ ID NO: 68287 - DNA, 2189 bp, Glycine max
  CDS (454)..(2049)
gaattcccgggtcgacttcgctgtcgacgatttcgtgttaaggagagggtgagatgctttcgtctaagcttgctcaaactggcctcgtctatgctgtattgggcagttgtggaatacaaagatctttgaacatctcctttactacatttttgcaacacctacctctttctctctctctctttcactcgtcctaggtttgattttttcttccctcaattcccaacctcgcatctcccattattttattctcaaaccacgacaacaaaaacacaacacaccccaacacacacacacaaacacaacacaaacttagtttctcaatttcttcctctcgagccaacccaagttaaattgaaaacaagagcaaaaactaaacaaaggtttggtcttttgatgtgagagtaagaatcagacatctgggttggtttgttgctgggttcggttaatgttagaatgtgggatctcaacgactcacccgatcagaggattaacaaggacgaaggatccgaagaagggtgttcttccctcaagacttccatcgatggagatgacatgatcaacaacaacaaaggcaaaagggttggatctgtttccaattcaagctcttctgcagtagtcatcgaagacggatcagaagaagaagtggacgaagaagaagaagaagaagaagatgatgaagaaggtggtgttggaagaagcatgaagaaacgtagcagcaagattttcgggttctctgtgacccaagatgaagagtccatggacagtgaccacccacctgtgacaaggcaattttttccggtggaagatgctgacgtagcggttgcaacaggtggtggaaccggtggaagctctactttccctcgtgctcactgggtgggtgtgaaattttgccaatcagaaacacttggcgctggaaaatcatcagtggaggtttctcaacctatgaagaagagtcgccgaggaccgaggtcaaggagctctcagtatagaggagtcaccttctaccgaagaacgggtcgctgggagtctcatatatgggattgtggaaaacaagtgtatctaggtggatttgacacagcacatgcggctgctcgtgcttatgatagagcggctattaaattccgaggagtggaggctgacattaacttcaatattgaagactatgaagatgacttgaagcagatgagcaatcttaccaaggaagagttcgtccacgtgcttcgccgccaaagcactggatttccgagaggaagctccaaatatagaggggtcactttgcacaagtgtggaagatgggaggctcgaatgggccaatttttagggaaaaagtacgtttatttgggtctctttgacactgagatagaagctgcaagggcttatgacaaagccgccataaaatgcaatggcaaagaggctgtaacgaattttgatcccagcatctacaacaatgagctcaataccgaatcctcaggtaacgctccagatcacaatctggatttaagtttgggcaatgcaacttcaaagcctggcaataatcaagcgttggggaatcacgccacaaatgctgtaacccatgatcagcacctgccatctgagtctaattggcgtaatgggggaaacaagcctaagctggtgaatatactccccaaaccatgtaatagaagcaacaacaaggactcacatggaagggatgtgcacggggagagtgaaacactgaggatgctaagtcaaacccaccttcattctccagcctccaatgaaatgcaactaagatatggtccctacaagtctcacggtggagagtcccaaatgcttcaaaattttgcacacattcacccaccaaattttcattttcccagcagcagcattggaggccgaattgggagtgatctttcattatcaatgactgatcaacaacagtggcaaaccgggccttcacattatttagcaactgctgcagcatcatcaagtttccaacaacagataagaccctcttctcaaggttggctgcagaaaaatgggttccacattctcatgagaccctcatgatccctattatatatagagaattttctgcctcgccaagtactagttacattcaaataatcattaatctgctcctcaagtaatattattattattacccttcaacggttccagagagagagagaccgacacgcagcggccgc

SEQ ID NO: 68288 - protein, 531 aa, Glycine max
MWDLNDSPDQRINKDEGSEEGCSSLKTSIDGDDMINNNKGKRVGSVSNSSSSAVVIEDGSEEEVDEEEEEEEDDEEGGVGRSMKKRSSKIFGFSVTQDEESMDSDHPPVTRQFFPVEDADVAVATGGGTGGSSTFPRAHWVGVKFCQSETLGAGKSSVEVSQPMKKSRRGPRSRSSQYRGVTFYRRTGRWESHIWDCGKQVYLGGFDTAHAAARAYDRAAIKFRGVEADINFNIEDYEDDLKQMSNLTKEEFVHVLRRQSTGFPRGSSKYRGVTLHKCGRWEARMGQFLGKKYVYLGLFDTEIEAARAYDKAAIKCNGKEAVTNFDPSIYNNELNTESSGNAPDHNLDLSLGNATSKPGNNQALGNHATNAVTHDQHLPSESNWRNGGNKPKLVNILPKPCNRSNNKDSHGRDVHGESETLRMLSQTHLHSPASNEMQLRYGPYKSHGGESQMLQNFAHIHPPNFHFPSSSIGGRIGSDLSLSMTDQQQWQTGPSHYLATAAASSSFQQQIRPSSQGWLQKNGFHILMRPS

SEQ ID NO: 68289 - DNA, 1535 bp, Glycine max
  CDS (98)..(1339)
cccttcccttcaactccacggcgcagatccgaggagtttgggaaaccctaattcattcctctttgcttcttctatctctattcctctaacaccagtgatggcaggtttggctccagaaggatcgcagtttgatgctcggcaatatgattctaagatgaatgaattgctttccgccgatggacaagaatttttcacttcatatgacgaagtctatgatagttttgatgcaatgggccttcaagaaaatcttctgagaggcatatatgcttatggttttgagaggccttctgcaatccagcagaggggaattgttcctttctgcaagggtctggatgtgattcagcaggctcagtctggaactggaaagacagcaacgttctgttcaggaattttgcagcagcttgactatggattggttcagtgtcaggctttggttttggcaccaacaagggagcttgcacagcagattgagaaggttatgcgagctctaggtgattaccttggtgtcaaggttcatgcttgtgttggtgggaccagtgttcgtgaggatcagcgcattctccaagctggtgtccatactgttgttggcactcctgggcgtgtatttgacatgctacggagacagtctcttcgtccagatcacataaagatgtttgttttggatgaggctgatgaaatgctttctcgtggtttcaaggaccagatctatgacatcttccagcttctgccgggtcaaattcaggttggagtgttctctgctacaatgccacctgaggccttggagattacgaggaagttcatgaataagccagtgagaatcctggtaaagcgtgatgaattgacccttgagggtatcaaacagttttatgtgaatgttgataaggaagactggaaactagagacattatgtgacctttatgagactttggctatcacccagagtgtcatctttgtgaacacaaggcgtaaggtggactggctcactgacaagatgcgaagcaatgaccatacagtctcagccacccatggagacatggaccaaaacactcgtgacatcatcatgcgggaatttcgctctggctcttctcgagttctaattaccactgacctcttggctcgtggtatagatgtacagcaggtgtctttggttataaactatgatctgccaacccaacctgaaaattatcttcatcgcataggacgaagtgggcgttttggaagaaaaggtgttgccataaactttgtgactttggatgatgcaagaatgctgtctgatattcaaaagttctacaatgtgactgtagaggagttgccatcaaatgttgctgatctgctctgatgggttaattttcattctttgttaagtcatcagagggctattactttttgccaattattattttgtgctctttgtttttctttttcaaattttagcattagagttccaatacacctgactttatttttataatggattctataaaatttgtttatttgcaaaaaaaaagagagagagaccgacacgcagcggccgc

SEQ ID NO: 68290 - protein, 413 aa, Glycine max
MAGLAPEGSQFDARQYDSKMNELLSADGQEFFTSYDEVYDSFDAMGLQENLLRGIYAYGFERPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHTVVGTPGRVFDMLRRQSLRPDHIKMFVLDEADEMLSRGFKDQIYDIFQLLPGQIQVGVFSATMPPEALEITRKFMNKPVRILVKRDELTLEGIKQFYVNVDKEDWKLETLCDLYETLAITQSVIFVNTRRKVDWLTDKMRSNDHTVSATHGDMDQNTRDIIMREFRSGSSRVLITTDLLARGIDVQQVSLVINYDLPTQPENYLHRIGRSGRFGRKGVAINFVTLDDARMLSDIQKFYNVTVEELPSNVADLL

SEQ ID NO: 68291 - DNA, 1571 bp, Glycine max
  CDS (123)..(1187)
ggttatttgtatgatttttattcttgtgttgtttctgaacgatttctctgttatctgtttcaattttgctggagtatttgaatatatagtcacctttaatggaagttttgctttttgcagtgatggcaggtttggctccagagggaacacaattcgatggtcgccaatatgatgctaagatgagtgaattgctttccactgatgggcaagaattcttcacctcttatgatgaagtgtatgacagctttgatgcaatgggattgcaagagaatcttctgcgaggcatatatgcttatggttttgagaggccttctgctatacagcaaaggggaattgttcctttctgcaaaggactggatgtgattcaacaggctcagtctggaacaggaaagacagcaacattttgttctggaattttgcagcagcttgattatggattggttcagtgccaggctttggttttggcaccaacaagggagctagcacagcagatcgagaaagttatgcgagctcttggtgattacttgggagttaaggtccatgcttgtgttggtgggacaagtgttcgtgaggatcagcgcattctccaagctggtgtccatactgttgttggcactcctgggcgagtgtttgacatgctgcggaggcagtctcttcgcccagattgcataaagatgtttgttttggatgaggctgatgaaatgctttcacgtggtttcaaggatcagatctatgacatcttccagctgctgccatccaaaattcaggttggagtgttctctgctacaatgccgccagaagcccttgaaattacaaggaagttcatgaataagccagtgagaatcctggtaaagcgtgatgaactgaccctggagggtataaagcagttttatgtcaatgttgacaaggaagagtggaagctggagacattatgtgacctttatgagactctggctatcactcagagtgtcatttttgtgaataccaggcgcaaggtggactggctcactgacaagatgcgaagcaatgaccacacagtctctgccacccatggtgacatggaccaaaacacacgtgatattatcatgcgtgaattccggtccggctcttctcgagtttctcattaccacggaccttctggcccgtggtatcgatgtgcagcaagtgtctctggtcataaactatgatctgccaacccaacctgaaaactatctccaccgcataggacgtagtggtcgatttggaagaaaaggagttgctataaactttgtcacgacagatgattccaggatgctgtctgatattcagaagttctacaatgtgactgtagaggagctgccatcaaatgttgctgatttactctgatgagttaatgtttgttctctgttaagtcatcaggttcttattctatttggcaagtattatttgtgctcattttctctctatatattttacccattagagatcaaagacatgtgatctgatgctatttgtattggattctataaattttgtttaatcaattaattagcaggttgctgctcaagcctgcatttaaaaaaaaaaaaaaa

SEQ ID NO: 68292 - protein, 354 aa, Glycine max
MAGLAPEGTQFDGRQYDAKMSELLSTDGQEFFTSYDEVYDSFDAMGLQENLLRGIYAYGFERPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHTVVGTPGRVFDMLRRQSLRPDCIKMFVLDEADEMLSRGFKDQIYDIFQLLPSKIQVGVFSATMPPEALEITRKFMNKPVRILVKRDELTLEGIKQFYVNVDKEEWKLETLCDLYETLAITQSVIFVNTRRKVDWLTDKMRSNDHTVSATHGDMDQNTRDIIMREFRSGSSRVSHYHGPSGPWYRCAASVSGHKL

SEQ ID NO: 68293 - DNA, 1790 bp, Glycine max
  CDS (205)..(1488)
gagagagagaccgacacgcacggccgctgcgtgtcgggtctctctctctctctaactgctactcgctcatcccgtggaggtttcgctctctcagtttcttttccccaaattggtttttcatctaacaatttactttgcagaaccgtaaccctaaccccttcccctaccttgtaaccttcctttcgatccttcacctcgcagataatgggagaaacaaaggacgaagcatacgaggaagagcttctcgattacgaggaggaagacgaaaaggcccccgactccgccggagctaaagtcaacggcgaagctaccaagaagggctatgttggaattcacagttcgggattcagggacttccttctgaagccagagcttcttcgggctattgtggactcgggatttgagcatccatctgaagtgcaacatgagtgcataccacaagcaattctcgggatggatgtaatttgtcaagcaaaatctggaatgggaaagactgctgtctttgttctctctactctgcagcagattgatcctgttcctggccaagtttctgcactggttctttgtcatacaagagaattggcataccagatatgccatgagtttgagaggtttagcacttacttacccgatctcaaggttgctgtcttttatggtggagtcaacatcaaagttcacaaggatctgctgaaaaatgagtgccctcatattgttgttggaacaccgggaagaatactagcattgactagggataaggacctttctttaaagaatgttagacatttcatattggatgaatgcgacaagatgctggaatcactggatatgaggaaagatgttcaagacattttcaagatgactccccatgataagcaagttatgatgttctcagcaacactcagcaaggaaattcgcccagtctgcaagaaatttatgcaagatcctatggaaatttatgttgatgatgaggccaagttgacccttcacgggcttgtgcagcactacatcaaattgaaagaggaagaaaaaaaccggaagttgaatgatcttcttgatgcactggactttaatcaagttgtgatctttgtgaaaagtgttagcagagcagctgagctggacaaactacttgtggagtgcaactttccatctatatgcattcattctggcatgtcccaggaagaaaggttaaagcgctataaaggtttcaaggaggggcatacaaggattcttgttgcaacagatttggttggaagagggattgatattgaacgtgtcaacattgttataaactatgacatgcctgattctgctgacacatacttacacagggttggtcgagctggaagatttggcaccaaaggccttgcaatcacatttgtttcctgttctactgatgttgatgttctcaacaatgttcagtcaaggtttgaggtggatataaagcaacttcctgagcagatcgatacctctacctatatgccatcgtagaattttttgggaacaatgttaagtgcttggtggcatgagtaatcgtgacgcagaacggtgcagctgatgattaaccgtgctgatagataccagagtctgtttacagactaggccattttaccattggatatttatcggtattagatgtagcagcagtgtaatggcttatgtatttatgggttttcacttactgtattttgtgtggcacctacgctgttttcatgaacggtcatgttttgagttggtcttactgcgaccttgatatttgatgctttatacttttgtcgaaaaaaaaaaaaaaa

SEQ ID NO: 68294 - protein, 427 aa, Glycine max
MGETKDEAYEEELLDYEEEDEKAPDSAGAKVNGEATKKGYVGIHSSGFRDFLLKPELLRAIVDSGFEHPSEVQHECIPQAILGMDVICQAKSGMGKTAVFVLSTLQQIDPVPGQVSALVLCHTRELAYQICHEFERFSTYLPDLKVAVFYGGVNIKVHKDLLKNECPHIVVGTPGRILALTRDKDLSLKNVRHFILDECDKMLESLDMRKDVQDIFKMTPHDKQVMMFSATLSKEIRPVCKKFMQDPMEIYVDDEAKLTLHGLVQHYIKLKEEEKNRKLNDLLDALDFNQVVIFVKSVSRAAELDKLLVECNFPSICIHSGMSQEERLKRYKGFKEGHTRILVATDLVGRGIDIERVNIVINYDMPDSADTYLHRVGRAGRFGTKGLAITFVSCSTDVDVLNNVQSRFEVDIKQLPEQIDTSTYMPS

SEQ ID NO: 68295 - DNA, 1627 bp, Linum usitatissimum
  CDS (56)..(1297)
ccaaaccctagctctttcaacttcctctgcacaaccgccgtcaaccagcttaatcatggcaggactagcacccgagggatcccagtttgatgctaagcagtacgatgccaagatgagtgaactgatttcagctgatggtcaggactacttcgcttcctatgacgaggttcatgaaaccttcgactctatgggtttgcaggagaatcttctcagaggaatttatgcatatggttttgagaagccgtctgcaatccagcagagggggattgttcccttttgcaagggactagatgttattcaacaggctcaatctggaactggaaagactgctactttctgttctggtatcctgcaacaacttaattatggtctagttgaatgccaagcactggtcttggcacccactagggagctggctcagcagattgaaaaggttatgcgagcccttggtgattatcttggagtcaaggtgcatgcatgtgttggtggaactagtgttcgtgaagaccaacgtatcctctcaagtggagtccatgttgttgttggtactcctggtcgtgtgttcgatatgctccgcagacagtcccttcgagctgattcgatcaagatgtttgtgttggatgaagctgatgagatgctctctcgtggatttaaggatcaaatctacgacatcttccagcttttgccaccaaacatccaagttggcgttttctctgcaacaatgccacctgaggctcttgatattacaaggaaattcatgaacaaaccagttaggattctggtgaagcgtgaggagctaaccttggagggtatcaaacagttccatgtgaatgtggacaaagaagaatggaagttggagacactgtgtgatctttatgagaccttagccattactcagagtgttatctttgtgaacaccaggcgcaaggtggactggctgactgacaagatgaggagcagagaccacacagtgtcagctactcatggtgacatggaccagaacactagggacatcatcatgagggagttcaggtctggctcatcccgtgtcctgatcactaccgacctattggcccgtggtattgatgtccagcaggtttcgcttgtgatcaactatgatctgccaacccaaccggagaactacctgcataggattggacgtggtggacgttttgggaggaaaggtgtggctatcaactttgtgaccaccgatgatgagaggatgcttttcgacatccagaagttctacaatgtggtgattgaggagctcccagccaatgttgctgatcttctgtgaggataaaaattgtttgcctgatggaatttgaaagagtgaagatgttttgtttaagaggagactcgatcaatcactcttgccctcccgttgtgatggtcgttaagtcttgtactcttttctttttcctttttatatttttatttttcatggactaagtagtattttgatattttcactatcagtatctggagatttagtatcgtatgttgtgacattgttccaattttgaatttagctgttggtagcatctttttcccccttgataactggtattgtggaatatttatgaatacagatttctgtatcgttcaactcaaaaaaaaaaaaaaa

SEQ ID NO: 68296 - protein, 413 aa, Linum usitatissimum
MAGLAPEGSQFDAKQYDAKMSELISADGQDYFASYDEVHETFDSMGLQENLLRGIYAYGFEKPSAIQQRGIVPFCKGLDVIQQAQSGTGKTATFCSGILQQLNYGLVECQALVLAPTRELAQQIEKVMRALGDYLGVKVHACVGGTSVREDQRILSSGVHVVVGTPGRVFDMLRRQSLRADSIKMFVLDEADEMLSRGFKDQIYDIFQLLPPNIQVGVFSATMPPEALDITRKFMNKPVRILVKREELTLEGIKQFHVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRGGRFGRKGVAINFVTTDDERMLFDIQKFYNVVIEELPANVADLL

SEQ ID NO: 68297 - DNA, 1940 bp, Zea mays
  CDS (3)..(1502)
ccatgcaccagcctagagctcgctacccacccggctatggctccggcggtggaggcggagccggacgtggcggtggaggcggaaatggaggaggtggcggaaaccacaactactacggccgaaacccgcagcaacaccactaccaccagcagcagcagtcgcagcactctcataggaactcttcgtaccagcaacagtggctgcggcgagaccaggcccccgccgttgcgggggcagcgtccggaaacgctgtggccaagacggcgtctcagcttgacgccgtaggctcgagctcccaagactggaaggctcaactaaatataccagctccagatacacgctacaggacagaggatgtcactgcaacaaaaggcaatgagtttgaagattatttcttgaaacgtgaactgcttatgggaatctacgaaaagggatttgaaagaccatctcctattcaagaagaaagcattcctattgcgctgactggaagtgatattcttgcaagggcaaaaaatggcactggaaagactgctgccttttgcattccggcacttgaaaaaattgatcctgaaaaaaatgctattcaagttgttatactagtaccaacaagggaactggctctgcaaacttcgcaagtctgtaaagagctcgggaagtaccttaacattcaagttatggttagcactggaggaactagcttgaaggatgacatcatgcgtttataccaacctgttcatttacttgttgggactcctggccgaatacttgatcttaccaggaagggcatttgtgtgttgaaagactgttcaatgcttgtcatggatgaggcagacaagctattagctccagagttccagccttctgtggaggcacttattcatttccttccacctagtcggcagctgttgatgttttcagcaacctttcctgtaactgtcaaggaattcaaagataaatatctgcctagaccttatgtgattaatctaatggatgaactgaccctgaaaggaatcacacaatattatgcttttgtcgaagaaaggcaaaaagttcattgcctgaatacacttttctcaaagcttcaaattaatcaatccattatattctgcaactctgttaatagagttgagctactggctaagaaaataactgaactcggttattcatgcttctacattcatgctaagatgttgcaagaccacagaaaccgagtgtttcatgattttcgtaatggtgcttgcagaaaccttgtgtgcacagatctgtttaccagaggaattgatatccaggctgttaatgtggtcattaattttgacttccctaagacatctgagacatacttacacagggttggccgttctgggagatatggacaccttggtttggcagtgaacttgatcacttatgaagaccgtttcaacttatataggattgagcaagaacttggaacggaaattaagacaatacccccacagattgacctgtccatatactgccaatgatatgtgacagtttcaatgagcatcggacacattttatttattttgagaacatctgtacatagcaacccatcaagtgagttctccaactaaggcgcaactatttcagaagctacctaaatggctacattcctttgtcgtcacacatcaatttctcccccattctcgtcgggttttgttttaatgccttgatgtcgtttgtaagcttacttggattagtagaggaagtgtttcctgtaggctctgatctggtactaacctgtttagctgaggacatgcacattgggtgggctgcttggggcccaaaactatgatgagatgagacattatcttacctcgcttgacattttcaatttacctgtttgccaatctcagtagagcctcagttctactggagttgcctgtgttattatttgattagttttcaaaaaaaaaaaaaaa

SEQ ID NO: 68298 - protein, 499 aa, Zea mays
MHQPRARYPPGYGSGGGGGAGRGGGGGNGGGGGNHNYYGRNPQQHHYHQQQQSQHSHRNSSYQQQWLRRDQAPAVAGAASGNAVAKTASQLDAVGSSSQDWKAQLNIPAPDTRYRTEDVTATKGNEFEDYFLKRELLMGIYEKGFERPSPIQEESIPIALTGSDILARAKNGTGKTAAFCIPALEKIDPEKNAIQVVILVPTRELALQTSQVCKELGKYLNIQVMVSTGGTSLKDDIMRLYQPVHLLVGTPGRILDLTRKGICVLKDCSMLVMDEADKLLAPEFQPSVEALIHFLPPSRQLLMFSATFPVTVKEFKDKYLPRPYVINLMDELTLKGITQYYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKTSETYLHRVGRSGRYGHLGLAVNLITYEDRFNLYRIEQELGTEIKTIPPQIDLSIYCQ

SEQ ID NO: 68299 - DNA, 1726 bp, Brassica napus
  CDS (76)..(1554)
ataatttgccattttgtttgccctatcttctgcaactctccaccatctcgtctcccaaggcagaagaagaaccccatggcgatttacgtcgcatcacggcggctttccgccagaacaaccgcggcggcgctgcgttacgccactgctctgagatcttattcgacctcgttcagggaggagagggacaccttcggcccgatccaagttccttccgataagttgtggggagcccagacgcagagatcgctgcagaacttcgagatcggcggcgagcgcgagcgaatgcccgagccaatcgtccgcgcttttggcgtcttgaagaagtgcgctgccaaggttaacatggagtatggacttgatccaactattgggaaagcgattatggaagctgctcaggaagttgctgagggcaaactcaatgatcatttcccccttgttgtttggcaaactggtagtggcactcagagtaacatgaatgctaatgaggtcattgctaacagagcagctgagattcttggtcgcaaacgtggtgaaaaatgtgtccaccctaatgaccatgtcaacagatctcagtcttctaacgacactttccctaccgtcatgcacattgcagctgcaaccgagattaattcaaggctcatccctagtctgaaaactttgcataccactctcgactctaagtccttcgagtttaaagatattgtgaaaattggaagaactcacactcaagatgctactcctttgactctaggacaagaatttggtggctatgctactcaggttaagtatggacttaatcgagtcacatgcactctaccccgcctctatcagcttgcacaaggtggaactgcggttgggacaggattaaacaccaagaaagggtttgatgtaaagatagctgctgcagtagccgaagaaacaaacctgccgtttgtcactgcagaaaacaagtttgaagctctggctgcacatgatgcttgtgttgaaaccagtgggtcacttaacacaatcgccacatcgttgatgaagattgccaatgatatacgttttcttggaagtggtccaagatgtggtcttggtgaacttgttctgcctgaaaatgagccaggaagcagcatcatgcctgggaaggtaaatcctacacagtgtgaggccttgactatggtttgtgctcaggtaatgggcaaccatgtagctgtgacagttggtgagtcaaatggtcatttcgaactgaatgtatttaagccggtgattgcaagcgctctcttgcattccgtgaggttaatagcagatgcttcagcttcgtttgagaaaaactgtgtaaggggtattgaggccaacagagaaaggatctcaaagcttttgcacgagtctcttatgcttgtgacatcattgaatccgaaaatcggatatgacaatgctgcagcagttgccaagaaagctcacaaagaaggatcgacactgaaggaagcggctctgaagttaggtgttcttacttctgaagagtttgatacccttgttgttcccgagaagatgatcggtccctccgattgatgttgagccaaaagcttcattttgccatgttttattcttgataaagaggttgtaatgacaaataagcaaatccccagactcaaattttgcatttggaaggattcaattctttatgtatcacacagttacttttatgttgaataaaagagcaactatgcaaaaaaaaaaaaaa

SEQ ID NO: 68300 - protein, 492 aa, Brassica napus
MAIYVASRRLSARTTAAALRYATALRSYSTSFREERDTFGPIQVPSDKLWGAQTQRSLQNFEIGGERERMPEPIVRAFGVLKKCAAKVNMEYGLDPTIGKAIMEAAQEVAEGKLNDHFPLVVWQTGSGTQSNMNANEVIANRAAEILGRKRGEKCVHPNDHVNRSQSSNDTFPTVMHIAAATEINSRLIPSLKTLHTTLDSKSFEFKDIVKIGRTHTQDATPLTLGQEFGGYATQVKYGLNRVTCTLPRLYQLAQGGTAVGTGLNTKKGFDVKIAAAVAEETNLPFVTAENKFEALAAHDACVETSGSLNTIATSLMKIANDIRFLGSGPRCGLGELVLPENEPGSSIMPGKVNPTQCEALTMVCAQVMGNHVAVTVGESNGHFELNVFKPVIASALLHSVRLIADASASFEKNCVRGIEANRERISKLLHESLMLVTSLNPKIGYDNAAAVAKKAHKEGSTLKEAALKLGVLTSEEFDTLVVPEKMIGPSD

SEQ ID NO: 68301 - DNA, 1764 bp, Glycine max
  CDS (34)..(1521)
gttattctccggtggctccttccttccttcgccatggcgttctacgtgctctcgcgtcgtttatcagctggatccaactcaacgacgctcctcgccctgcgttttgcttcctcttccagatccttctcctcttccttcagggaagaaagagatacctttggacccattcaagttccctccgacaaattatggggagcacaaactcaaagatcgttgcagaacttcgacatcggtgggccccgcgaacgcatgcccgaacccatcattcgcgcttttggcgtcttgaagaaatgcgctgctaaggtgaacatggagtatggtcttgatcccatcgtgggagaagcaataatgcaagcggcacaagaagtagccgagggaaaactaaacgaacattttcctctcgttgtatggcaaactggcagtggcactcaaagtaacatgaatgctaacgaggttattgcaaaccgagcagcagagattcttggccataagcgcggtgggaagttcgtgcacccaaatgaccatgtcaatagatcgcagtcttctaatgatacattcccaaccgtaatgcacattgcagccacaatggaaataaactcaagactaattcccagcttgaaaaccttacacggtacactaaactcaaagtcaattgaattcaaagatattgtcaagattggacgcactcatactcaagatgcaacacctttgactcttgggcaagagtttagtgggtatactacacaagtgaagtacggtattgatcgagtaattggcactttgccgcacctgtatcagcttgcccagggtggtacagctgtagggactggattgaatacaaagaaggggtttgatgccaagatagcagcagcagtagctgaggaaacaaatctgccttttgttacggcagaaaataagtttgaggccttggctgcccatgatgcttttgttgaaactagtggagcacttaacactattgcggcttctttgatgaagattgctaatgatatacggttgttaggaagtggtccacgctgcggtcttggtgaactcattcttcctgaaaacgaaccaggaagtagtatcatgcctgggaaggttaaccctacccagtgtgaggctttgacaatggtgtgtgcccaggtcattggaaaccatgttgcagttacagtgggtggatcaaatggtcattttgagcttaatgtgttcaagccaatgactgccagttgtctcctgcattcgctgagactgcttggagattcatctgcttcctttgaaaagaattgtgtgagaggcattcaagctaatagggaaagaatttcaaaattactgcatgagtcactgatgctcgtcacatccttaaacccaaaaattggttatgacaaggcagcagcagttgccaagacagcccacaaagaggggtgtactcttaaggaagctgcattgaaactcggagtgctcagctctgaagattttgacaagcttgtggtacctgagaaaatgcttggaccgtctgattgactaactcgcaatgtttttgttctaataattccttgtttcatcatatcggctacatttgaggtagtatttttttagctacacccgttgattggtttgagaaatggcaacccaatgaacaataatttggcttcctcagttgatattcgcgagggaagagttcttccaaatttgtaacgagacaatgtattgcagaaatttactgagccaaataaagggaaattttttattcaaaaaaaaaaaaaa

SEQ ID NO: 68302 - protein, 495 aa, Glycine max
MAFYVLSRRLSAGSNSTTLLALRFASSSRSFSSSFREERDTFGPIQVPSDKLWGAQTQRSLQNFDIGGPRERMPEPIIRAFGVLKKCAAKVNMEYGLDPIVGEAIMQAAQEVAEGKLNEHFPLVVWQTGSGTQSNMNANEVIANRAAEILGHKRGGKFVHPNDHVNRSQSSNDTFPTVMHIAATMEINSRLIPSLKTLHGTLNSKSIEFKDIVKIGRTHTQDATPLTLGQEFSGYTTQVKYGIDRVIGTLPHLYQLAQGGTAVGTGLNTKKGFDAKIAAAVAEETNLPFVTAENKFEALAAHDAFVETSGALNTIAASLMKIANDIRLLGSGPRCGLGELILPENEPGSSIMPGKVNPTQCEALTMVCAQVIGNHVAVTVGGSNGHFELNVFKPMTASCLLHSLRLLGDSSASFEKNCVRGIQANRERISKLLHESLMLVTSLNPKIGYDKAAAVAKTAHKEGCTLKEAALKLGVLSSEDFDKLVVPEKMLGPSD

SEQ ID NO: 68303 - DNA, 1860 bp, Glycine max
  CDS (135)..(1622)
gctgaacaaaaatactagactattcatttggggtccaacttggaagaagactgcggaatcgcgtatcctgattggtcagacaagtgttatgctccggtgactccttccttcgccacccccactcaaattcaaccatggcgttgtacgtgctctcgcgtcgtttatcagctggatccaactcaaccacgctcctcgccttgcgttttgtttcctctaccagatcctactcctcttccttcagggaagaaagagatacctttggagccattcaagttccctccgagaaattatggggagcacaaactcaaagatcgttgcagaacttcgatatcggtgggccccgcgaacgcatgcccgaacccatcattcgcgcctttggcgtcttgaagaaatgcgctgctaaggtgaacatggagtatggtcttgatcccgccgttggaaaagcgattatgcaagcggcacaagaagtggccgagggaaaactaaacgaccattttcctctcgttgtatggcaaactggcagtggcactcaaagtaacatgaatgctaacgaggttattgcaaaccgagcagcagagattctttggcataagcggggtgggaagttagtgcacccaaatgaccatgtcaatagatcacagtcttcaaatgatacattcccaactgtaatgcacattgcagccgcaatggaaataaactcaagactaattcccagcctgaaaaccttacatggtacactaaactcaaagtcaattgaattcaaagatattgtcaagattggacgcactcatactcaagatgcaacacctttgactcttggacaagagtttagtgggtatactacacaagtgaagtatggtattgatagagtaattggcactttgccgcacatgtatcagcttgcccagggtgggacagctgtagggactggattgaatacaaagaaggggtttgatgccaaaatagcagcagcagtagctgaggaaaccaatctgccttttgttacggcagaaaataagtttgaggccttggctgcccatgatgcttttgttgaaactagtggagcccttaacactattgcggcttctttgatgaagattgctaatgacatacggttgttaggaagtggtccacgctgcggtcttggtgaactcattcttcctgaaaacgaaccagggagcagtatcatgcctgggaaggttaaccctacccagtgtgaggctttgacaatggtgtgtgcccaggtcataggaaaccatgttgcagttacagtgggtggatcaaatggtcattttgagcttaatgtgttcaagccaatgattgccagttgtctcctgcattcactgagactgcttggagattcatctgcttcctttgaaaagaattgcgtgagaggcattcaagctaacagggaaagaatttcaaaattactgcatgagtcactaatgcttgtcacatccttaaacccgaaaattggttatgacaaggcagcagcagttgccaagacagcccacaaagaggggtgtactcttaaggaagctgcattgaaactcggagtgctcagctctgaagattttgacaagcttgtggtacctgagaaaatgcttggaccatctgattgactggctcgtaatgttttgttctaattattccttgttttatcatcggctacattgaggtagtattttttagccacacccgttgataggtttgagaaatggcaatccaatgaacaataatttggcttcctcagttgatattcgcgagggaagagctcttccaaatttgtaatgagacaatgtattgcagaaatttactgacccaaataaagggaaaatttgtattcaaaaaaaaaaaaaa

SEQ ID NO: 68304 - protein, 495 aa, Glycine max
MALYVLSRRLSAGSNSTTLLALRFVSSTRSYSSSFREERDTFGAIQVPSEKLWGAQTQRSLQNFDIGGPRERMPEPIIRAFGVLKKCAAKVNMEYGLDPAVGKAIMQAAQEVAEGKLNDHFPLVVWQTGSGTQSNMNANEVIANRAAEILWHKRGGKLVHPNDHVNRSQSSNDTFPTVMHIAAAMEINSRLIPSLKTLHGTLNSKSIEFKDIVKIGRTHTQDATPLTLGQEFSGYTTQVKYGIDRVIGTLPHMYQLAQGGTAVGTGLNTKKGFDAKIAAAVAEETNLPFVTAENKFEALAAHDAFVETSGALNTIAASLMKIANDIRLLGSGPRCGLGELILPENEPGSSIMPGKVNPTQCEALTMVCAQVIGNHVAVTVGGSNGHFELNVFKPMIASCLLHSLRLLGDSSASFEKNCVRGIQANRERISKLLHESLMLVTSLNPKIGYDKAAAVAKTAHKEGCTLKEAALKLGVLSSEDFDKLVVPEKMLGPSD

SEQ ID NO: 68305 - DNA, 2120 bp, Zea mays
  CDS (76)..(1572)
tcgctgtcgacgatttcgtccatttcccagccgccgcggcgccacgcagacctagcagagaaacacccacccgagatggcgatggctctgcgccgccttgcgggcgtgtccggatcgccgtcggcctcctctgccgcggccacggtgctactccggtcggcgctgacccgcccgatctccaccggcttccgcgaggagcgcgacaccttcggtcccatccaagtccccaacgacaagctgtggggcgcgcagacgcagagatcgctgcagaactttgacattggcggggagcgtgagaggatgcccgttcccatcatccgtgcctttggcgtgctaaaaaagtgcgccgctaaggtgaatatggactatggccttgatccaacaatagggaaggccataatacaggcagctgaggaggtcgcagagggaaagttggatgatcacttcccacttgttatctggcaaactggcagtggcacacaaagcaacatgaatgccaatgaggtaattgcaaatagggcatctgagatccttggacacaagcgcggtgagaagtttgtgcacccaaatgaccatgtgaataggtcacaatcttcaaatgatacatttcccactgtaatgcatatagcgacggccgttgagatacattcgaggtttatcccaagtttgcaacagttgcatgattcacttcattcgaaaactattgagtttaaagacataattaaaattggacgtacacatacccaagatgccaccccattgactcttggccaagaattcagtggctacactacacaggtcaaatatggaattgaccgcattaattgtacattacctcggatgtaccagcttgctcaaggtggaactgcagttggaactggcttgaacaccaagaaaggatttgatgccaaaatagctgctgcagtggctgaggaaacaaacctaccctttgtgacagcagagaacaagtttgaagctttggcagcacatgacgcttttgttgagagcagtggtgccgtaaatacaatttctgcatctcttatgaagatagcaaacgacatacgtttgctaggaagtggtcctcggtgtggtcttggtgaactaatcctaccagaaaatgagcctgggagcagcattatgcctgggaaagttaatccaacccagtgtgaggctctgacaatggtttgtgcacaggttatgggtaatcatgttggtgttacaattggtggtgccaatgggcattttgaactgaatgtttttaagccaatgatcgcagccggattacttcgatcattgaggttgttaggggatgcatccgtgtcctttgagaaaaattgtgtcaggggaattcaagcaaaccacaagagaatttcacaacttttgcatgagtctctgatgttagtgacatctttgaaccctaaaattggctatgacaatgctgcagctgttgctaagaaagcccacaaagaaggaaccacgttgaaggaagctgcattagaccttggagtattaacggagcaagaattccatgagcttgtcgtcccggagaaaatgattggtccttctgattgataaccccatgttcactatgtttctttgaagcattcaggttgccacatccgcgagttctggtggccctgtgtttccaagttaatgattctagcgcacccataaataaagcaaataatttttcatatggtcattaggtcctcaccgtaccgcactagagaaatgatttttgcatggcggatggtatctgagaaaacagttgtattcttgttcaaatagggagcagtgcactttgattcatgaggcgccttccattatcttggcatcagtcaaccttttcttgccaagtagctagtgctatgcaacaagtgacatggcaaccatgtatagaaattatttgcatgggtttgtgttcttgccaggtagctaatgttatgtaataagtgacaaggaaacaatgccatgaattatttgcattgggttttgacgagtgaaatagaaatatacgccctgttttagttttaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 68306 - protein, 498 aa, Zea mays
MAMALRRLAGVSGSPSASSAAATVLLRSALTRPISTGFREERDTFGPIQVPNDKLWGAQTQRSLQNFDIGGERERMPVPIIRAFGVLKKCAAKVNMDYGLDPTIGKAIIQAAEEVAEGKLDDHFPLVIWQTGSGTQSNMNANEVIANRASEILGHKRGEKFVHPNDHVNRSQSSNDTFPTVMHIATAVEIHSRFIPSLQQLHDSLHSKTIEFKDIIKIGRTHTQDATPLTLGQEFSGYTTQVKYGIDRINCTLPRMYQLAQGGTAVGTGLNTKKGFDAKIAAAVAEETNLPFVTAENKFEALAAHDAFVESSGAVNTISASLMKIANDIRLLGSGPRCGLGELILPENEPGSSIMPGKVNPTQCEALTMVCAQVMGNHVGVTIGGANGHFELNVFKPMIAAGLLRSLRLLGDASVSFEKNCVRGIQANHKRISQLLHESLMLVTSLNPKIGYDNAAAVAKKAHKEGTTLKEAALDLGVLTEQEFHELVVPEKMIGPSD

SEQ ID NO: 68307 - DNA, 2014 bp, Zea mays
  CDS (30)..(1526)
tcgctgtcgacgatttcgtcccacccgagatggcgatggctctgcgccgccttgcgggcgtgtccggatcgccgtcggcctcctctgccgcggccacggtgctactccggtcggcgctgacccgcccgatctccaccggcttccgcgaggagcgcgacaccttcggtcccatccaagtccccaacgacaagctgtggggcgcgcagacgcagagatcgctgcagaactttgacattggcggggagcgtgagaggatgcccgttcccatcatccgtgcctttggcgtgctaaaaaagtgcgccgctaaggtgaatatggactatggccttgatccaacaatagggaaggccataatacaggcagctgaggaggtcgcagagggaaagttggatgatcacttcccacttgttatctggcaaactggcagtggcacacaaagcaacatgaatgccaatgaggtaattgcaaatagggcatctgagatccttggacacaagcgcggtgagaagtttgtgcacccaaatgaccatgtgaataggtcacaatcttcaaatgatacatttcccactgtaatgcatatagcgacggccgttgagatacattcgaggtttatcccaagtttgcaacagttgcatgattcacttcattcgaaaactattgagtttaaagacataattaaaattggacgtacacatacccaagatgccaccccattgactcttggccaagaattcagtggctacactacacaggtcaaatatggaattgaccgcattaattgtacattacctcggatgtaccagcttgctcaaggtggaactgcagttggaactggcttgaacaccaagaaaggatttgatgccaaaatagctgctgcagtggctgaggaaacaaacctaccctttgtgacagcagagaacaagtttgaagctttggcagcacatgacgcttttgttgagagcagtggtgccgtaaatacaatttctgcatctcttatgaagatagcaaacgacatacgtttgctaggaagtggtcctcggtgtggtcttggtgaactaatcctaccagaaaatgagcctgggagcagcattatgcctgggaaagttaatccaacccagtgtgaggctctgacaatggtttgtgcacaggttatgggtaatcatgttggtgttacaattggtggtgccaatgggcattttgaactgaatgtttttaagccaatgatcgcagccggattacttcgatcattgaggttgttaggggatgcatccgtgtcctttgagaaaaattgtgtcaggggaattcaagcaaaccacaagagaatttcacaacttttgcatgagtctctgatgttagtgacatctttgaaccctaaaattggctatgacaatgctgcagctgttgctaagaaagcccacaaagaaggaaccacgttgaaggaagctgcattagaccttggagtattaacggagcaagaattccatgagcttgtcgtcccggagaaaatgattggtccttctgattgataaccccatgttcactatgtttctttgaagcattcaggttgccacatccgcgagttctggtggccctgtgtttccaagttaatgattctagcgcacccataaataaagcaaataatttttcatatggtcattaggtcctcaccgtaccgcactagagaaatgatttttgcatggcggatggtatctgagaaaacagttgtattcttgttcaaatagggagcagtgcactttgattcatgaggcgccttccattatcttggcatcagtcaaccttttcttgccaagtagctagtgctatgtaacaagtgacatggcaaccatgtatagaaattatttgcatgggtttgtgttcttgccaggtagctaatgttatgtaataagtgacaaggaaacaatggcatgaattatttgcattgggtttaaaaaaaaaaaaaaaaaaaaaaaaaaaaaaaaaaaataaaaaaaaaaaaaaaagagaccgacacgca

SEQ ID NO: 68308 - protein, 498 aa, Zea mays; identical to SEQ ID NO: 68306

SEQ ID NO: 68309 - DNA, 1883 bp, Brassica napus
  CDS (119)..(1651)
caacccgaaaaaacaagaggttgttcttgttccgacacgacaacacatccagtatcggagctaataagagggaagaaagaagaaatagttgactgtgtttaagggtttctgttgaaaaatgtcgaacatagacattgaagggatattgaaggagctacctaacgatgggaggatcccaaaaaccaagatcgtttgcactctaggaccagcttctcgcactgttcctatgatcgaaaagcttctcagagccggtatgaacgtcgctcgcttcaacttctcacatggcagccatgagtatcaccaaggcacactcgacaacctccgcaccgctatgcagaacacaggcattctcgccgccgtcatgcttgacacaaagggacctgagattcgtactggtttcttgaaagatgggaaccctatacaactcaaggaaggccaagagatcactatcaccactgactacgaaactttaggagatgagacgacgatctccatgagctataagaagcttcccttagatgtgaagcccggaaacaccatactctgtgcagatggaagcataagtctagctgtcttgtcatgtgatccagagtctggaactgttaggtgcaggtgcgaaaacacggcgatgcttggcgagagaaagaacgtgaatctccccggtgtcgttgttgatctccccactctgacagacaaggatattgaagatattatgggttggggtgttcctaacagcatcgatatgattgcgctttcttttgtccgtaaaggctcagatcttgttaatgtcaggagggttcttggttctcatgctaaaagcattatgctgatgtcaaaggttgagaaccaggaaggagtggtgaactttgatgagatactgcgcgaaacagatgcattcatggtcgctcgtggtgatctcgggatggagattcccatagagaagatcttcttagctcagaagctgatgatctacaagtgcaaccttgcaggcaaaccagtggtgacagccactcagatgcttgagtcaatgatcaagtcaccaaggccaacacgtgctgaagccacggacgttgccaacgccgtccttgacggcacagactgcgtgatgctcagcggagagagcgcagcaggagcttatccggagatagccgtgaaagtcatggccaagatctgcattgaagcggagagctctcttgactacaacacgatctttaaagagaggatcagagcaactccggttccaatgagcccgttagagagtcttgcatcgtcagctgtgagggctgcgaacaaagcgcatgcgaagctcatcattgtgttgactcgtggaggctcaacagctaagcttgtagctaagtacagaccctctgttccgattctttcggtggttgtaccagttatgaccacggattcctttgactggacttgtagtgacgagtcgcctgcaaggcatagtttgatatacagaggtttgatccctatgttggctgaaggatctgcaaaggcgacagatagtgagtccacagaggttatcattgaatccgctttgaagtcagctgtgcagagaggactgtgcaaccatggtgatgctgttgtggcgctgcaccgtattggagtcgcctcggttattaagatctgtgtggttaagtaaagaaataaagaatagctcttggctccttatgattgttggcaatcgtaactgagttgacttcgttacttgaaataaagatgtactgttggagacatctctctctctctctctctctctctctctctctgtcttttcagttttcaagattatgaatcttaaatctgctttgtatgaatcactatgtataacactgtttctcttcataagctttgcttacaaaaaaaaaaaaaaa

SEQ ID NO: 68310 - protein, 510 aa, Brassica napus
MSNIDIEGILKELPNDGRIPKTKIVCTLGPASRTVPMIEKLLRAGMNVARFNFSHGSHEYHQGTLDNLRTAMQNTGILAAVMLDTKGPEIRTGFLKDGNPIQLKEGQEITITTDYETLGDETTISMSYKKLPLDVKPGNTILCADGSISLAVLSCDPESGTVRCRCENTAMLGERKNVNLPGVVVDLPTLTDKDIEDIMGWGVPNSIDMIALSFVRKGSDLVNVRRVLGSHAKSIMLMSKVENQEGVVNFDEILRETDAFMVARGDLGMEIPIEKIFLAQKLMIYKCNLAGKPVVTATQMLESMIKSPRPTRAEATDVANAVLDGTDCVMLSGESAAGAYPEIAVKVMAKICIEAESSLDYNTIFKERIRATPVPMSPLESLASSAVRAANKAHAKLIIVLTRGGSTAKLVAKYRPSVPILSVVVPVMTTDSFDWTCSDESPARHSLIYRGLIPMLAEGSAKATDSESTEVIIESALKSAVQRGLCNHGDAVVALHRIGVASVIKICVVK

SEQ ID NO: 68311 - DNA, 1983 bp, Brassica napus
  CDS (100)..(1815)
atccccctctctctctctctcttaaatatcagttttaacagaaaacctcattctcattctctctcctctgcttgacctctgttcttcaagttgtacgacatggcggcgacaggtcaaatctcgacgagaatgacggtggatcgcactctgtcctcctccaggaacgctggactttccctttcaccatcaccccagagaacgctaatcggcgtcgccggtaggtctggtatcgctcaccgtcaactgtctctctccgtcagagcgattaacaccaatgaagatagccggaaagtcaaggtttatgcagagaacggcgctttcgatttgggagtgatggatccttcagtggagccatataaatttgcggagccaagaacaagtcataatgattcgaggaggaaaaccaagattgtgtgtaccattggaccttcctctagctctcgtgaaatgatttggaaactcgcggaagcaggaatgaatgtggctcgtttgaatatgtctcatggagatcatgcttctcatcagattactattgatcttgttaaagaatacaactctctctttgttgacaaagccattgctatcatgttggatacaaagggtcctgaggttcgaagtggggatgtacctcagccgatcttccttgaagagggtcaagagtttaattttaccatcaagagaggtgtctcaatgaaagacaccgtcagtgtcaactatgatgattttgttaacgatgtcgaagttggagacatacttttggtcgatggtggaatgatgtcactagctgttaagtccaagacgagcgatttggtgaaatgtgtagttattgacggtggagagcttcaatctagacgtcacttgaatgttcgaggaaagagtgctactcttccttccataacagacaaagattgggaagacatcaaatttggagtggacaaccaagttgatttctatgctgtctcttttgttaaggatgctaaagttgtccatgagttgaaaaactacctcaaaagctgcagtgcggatatctctgtgattgtgaaaattgaaagcgcagattctataaagaatcttccttccattatatctgcttgtgatggggcaatggttgctcgtggagatcttggagctgaacttcccattgaggaggttcccttgttacaggaggagataatcacaaggtgtaggaacattcataaaccagtgattgtcgccacaaacatgctagagagtatgattaatcatccaacacctacaagagctgaagtatctgacattgcaattgcagtgcgcgaaggagcagatgcaatcatgctttctggtgaaaccgcacacggaaagtttcctctgaaagctgttaacgtgatgcataccgtggctttgagaactgaggctagtctacctgttagaacctcagcaatccggaccactgcttacaagggtcgcatgggccaaatgtttgctttccatgcttctataatggcgaatacactgaacacaccgatcattgtgttcacaagaactggatccatggcagtgcttctgagtcactaccgcccgtcctcaacaattttcgccttcacaaaccagaggagaataatgcaaaggctggctctttaccaaggtgtcatgcctatatacatggagttttctgatgatgcagaagatacatatgcccgttccttgaaactcctacaggacgagaatatgcttaaggaaggacaacatgtaactcttgtccaaagtggtgcgcaacccatttggcgtgaagaatcaacacatctcatacaagtccgtaagattaagataggttgatgtttttcactactcgagcttctatatccctgactttatttttcttacacgatttgatccaatattgttttatgtcactcacagtgaaaccatatatatttgttttaagttcttgaaccacatgactgtaaaaacaaaacagtcttttcgatgaaaaaaaaaaaaaaa

SEQ ID NO: 68312 - protein, 571 aa, Brassica napus
MAATGQISTRMTVDRTLSSSRNAGLSLSPSPQRTLIGVAGRSGIAHRQLSLSVRAINTNEDSRKVKVYAENGAFDLGVMDPSVEPYKFAEPRTSHNDSRRKTKIVCTIGPSSSSREMIWKLAEAGMNVARLNMSHGDHASHQITIDLVKEYNSLFVDKAIAIMLDTKGPEVRSGDVPQPIFLEEGQEFNFTIKRGVSMKDTVSVNYDDFVNDVEVGDILLVDGGMMSLAVKSKTSDLVKCVVIDGGELQSRRHLNVRGKSATLPSITDKDWEDIKFGVDNQVDFYAVSFVKDAKVVHELKNYLKSCSADISVIVKIESADSIKNLPSIISACDGAMVARGDLGAELPIEEVPLLQEEIITRCRNIHKPVIVATNMLESMINHPTPTRAEVSDIAIAVREGADAIMLSGETAHGKFPLKAVNVMHTVALRTEASLPVRTSAIRTTAYKGRMGQMFAFHASIMANTLNTPIIVFTRTGSMAVLLSHYRPSSTIFAFTNQRRIMQRLALYQGVMPIYMEFSDDAEDTYARSLKLLQDENMLKEGQHVTLVQSGAQPIWREESTHLIQVRKIKIG

SEQ ID NO: 68313 - DNA, 1911 bp, Brassica napus
  CDS (85)..(1668)
ccaaacctcacacacacacagacacacaccttccatctctccgctcgccgtcgatcatctgagatctctctcccctcaccaaagatgcattcgagccatctccttctcgaggagccgatcaggatggcttctatcctcgagccatccaaatccagcttctttccggcgttaactaagatcgtcgggactctcggtcccaaatccagatccgttgagacactctccggctgtctcaaatccggcatgtctgtggctagattcgatttctcttggggagacgctgagtatcaccaagagacgcttgataatctgaagattgctgttaagagcaccaagaagctttgtgctgttatgcttgatacagtgggacctgagcttcaagtgatcaacaagtctgagaaagctattactcttaaagctgatggacttgttactttgactcctaatcaagaccgagaagcctcttctgaagtccttcccattaactttgatggccttgccaaggcggtgaagaaaggagacactatctttgttgggcagtacctattcactggtagtgaaacaacttcagtttggctcgaggttgatgaagttaaaggagatgatgtcatttgcctttcaaggaatgctgctactctcgctggttctatgttcaccttgcacgcctctcaagttcacatcgatatgccaactcttactgagaaagataaagaggttataagcacatggggagttcaaaacaaaatcgactttctctcgttgtcctattgtcgccatgcagaggatgttcgccagacccgtgagatgcttaaaaagttgggtgacctctctcaaacacaaatatttgccaagattgagaacgttgagggactaaaccactttgatgagattctacaagaagctgatggaattattctttctcgtgggaacttgggtattgatctacccccggagaaggtgtttttgtttcaaaaggcggctctttacaagtgcaacatggcaggaaagccagccgttcttactcgtgttgttgatagtatgactgacaacttgcgaccaactcgtgcagaggcaacagatgttgctaatgctgttttagatggaagtgatgcaattcttctcggtgctgagactcttcgcggtctgtaccctgtggagactatatcaactgtcggaaggatctgtgctgaggcagagaaggttttcaatcaagatttgtacttcaagaagactgtcaagtatgttggagagccgatgtctcacctcgaatccattgcttcttcagctgtaagggcagcaatcaaggttaaggcatccgtcattatatgctttacctcttctggaagagcagccaggttgattgctaaatacaggccaacaatgccggttatttctgtagtcattccacgggttaagacaaatcagctaaaatggagcttcagtggagcctttgaggctaggcagtcacttattgtcaggggcctcttccccatgcttgctgaccctcgtcaccctgcggaatcaacaagtgcgacgaacgagtcagtcctgaaggttgcgttagaccacgggaagcaagcaggagtgatcaagtcgcacgacagagtagtggtgtgtcagaaagttggtgatgcatctgtggtcaagatcatcgagcttgaggattgataatatgggaggaaaacaattgctacaatctttttacttcgatccagtgctctgcagtgagtattcaggagatttgatgtctctgatgtttcccatttttcttggctattacatttggctggcctcagatttaaactacggtaaaaaaagtatacaatgtctagcaattattcaataatcttgtaacatcccactatgtttttctatgttacaaaaatattacgactcaaaaaaaaaaaaaaa

SEQ ID NO: 68314 - protein, 527 aa, Brassica napus
MHSSHLLLEEPIRMASILEPSKSSFFPALTKIVGTLGPKSRSVETLSGCLKSGMSVARFDFSWGDAEYHQETLDNLKIAVKSTKKLCAVMLDTVGPELQVINKSEKAITLKADGLVTLTPNQDREASSEVLPINFDGLAKAVKKGDTIFVGQYLFTGSETTSVWLEVDEVKGDDVICLSRNAATLAGSMFTLHASQVHIDMPTLTEKDKEVISTWGVQNKIDFLSLSYCRHAEDVRQTREMLKKLGDLSQTQIFAKIENVEGLNHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICAEAEKVFNQDLYFKKTVKYVGEPMSHLESIASSAVRAAIKVKASVIICFTSSGRAARLIAKYRPTMPVISVVIPRVKTNQLKWSFSGAFEARQSLIVRGLFPMLADPRHPAESTSATNESVLKVALDHGKQAGVIKSHDRVVVCQKVGDASVVKIIELED

SEQ ID NO: 68315 - DNA, 1930 bp, Brassica napus
  CDS (109)..(1692)
cggtcaaatcccattcgcataaaaagcatctcctctccgatcgaattctctcactctgttcgccgccgaagatctgagatctctcctctctcctctctcacctcaaagatgcattcgagtcatctccttctcgaggaaccgatcaggatggcatcaatcctcgagccatccaaatctagcttcttcccagcattgactaagatcgtcgggactctcggtcccaaatcccgatccgtcgagactctctccggttgcctcaaatccgggatgtccgtggctcgatttgatttctcttggggagatgctgagtatcaccaggagacgctggataatctgaaaattgctgtgaagagcactaagaagctttgtgctgttatgcttgatactgtgggacctgagctgcaagttatcaacaagtctgggaaagctattactcttaaagccgatggacttgttactttgacacccagtcaagatcgagaagcgtcttctgaagtccttccgattaactttaatgggcttgccaaggcagtgaagaagggagacactatctttgttgggcaatacctattcactggtagtgaaacaacttcagtttggctcgaggttgatgaagttaaaggagatgatgtcatttgcctgtcaaggaatgctgctactcttgctggttctctcttcactctgcacgcctctcaagttcacatcgatctgccaactcttacggagaaagataaggaggttataagcacatggggagttcagaataaaatcgattttctctctttgtcttattgtcgtcatgcggaggatgttcgccagacccgcgaaatgcttaagaagttgggtgacctctctcaaacacaaatatttgccaagattgagaatgtagagggacttaaccactttgatgagattctacaagaagctgatggaattattctttctcgtgggaatttgggtattgatctacccccggaaaaggtgtttttgtttcaaaaggcggctctttacaagtgcaacatggctggaaaaccagccgttcttacccgtgtcgttgatagtatgactgacaacttgcgaccaactcgtgcagaggcaacagatgttgctaatgctgttctagatggaagtgatgcaattcttcttggtgctgagacccttcgcggtttataccctgttgagacaatatccactgtcggtagaatctgtgctgaggcagaaaaggttttcaatcaggacttgtacttcaagaagactgtcaagtatgtaggagaaccgatgtctcacttggaatccattgcttcttcagctgtacgggcagcaatcaaggttaaggcatctgtcattatatgcttcacctcttctggaagagcagcaaggttaattgccaaatacaggccaacaatgcccgttatttctgttgtcattccccgggttaagacaaatcagctgaaatggagctttagtggagcctttgaggcgaggcagtcacttattgtcagaggccttttccccatgctcgctgatcctcgtcacccagcggaatcaacaagtgcgacgaacgagtcagtcctcaaggttgcactagaccatggaaagcaagcaggagtgatcaaatcgcatgacagagtagtggtgtgtcagaaagttggtgatgcttctgtggtgaagatcatcgagctagaggattaacacaaaaatggaagaagaaaacaattgctatatttttcttacttcgagactgtgccggagtgagtatatttttatctacgggacttttggtttttgagatttgatgtctctaaatgattcccttctttttcctttcggtatacatttgggttgccttcagatttaaagccatgtttaaagagtatacaatgtctagcaaattattcaataaactgtaacatccaaaaaaaaaaaaaaa

SEQ ID NO: 68316 - protein, 527 aa, Brassica napus
MHSSHLLLEEPIRMASILEPSKSSFFPALTKIVGTLGPKSRSVETLSGCLKSGMSVARFDFSWGDAEYHQETLDNLKIAVKSTKKLCAVMLDTVGPELQVINKSGKAITLKADGLVTLTPSQDREASSEVLPINFNGLAKAVKKGDTIFVGQYLFTGSETTSVWLEVDEVKGDDVICLSRNAATLAGSLFTLHASQVHIDLPTLTEKDKEVISTWGVQNKIDFLSLSYCRHAEDVRQTREMLKKLGDLSQTQIFAKIENVEGLNHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICAEAEKVFNQDLYFKKTVKYVGEPMSHLESIASSAVRAAIKVKASVIICFTSSGRAARLIAKYRPTMPVISVVIPRVKTNQLKWSFSGAFEARQSLIVRGLFPMLADPRHPAESTSATNESVLKVALDHGKQAGVIKSHDRVVVCQKVGDASVVKIIELED

SEQ ID NO: 68317 - DNA, 1903 bp, Brassica napus
  CDS (122)..(1618)
ttccctagtccccaaggcccaagccagatctctctctctctctctataaatctctctcggtctctactaccatctctgatccaacctatttccccattgaactcgctgttttcttccaaagatggcgatgatagagcaaaggccgaagacgaagatcgtgtgtaccgttggtcccgcttccagatccgttgagatggtcgagaagcttctcagggctggcatgaacgtcgctaggtttaacttctctcacggatctcatgagtaccaccaggagactctcgataatctccgtcaagctatgctcaacactggtatcctctgcgccgtcatgctcgataccaagggtccagagatccgaaccggattcttgaaagatgggaaaccaatccagttgaaacaaggccaagagatcaccatctccactgactacgacttgcagggagacgaggaaacaatctgcatgagctacaagaagttggctgaggatgtgaacccagggatggttatcctctgtgctgacggtacaatctcgttactggtcctctcctgtgacacagagaacggcacagtccgttgccgctgcgagaactctgccatgcttggtgagaggaagaacgttaatctcccaggtgttgttgtggacctcccaactctaactgagaaagacaaagaagacatcatgaagtggggagtcccgaatcagatcgatatgatcactttgtcttttgtcagaaaaggttcggacttggttcaggtcaggaaactgttaggagatcatgccaagaacattcttctcatgtcaaaggttgagaaccaagaaggtgtggcgaacttcgatgacattcttgtcaactccgacgcgtttatgattgcaagaggagatctcggcatggagatcccaatcgagaagatcttcctagctcagaaagtgatgatctacaaatgcaacatccagggaaaaccagtggtcacagcgactcagatgctcgagtccatgatcaaatcccctcgacccacaagagctgaagccactgacgtagcaaacgcagtcctcgacggcaccgactgtgtcatgctcagcggagaaaccgcagctggagcttaccctgagctagctgtacgcacgatggccaagatctgcgttgaagccgagagcacgcttgactacggagacgtcttcaagaggatcatgcagtactctccggttccaatgtccccgctggagtcactggcctcctctgcagtcagaacagctaactcggctagagccacgctcatcatggtcctaaccaggggaggaagcacggcgaggcttgtggctaaatacagaccagggatgcctattttgtcagtcgttgttcccgagatgaaaacagacttctttgactggtcttgcagcgacgaatcgccggcgaggcacagtctcatcttccgtgggttgattccggtgctgtacgcagggtctgctagagcctcgcatgatgagtccacagaagaagctattgagtttgcgactcagcatgggaaagagaagcagctgtgtaagactggagactctgttgttgctctgctccgagttggtaatgcttctctaatcaagatcttgaccgtcaagtgatgattgatgattcacgatctttaaaaaggagtcccgtttttggcgtttggcggttgggggaaacgcaactataatcggtttttgttatgaattttttttattcaagattgtgattacatatcttgagataggaaactcaagttctctttcttgctaattacaactactgtggtgaccagtgaatccacttacggctctcttttgttttggattattggttgtatggaactaatcaatcatacacgtatctattatcatgattttcttctgaaaaaaaaaaaaaaa

SEQ ID NO: 68318 - protein, 498 aa, Brassica napus
MAMIEQRPKTKIVCTVGPASRSVEMVEKLLRAGMNVARFNFSHGSHEYHQETLDNLRQAMLNTGILCAVMLDTKGPEIRTGFLKDGKPIQLKQGQEITISTDYDLQGDEETICMSYKKLAEDVNPGMVILCADGTISLLVLSCDTENGTVRCRCENSAMLGERKNVNLPGVVVDLPTLTEKDKEDIMKWGVPNQIDMITLSFVRKGSDLVQVRKLLGDHAKNILLMSKVENQEGVANFDDILVNSDAFMIARGDLGMEIPIEKIFLAQKVMIYKCNIQGKPVVTATQMLESMIKSPRPTRAEATDVANAVLDGTDCVMLSGETAAGAYPELAVRTMAKICVEAESTLDYGDVFKRIMQYSPVPMSPLESLASSAVRTANSARATLIMVLTRGGSTARLVAKYRPGMPILSVVVPEMKTDFFDWSCSDESPARHSLIFRGLIPVLYAGSARASHDESTEEAIEFATQHGKEKQLCKTGDSVVALLRVGNASLIKILTVK

SEQ ID NO: 68319 - DNA, 2063 bp, Glycine max
  CDS (192)..(1700)
ttgcataataacaagagtcgcatcgcatcacaaatcttttttgtctctctctacttttttgctttctttcttcttctgtttatcgcatcgcgtattggttggtcgaaaaacaaagagtgtgtgttgtgtggtttggtttggtttttcacttttcttcatctttttgcgagaagacacacacacagagagagatggctacgacgaggattgaggcagagaagaagccgaagacgaagatcgtgtgcactctgggccccgcatcacggtcggtcccaatgatcgagaagcttctgcgagcaggcatgaacgtggcgcgcttcaacttctcccatgggtcccacgagtaccaccaggaaaccctcgacaacctccgcgccgccatggagaacaccggtattctctgcgccgtcatgctcgacaccaaggggcctgagattcgaactggttttctcaaggacggtaagcctatccaactgatacaaggtaatgaaataaccatttccactgactatgacctaaagggagatgagaagacgatttgtatgagctacaaaaagctgcctgaggatgtgaagcccgggatggtcatactctgtgcggatggcaccatatcatttacagttttatcatgtgacaaacaagcaggcttggttcaatgccgatgtgagaactctgccactcttggcgagaggaagaatgttaatttgcctggagtgatagtggatctcccaactttgacagacaaggacaaggaagatatcttggcctggggaattccgaataaaattgacatgattgctctttcttttgttcgaaaaggttctgacctggtggaagtcaggaaagttctgggaaaacatgctaagaacattatgctcatgtctaaggttgaaaaccaagaaggggttgcaaattttgatgaaatccttgcaaattcagatgcatttatggtggcacgtggtgaccttggaatggaaattccaatagagaagatatttctcgcacagaaagtgatgatttacaagtgcaacatccaaggaaaaccagttgtcactgcaacccagatgttggagtcaatgatcaaatctcccaggccaaccagggccgaagctactgatgttgccaatgcagttctggatggcacagactgtgtgatgcttagtggtgaaaccgctgctggagcctatccagaccttgctgttcaaacaatggctaaaatatgcattgaagcagagagcacccttgactatggtgatgtgttcaaaaggattatggagcactcaccggtacccatgagcccattagagagtctagcttcttctgctgttagaacagccaactcggctagagcggctcttatcttggttttaactagaggagggagtactgcaaaattggtggcgaaatacaggccagggatgccaattctttccgtggttgttcccgagctcaagactgatagctttgattgggcatgcagtgatgaggcccctgcgagacatagccttatattccgcgggttggttcccgtgttgagtgcagcttctgctagagcttctcatgctgaaacaacagaagaagcaatagaattcgccatgcaacatgccaagtccaagggtctctgccacaacggggattcagtggtggcactgcatcgtgtgggcactgcatctatcatcaagatcttgactgtgaaatgatcacccccattacaaggaattcttctgctgtttatggcaaattttttggatggtgcaaaagaggtctcgatatacctcttcatatctacattggatgcaaacttcaattaaaagcatttattaggatcggttacctgtttttcacatatcatatattactttttttttttttttttgttacatttgccttatcattgtggcgagtagccacttgttttcatttgttaagattttgtacgaggcttttggtgaaccaaaaaactagccacttctggattttgaattttgcggtctaaagttgttttaacttttaattgagcagtcagcagtgtatgttttttgagaccgacacgcagcggccgc

SEQ ID NO: 68320 - protein, 502 aa, Glycine max
MATTRIEAEKKPKTKIVCTLGPASRSVPMIEKLLRAGMNVARFNFSHGSHEYHQETLDNLRAAMENTGILCAVMLDTKGPEIRTGFLKDGKPIQLIQGNEITISTDYDLKGDEKTICMSYKKLPEDVKPGMVILCADGTISFTVLSCDKQAGLVQCRCENSATLGERKNVNLPGVIVDLPTLTDKDKEDILAWGIPNKIDMIALSFVRKGSDLVEVRKVLGKHAKNIMLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPDLAVQTMAKICIEAESTLDYGDVFKRIMEHSPVPMSPLESLASSAVRTANSARAALILVLTRGGSTAKLVAKYRPGMPILSVVVPELKTDSFDWACSDEAPARHSLIFRGLVPVLSAASARASHAETTEEAIEFAMQHAKSKGLCHNGDSVVALHRVGTASIIKILTVK

SEQ ID NO: 68321 - DNA, 1976 bp, Glycine max
  CDS (116)..(1696)
cgtacaacactttctatatttatcgtccattctctctcactccataattgcttcttgctttggtcgatccattcggtgatcactgaccagtggtttggtgttgttgatagagaaaatgcattccagccctttgcttcttgaggaacccattaggatggcatccatccttgagccatccaagcctactttttttccggctatgacgaaaattgttggcacacttggtccaaagtcacgatcagttgatataatttcccattgccttgatgcaggaatgtctgtggcaaggtttgacttttcatggggtgatccagaataccatcaagagacattggaaaatttgagagttgctatcaaaagtaccaagaaactctgtgcggttatgctagatactgtgggtccagaattacagattgagaataagactgatcacccaatcacccttgaagcagacacattagttgtcttaactccagatcaaaataaagaagctagttcaaatctcttaccattaaattttaccgggctatcaaaggctgtgaagaagggtgatactatttttattggaaaatacttgtttactggaagtgaaacagcttctgtatggctggaggtcagtgaggtggaaggtgaggatgtcacctgtctggtaaaaaacactgccacactctctggatcattgtttactgtacatgtctctcagattcacatcgatcttcctactcttgctgataaagataaggaggtaataagcacatggggtgttcaaaacaatattgacttcctttcattatatacccggcacgttgaagatattcgtcatgcacgtgaatttctctctaaattgggtgacctgaagcagacacatatttatgcaaagattgaaaatatagagggaatgaaacattttgatgaaatattgagagaagcagatggtatcatcctcgctcgtggaaatttagggatagaactcccacctgagaaggttttcttattccaaaaggctgctatttacaagtgtaacatggttggaaagccagttgttgttacacgtgttgtggactctatgactgataatctaagacctactcgtgctgaagcaacagatgttgccaatgcagtgttggatggaagtgacgcaattctccttggagcagagaccctgcggggacaataccctgtagagaccatttctatagttggaaaaatatgtgctgaggcagagaaagttcataatcaagatttgtattttaagaaggctgtaaaatatgtgggagagccaatgagccatttggaatcaattgcttcctctgcggttcgggcagctatcaaggttaaggcctctgttattatttgcttcacttcatctggaagagctgcaagattgattgctaagtacagaccaaccatgcctgtgatatctgttgtcattcctcaattgaagacaaatcaactccgatggacgttcaccggtgcttttgaggctaggcaatctcttattgtgagaggtctttttcctatgctggcagatccacgacacccagctgagtccagaagtggaacaaatgaatcaattttgaaggttgctttagaccatggcaaggcttttggcatcataaagccacatgaccgagttgttgtctgccagaaagtagctgactcgtcagttgtgaagattcttgagctcgaagattgaatgattacaacttatgcgttatttgatgcataataataaagattcttgggcttgtgtttgataatcggagcgatatccagttttgaaatcaagcatggtgtgctgatctttcggctacttatgttgtttaatagtaaaccatccgaattcgaaaacgaaattgattatcttctaatgaattttatgctgaaaagaaaagtatgaattataagacaacttgtaaacactgagtgtgccagataaacttgtgagattattttagcttaaaaaaaaaaaaaaa

SEQ ID NO: 68322 - protein, 526 aa, Glycine max
MHSSPLLLEEPIRMASILEPSKPTFFPAMTKIVGTLGPKSRSVDIISHCLDAGMSVARFDFSWGDPEYHQETLENLRVAIKSTKKLCAVMLDTVGPELQIENKTDHPITLEADTLVVLTPDQNKEASSNLLPLNFTGLSKAVKKGDTIFIGKYLFTGSETASVWLEVSEVEGEDVTCLVKNTATLSGSLFTVHVSQIHIDLPTLADKDKEVISTWGVQNNIDFLSLYTRHVEDIRHAREFLSKLGDLKQTHIYAKIENIEGMKHFDEILREADGIILARGNLGIELPPEKVFLFQKAAIYKCNMVGKPVVVTRVVDSMTDNLRPTRAEATDVANAVLDGSDAILLGAETLRGQYPVETISIVGKICAEAEKVHNQDLYFKKAVKYVGEPMSHLESIASSAVRAAIKVKASVIICFTSSGRAARLIAKYRPTMPVISVVIPQLKTNQLRWTFTGAFEARQSLIVRGLFPMLADPRHPAESRSGTNESILKVALDHGKAFGIIKPHDRVVVCQKVADSSVVKILELED

SEQ ID NO: 68323 - DNA, 1965 bp, Glycine max
  CDS (127)..(1764)
ctgaccaccagaagaatgggacctggttggttgaaagtggagcgaagaaaactaacggagacttgtttggaagctagtctctggtgagagtgaaggcgcaccatcttcaccttgaagtcaacgatcatggcaaccattaacctttcttccgctactacgtctctcttccaatccaaacaccgaacgaaacgcattccacgcctccctacaatcgccagaataacaaaccacatcgaaggaactcatcttaactcccccaacggctctcccatccttggcaacgcaaacaattcccttgaggttccctccaataactatatctcgctacactcttcagacgtgcgtaggaaaactaagatcgtgtgcacgataggtccttctacgagctcacgtgatatgatatggaacctggctcaagctggaatgaacgtggcgcgtttgaacatgtcgcatggggaccacgcctcgcacctccaaaccattgatttggtgaaagaatacaattctcagtttcaagataaggttgtagccatcatgctcgacaccaagggtcctgaagttagaagtggggatgtagctcaacctattttacttaaagagggacaagaattctgtttcaccactatgagaggggttagcacacatgacacggttagcgtgaactacgatggctttgtgaatgatgtggagttcggagatgtgttgctggttgatggaggaatgatgtctcttgctgttaagtcaaagacaaaagacttggttaaatgtgaagttattgatggtggtgaactgaaatctaggcgtcatttaaatgtccgtggaaaaagtgcaacacttccttccataactgacaaggactgggaagatatcaagtttggggtggacaatcaagtagacttctttgctgtctcatttgtcaaggatgctagagtggtgcacgagttaaaacactacctcaaaagtcataatgccgatatacacgtgattgtaaaaattgaaagtgcagattccataccaaatctccattcgatactttctgcttcagatggggccatggtcgctcgtggggatcttggagctgaacttccaatagaggaagttcctttattgcaggaagacatcattcgaagatgtcaaattatgcaaaagcctgttattgtggcaacaaatatgcttgaaagcatgattaatcatcccacaccaacaagggcagaagtttcagacatcgcaattgcagtaagacaaggtgctgatgctatcatgctttcaggagaaactgcacatggaaaatttccattgaaagctgttaaagttatgcacacggtggctcttaggaatgaatccagtgttcaaagtggtgtttcttatccgagtcaactgagttcccatgaaagtcatatgggagaaatgtttgctttccatgcgacaacaatgtctaacactcttaatactcctattattgttttcaccagaacaggatccatggcaattcttttgagccattataggccttactcaacaatctttgcattcacaaatgaagcaagaattaagcagaggttggcgctttatcatggggttatgtccatatacatgcaattttcaaatgatgtagaagagaccttctctagagccctcaagctactattgagtaagagtcatttacacgagggacaacatgtcacacttgttcaaagtggagcacaaccaatctggcgtgaggaatccactcaccacatacaagttcgcaaggttcatggataaaattctatgaaggatctttgttcctcataagtgtacagtttttttccccactatcttgtaactattcatagtaatggctattcactatcttgtaactattcatagttatgactattatgcacttgaaacaccaaagttggatagtaaaggaattttcataatgcaaatagtgatttattgataaggaaaaaaaaaaaaaaa

SEQ ID NO: 68324 - protein, 545 aa, Glycine max
MATINLSSATTSLFQSKHRTKRIPRLPTIARITNHIEGTHLNSPNGSPILGNANNSLEVPSNNYISLHSSDVRRKTKIVCTIGPSTSSRDMIWNLAQAGMNVARLNMSHGDHASHLQTIDLVKEYNSQFQDKVVAIMLDTKGPEVRSGDVAQPILLKEGQEFCFTTMRGVSTHDTVSVNYDGFVNDVEFGDVLLVDGGMMSLAVKSKTKDLVKCEVIDGGELKSRRHLNVRGKSATLPSITDKDWEDIKFGVDNQVDFFAVSFVKDARVVHELKHYLKSHNADIHVIVKIESADSIPNLHSILSASDGAMVARGDLGAELPIEEVPLLQEDIIRRCQIMQKPVIVATNMLESMINHPTPTRAEVSDIAIAVRQGADAIMLSGETAHGKFPLKAVKVMHTVALRNESSVQSGVSYPSQLSSHESHMGEMFAFHATTMSNTLNTPIIVFTRTGSMAILLSHYRPYSTIFAFTNEARIKQRLALYHGVMSIYMQFSNDVEETFSRALKLLLSKSHLHEGQHVTLVQSGAQPIWREESTHHIQVRKVHG

SEQ ID NO: 68325 - DNA, 2067 bp, Triticum aestivum
  CDS (115)..(1659)
gaattcccgggtcgacttcgctgtcgacgatttcgtatccgccccaaatccaaatctcatcgccttcccactctccccaccccaccctcgtctcccccggatcggtagcgcgcgatggccaacatcgacatggcggcggtgctggcggacctggagcgggacgcggcggcggacgcccgcaccccgcggaccaagctggtgtgcacgctcggcccggcctcccgctccgtgcccatgctcgagaagctgctccgcgccggcatgaacgtcgcgcgcttcaacttctcccacggcacccacgagtaccacaaggagaccctcgacgccctccgccaggccatgcacaacaccggcatcctctgcgccgtcatgctcgacaccaagggacctgagattcgtactggatttttgaaggatggtaaaccaatcaaactgacaaagggtcaagaaatcactgtttccaccgactatgatatcaagggcgacacgaacacgatctccatgagttacaagaaacttcctcaggatgtgaagcctgggcatgtcatactatgtgctgatggtaccatctccttggctgttctctcttgcgacccagcagctggaactgtcagatgtaggtgtgagaacactgcaatgcttggagagaggaagaattgtaatctgccaggaattgtcgtggaccttcctacactaacggagaaggataaggaggacattttggaatggggtgtgcctaatgacattgacatgattgctttgtcgtttgtccgcaaaggatcagatttggtgaccgtcaggcagcttcttggacagcatgcaaagcgcatcaagttaatgtcaaaggttgaaaaccaggagggcattgtgaactttgatgacattctgagggaaaccgatgcctttatggttgccagaggtgatcttggaatggagattccagttgagaagatattcctggcccaaaaaatgatgatttacaagtgcaaccttgctggcaagcctgttgtcacagcgacccagatgcttgagtcaatgatcaagtccccgaggccaacccgtgccgaggctactgacgtcgcaaatgcggtgcttgatggaaccgactgtgtcatgctcagtggtgaaagcgctgctggagcataccctgaggtggctgtgaagatcatggctcgcatctgcgtggaggcagagtcttccctggacaacgacgccgtcttcaaggagatgatcaaggccgcgcccctcccgatgagcccgctggagtcccttgcgtcttccgccgtgcggaccgccaacaaggccagggccactctgatcgtcgtcctgacccgtggcggcaccactgcgaagctggtggccaagtaccgccccagggtcccgatcctctcggtggttgtcccagtgctgacaaccgactcgttcgactggaccgtcagctccgagggcccggccaggcacagcctgatctacaggggcctgatcccgctcctcgccgagggctccgccaaggccaccgactcggagtcgacggaggagatcctccaggcggcgctcaagtcggccgtgaagaagcagctctgcaaggccggcgacgccgtagtcgtcctgcaccgcatcggcatggcctccgtcatcaagatctgcaccgtcaagtgaccgccattgccgggcatggtgacccgagcgccgccccggtccttgctgccgtggcgagacccgggtctcccttgttcctctctggtctttctcctggagacgaactgattaatcgccgtaccgtcagtattgcagtttgttgcatagatccgatccgagctggtaaattaggagggagaggactccgttatatagagctcttttattacctgtagtatggtgtttggcaggtgtcatgcctgcacaaatttttctctaattattattagttgctgctgctgcttgttgtactctgaactctcaagtactggtttggtagtgatgtcgatacatgtggtgataataagattttggcatcgtcgagtcggaagctcaaaagagagagagagaccgacacgcagcggccgc

SEQ ID NO: 68326 - protein, 514 aa, Triticum aestivum
MANIDMAAVLADLERDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEITVSTDYDIKGDTNTISMSYKKLPQDVKPGHVILCADGTISLAVLSCDPAAGTVRCRCENTAMLGERKNCNLPGIVVDLPTLTEKDKEDILEWGVPNDIDMIALSFVRKGSDLVTVRQLLGQHAKRIKLMSKVENQEGIVNFDDILRETDAFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNDAVFKEMIKAAPLPMSPLESLASSAVRTANKARATLIVVLTRGGTTAKLVAKYRPRVPILSVVVPVLTTDSFDWTVSSEGPARHSLIYRGLIPLLAEGSAKATDSESTEEILQAALKSAVKKQLCKAGDAVVVLHRIGMASVIKICTVK

SEQ ID NO: 68327 - DNA, 1046 bp, Triticum aestivum
  CDS (10)..(831)
gcaacttgcatgaacacaaccgcacctcagaactcctctgtaacctctacctgtgctcattcctcggaagtactgcacggctgccgcctcatggcggcatccacagcgtcgtctagccccttgacggccttcctccatcggcacgacgcacgcagccgacgccgcgcaaggttcgtcgtcgcggcgagcacggcggacgccgagccgtccccagaggctacagcggcgtcgtcctcgtcaacggcagggccagggaagaagaagacggtggacacaaggatccactggtctgacccagacgaagggtgggtgggaggaaaggcgaacaaggaaggcgacggccgcaaggacgagccgatggggcgacgattcgccgacctcatcaacaacccgtccgagtcacactaccagttcctaggaatatcgcctggtgcagacatagaggagatcaaggcggcgtaccggcggctgtccaaggagtaccacccggacacgacgaggctgccgctcaagtcggcctcggagaagttcatccggctccgggaggtgtacaaggtgctgagcaaggaggagagccgccgcttctacgactggacgctggcgcaggaggccgagagccgccggctgcagcagctcaggtcacgcctcgaggacccctacgagctcgacctccagaactacgagcccgtgcccgacacggtggatcgccttggcgggaagaacatggagctcagcgaccaggccatgaccgccctcacgttcgacatcggcatcatcatcttcagcatctgctgcatcatctacgccctcttcttcaaggagcaatactgatagaacagaaggatgctgtatagtagtactggactacagacacgaatggtacagtatatgcaaggtaatagcagataatgtcatatagcgtattatgtaacatgaaatacaagctaggaatcactcataggtattatctcaacaatcctataattttgtccaaaacttggatgtttgagtgaatgagctctcttcactttaaaaaaaaaaaaaaa

SEQ ID NO: 68328 - protein, 273 aa, Triticum aestivum
MNTTAPQNSSVTSTCAHSSEVLHGCRLMAASTASSSPLTAFLHRHDARSRRRARFVVAASTADAEPSPEATAASSSSTAGPGKKKTVDTRIHWSDPDEGWVGGKANKEGDGRKDEPMGRRFADLINNPSESHYQFLGISPGADIEEIKAAYRRLSKEYHPDTTRLPLKSASEKFIRLREVYKVLSKEESRRFYDWTLAQEAESRRLQQLRSRLEDPYELDLQNYEPVPDTVDRLGGKNMELSDQAMTALTFDIGIIIFSICCIIYALFFKEQY

SEQ ID NO: 68329 - DNA, 2002 bp, Triticum aestivum
  CDS (128)..(1711)
cgaacattcctctttctctcccttgcttggggaagaagaagaagaagaagaagaagagagggcgagcgcccccgcctcccgacgccgtcgcccctcgccgccgatctgatctcaggagccagcgaagatgcattccaccaatctgctcctcgaggagcccatccggatggtctccatcctcgagccatccaagccgaacttcttcccggcgatgacgaagattgtggggacgctgggtccgaagtcccggtccgttgaggccatctccgcctgtctaaaggccggcatgtctgtggcccgtttcgatttctcgtggggggatgccgcgtaccaccaggagacactcgagaacctcaagctcgccatcaaggccaccaagaagctatgtgctgttatgctcgacactgttggccctgagttgcaagtggtgaacaagagtgaagtcacaatctcgcttgaagagaacgagtctgttgttctcacccctcaccagggccaggaggcctcttccaagttgctccctatcaacttcgctggactcgccaaggctgtgaagcccggagccacaatattcgttgggcaatatttgttcacgggcagtgagactacatcagtttggctggaggtttctgaagttcaaggggatgacgtggtttgcgtgatcaagaactcagctaccctggctgggtcactcttcacattgcactgctcccagatccatatcgacatgcccacgctgtctgatgaggataaagatgttatgaaaaaatggggtgctccaaacaagattgacttcctctctctttcttatacaaggcatgcagaagatgtgcggcaagcacgggagttcctctctaagttaggtgatcttagccaaactctgatttttgccaaaattgagaatgtggagggcttgaaccattttgatgagatcctggaggaagcggatggtatcattctgtcaagagggaaccttggaattgatcttccacctgaaaaggtgttcttatttcagaagtctgctctgcacaagtgcaacatggctggaaagcctgctgttgttactcgtgttgtggacagtatgacggacaacctaaggcctactcgtgcggaggcaactgatgtggcaaatgcggtgctggacggtagtgatgccattctccttggtgctgagactctccgtgggttgtatccagtcgagactatttcaacagtgggcagaatttgtgctgaggctgagaaggtcttcaaccaagatttgtatttcaagcgaaccgtgaaatatgtgggagaacccatgacccacttggagtctattgcttcctctgcagtgcgggctgctattaaagttaaggcttcggtcatcatttgcttcacttcatctggacgggctgcaaggctaattgccaagtacaggcccaccatgcctgtcctgtccgttgtcattcctcgtctgaaaacaaatcaattgaagtggagcttcacaggtgcatttgaggcaagacaatcactcatagttagaggcctctttcccatgcttgctgatccacgtcatccggctgattctactagcactacaaatgaatcagtgttgaaggttgctcttgaccacggcaaagcatctggtgtgatcaagtcgcatgaccgtgtcgtcgtgtgccagaaagtgggagattcctctgtcgtgaagatcattgagctagacgactaggcaaaattagcctttgctcagggcttgccagatttttgactaggccaaaacgttgcttggtggctatgtataattctatctatagttttgcaaaacgagcagtttttcctatggtgtcatcataggatccgcggttatcattctgaaacctacgctagttattatggatatgtcctcagattttactgcagtgtagcgagtaaatgatctgatggaataatgatatcaaaactttgtgacccttattgttgtcgctaagcctatgttcccatttgcaaaaaaaaaaaaaaa

SEQ ID NO: 68330 - protein, 527 aa, Triticum aestivum
MHSTNLLLEEPIRMVSILEPSKPNFFPAMTKIVGTLGPKSRSVEAISACLKAGMSVARFDFSWGDAAYHQETLENLKLAIKATKKLCAVMLDTVGPELQVVNKSEVTISLEENESVVLTPHQGQEASSKLLPINFAGLAKAVKPGATIFVGQYLFTGSETTSVWLEVSEVQGDDVVCVIKNSATLAGSLFTLHCSQIHIDMPTLSDEDKDVMKKWGAPNKIDFLSLSYTRHAEDVRQAREFLSKLGDLSQTLIFAKIENVEGLNHFDEILEEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVRAAIKVKASVIICFTSSGRAARLIAKYRPTMPVLSVVIPRLKTNQLKWSFTGAFEARQSLIVRGLFPMLADPRHPADSTSTTNESVLKVALDHGKASGVIKSHDRVVVCQKVGDSSVVKIIELDD

SEQ ID NO: 68331 - DNA, 1825 bp, Helianthus annuus
  CDS (128)..(1624)
ataacaaaccaacccacccatttttattctcatttcacacatcaccgccgcccaatattcaatacattctcatcattttcaattctgtttctcaatttgattccattattccttcacaatcacactgatggatcaccagatgaagaggccgaagacgaagatcgtctgcacgttaggacctgcatctagatcagttccaatggtggagaagctcttaaaagcaggtatgaacgttgctcgcttcaatttctctcacggatcctatgaatatcatcaggaaacgcttgataatctccgcactgctatggataacaccggtatactctgtgcggttatgctcgacaccaagggtccagagattcgaaccgggtttttaaaagatggcaagccagttcagcttaaacagggtcaagaaatcacaatctctatcgattacaccatcaaaggcgatgaaaacatgatctgcatgagctacaagaagctagctcacgatgttaaaccacaaagtgtgattctctgtgcagacggcaccatttcgtttactgttctgtcttgtgacattgaaaacgggctagttcgttgtcgttgtgagaacactgcggttcttggtgaacgaaaaaacgttaatctacctggtgtgattgtggatctaccaacgctgactgagaaagacaaagaagatatcatgaaatggggtgttcctaataagattgatatgattgctttgtcgtttgtccgaaagggttcagaccttgtggaggttcgtaagctgttgggagtacatgctaaaaacattctgcttatgtctaaggttgaaaatcaagaaggggttgccaactttgatgatatcctagcgaactcagacgcgtttatggtggcgcgtggtgatctcgggatggaaattccgattgagaaaatatttctagctcagaaagtaatgatatacaagtgcaacctacaaggaaagccggttgtaaccgccactcaaatgctggagtcaatgatcaagtctccaaggcccactcgagccgaagccacagacgttgctaacgcggtcctcgatggaaccgactgcgtcatgcttagtggagaaaccgcagccggggcttacccagagctcgcagttcaaaccatggctaaaatctgcatggaagccgaaagcacaatagactataaagacgttttcaaaaggatcactgccaatgcaccggtccccatgagcccacttgaaagcttagcctcttctgcggttcgaaccgcgatctcatcaaaagcgagtctgatattggttctaaccagaggtggaagcactgcgaaactagtggctaagtaccgccccgggatgcctatactgtctgttgtggttccagaaatcaagaccgattcttttgactggtcttgtagtgatgagtcaccggctagacatagtctaatctttaggggtttggtcccggttttgattgcggggtctgctagagcttctcatgatgagtccactgaagaagctattgaatttgctttgcaacatgctaaagataaaggactatgcaagaatggtgattcggttgtggctctacatcgtgttggaaccgcgtctataatcaagatcgtgacagttaagtgattcttatgctatattgatattgtcgatttttgccctttcgatggcacacattgttacactggtaaactaaagttgattttggtatcgatgaactggatttgttatgagaaactacgtaacgagtaatgcatttttgtcgcgagtttgaataattgacattacttcgtgttttttggaaaaaaaaagaaaaaaaaaaaaaaa

SEQ ID NO: 68332 - protein, 498 aa, Helianthus annuus
MDHQMKRPKTKIVCTLGPASRSVPMVEKLLKAGMNVARFNFSHGSYEYHQETLDNLRTAMDNTGILCAVMLDTKGPEIRTGFLKDGKPVQLKQGQEITISIDYTIKGDENMICMSYKKLAHDVKPQSVILCADGTISFTVLSCDIENGLVRCRCENTAVLGERKNVNLPGVIVDLPTLTEKDKEDIMKWGVPNKIDMIALSFVRKGSDLVEVRKLLGVHAKNILLMSKVENQEGVANFDDILANSDAFMVARGDLGMEIPIEKIFLAQKVMIYKCNLQGKPVVTATQMLESMIKSPRPTRAEATDVANAVLDGTDCVMLSGETAAGAYPELAVQTMAKICMEAESTIDYKDVFKRITANAPVPMSPLESLASSAVRTAISSKASLILVLTRGGSTAKLVAKYRPGMPILSVVVPEIKTDSFDWSCSDESPARHSLIFRGLVPVLIAGSARASHDESTEEAIEFALQHAKDKGLCKNGDSVVALHRVGTASIIKIVTVK

SEQ ID NO: 68333 - DNA, 1989 bp, Brassica napus
  CDS (70)..(1725)
cgcaaaaccaaaacttctccaaagctttgaaaagaaaaaccaaagtgttaaattgtctaaaaacttagaatggctccacaagaagacgccatgcagaaacagagcagcaacaagagtgacgtcatattccgatcaaagcttccggatatttacatcccgaaccacctccctctccacgactacatcttccaaaacatctccgagttcgcctccaagccttgcctgatcaacggtcccaccggccacgtgtacacttactccgaggtccatgtcgcttcccgtcgcatcgccgccggttttcaaaaactcggcgttaaccaaaacgacgtcgtgatgatcctcctctcgaattgccccgagttcgtcctctctttcctcgccgcctccttccgcggcgcaacggccaccgccgctaacccgtttttcactccggcggagatcgccaaacaggccaaagcctcgaactcgaagctcatcgtcaccgagtctcgctacgtcgataaaatcaaagacctccaaaacgacggcgttataatcgtctgcaccgacgaggaaccttctccgatcccggaaggctgcctccgattcaccgagttgactcagtcaaccgaaattgaaacggtggagatttcttccgacgacgtggtggcgcttccttactcctccggcacgacgggtctacccaaaggagtgatgctgactcacaagggactagtcacgagcgtcgctcagcaagtcgacggcgataatccgaatctttacttccacagcgatgacgtcatactctgtgtcttgcccatgttccatatctacgctttgaactcgatcatgctgtgtgggcttagagttggtgcctcgatcttgatcatgccaaagttcgagattaatctgctcttggagctgatacagaggtgtaaagtgacggttgctccgatggttccgccgattgttttggcgatggcgaagtcgccggagacggagaagtatgacttgagctcgattagggttgtgaaatctggtgctgctccgcttggtaaggagcttgaagatgccgtcagtgccaagtttcctaacgccaaactcggtcagggatacggaatgacggaagcaggtccggtgctagcaatgtcgttagggttcgcgaaagagccgtttccagtgaagtcgggagcttgtggtacggtggttagaaacgccgaaatgaaaatcatcgatccagacaccggagactcactttccaaaaacaaacctggagagatttgcatccgtggtcaccagatcatgaaaggttacctcaacaacccggcggctacatcagagaccatagacaaagacggctggcttcacacgggagatatcggattgatcgatgacgacgacgagcttttcattgtcgatagattgaaagaacttatcaagtacaaaggttttcaagtggctccggctgagctagaggctctcctcatcggtcatcaggatatcaccgacgtggccgttgtcgccatgaaagaagaggctgctggtgaagttcccgttgcgtttgttgtgaaatccaaggattcagagttatcagaagatgatgtgaaacaattcgtggcgaaacaggttgtgttttacaagagaatcaacaaagtgttcttcgttgagtccattcctaaagctccgtcagggaagatattgaggaaagacctgagggcaaaactagcaaatgggttggtaaactaaagaaacgaaacgcaaaagatgttccattgtatatacatacaactgtttgacgatcccaatgaaggactagagaaactcatacgaatcaatcaatgcctgtttctttttgtctttgtgttgttgttgtctttggttcatgtaatgaaccttttgtaataaaaggtggtttctttttttttgggtttcatgtaacttgtgctggagaagaccagcagactttttcataaaataaattactgttgttaaagcaaaaaaaaaaaaaaa

SEQ ID NO: 68334 - protein, 551 aa, Brassica napus
MAPQEDAMQKQSSNKSDVIFRSKLPDIYIPNHLPLHDYIFQNISEFASKPCLINGPTGHVYTYSEVHVASRRIAAGFQKLGVNQNDVVMILLSNCPEFVLSFLAASFRGATATAANPFFTPAEIAKQAKASNSKLIVTESRYVDKIKDLQNDGVIIVCTDEEPSPIPEGCLRFTELTQSTEIETVEISSDDVVALPYSSGTTGLPKGVMLTHKGLVTSVAQQVDGDNPNLYFHSDDVILCVLPMFHIYALNSIMLCGLRVGASILIMPKFEINLLLELIQRCKVTVAPMVPPIVLAMAKSPETEKYDLSSIRVVKSGAAPLGKELEDAVSAKFPNAKLGQGYGMTEAGPVLAMSLGFAKEPFPVKSGACGTVVRNAEMKIIDPDTGDSLSKNKPGEICIRGHQIMKGYLNNPAATSETIDKDGWLHTGDIGLIDDDDELFIVDRLKELIKYKGFQVAPAELEALLIGHQDITDVAVVAMKEEAAGEVPVAFVVKSKDSELSEDDVKQFVAKQVVFYKRINKVFFVESIPKAPSGKILRKDLRAKLANGLVN

SEQ ID NO: 68335 - DNA, 1836 bp, Glycine max
  CDS (42)..(1598)
acaattcacaaccttcaaacatatttataagaataacaccaatggatactccaatgaccctcacgggcttgctccgcgacgtcgccgccaaattcccttcccgccgcgccatctccgtcgccggaaaattcgacctcacccactcccgcctccatcaactggttgaatccgccgccgcccgcttagtcgccgccggaatcaaacccggcgacgtcatcgctctcaccttccccaataccgtcgagtttgttgtcttgtttctagccgtcattcgagtgcgcgccacagccgcgccgttaaacgcggcttacacagccgaagagtttgagttttacttgtccgactccgagtccaagcttcttctaacatcagcagaaggaaacaactcagctcaagccgcagcttcaaaactcaacatccttcacagcacagcttcaataacccaagccggagacaaagaagccgagctgagcctctcattaagccactccgagtcagagtcaattaactcggttgagtcactcggaaacgatccagatgacgtggcgcttttccttcacacctcgggcaccacgagccgacccaagggagtgcctttgacgcaacacaacctgttctcttccgtgaacaacattaaatcggtgtaccgactcactgagtccgactcgacggtgatcgttcttcctttattccacgtgcacggtttgatcgcggggctcctgagttcgctcggcaccggggcggcggtggcgctgccggcagcggggagattctccgcctcgtcattctggaaggacatgattaaatacagcgccacgtggtacacagcggttcctacaatacaccagatcatactggaccgccactcgaacagccccgaaccggtttacccgcgcctccggttcattcgaagctgcagcgcgtcgctcgcaccggctattctgggtaaacttgaggaggccttcggtgcgccagtgctggaggcttacgcgatgacggaagcgtcgcatttgatggcttcgaaccctttgccgcaagatgggccccacaaggccgggtcggttgggaaacccgtgggtcaagaaatggttatattggacgaaacgggtcgggttcaagatgctgaagttagtggagaggtttgcattaggggtcctaatgttacgaagggatataaaaataacgtggatgccaatacggcggcgtttttgtttggttggtttcacaccggtgatgttgggtacttggattctgatgggtatttgcatctcgtgggtcggatcaaggagctcatcaaccgaggaggagaaaagatatcaccaatagaagtggatgctgtccttctttcacacccagacattgctcaggcagttgcttttggagtgcctgatccaaagtatggggaggagatatactgtgctgtaatcccaagagaaggatcagacattgatgatgcagagttgctaagatattgcaagaagaatcttgcatctttcaaagtccccaaaaaggtcttcattaccgattctttgcccaagactgccaccggaaagattttgcgtcgtcttgtggcagaacactttgtctctcaaatttgagcaactcaagtcctacatttgaagactccatacctggccatacatagttggagtccacacaccataaatttcaacagtagtttggcaacttggcatttaggaggaggatatttctgcaaatggtctttcatacaggatacagtatattgtagttttcaatgattcatgtgaaatgttcacagggtaatgttttcaaggttttaaagatcttaaataatttctcaaaaaaaaaaaaaaa

SEQ ID NO: 68336 - protein, 518 aa, Glycine max
MDTPMTLTGLLRDVAAKFPSRRAISVAGKFDLTHSRLHQLVESAAARLVAAGIKPGDVIALTFPNTVEFVVLFLAVIRVRATAAPLNAAYTAEEFEFYLSDSESKLLLTSAEGNNSAQAAASKLNILHSTASITQAGDKEAELSLSLSHSESESINSVESLGNDPDDVALFLHTSGTTSRPKGVPLTQHNLFSSVNNIKSVYRLTESDSTVIVLPLFHVHGLIAGLLSSLGTGAAVALPAAGRFSASSFWKDMIKYSATWYTAVPTIHQIILDRHSNSPEPVYPRLRFIRSCSASLAPAILGKLEEAFGAPVLEAYAMTEASHLMASNPLPQDGPHKAGSVGKPVGQEMVILDETGRVQDAEVSGEVCIRGPNVTKGYKNNVDANTAAFLFGWFHTGDVGYLDSDGYLHLVGRIKELINRGGEKISPIEVDAVLLSHPDIAQAVAFGVPDPKYGEEIYCAVIPREGSDIDDAELLRYCKKNLASFKVPKKVFITDSLPKTATGKILRRLVAEHFVSQI

SEQ ID NO: 68337 - DNA, 2025 bp, Glycine max
  CDS (60)..(1748)
gaattcccgggtcgacttcgctgtcgacgatttcgtcgtaaacacattcagacaccaccatgataactctagctccttctcttgatactccaaaaactgatcaaaaccaagtttctgatccccaaactagccatgtcttcaaatcaaaattaccagatatcccaatctccaaccacctccctctccactcctactgcttccagaacctctcccaatttgcccaccgcccttgcctcatcgtcggacccgcctccaaaaccttcacctacgccgacacccacctcatttccagcaagatcgccgccggattgtccaacctcggaatcctcaagggcgacgtcgtcatgatcctcctccagaactccgccgatttcgtcttctccttcctcgccatctccatgattggcgccgtcgccaccaccgccaacccgttctacaccgccccggagatcttcaagcagttcaccgtctccaaggcgaagtcgatcataacacaggcaatgtacgtggacaagctccgcaaccacgacggcgcgaagctcggcgaggacttcaaggtcgtaaccgtcgacgatccgccggagaattgcctccacttctctgtcctctcggaggcgaacgagagcgacgtgccagaggtggagatccacccggacgacgcggtggcgatgccgttctcctccggcacgacgggtttacctaaaggagtgattctcacgcacaagagtttaaccacgagtgtggcgcagcaagttgacggagagaaccctaacctctacctcaccaccgaggacgtgctcctctgcgtgcttccgctctttcacatattctcgctcaacagtgtgctattgtgcgccctcagggcggggagtgcagttttgttgatgcagaagttcgagatcgggacactgctggagctgatacagcggcaccgagtgtcggtggcgatggtggtgcccccgctggtgttggcgttggcaaagaatccgatggtggcggattttgacctgagttcaatacggttagtgctgtccggagctgctcccttggggaaggagctcgaggaggctctccggaacaggatgcctcaagctgttttgggacagggttacgggatgacagaagcagggccagtgctgtccatgtgcttgggctttgcaaagcaacctttccaaacaaaatcaggctcttgtggtaccgtagtcagaaatgcagaactcaaggttgttgaccctgaaactggtcgttctcttggctacaatcaacccggtgaaatttgcatccgagggcaacagatcatgaaaggatatctgaacgatgaggcagcgacagcatcgaccatagattcagagggttggcttcacaccggtgatgttggctacgtagatgatgatgacgaaattttcattgttgacagggtgaaggaactcatcaaatataaaggcttccaggtgccccctgcagaacttgaagggcttcttgtaagccatccctccattgcagatgcagctgttgtcccacaaaaggatgttgctgctggtgaagttcctgttgccttcgttgtgagatcaaacggctttgatctaactgaagaggctgtaaaagagtttatagctaaacaggtagtgttttacaaaagactgcacaaagtttattttgttcatgctattcccaagtctccatcaggaaagatattaaggaaagacctcagagcaaagctagaaaccgccgccactcagacgccttaaaggctagctagaacctgcccccttttttcttggcaatattttccttattttttatttatattattggtttcacacgtgtaatttacgtatcaatgcttcacggcattaagccaatccgagaagcagttgcacttacgtataatcattgtatttttatgtccattgtccaccaccatgtctgtattgtggttttagatcactaattttcgagaccttgtattattggtgttatcaaatccttgctattctgcaaaaaaaaccgacacgcagcggccgc

SEQ ID NO: 68338 - protein, 562 aa, Glycine max
MITLAPSLDTPKTDQNQVSDPQTSHVFKSKLPDIPISNHLPLHSYCFQNLSQFAHRPCLIVGPASKTFTYADTHLISSKIAAGLSNLGILKGDVVMILLQNSADFVFSFLAISMIGAVATTANPFYTAPEIFKQFTVSKAKSIITQAMYVDKLRNHDGAKLGEDFKVVTVDDPPENCLHFSVLSEANESDVPEVEIHPDDAVAMPFSSGTTGLPKGVILTHKSLTTSVAQQVDGENPNLYLTTEDVLLCVLPLFHIFSLNSVLLCALRAGSAVLLMQKFEIGTLLELIQRHRVSVAMVVPPLVLALAKNPMVADFDLSSIRLVLSGAAPLGKELEEALRNRMPQAVLGQGYGMTEAGPVLSMCLGFAKQPFQTKSGSCGTVVRNAELKVVDPETGRSLGYNQPGEICIRGQQIMKGYLNDEAATASTIDSEGWLHTGDVGYVDDDDEIFIVDRVKELIKYKGFQVPPAELEGLLVSHPSIADAAVVPQKDVAAGEVPVAFVVRSNGFDLTEEAVKEFIAKQVVFYKRLHKVYFVHAIPKSPSGKILRKDLRAKLETAATQTP

SEQ ID NO: 68339 - DNA, 1927 bp, Glycine max
  CDS (86)..(1729)
gaattcccgggtcgacttcgctgtcgacgatttcgttcaatctccaggctatctatcaagtaagaaagctgttaagaggaggagaatggctgatgatggaagcaggagggaattgatattcaggtcgaagcttccggatatctacatccccaaacatatgcccctccactcttactgcttcgagaatttgagagagtgtggttcacgcccctgcctgatcaatgcccccacgggagacgtctacagctaccacgaggtggacagcaccgccagaaaggtggcgagggggctgaagaaagagggcgtggaacagggccaggtcatcatgatcctcctccccaattgccccgaattcgtcttctcgtttcttggcgcatcccaccgcggtgccatggccactgccgccaaccctttcttcacccccgccgagattgcaaagcaagcccatgcctccaatgccaagctcctcatcacccaggcctcttactacgacaaagtcaaggacctccgcgacatcaagctcgtattcgtcgactcttgtcccccccatacagaggagaagcagcatctccatttctcacatctgtgtgaggataacggtgacgctgatgttgatgttgatgttgatatcaagcccgatgacgtggttgcattgccttattcttcgggaacaactggtcttcccaagggagtgatgctgagccacaaggggctggtgaccagcattgctcagcaggttgacggtgataatcccaacctctattaccactgccacgacaccatcctctgcgtgcttcccctctttcacatttactctctcaactccgttcttctctgtggcttgcgtgccaaggctaccattctcctcatgcccaagttcgatattaactccttgcttgctctcattcacaagcacaaagtcactattgcccctgtcgtccctcccattgttctcgccatttccaaatcacccgatctccacaagtacgacctgtcttccatcagagtcttgaagtccgggggagcccctctgggtaaggaactcgaagacactctcagagctaaattccccaacgccaaacttggccagggatacggaatgactgaggcagggcctgtgctaacaatgtctttagcttttgctaaagaaccgatagacgtgaaaccaggtgcatgtggaaccgttgtaagaaatgcagagatgaagattgtcgatcctgaaaccggtcattctttacccagaaaccaatccggtgaaatttgcataagaggcgaccagattatgaaaggttatctaaatgatggagaggctacagagagaaccatagacaaagatggttggttgcacacaggtgacatcggttacatcgacgatgacgatgagttattcatcgttgacaggctcaaggaattgatcaaatacaaaggatttcaagtggctccagctgaacttgaagcccttcttctcactcatcctaagatctctgatgctgctgttgttccaatgaaggatgaagccgcgggagaggtacctgttgcatttgtggtcatatcaaatggttataccgacacaaccgaggatgaaattaagcagtttatctccaaacaggtggtgttttacaaaagaataaaccgagtattcttcattgatgcaattcccaagtcaccgtcaggcaaaatcttgcgcaaggatctaagagcaaagatagcggcaagtgttccaaaatgaaattaaaccaaacccatcatgttatggtgttattatacgatgcccgcataagcaagcttcaacacaaaaggaagaggcgctgttgcttgatcccgctagcttttacgtattttctcttacgtaacaaccgtgtataagttaccagtgtgattttcttacagaactatcttctgtaaagattccaaaaaaaaaaaaaaa

SEQ ID NO: 68340 - protein, 547 aa, Glycine max; identical to SEQ ID NO: 29714

SEQ ID NO: 68341 - DNA, 399 bp, Glycine max
  CDS (1)..(399)
atgaaagacacaatggaaactcctacgacactcaccaccttgctccgccacgtcgccgccaaattcccctcccgccgtgccatctccgtcgctgccaaattcgacctcacccactcccgcctccaccgcctggtcgaatccgccgccgctcagttagtctccgccggcgtcaaacccggcgacgtcgtcgccctcaccttccccaacaccatcgagtttgtagtcatgttcctagccgtcattcgggctcgagccacagccgcgccgttaaactcggcttacacagcggaagagttcgagttttacttatccgactcggagtccaagctcctcctaacatcaccagaaggaagaattgacatgtgtcatgtccatggccttatactgggtttcaaataa

SEQ ID NO: 68342 - protein, 132 aa, Glycine max
MKDTMETPTTLTTLLRHVAAKFPSRRAISVAAKFDLTHSRLHRLVESAAAQLVSAGVKPGDVVALTFPNTIEFVVMFLAVIRARATAAPLNSAYTAEEFEFYLSDSESKLLLTSPEGRIDMCHVHGLILGFK

SEQ ID NO: 68343 - DNA, 1897 bp, Glycine max
  CDS (133)..(1689)
gaaaacaccaactgttttgagttttccaaccttaaaaagactctctcttctctctctctctttctctccctgaagcaaaacaacattagcatcaaaaccagagtggttctagtaatccggtgctgctagaggatgggaactagtgaatggcatatcgagcgaagatctagcttcggcactgaatcccccttagcaagagaggcaggaaatgtgcctgaaactgggtcactctctattgttgtgcttggcgcttctggggatcttgctaagaagaagacatttcctgcacttttccatctataccggcagggattcttaccagcagatgaagttcacatttttggctatgcaaggacaaaaatatctgatgatgaattgagaaaccggttgcgtggctatcttgttccaaacaaaggtgcttctccccaactgttggaggatgtagagaagtttttacagctgatcaaatatgtaagtggctcttatgattctgaggatggatttcgcttgttggataaagagatttcagagcatgaatatttgaaaaagagtgttgagggtttatctcggaggcttttctatcttgctcttccaccttcagtatatccatctgtttgcaagatgatcaagacttgttgcatgaataaatctgatcttggtggatggacacgtgttgttgtcgagaagccttttggtaaggatctagaatctgcagaggaactcagtactgagattggaaagttgtttgaggaaccacagatttatcgtattgatcactacttgggaaaggaactagtgcagaacttgttggtacttcgctttgcaaatcggtttttcttgccactttggaaccgcgacaacattgacaatgtacagatagttttcagagaggattttggaactgatggccgtggtggatattttgaccaatatggaattattcgagatattattcaaaaccatttgctgcaggttctttgcttggttgctatggaaaaaccagtttctctcaggcctgagcacattcgggatgagaaagtgaaggttcttgaatcagtgctccctattagagatgatgaggttgttcttggacaatacgaaggctataaagatgacccaacagtacctgacaagtcaaacaccccaacatttgcaactgttattctgcgaatacacaatgaaagatgggaaggtgttccgttcatactaaaagcagggaaggcactaaattctagaaaggcagagatcagggttcaattcaaggatgtccctggtgatattttcaagtgtaaaaagcaggggagaaatgagtttgttatccgcctacaacctttagaagctatgtacatgaagcttacggtcaagcaacctggactggagatgtcaacagttcaaagtgagctagacttgtcatatggacaacggtatcaaggagtaaccattcctgaggcttatgaacgcctaattcttgacacaattaaaggtgatcagcagcattttgttcgcagagatgagttgaaggcatcctggcagatcttcaccccacttttgcacagaattgatgaaggggaattcaagccactcccctacaaaccaggaagcagaggtcctgcagaagcagatcagttacttgaaaaagcaggctatgttcaaacacacggctacatatggatccctcctaccttgtagagtaatctaatgtaataacatgaggaatctttagttgctaatgaatacacaataagcttgagaggcttcccttggaaccactcctcatgaatgtgtaatcaagcatttgaactatgagagtgtttgacacggtttgtgtaactgatttgcctttaaatgcaaaataaatggaaaatgaagtctatttaccggcaaaaaaaaaaaaaaa

SEQ ID NO: 68344 - protein, 518 aa, Glycine max
MGTSEWHIERRSSFGTESPLAREAGNVPETGSLSIVVLGASGDLAKKKTFPALFHLYRQGFLPADEVHIFGYARTKISDDELRNRLRGYLVPNKGASPQLLEDVEKFLQLIKYVSGSYDSEDGFRLLDKEISEHEYLKKSVEGLSRRLFYLALPPSVYPSVCKMIKTCCMNKSDLGGWTRVVVEKPFGKDLESAEELSTEIGKLFEEPQIYRIDHYLGKELVQNLLVLRFANRFFLPLWNRDNIDNVQIVFREDFGTDGRGGYFDQYGIIRDIIQNHLLQVLCLVAMEKPVSLRPEHIRDEKVKVLESVLPIRDDEVVLGQYEGYKDDPTVPDKSNTPTFATVILRIHNERWEGVPFILKAGKALNSRKAEIRVQFKDVPGDIFKCKKQGRNEFVIRLQPLEAMYMKLTVKQPGLEMSTVQSELDLSYGQRYQGVTIPEAYERLILDTIKGDQQHFVRRDELKASWQIFTPLLHRIDEGEFKPLPYKPGSRGPAEADQLLEKAGYVQTHGYIWIPPTL

SEQ ID NO: 68345 - DNA, 2094 bp, Hordeum vulgare
  CDS (41)..(1909)
cgggatacggcggactgagaaagaagcgctaaccccgagcatggttacgacagtcctcgccgtggcggcttcagcagctccagcgccgcctccgtcgttggctgcgcgcttcagcccggttgcaggacctgctgtcggttttagagcgcattgttggattactgccaagatgaagctccacaaggccctggggaggcatggatggcaagtccagagaaagctggatattcgaggggatggtaaaattcctgactacttcgaggttgcatggcggactggaaatataactcgtcggaatgtacaacctgctggtgaaactggaggtgaaacggcaaatacaagctctgttatgtcagataactcgatcgatgacaaaggtttattgcatctgggactcaacaactctgaagctgatcgtcctgtactagaggaagaccttgttctgtttgataactttaatgaccaacctgaaagtgtaccatctctttgcattgctgtcattggagctactggcgaactggcaagaagtaaagtcttcccagcactatttgctctgtattacagtggttttcttcctcagaatgttgccatatttggatattctagaaagacattggcagacgaggatttaagatccatgattgaatccaatttgacctgtcgggtagatcaccacgaaaactgtgaagacaagttaaatgaattccttaaaaggacatactatgtcgatgcaggacacgataataaagatgggatggcgaaactaaatttgagaatgacacagatagagggcacttgtgcagcaaacaggatattctaccttgctgttccccaagaggcacttcttgatgtggcattgccattatctgacattgcccaaactaagcatggctggaataggataattatcgagaaaccatttggcttcactagtttgtcctcacaacgggtaacacagtctttgttgtcaagatttgaagagaagcaaatttaccgaattgatcatcttttggggaaggatctaattgaaaatctcactgtcttgagattttctaatttggtgtttgaaccattatggagtaggaagtacatacgtaatgtgcaggtcgttttttcagaagaaacatcaacagaaacacaagggaggtacttcggaaactatgggataatccgtgatatagtgcacagccacattcttcaaacgatagcactatttgctatggaaccacctgtaagtcttgatggggaggatatccgcgatgagaaggtgaaggtgctcagatcaattagaaaagtggacattgatgatgtcgtccttggtcaactcaaaaatacctgtggtaaagttgaccaatatacaaaatcaatgacacctacctacttggctgccgcaatgtacattgacaatgcacgttgggatggggtaccttttttgatcaagactggaatgggacttatggagaatagagctgagattcgtattcaatttcatcacgtccctggcaatatctaccgtgaacgttttggtcatgacatagatcttgacacaaatgagctggttttacgtgacctacccgaagaagccattctcttgaaagtcaacaataaggtcccgggtcttgggctccagttggatgcttcagagctcaacctactttacagagacaggtacgatgttgaagttccagattcatatgagcatcttcttttggatgttctagatggcgatagtcatctgttcatgcgaagtgatgaattagctgctgcatggagcgtgttggcgccaatactccatgagatcgaccagaagagggttgctcctgagctctacgaggctggggataaaggaccgattaatgcttactatctcgctgctaaacatggagtccgatgggatgatggctgctgagcggatgcttgggagctgctcaatgtatttcgcttccttctctctatgtagcaaaatctgtttggtaagaaatagagagaaaaaaagtgtttcttgcttgttgattcaaacccttccaaggtggatcaaagctactactccctccatcccaaaataaatgtctcaacattaaaaaaaaaaaaaaa

SEQ ID NO: 68346 - protein, 622 aa, Hordeum vulgare
MVTTVLAVAASAAPAPPPSLAARFSPVAGPAVGFRAHCWITAKMKLHKALGRHGWQVQRKLDIRGDGKIPDYFEVAWRTGNITRRNVQPAGETGGETANTSSVMSDNSIDDKGLLHLGLNNSEADRPVLEEDLVLFDNFNDQPESVPSLCIAVIGATGELARSKVFPALFALYYSGFLPQNVAIFGYSRKTLADEDLRSMIESNLTCRVDHHENCEDKLNEFLKRTYYVDAGHDNKDGMAKLNLRMTQIEGTCAANRIFYLAVPQEALLDVALPLSDIAQTKHGWNRIIIEKPFGFTSLSSQRVTQSLLSRFEEKQIYRIDHLLGKDLIENLTVLRFSNLVFEPLWSRKYIRNVQVVFSEETSTETQGRYFGNYGIIRDIVHSHILQTIALFAMEPPVSLDGEDIRDEKVKVLRSIRKVDIDDVVLGQLKNTCGKVDQYTKSMTPTYLAAAMYIDNARWDGVPFLIKTGMGLMENRAEIRIQFHHVPGNIYRERFGHDIDLDTNELVLRDLPEEAILLKVNNKVPGLGLQLDASELNLLYRDRYDVEVPDSYEHLLLDVLDGDSHLFMRSDELAAAWSVLAPILHEIDQKRVAPELYEAGDKGPINAYYLAAKHGVRWDDGC

SEQ ID NO: 68347 - DNA, 2127 bp, Glycine max
  CDS (81)..(1823)
accaaaatatagcttactatacacaacactgtgttgtgcttgtgaatctgccttcgaagagaatcagcacagcagcaacaatggaggcgccgccatttgcttattctgcttccacttcctctctcttttctcttcgcaacaagccactctcatcccctacaatcacccatttgggcaacaccaaaccatcaaagagtttctcggttggtgcctcctcttctagggattctgttgtgactttgcttgattacggtgctggcaatgttcggagtgtcaggaatgcaatcagattcctcgggtttgacatcaaagatgtgcaaactccgcaagatattctgaatgcaagtcggttagtttttcctggtgttggagcatttgctgctgccatggaggtgttaagcaaaactggaatggatgaagcactatgttcatatattgacaaggatcgtccatttctgggcatttgtcttggacttcaactactttttgaatctagtgaggagaatggaccagtaaaaggtcttggcttaatacctggaactgttgggcgatttgactcatcaaatggttttagagtaccacatattggctggaatgctttacaaatcactgaggactcgggaattttggatgatgttggaaatcaccatgtctattttgtgcactcttatcgtgccatgccttcagatgacaacaatgagtggatatcctccacctgtgactatggtgacaaatttatagcatctattagaagaggaaatgtgaatgcggttcaattccatccagagaagagtggagatgttggcctctctattttgggaagattcttgaatccgaagtcaaacatggcaaagaagcctggggaaggcaaagcttcaaaacttgcaaaaagggtgattgcttgtcttgatgtgagaacaaatgataagggggaccttgttgtaaccaaaggagaccagtatgatgtaagagaacatacaaaagagaatgaggtaagaaatcttggcaagccagttgatcttgctggacagtactataaagatggagctgatgaggtcagctttctaaatattactggatttcgcgacttccctcttggtgatttaccgatgctgcaggtattgcgatacacatcagaaaatgtttttgtacccttaacagttgggggaggaattagagatttcacagattcaactgggaggtactattcaagtttggaagttgcttctaaatactttaggtctggggctgataagatttccattggaagtgatgcagtttatgctgcagaagaatatttaaaagccggagtaaagactgggaagaccagcttggagcagatatcaagagtttatgggaatcaggcagtggttgttagtatcgatccgcgtagagtgtatgtaaaggatcctaatgatttgcaattgaagaccataagggtttcaagtccaggtccaaatggagaagaatatgcatggtatcaatgtacagttaatgggggacgagagggccggccaattggtgcttatgaactagcaaaagcagttgaagagcttggtgctggtgaaatactacttaattgcatcgattgtgacggtcaagggaaaggatttgatgtagatttaattaagttgatatcagatgctgtaagtatccctgtcatcgcaagtagtggtgccggtgctcctgaacacttctctgaggtgttctataaaacaaatgcatcagcagcacttgctgctggcatttttcacaggaaagaggtgcctattcagtcggtaaaagagcatttgttgaaggaaggcatagaagttcgaatctgatcatatgcatttagtggtaaaatttttgagatgcacttcataataatcaaaccttgtacgttatccctttttgtgtaatctaacgaagctctcaaaatgtcaaccttttggatcatgaaaagattttcacaacgagacctttcctttgtaatatttttaaggaaaatatatttaccatgtgcagcactatctctgaacatttgttattacaaaattatttcatgtgtcacctgtatggtagtgtgcgatgtttctcgtgtttgattggttattgaagatatttttaaggaaaaaaaaaaaaaaa

SEQ ID NO: 68348 - protein, 580 aa, Glycine max
MEAPPFAYSASTSSLFSLRNKPLSSPTITHLGNTKPSKSFSVGASSSRDSVVTLLDYGAGNVRSVRNAIRFLGFDIKDVQTPQDILNASRLVFPGVGAFAAAMEVLSKTGMDEALCSYIDKDRPFLGICLGLQLLFESSEENGPVKGLGLIPGTVGRFDSSNGFRVPHIGWNALQITEDSGILDDVGNHHVYFVHSYRAMPSDDNNEWISSTCDYGDKFIASIRRGNVNAVQFHPEKSGDVGLSILGRFLNPKSNMAKKPGEGKASKLAKRVIACLDVRTNDKGDLVVTKGDQYDVREHTKENEVRNLGKPVDLAGQYYKDGADEVSFLNITGFRDFPLGDLPMLQVLRYTSENVFVPLTVGGGIRDFTDSTGRYYSSLEVASKYFRSGADKISIGSDAVYAAEEYLKAGVKTGKTSLEQISRVYGNQAVVVSIDPRRVYVKDPNDLQLKTIRVSSPGPNGEEYAWYQCTVNGGREGRPIGAYELAKAVEELGAGEILLNCIDCDGQGKGFDVDLIKLISDAVSIPVIASSGAGAPEHFSEVFYKTNASAALAAGIFHRKEVPIQSVKEHLLKEGIEVRI

SEQ ID NO: 68349 - DNA, 1523 bp, Brassica napus
  CDS (149)..(1330)
gatagatccaccaaagcaggtcaatggactgacttttggataacaatagatcctaagtaaacgggcaggcaccaattgtgtgtccgaagagagacaagagacagaaagagagttagacaaaacattccgattgatccaagaaaccgtcatgattcttacaaagtgcttgccattgatatggctatctctagtcactctgtgtgctgggagaagattataccaagtccctggtaaaggagtcaaagatgatgcttctaagcagccgattcagacatcacgtccttataacatcgcacacagaggttccaacggagagatcccagaagaaactaaagctgcatacttgaaagcaattgaagaggggacagactttatagaaactgatatcttatcatcaaaagatggtgtgcttatctgtttccatgatgttatccttgacttaacaaccgatgttgcgagtcgcaaggagtttgctggtcgtaataggacatatgatgtccaaggtttcaagatccctggctttttcacttttgattttactctcaaagaactaaagacactacggacaaaacagagatatgcttttcgagaccagcaatacaacggaaagtaccccatcatcacatttgaagagttccttgccattgctcaggatgctccaagagttgtggggatctatcctgagattaagaatccagttttaatgaaccaacatgtcaagtggcctggtggtaagagatttgaggataaagttgtggagacacttaagaagcatgggtacggaggcgcatatttatccaagcagtggttgaacaaacccttgtttattcagtcatttgctccatcttcactcgtgtacatatcaaacttgacagactcgccaaaagtcttattaataaatgatgttatcaggccaactcaagatactaaccagacatacgcagagatcacatcagatgcttatttcacctacatcaaagagtatgttgttggtattggaccatggaaggatacaatagttccagtaacaaacaactacatgctaaccccaacagatttggtcaaaagagctcacgcgcataagctacaggtgcatccatacacgtacaggaatgaaaaccagttcttacactttaacttcagccaggatccatataaggaatacgagtactggatcaaagagattggagttgatggactctttactgatttcaccggtagcctccataactatcaagagtgggcatccccattacctgaaacctccaagtcaacacgtcagcttttgagtcatattgcttctttggtccgcccttatgcaaaggcttgaagcaccacactaagtctttaatctaacggaagagtcttgaagattaaataaaagtgaaagacacagattcatcaaattgtatctgttttacttcacaagatttatacattaaaagtcagtcaaacaactttgtaaaatcttggacagagttctataatattctatcaaacttttaacataaaaaaaaaaaaaa

SEQ ID NO: 68350 - protein, 393 aa, Brassica napus
MILTKCLPLIWLSLVTLCAGRRLYQVPGKGVKDDASKQPIQTSRPYNIAHRGSNGEIPEETKAAYLKAIEEGTDFIETDILSSKDGVLICFHDVILDLTTDVASRKEFAGRNRTYDVQGFKIPGFFTFDFTLKELKTLRTKQRYAFRDQQYNGKYPIITFEEFLAIAQDAPRVVGIYPEIKNPVLMNQHVKWPGGKRFEDKVVETLKKHGYGGAYLSKQWLNKPLFIQSFAPSSLVYISNLTDSPKVLLINDVIRPTQDTNQTYAEITSDAYFTYIKEYVVGIGPWKDTIVPVTNNYMLTPTDLVKRAHAHKLQVHPYTYRNENQFLHFNFSQDPYKEYEYWIKEIGVDGLFTDFTGSLHNYQEWASPLPETSKSTRQLLSHIASLVRPYAKA

SEQ ID NO: 68351 - DNA, 1352 bp, Glycine max
  CDS (67)..(1245)
gactcggaaacgatgaagtgagcaacacaacacaaccagacccatcgttatcttatctccttctccatggcttccttacccagttttactccttttgtatttctattgcttgtcattggatgcaatgcaaggcctttgtatccacttcccagcaaaggtgatgatggaaataggaagcccctacaaacttttcgcccttataacattgctcatcgcggttcaaacggagagcttcctgaggaaactcatcctgcatacttgagagctattgaggagggtgcagacttcattgaaactgatatcttatcatccaaagatggtgttcttgtatgtttccatgatgttacccttgataatactactgacattgcaaatcgcacagagtttgctaatcgtaaaagaacatatgaagtccaaggggaaaacatgactggcttttttactgttgatttcacattaaaggaattaaagtcattgagggtgaaacagaggtgtagcttcagggaccaacagtttaatggaaagtttcaaatcatcacttttgaagagttcattaccatagcactggatgcacccagagttgttggaatatatccagagataaaaaatccagtatttatcaatcaacatgttaaatggtcccatggcaaaagatttgaggacaagtttgtggagacacttcagaaatatgggtacaagggttcctacctgtcaaaagattggttgagacaacctgtatttattcagtcatttgctccaacttcactcgtgtatatatcaaataaaacggacttgcccaaggttttcttaattgatgatgttactgttccaactcaagacactaatcagtcatattgggagattacatctgatgaatacctagagtacataaagcaatatgttgtgggaattggaccttggaaggacacagtggtacctgtggtaaaaaattatatgacaaatcctactaatcttgttgccagggcacatgctcataacctgcaggtgcatccatatacttaccgaaatgagttcccatttttgcatttcaacttcagtcaagatccgtatatggaatatgatttctggatcaacaagataggcgttgatggtctctttacagacttcactggtagtcttcatcgttatcaggaatggacctctaaccgtaaagatgatgatgatgacaagactgaatccaatctattacataaaattgctttgttagtctcctcttatgaatgatcttgagaattcagatggtgtataagtgtttggattaatttattgtgttcaaaagacgctaataacaatatttacaagagagcttttgagtttaaaaaaaaaaaaaa

SEQ ID NO: 68352 - protein, 392 aa, Glycine max
MASLPSFTPFVFLLLVIGCNARPLYPLPSKGDDGNRKPLQTFRPYNIAHRGSNGELPEETHPAYLRAIEEGADFIETDILSSKDGVLVCFHDVTLDNTTDIANRTEFANRKRTYEVQGENMTGFFTVDFTLKELKSLRVKQRCSFRDQQFNGKFQIITFEEFITIALDAPRVVGIYPEIKNPVFINQHVKWSHGKRFEDKFVETLQKYGYKGSYLSKDWLRQPVFIQSFAPTSLVYISNKTDLPKVFLIDDVTVPTQDTNQSYWEITSDEYLEYIKQYVVGIGPWKDTVVPVVKNYMTNPTNLVARAHAHNLQVHPYTYRNEFPFLHFNFSQDPYMEYDFWINKIGVDGLFTDFTGSLHRYQEWTSNRKDDDDDKTESNLLHKIALLVSSYE

SEQ ID NO: 68353 - DNA, 1463 bp, Zea mays
  CDS (158)..(1333)
gaattcccgggtcgacgatttcgtcggagcgagtccggagcatagcaacctcgctgggctcgggcccgcggagccgggatatactccagggaagtcgagcaaggagagtgtggactgtggacgacaggggtaaagatcgagtgagcatcgctgcaccatgcgcccttctatctgctgtgcacctctttttcttctgctactattacatttggcatttgctagacctctctttcctctaccgagtaagacaaagaatgaagagaagaagcccatacagacgtttcggccatataacattgctcatcgtggatcaaatggggaaattcccgaggaaacagctgctgcatacatgagagctattgaagaaggggccgattttatagagtctgacatccttgctagcaaagatggggccttgatttgttttcatgatgtaacacttgatgatacaactgatgttgccaagcgtaaggaatttgccaatcgaagaagaacctatgaagtggagtggtttaatgttactggatggtttgtagtggacttcacactggaggaacttaaaacacttagagtgaagcagagatactcgtttagagatcaacaatacaatggtatgttttcaatcatcacgtttgaagaattcatttcaattgccctagatgcagacagaactgtcggcatatatcccgagattaaagatccagtttttatcaacaagcatgtcaagtgggctgatgggaagaagtttgaggacaaatttgtggataccttgcttaaatatggatacaaaggtcaatatatgtcagagaattggctgaagcagccattgtttatacaatcctttgctcccacctccattgtacatgtatcagattttattgactctcccaaggtatttttgattgatgatatcagtgtgagaacacaagacacgaaccagtcatactgggaaattacttcagatgaataccttgcatacattagtaaatatgtcgttggccttggtccatggaaggacactattgttccagcttcaggaaactacttgatgccacctagtgatcttgtcgcacgggcacatgctcataatctccaggtacatccatacacgtacaggaacgagaaccagttcctgcacttcaacttttttcaagatccctacaatgaatacgacttctggataaacactgtgggggttgatggactgtttacagatttcaccggaacccttcacaggtaccaagaattgacatccccacaccggaaggatgagactgcaaatagcctcctagtaaaaattagccaaatgatctcagcatatgaaggtctctgatcagcacgacgttgctgaaaattgtttgtacgatccattcatcacggacggtgcaacgtgacactgtgactttgcaaggttaaataaacgagttgtttctggttaaaaaaaaaaaaaaaaaagcggccgc

SEQ ID NO: 68354 - protein, 391 aa, Zea mays
MRPSICCAPLFLLLLLHLAFARPLFPLPSKTKNEEKKPIQTFRPYNIAHRGSNGEIPEETAAAYMRAIEEGADFIESDILASKDGALICFHDVTLDDTTDVAKRKEFANRRRTYEVEWFNVTGWFVVDFTLEELKTLRVKQRYSFRDQQYNGMFSIITFEEFISIALDADRTVGIYPEIKDPVFINKHVKWADGKKFEDKFVDTLLKYGYKGQYMSENWLKQPLFIQSFAPTSIVHVSDFIDSPKVFLIDDISVRTQDTNQSYWEITSDEYLAYISKYVVGLGPWKDTIVPASGNYLMPPSDLVARAHAHNLQVHPYTYRNENQFLHFNFFQDPYNEYDFWINTVGVDGLFTDFTGTLHRYQELTSPHRKDETANSLLVKISQMISAYEGL

SEQ ID NO: 68355 - DNA, 1166 bp, Brassica napus
  CDS (72)..(977)
gaattcccgggtcgacttcgctgtcgacgatttcgtacaaaatcaaaactttggagtaagagacggtgaagatgagctttgtcaagtatctccgccgtgatagtttgctccagttagccggaaaacgatcccttagccgaagttgcatgcttcagacctgccggactctcatcattgaaaccgccccgcctgaatctgtcaagcttaaccgtctctctggttccgattctgggattgtcgaggtcaatctagacaggtctgtggccaaaaattccattaataaagagatgctgaaaggtctccagaccacatttgagaccatacatcatgatagttccgctagagttgtgatgatcacaagtctggttccaggagttttctgtgcaggtgcagatctcaaggaacgtagaactatgagtccatctgaggttcacacatatgtcaactccttgcgctacatgttctccttcatagaggcattgagtatcccaactattgctgcaatagaaggtgtggcactaggaggtggactcgaaatggctttatcctgtgatcttcgaatctgtggcgaaaatgcagtatttggtttgcctgaaacaggactcgctgtaatccctggtgctggtgggacacagagactctcaaggctggttggaagatcagtttcaaaggaacttatattcacaggtcgaaagattgatgcaagagaagctgcaaagaaagggctagttaacttctgtgttgcggcgggtgaggctcataagaaagcaatggaagtggctcagcagataaataataaaggtccaatggcgataaagatggcgaagaaagcgattgatgaaggaatagagacgaatatggcttcaggattagagctagaggagatgtgttatcagaagcttctaaacactgaagatcgtctggaaggattagctgcgtttgctgagaaacgtaagcctcgttacactggcaagtgaagctcttttagtttcaataaccggggggagataaccattgtattggatgttaagaaccgggatggtttaggattataataatgtgtatgacacagaaaccaagtaaaaataaacatttgaatatcactcgttctatttgtgcattcattggcttaataaaattaaattcggatacaaaaaaaaaaaaaa

SEQ ID NO: 68356 - protein, 301 aa, Brassica napus
MSFVKYLRRDSLLQLAGKRSLSRSCMLQTCRTLIIETAPPESVKLNRLSGSDSGIVEVNLDRSVAKNSINKEMLKGLQTTFETIHHDSSARVVMITSLVPGVFCAGADLKERRTMSPSEVHTYVNSLRYMFSFIEALSIPTIAAIEGVALGGGLEMALSCDLRICGENAVFGLPETGLAVIPGAGGTQRLSRLVGRSVSKELIFTGRKIDAREAAKKGLVNFCVAAGEAHKKAMEVAQQINNKGPMAIKMAKKAIDEGIETNMASGLELEEMCYQKLLNTEDRLEGLAAFAEKRKPRYTGK

SEQ ID NO: 68357 - DNA, 1182 bp, Brassica napus
  CDS (186)..(1016)
tcactcctctcttcgatctcattctcttctgcacaaatgccaggggcactgccagcttatcaaaaacggttcacgttaaccgtctccaatcaaaccaaaaaggtcatccttccgaacgaaacacacatttgcaacctcaaatctcttataaccttatcaccaccatttttccaaattcgaagctaatggattcctacaaaaccctagaaatcgttcgcaagaataccgactcctccgtcttccacgtcgtcctcaacaggccgtcgcagctcaacgccctatccctcgacttcttcgacgaattccccatagctctatcgtccctcgaccaaaacccagacgtcgccgtcatcatcctctccggcgccggaaaacacttctgctccggcatcgacctcgcttccctctcctcgatctcggcccaatcgtcctcaggcggcgacagagggcgctcgagtgagggtctacgacgcaggatcaaatcgatgcaggcggcgataaccgccgtggaagagtgccggaagcctgtgatcgcagctgtgcacggcgcgtgtatcggagggggagttgatctcgtcacggcttgtgacgttagatactgctccgaggacgctttcttctcgatcaaggaggttgatctagcgatcgttgcggatctcgggactctccagcggttgccgaggatcgtcgggcacgcgaaggctatggagttggcgttgacggcgagacgattctcgggatgtgaagcgaaggaacttggtcttgtttctcaggtcttcagatctaagtcggagcttgataaaggcatcaccatgatcgctgaaggaatagcagcgaagtctcctttagctgtgacagggacgaaggcagtgttgttaagaagcagagagatgagtgtagaacaaggtcttgactacgtagcaacttggaactcgggtatgcttatatcgaacgatctcaacgaagctgtctctgcgcagatgatgaaaagacaacctcgtttctctaaactgtgacgagagtctctgtttctttcttcttgtctgcctggtaacaaagcaataaggtctttattggaagaagttttgttttatagtttctacagcagcttgaataatttgatgactttagtttgggctttgatttgagtcagttgtctcgatcgtccaaaaaaaaaaaaaa

SEQ ID NO: 68358 - protein, 276 aa, Brassica napus
MDSYKTLEIVRKNTDSSVFHVVLNRPSQLNALSLDFFDEFPIALSSLDQNPDVAVIILSGAGKHFCSGIDLASLSSISAQSSSGGDRGRSSEGLRRRIKSMQAAITAVEECRKPVIAAVHGACIGGGVDLVTACDVRYCSEDAFFSIKEVDLAIVADLGTLQRLPRIVGHAKAMELALTARRFSGCEAKELGLVSQVFRSKSELDKGITMIAEGIAAKSPLAVTGTKAVLLRSREMSVEQGLDYVATWNSGMLISNDLNEAVSAQMMKRQPRFSKL

SEQ ID NO: 68359 - DNA, 1070 bp, Triticum aestivum
  CDS (67)..(981)
gctgactctgcctctgctctttcctccgcccagcaccagtctcccactctcgcccgactctccaccatgcgcagcctacggggcctcctcgccgtctccggccacctcgccgcccgccacgcgccgccgagcggcgcctcctcgtctccccacagcgtcctcttcgcccgtgccctccagatcctctcccagccggagcccgtccgcctccacaagctctcggcgcccgactccgggatcgtggagctgaggctggagcggccggaggccaggaacgccatcgggaaggagatgctcaaggggctgcggagcgccatggacaaggtgaaggccgactcgacggccaacgttgtactggtagcgagctccgtgcccaaggtcttctgcgcgggcgctgacctcaaggaaaggaggttaatgggcccttctgaagtccgggaatttgttaataccttgagagctacattctcatcctttgaggcactccctattcctacaatagctgttgttgaaggagctgcctttggcggtgggctagagttggctctttcatgtgatcttcgtatatgtggggagagtgcaacattcagcttgccagaaaccggccttgctattattcctggagctggagggacacagcgtcttccaaggattgttggaagggccagagcaaaggaattgatattcactggccgtagatttgatgcgacagaagctgtaaatatgggggtagtgaactactgcgttcctggtggcgaggcttatcaaaaggctcttgaacttgcccgggagataaatcagaaaggtccgttagcgataaggatggccaagaaggccatcaacgaaggggtggaggtagacctgtcctctgcgttggctgtcgaagaagagtgctacgagcaagttctgcacactcaggatcgccttgaaggtctagctgcatttgcagagaaaagaagacctttgtacacaggaaagtgaggccgtactgaagtcagccctgttagcctcttatgtcttatctgctgataccctgaagaatgtgtccttgttccaaaaaaaaaaaaaaa

SEQ ID NO: 68360 - protein, 304 aa, Triticum aestivum
MRSLRGLLAVSGHLAARHAPPSGASSSPHSVLFARALQILSQPEPVRLHKLSAPDSGIVELRLERPEARNAIGKEMLKGLRSAMDKVKADSTANVVLVASSVPKVFCAGADLKERRLMGPSEVREFVNTLRATFSSFEALPIPTIAVVEGAAFGGGLELALSCDLRICGESATFSLPETGLAIIPGAGGTQRLPRIVGRARAKELIFTGRRFDATEAVNMGVVNYCVPGGEAYQKALELAREINQKGPLAIRMAKKAINEGVEVDLSSALAVEEECYEQVLHTQDRLEGLAAFAEKRRPLYTGK

SEQ ID NO: 68361 - DNA, 2635 bp, Triticum aestivum
  CDS (58)..(2217)
aagaaaaccaaaaggcagcttcagctgtgccggccggccgtctcgcccctgacggagatggcgaggggcgcaaccaccatggaggtccgcgacgacggcgtcgccgtcatcaccatctccaacccgcccgtcaacgccctctcctttgacgtcatagctagcttgcagagaaactatgaagaagctctaagaaggaatgatgtcaaggccatcgttctcactggggccaaagggaggttttcaggtggatttgatataaatggattcggaaataaaccaaaaaacgagaagcccgggtccttttctattgattttctgactggcgtagtggaagatgctcagaagccgtcagtggctgctatagatggtgttgctctaggtggtggcttagagcttgcaatggtttgccatgctcgcgtttctacaccgtcagctcaattaggactacctgaacttcagcttggtatcattcctggaatgggaggaacacaacgattgccccgccttgttggcctgaaaaaagctcttgagatgatgttgatgtcaaagtctataaaaggagtagaggctcacaaattcggtttggttgatgccatagtttcagctgataagctgatcagcactgcctgttcttgtgctctggaaatccacgaacacaaaaggccatggttaaagagtctcctgagaacggatagacttacagatattgtggaagcaaagaaaattctcaaatttgcgagagttcaagccctaaaacaggctgctaatcttcaacatccattagtttgcattgatgttattgaagaaggaattctttttggccctcgtgccgccctcatgaaggaagtgctttctggaaaaatgcttgagcagtctcaaacaagcaaaagcttaaggcatttttttttcgcccaacgtgcgacttcaaagataccaaatattaccaacttgggtttgacaccacggagaatactaaaggcagctattgttggtggaggtctaatgggatccggaattgcaactgcgttcatactgagtgacattgtggtagtcttgaaagaagtaaatgagaagttcttgaatactggcattaacagaattaaagccaatttgcagagttttgtcaaaaagggacgaatgacccaagaagattatgaaaagaaactttctctgctgtccggtgttcttgactacgagcaatttagagatgcagatgtggtcattgaggccgttattgaggatctattgctgaagcagaaaatattctctgatcttgaaaggagctgtcactctaattgtatatttgccacaaatacttcaaccatagacttgcggttaattggccaacaaacagcttgtcaagatcgaattgttggtgcccacttcttcagtccagctcatgtcatgccactgttggaaatagttcgtactcagcagacttcctcacaagttattgtggacttgctagatgtggcaaagaagatacggaaaacaccaattgttgttgggagctgcactgggtttgctgtcaataggatgttttttccttacggccaggcggctggtttgctcgttgattatggtttggatatatatcacatagatcacgtgatagcaaattttggaatgccgacgggaccttttcgattagctgatcttgtaggttttggcgttgccgttgccactggaaagcaatattataagagttatccagagcgatgttataaatcacgtcttactgaaattatgctcgaggagaacaggacaggtgaatcttctcataggggattttatctttataatgataagcgacaagcttctccagatcctgatatcaaaaagtatgttgagaaatcaagaaacatggcaggtgttgcacaagatcctaagctgatgaaattaacagacaaggacattgtagagatggtcttctttcccgtggtgaatgaggcctgccgagtgctggatgagggaattgcactgaaagcatctgaccttgatgtagcatccattatgggaatgggcttcccttcttttaggggtggagtgatgttttgggccgactctctcggtgcggaatacgtgtaccgcagactggatgcgtggtccaaggattacggagagttcttcagaccctgtgaatatctagctgccagagctagtcgcggcacatccttggctgccaccacagctgatggcaccaaatcgcgactctagatcgtgtacctgggtgtgctgccgtgtccagtcgggatggaggagctgcaatgttccggatacaatcgtgtgttagatgtaataaagtgcacggcaaaaatgctaggttggttttgagtgttggtgggtgcggcttttttccttctgcagcagctgctgtgtgatgtgttgccgtggtcttacccactgtgcagtagttttctgcatcgcggattcccctggcgcgctgctgcgacgtgtccgcgaaacctctatgggcgtgtttggttaccgtttgctacagtatctacatcgcatacacttctcaatccagtctggttgagcaaaaacaggccctaatacgccatctgcaacttgtttgagcaaaaacaggccctaatacgccatctgcaacttgtttggtaaaaaaaaaaaaaaa

SEQ ID NO: 68362 - protein, 719 aa, Triticum aestivum
MARGATTMEVRDDGVAVITISNPPVNALSFDVIASLQRNYEEALRRNDVKAIVLTGAKGRFSGGFDINGFGNKPKNEKPGSFSIDFLTGVVEDAQKPSVAAIDGVALGGGLELAMVCHARVSTPSAQLGLPELQLGIIPGMGGTQRLPRLVGLKKALEMMLMSKSIKGVEAHKFGLVDAIVSADKLISTACSCALEIHEHKRPWLKSLLRTDRLTDIVEAKKILKFARVQALKQAANLQHPLVCIDVIEEGILFGPRAALMKEVLSGKMLEQSQTSKSLRHFFFAQRATSKIPNITNLGLTPRRILKAAIVGGGLMGSGIATAFILSDIVVVLKEVNEKFLNTGINRIKANLQSFVKKGRMTQEDYEKKLSLLSGVLDYEQFRDADVVIEAVIEDLLLKQKIFSDLERSCHSNCIFATNTSTIDLRLIGQQTACQDRIVGAHFFSPAHVMPLLEIVRTQQTSSQVIVDLLDVAKKIRKTPIVVGSCTGFAVNRMFFPYGQAAGLLVDYGLDIYHIDHVIANFGMPTGPFRLADLVGFGVAVATGKQYYKSYPERCYKSRLTEIMLEENRTGESSHRGFYLYNDKRQASPDPDIKKYVEKSRNMAGVAQDPKLMKLTDKDIVEMVFFPVVNEACRVLDEGIALKASDLDVASIMGMGFPSFRGGVMFWADSLGAEYVYRRLDAWSKDYGEFFRPCEYLAARASRGTSLAATTADGTKSRL

SEQ ID NO: 68363 - DNA, 1254 bp, Brassica napus
  CDS (92)..(1063)
cctgtttacacatttcttgcttctttctggtttatccgttacccataaaagcatcatttagttctgctctgagttctcaagacagaccaggatggaagaccggtacatgatcaagaacgatgtcactgaattgattggtaacacaccaatggtgtacctaaataaaattgttgacggttgcgtcgcacgtattgctgccaagcttgagatgatggagccctgctctagcataaaagacagaatcgcttatagtatgatcaaagatgcagaagacaaaggattgattactcccggaaagagtacattgattgaggcaaccggcggtaatactgggattggtttagccagcataggagctgcaagaggctacagagtgatacttttgatgccttcaacgatgagcttagagaggagaatcattttgagagcattaggtgcagagcttcatctttcagatatgaacataggcattaaaggaatgttggagaaagctgaagagatattaagcaaaactcctggtggttacataccacaccagtttctaaatcctgagaaccctgagattcattacagaacaacgggtccagagatatggagagattcagcaggggaagtagatattttggtagctggggctggcactggtggaacggttagtggaactgggaggtttcttaagaagatgaacaaaaacattaaggtttgtgtggtggaacctacagaaagtgcagtacttagcggaggagaaccaggtccacatttgatccaggggattggtcctggtgtcattccaaccaatttggatttaagcattgttgatgaagtcattcaggtgacaagtgaagaagctattgaaacagccaagcttcttgctcttaaagaaggattattggtgggaatatcgtcaggggctgcagcagccgctgcattaaaggttgctaaacggccagaaaacgcaggcaaacttattgtggtgatttttcccagtggaggagagcgttatttatcaacagaactgttcgagtcggtcagatatgaagcagagcatttgtcgatcgattgattgccaaatgtgtgatttggtttggtttggtgagagatgttggtaacgagattacggtttgattgtttcagatcattgtaaaatctgtaatagtattagatgatgaatcattatagttgttcttcattactgtagtcccccggtctaaaactgtttaaagatgatcctaatctaccaaaaaaaaaaaaaaa

SEQ ID NO: 68364 - protein, 323 aa, Brassica napus
MEDRYMIKNDVTELIGNTPMVYLNKIVDGCVARIAAKLEMMEPCSSIKDRIAYSMIKDAEDKGLITPGKSTLIEATGGNTGIGLASIGAARGYRVILLMPSTMSLERRIILRALGAELHLSDMNIGIKGMLEKAEEILSKTPGGYIPHQFLNPENPEIHYRTTGPEIWRDSAGEVDILVAGAGTGGTVSGTGRFLKKMNKNIKVCVVEPTESAVLSGGEPGPHLIQGIGPGVIPTNLDLSIVDEVIQVTSEEAIETAKLLALKEGLLVGISSGAAAAAALKVAKRPENAGKLIVVIFPSGGERYLSTELFESVRYEAEHLSID

SEQ ID NO: 68365 - DNA, 1595 bp, Brassica napus
  CDS (40)..(1329)
gaattcccgggtcgacgtcgtattctgaaaagcacgatcatggcggtgctcatggcttcaaggtttaacagtgaagctaggatcgcgtctcgatgcctttcaacactcttgagaaatcaaagagtcctgatagcctcaccatcatcatcatccatggcatccgcatcttcttcctctgctctcctccttaacccgttgacttcctccactctccgtcacttcagatcctcttcggagatctcttctctctccttctctgcttccggcttccctctagcgatgaagagccagcagagtcggagctatggagatgtctcgaaacgagatccgtgcgaggccgttaagcgtgagaatggagctgatgagctcaacatcgctgagaatgtgtctcagctcattgggaaaactcctatggtgtacttgaacagtatggcgaagggttgtgtagcgaacattgctgctaagctcgagatcatggagccttgttgcagtgtcaaggataggattgggtacagtatggttactgatgctgagcaaaaaggattcatatcacctggaaagagtgttcttgtggaacctacaagtggaaacacgggtattggacttgcgtttatcgctgcttcaagaggctaccgactcatcttgacaatgccatcatccatgagtatggagagaagagttcttctaaaggcgtttggagctgagcttgtgctgactgatcctgctaaaggcatgaccggtgcagttcagaaggctgaggaaatcttgaaatcaactcctgatgcttacatgctccaacagtttgacaaccctgccaatccaaagatccattatgagactactggtcctgagatatgggaagatacaaagggaaaggtggatatatttgttgctgggattggaactggtgggactatcactggtgttggtcggttcattaaagagaaaaaccccaaagtgcaggttattggtgttgaaccaactgaaagcgacatactttctggtggcaaaccgggacctcacaagattcaagggattggagctggatttatacctaagaatttggatcgggcaattatggatgaagtcatagcgatttcaagtgaggaagctatagaaactgcaaagcaactagctctcaaagaaggcttgatggttggaatatcatctggagctgctgctgctgctgcaatcatggtagcaaagagacctgagaatgcagggaaactcattgctgttgttttcccgagctttggagagcgatatttatcaacccctctgttccagtctatccgggaagaggttgagaaaatgcagcctgagatatgaacaaaagcaaatatctttcttctactgttaggtttgcctcttgagagtgctaagccattcttgcttatcaataagccaaatagtgcaacttgtattgttcaacatttctatcaaaaatccccaatggataattaattagatacaattaaacaagatgaattatccatctatatttttttgttaaccaataaattgtagccgttggtgtgtaatatgtacgattatttaaatttataatgatcaaattaatgaaaaaaaaaaaaaaa

SEQ ID NO: 68366 - protein, 429 aa, Brassica napus
MAVLMASRFNSEARIASRCLSTLLRNQRVLIASPSSSSMASASSSSALLLNPLTSSTLRHFRSSSEISSLSFSASGFPLAMKSQQSRSYGDVSKRDPCEAVKRENGADELNIAENVSQLIGKTPMVYLNSMAKGCVANIAAKLEIMEPCCSVKDRIGYSMVTDAEQKGFISPGKSVLVEPTSGNTGIGLAFIAASRGYRLILTMPSSMSMERRVLLKAFGAELVLTDPAKGMTGAVQKAEEILKSTPDAYMLQQFDNPANPKIHYETTGPEIWEDTKGKVDIFVAGIGTGGTITGVGRFIKEKNPKVQVIGVEPTESDILSGGKPGPHKIQGIGAGFIPKNLDRAIMDEVIAISSEEAIETAKQLALKEGLMVGISSGAAAAAAIMVAKRPENAGKLIAVVFPSFGERYLSTPLFQSIREEVEKMQPEI

SEQ ID NO: 68367 - DNA, 1292 bp, Glycine max
  CDS (144)..(1121)
gaattcccgggtcgacttcgctgtcgacgatttcgtagctcatagaaattctcgtcctcttcctacataagtcttctcttatcataaacgcgtgttgctcggataaggttgtgctgcggtgattcactcgtactttgcttaatatggcggttgagaagttgagcattgcaaaagatgtgactgaattaattggcaaaactccattggtatatctcaaccgcatcgtggatggctgtgttgccaaagttgctgcgaagctagaaatgatggaaccttgctccagtgtcaaagacaggatagggtatagcatgattgtagatgctgaggagaaaggactcatcacaccgggtgaaagtgtcctcattgagcctactagtggaaacactggcataggtttggcattcatggcagctgctaagggttataaacttattataaccatgccttcttcgatgagtctcgaaagaagaaccattcttcgagcttttggagctgagttagtcctcactgatcccgccaaaggtatgaaaggagctgttcagaaggcagaagagattcgggataagactccaaattcttatattcttcaacaatttgaaaatcctgccaacccaaagatccattatgaaaccactggaccggagatctggaagggctctagtgggaaggttgatgctcttgtctctgggattgggactggaggtacaataacaggtgctggaaaatatctgaaagatcagaaccctgatataaagctatatggcattgaaccagtagaaagtccaatactgtctggaggaaaacctggccctcataagatccaaggaattggtgctggcttcatccctggtgttctggatgtcgatttacttgatgaagttgttcaaatttcaagtgaagaagccattgaaactgctaaacttcttgctttgaaagaaggtttgctggtgggaatatcatctggtgcagctgcagctgctgcaattaagatagcaaagaggccagaaaatgctggaaaactcattattgcggtcttcccaagctttggagagcgttatttatcatctgtgctctttgaatccgtgaagcgagaagcagagagcatggtcttcgagccttgaatatgaagttatacgagccatttgctgcttttcaagttgcattctctccttgggttgtgtatctattttttctcttatggatctgaaaaataaaaaatggtttatgtttggttgttaattgactacgatttaataaaaaatataagatgtttgccgaaaaaaaaaaaaaaa

SEQ ID NO: 68368 - protein, 325 aa, Glycine max
MAVEKLSIAKDVTELIGKTPLVYLNRIVDGCVAKVAAKLEMMEPCSSVKDRIGYSMIVDAEEKGLITPGESVLIEPTSGNTGIGLAFMAAAKGYKLIITMPSSMSLERRTILRAFGAELVLTDPAKGMKGAVQKAEEIRDKTPNSYILQQFENPANPKIHYETTGPEIWKGSSGKVDALVSGIGTGGTITGAGKYLKDQNPDIKLYGIEPVESPILSGGKPGPHKIQGIGAGFIPGVLDVDLLDEVVQISSEEAIETAKLLALKEGLLVGISSGAAAAAAIKIAKRPENAGKLIIAVFPSFGERYLSSVLFESVKREAESMVFEP

SEQ ID NO: 68369 - DNA, 1257 bp, Linum usitatissimum
  CDS (102)..(1079)
gcattgcccacagaaatttctagtcggcttccagcttttgctcttaccattccctctgcacccaaatacccattaattgtgctgcactctttttcatcagaatggcagaggagaacattgggattgctaaggatgtcactgagttgattggtaaaacaccattggtatatctcaccaatgtcgtggatggctgcgtcgctcgggttgctgctaaactagagatgatggagccttgctcaagcgtcaaggataggattggatatagtatgatagctgatgccgaggagaagggtcttatcaagcctggagagagtgtccttattgagccaacaagtgggaacactgggatagggctggcattcatggcagcagccaagggctacagacttataattaccatgcctgcttcgatgagtttggagagaagaatggttctccgtgcttttggagccgagcttgttcttacagatccagcaagaggtatgaaaggggctgttcagaaagcagaagatatcttggcaaagacacctaatgcttacattcttcagcaatttgaaaaccctgccaacccaaaggttcattatgaaaccactgggccggaaatatggaaaggttcagctggcaaagtagatgcctttgtgtcgggtataggaactggaggaacagtaactggtgctgggaagtatcttaaggagcagaacccagatgtaaagctttatggcgttgaaccagttgaaagtgcagtgttgtctggaggaaaacctggcccgcataaaatccagggaattggtgctggcttcatccctggagtcttggatgttggtttgcttgatgaggtcgttcaaatatcgagcgaagaagctatcgagacagcaaaaaccctcgccttgagggaaggactgatggtaggaatatcatctggtgcagccgcagctgctgctattaagatagcaaagaggcctgagaatgctggaaagctcatagttgtggtgttcccaagtttcggtgagcgatacctctcatcgatactcttcgaggatgtgaagcgagaagctgagaacatggttttcgagccttgaagcagtatcatgtgtgtactgagtgaataatacagagagggtccatatttctgatggtttcttagtagtctaccggaatgggaaaagctgtgatgtttggacatgaagtttgtgagccgttacatagaattttatggaatgagtgacctttttcagcagaattaaaaaaaaaaaaaaa

SEQ ID NO: 68370 - protein, 325 aa, Linum usitatissimum
MAEENIGIAKDVTELIGKTPLVYLTNVVDGCVARVAAKLEMMEPCSSVKDRIGYSMIADAEEKGLIKPGESVLIEPTSGNTGIGLAFMAAAKGYRLIITMPASMSLERRMVLRAFGAELVLTDPARGMKGAVQKAEDILAKTPNAYILQQFENPANPKVHYETTGPEIWKGSAGKVDAFVSGIGTGGTVTGAGKYLKEQNPDVKLYGVEPVESAVLSGGKPGPHKIQGIGAGFIPGVLDVGLLDEVVQISSEEAIETAKTLALREGLMVGISSGAAAAAAIKIAKRPENAGKLIVVVFPSFGERYLSSILFEDVKREAENMVFEP

SEQ ID NO: 68371 - DNA, 1269 bp, Linum usitatissimum
  CDS (3)..(1058)
gaatgcccgggtcgacggaggccgccgcagctgattcctcccctgattttgcccagagactcagagatctccccaaacttctccccggcactagaatcaaacccactgctcagcagcttattggcaagactccccttgttttcctcaaccgggtggctgaaggatgtggagcttatattgctgttaagcaagagatgtttcaaccaacctctagcgtgaaggacagaccagcaatggcaatgattgaagatgcggagaggaagaacctgattacccctgggaagacaaccctgatagagccaacttctggcaacatgggtatcagcatggcgtttatagcagcaatgaaagggtacaagatggttctgactatgccatcttacacaagcttggagagaagggtaacaatgagagcattcggagctgagcttatccttactgacccaactaagggaatgggtggaacagtcaagaaggcatatgatctgctggaatccactccggatgcattcatgcctcaacaattctcaaaccctgccaacactaagatccatttcgaaaccacgggtcctgaaatttgggaggatacgttgggccaagttgatatctttgtgatgggaattggcagtggagggactgtttctggtgttgggcagtatctgaaatccaagaatcctaacgtcaagatatatggtgtggagcctgcagaaagcaatgtactgaatggtggcaaaccgggtcctcatcaaattaccggcaatggagtcgggttcaaacctgatatcttggacatggacatgatggaaaaggttcttgaggttaccagtgaagatgcagtgaaaatggcaagaagacttgccgtggaagagggactcatggttgggatatcatctggagccaatacagttgcagcacttgaacttgctaaaaggccagagaacaaggggaagctcattgtgactgtgcatgcaagcttcggggagagatacctgtcgtcggtgctgttcgaggagctgaggaaagaagctgagaacatgaaacctgtttctgttgattaatcaatctatctacattagttcagttctagcaccagcctctctgctgtgtttttactgttactagttgcatcttatgttgtattaagaggggtaacaaagaaagaagtgaggaacttcgagacttagtatttatgcagtaaatttggattaatataaccagaaggtctagtatccctcctaaattgggattcaaccgacacgcagcggccgc

SEQ ID NO: 68372 - protein, 351 aa, Linum usitatissimum
MPGSTEAAAADSSPDFAQRLRDLPKLLPGTRIKPTAQQLIGKTPLVFLNRVAEGCGAYIAVKQEMFQPTSSVKDRPAMAMIEDAERKNLITPGKTTLIEPTSGNMGISMAFIAAMKGYKMVLTMPSYTSLERRVTMRAFGAELILTDPTKGMGGTVKKAYDLLESTPDAFMPQQFSNPANTKIHFETTGPEIWEDTLGQVDIFVMGIGSGGTVSGVGQYLKSKNPNVKIYGVEPAESNVLNGGKPGPHQITGNGVGFKPDILDMDMMEKVLEVTSEDAVKMARRLAVEEGLMVGISSGANTVAALELAKRPENKGKLIVTVHASFGERYLSSVLFEELRKEAENMKPVSVD

SEQ ID NO: 68373 - DNA, 1453 bp, Zea mays
  CDS (120)..(1097)
gaattcccgggtcgacttcgctgtcgacgatttcgtcaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccaagctcgagtccatggagccctgctccagcgtcaaggataggattggctacagcatgatcacggacgcagaggagaaagggctgattactccaggcgtgagtgttctgattgaaccaactagcggcaacacaggcattggactggcctttatggctgctgccaagggctacaaacttacactcacaatgcctgcctccatgagcatggagaggaggatcatattgaaggcttttggtgctgaacttgtccttactgacccactcctgggaatgaaaggagctgtcaagaaagcggaagagatacaagcaaagacacccaactcttacatccttcaacaatttgaaaatccagctaacccaaagattcactatgagactactgggcctgaaatctggaaagctacagcaggaaaaattgatggccttgtatctggtatcgggacaggaggtaccatcaccggtactgggcgatacctcagagagcaaaatcctaatgtcaagctctatggtgtggagccagtggagagtgctgttttgaatggtggaaaacctggaccacacaagattcaaggaattggagctggttttatccctggagtcttggatgttgatctccttgatgaaactctacaagtttcaagtgatgaagctatcgagactgccaaggctcttgctctgaaagaagggttgttggttggaatctcttctggtgcagctgcagctgcggcagttaggcttgctaagaggccagaaaacgccggaaagctatttgttgtcgtgttcccgagcttcggcgagcgctacctctcctcggtgctgttccagtccatcaagaaggaagcggagagcatggtggtcgagccctagagcacacagttctgggcttctggcaaactatttcctgagacgttcatcatttccatcacagaaaaataaagctcgggtgccttctgttgatttcgacgtacatttccctgccgattgtgtccagtccagcccactgttgtcgctggagaacacgtcgtttttagacttgtgatgttttactactgttttgacactcgttgtatttctgtatatcgcgtcagactgtgaaataaaagcagtacagtgtgtttcttgaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaagcggccgc

SEQ ID NO: 68374 - protein, 325 aa, Zea mays
MGEASPSIAKDVTELIGNTPLVYLNKVTEGCVGRVAAKLESMEPCSSVKDRIGYSMITDAEEKGLITPGVSVLIEPTSGNTGIGLAFMAAAKGYKLTLTMPASMSMERRIILKAFGAELVLTDPLLGMKGAVKKAEEIQAKTPNSYILQQFENPANPKIHYETTGPEIWKATAGKIDGLVSGIGTGGTITGTGRYLREQNPNVKLYGVEPVESAVLNGGKPGPHKIQGIGAGFIPGVLDVDLLDETLQVSSDEAIETAKALALKEGLLVGISSGAAAAAAVRLAKRPENAGKLFVVVFPSFGERYLSSVLFQSIKKEAESMVVEP

SEQ ID NO: 68375 - DNA, 1309 bp, Hordeum vulgare
  CDS (30)..(1076)
ctctcgtccagcgagaagagcatccatccatggcgccgggggtggaggaggcggagggggctggcaggagaggggtcccttccctgctcggcgacggcggaaccgggcaggaggagcacatcgcctctgacgtcacccagctgatagggtggacgccgctgatcgagctgaggcggatcgccgggaaggagggggtgggtgcccgcatcgtcggcaagatcgaggcctaccagcccctctgctccgtcaaggaccgcagcgctctcaggatgatagaagacgccgaagagaaagggctgatttcacctggtgtcacgactctagtcgagccgacaagtggtaatttggggctaggactggtgctcattgctctgagcaaagggtacaggtttgttgcggtgatgccgggtcagtactcgctggataagcagatcttgttgagatacatgggtgctgagttgttcataactgatccagcacttgggtttccgggacaagttgaaaaggtcgaacagctcaagaaagaattgcccaatgtacatgttcttgatcagttctcgaatccagcaaaccccgaggcacacattcgatggactggacccgagatttggaaggatactgctggaaaggtggatatatttgttgcgggttcaggctcaggaggcacagtatcaggtgttgggaagtatttgaaaatgcaaaatccaaatgtgaagatcatttgtgttgagcctgcagagagcccagttatttcaggtggggagcgaggcaaacataaaatccagggaataggaccaggattcgtgcctgaaatcttggacacctcggtcatcgacgaggtgcttaccgtgaccactgaggaagcaatggcgaacgcaaggaggttggcaatggaagagggcctgcttgtgggcatatcttctggggcaaacttggcggcttgcttgaaggtcgcggtgagagaagagaacaaggggaagatgattgtgaccatgttcccgagcgggggcgagagatacatgaactctgacctctttgcagctgtaagagaggagtgtattgccatgaccttttgatctcacatgctacaaattcaaaagagttgtgtgtaaaaggtgaatgcagctggttaccatattgtgtcgcatgaccttgctacggatttcatctacaagggatcatgaagggttgttagtcattgagcgaatgtattaccagatcatattatgccacaacggcaccaaaacagaacatctatgttataaatttagtgtaccagttgtttttttggtgtaaaaaaaaaaaaaaa

SEQ ID NO: 68376 - protein, 348 aa, Hordeum vulgare
MAPGVEEAEGAGRRGVPSLLGDGGTGQEEHIASDVTQLIGWTPLIELRRIAGKEGVGARIVGKIEAYQPLCSVKDRSALRMIEDAEEKGLISPGVTTLVEPTSGNLGLGLVLIALSKGYRFVAVMPGQYSLDKQILLRYMGAELFITDPALGFPGQVEKVEQLKKELPNVHVLDQFSNPANPEAHIRWTGPEIWKDTAGKVDIFVAGSGSGGTVSGVGKYLKMQNPNVKIICVEPAESPVISGGERGKHKIQGIGPGFVPEILDTSVIDEVLTVTTEEAMANARRLAMEEGLLVGISSGANLAACLKVAVREENKGKMIVTMFPSGGERYMNSDLFAAVREECIAMTF

SEQ ID NO: 68377 - DNA, 1574 bp, Hordeum vulgare
  CDS (50)..(1189)
gcggctcctctctttcccctctgtaaaacccctcgcgcagacggcggccatggcgatggcgtcgccgccagcctgctccctcctcctcccggccatttcttgcgcgccggcctacgctagtgtcccacgagcaccccggttcctcacctgcccacgcgctgtaacagcccaccgaccccttcccacgacctcctctcctaaggtcgcggcgccccccgccgtcgagatcccggaggagtacgcggatgatgtcgaagcggtgaacattgcggtggacgtcactcagctaattggaaagaccccaatggtatatctcaataatgttgtcgaaggttgtgccgctaatattgccgcaaagcttgagtacatgggaccttgccggagcgtcaaagacaggattgcattaagcatgattagtgacgcagaagagaaaggattaatttctccaaacaagaccattttggtagaaccaactactgggaatactggtataggactagctgcagtagctgctgctagaggatacaaaatgatagcaactatgccttcatcgatagatgttgagagacgcattcttgtacgcgcatttggagcagatattgtgttaactgatcctacaacaggactaaaaggagctgttgacaaagctgaggaaatagtttcaaagacaccgaatgcgtacatgtttcagcaattcgacaatacagctaacagtgagatccactttcaaaccacaggcccagaaatatgggaggacacactgggtactgttgacatacttgttgcgagcatcgggactggtggcactatcactggcaccgggcgctacttaaaaatgatgaatagagatattaaggtcatcggggtagagcctgctgaaactagtgtgatttctggcgacaagccaggttatattccaagcatactagatgttcagctccttgatgaggttgtgaaggttaccactgcagaggcagttgatgttgcgaggctgcttgcactaaaagagggcttgctggttggcatttcgtcaggtgctgcagcaattgctgctataaacgtggccaaaagacctgaaaatgctggaaagctgattgccgttatcttccccagctttggagagagatatatctctagcattttgttccgtccgatatacaactccgttcgaaggatgaggaagcgatgatcaacttctcccattccaacaaagacggacccgacaggcttccacggcatgacaaacataacacatcaagcagggcagcattgtagaaatgctctggcagcagaaggacactggtcgtaaatgtttgaaattgcgcagagtagctgccgagtgggcttcagcactgcatcgacttggttccataaaaaaccgagggaagggaaaatcatgagttgttgtatgttatctgcctcaaacgtttggaactcggtgaaacatgccgaattagatgtggtagttcgtttaggatcaatgtttgagtagtctatagggccaggaacaaagcagacttatcatctgatatttgactgatcttactaaatggcctcctaaaaaaaaaaaaaaa

SEQ ID NO: 68378 - protein, 379 aa, Hordeum vulgare
MAMASPPACSLLLPAISCAPAYASVPRAPRFLTCPRAVTAHRPLPTTSSPKVAAPPAVEIPEEYADDVEAVNIAVDVTQLIGKTPMVYLNNVVEGCAANIAAKLEYMGPCRSVKDRIALSMISDAEEKGLISPNKTILVEPTTGNTGIGLAAVAAARGYKMIATMPSSIDVERRILVRAFGADIVLTDPTTGLKGAVDKAEEIVSKTPNAYMFQQFDNTANSEIHFQTTGPEIWEDTLGTVDILVASIGTGGTITGTGRYLKMMNRDIKVIGVEPAETSVISGDKPGYIPSILDVQLLDEVVKVTTAEAVDVARLLALKEGLLVGISSGAAAIAAINVAKRPENAGKLIAVIFPSFGERYISSILFRPIYNSVRRMRKR

SEQ ID NO: 68379 - DNA, 1533 bp, Zea mays
  CDS (40)..(1230)
gaattcccgggtcgacttcgctgtcgacgatttcgtaggatggcgtcgtggtcgtcgccctcatccgccgccgccgcctcgggcgcccgattcggccccttcccgagccgagcgcagcggctcgtgccgtatccgtcgctcgcccgcggaacccccgcctcgacgctcgtcctcaggccccacccggacggccgtggccatggcctcctcgcgcacaccggctcctcttcctcgcggtgccgcgccgtcgccgccgaggtcgagggcctcaacatcgccaaccacgtcagccagctcatcggcaagacaccaatggtatatatcaacaatgtcgtcaagggctctgtcgccaatgttgctgctaagcttgagattatggagccctgttgtagcgtcaaggacaggatagggtacagtatgataaatgatgctgaacagaagggcttgattactcctggaaagagtgttttagtggaagctacaagtggaaatacaggcattggtcttgcctttattgctgcttccaaaggatataagttgatattaacaatgccttcatcaatgagcatggagagaagagtcctactcagagcttttggtgctgaacttgtccttactgatgctgcaaaagggatgaaaggagccgtagataaggctacagagattttaaataagacacccaattcttacatgcttcaacagtttgataaccctgccaaccctaaggtacattatgagaccactggcccagagatctgggaggattcaaaggggaaggtggatatactaattggtggaattggaacaggcgggacaatatctggtgctggccgtttcctcaaggagaaaaattctggaattaaggttattggtattgagccttctgaaagtaacatactctccggtggaaaacctggtccacataagattcagggaattggtgcaggatttgttccaaggaacttggatagcgatattcttgatgaagtaattgagatatcaagtgatgaagctgttgagactgcaaaacagttggctgttcaggaaggattactggttggaatctcctctggagcagctgctgccgctgccataaaggttgcgaaaagaccagaaaatgctggaaagttgatagtggttgtgtttccgagttttggcgagaggtacctttcatctgtcctttatcagtccataagagaagaatgcgagaacatgcagcctgagccatgacggagccgtcactttaaacagcgtaataaatgtatctggaataagatgcgtgggcaccattagtgtgctccaattggtatcatttggcccatgctcacgctatccttttgtctctatgaccgaaactaatcaggcgtgtgagaaatatccatgactctcccaattgctttccattagcaaaatgattacacttctgaattgtctatacgattcaggctgatttgattggtaattgtaaacaacttgtccttgaatctttgaagtcaaacaaagtcagttggctgaaccaaaaaaaaaaaaaaa

SEQ ID NO: 68380 - protein, 396 aa, Zea mays
MASWSSPSSAAAASGARFGPFPSRAQRLVPYPSLARGTPASTLVLRPHPDGRGHGLLAHTGSSSSRCRAVAAEVEGLNIANHVSQLIGKTPMVYINNVVKGSVANVAAKLEIMEPCCSVKDRIGYSMINDAEQKGLITPGKSVLVEATSGNTGIGLAFIAASKGYKLILTMPSSMSMERRVLLRAFGAELVLTDAAKGMKGAVDKATEILNKTPNSYMLQQFDNPANPKVHYETTGPEIWEDSKGKVDILIGGIGTGGTISGAGRFLKEKNSGIKVIGIEPSESNILSGGKPGPHKIQGIGAGFVPRNLDSDILDEVIEISSDEAVETAKQLAVQEGLLVGISSGAAAAAAIKVAKRPENAGKLIVVVFPSFGERYLSSVLYQSIREECENMQPEP

SEQ ID NO: 68381 - DNA, 1190 bp, Helianthus annuus
  CDS (33)..(1010)
tgattgattatctttgaataactgaacaagttatggctgaaggaaagagtgggatcgctaaggatgttacagaattgattggtaacactcctttggtttatctcaacaatgttgtggatggttgtgttggccgtattgcggctaaactggaaatgatggagccttgttctagtgttaaggacaggattggttatagcatgattacggacgccgaagaaaaggggctcataacacctggagagagtgtccttgtcgaaccaacaagcggcaacactggcattgggctagctttcatggctgcggcaaaggggtacaagctcatcattacgatgcctgcttcgatgagccttgagagacgaattgttctccgtgcttttggtgctgagttggtccttactgatcccgctaaaggagtgaaaggtgctctccagaaagctgaggagattatggctaaaacgccaaattcttacatgcttcagcagtttgagaatcctgctaatccaaagatccattacgaaacaactggacctgaagtctggaaaggtacaggtgggaaaatcgatgcttttgtttccggcattggtactggcggtacgattacaggtgcagggaaatatcttaaagagcagaaccctgacataaagctttacggcattgagcctactgaaagtgctattttgtctggaggaacccctggtccacataagatccaagggattggtgctggattcatccctggtgttttagaagttgatcttattgatgaagttattaaagtttcaagtgaagaagcaattgaaactgcaaagcttcttgctcttaaagaaggattacttgtggggatatcatctggtgcagcagccgcagctgcaatcaagattgcaaagaggccagaaagtgctggaaagctgattgttgctgtgttcccgagtttcggggagcggtatctgtcttctgtgctatttgattcggtgcgaaaggaggcagagactatgacttttgatccttgaatacaatgagattgtgttattaagagggatcatgtcaacatatttgaagttcaatttgtaactgatgtctttttttttcatggggcaccttgttctatttttggtcccgttgtatgcttgtttcgaatgttatatcatgtggatgatatctttttctaaaaaagcaaaaaaaaaaaaaaa

SEQ ID NO: 68382 - protein, 325 aa, Helianthus annuus
MAEGKSGIAKDVTELIGNTPLVYLNNVVDGCVGRIAAKLEMMEPCSSVKDRIGYSMITDAEEKGLITPGESVLVEPTSGNTGIGLAFMAAAKGYKLIITMPASMSLERRIVLRAFGAELVLTDPAKGVKGALQKAEEIMAKTPNSYMLQQFENPANPKIHYETTGPEVWKGTGGKIDAFVSGIGTGGTITGAGKYLKEQNPDIKLYGIEPTESAILSGGTPGPHKIQGIGAGFIPGVLEVDLIDEVIKVSSEEAIETAKLLALKEGLLVGISSGAAAAAAIKIAKRPESAGKLIVAVFPSFGERYLSSVLFDSVRKEAETMTFDP

SEQ ID NO: 68383 - DNA, 1391 bp, Glycine max
  CDS (112)..(1203)
ctcgccgccaatttcttctcctgtcatctaagatctctccgcacaaacacttcgaacgacaccgttttaggcttcgtcggattccgatcttccttttttcttcctcaagtcatggccacactcaagagcgtctgcttcagaggatccacctttcccgtttgcccctccaatttcacgaacactagaaacaccaggagctcatgttggaggcctacacaagcagctgtgaagtccaatttccatctcccaatgcgcagttttgagttaaaaaataggacttctccagaggacataaaggctctgagattgataactgccattaaaactccatacctacctgatggtcgttttgatcttgaagcatatgatgacttggtgaatatgcagattggacaaggggctgaaggtgttattgttggtgggacaactggtgaaggccaattaatgagctgggaagagcacataatgcttattgctcatacagtcaactgttttggtgggaaaattaaggttattggaaatactggaagcaactccaccagggaagcaattcatgccactgagcagggttttgctgttggaatgcatgctgcccttcacataaacccttactatggcaaaacctccttggatggtatggttgctcactttcaaagtgtgctttccatgggacccacaataatctacaatgtgcctgcacggaccggtcaagacattcctccgcatgtaattcaaaccttagctgaaagtgttaacctggctggtgtcaaggagtgtgtgggaaatgaccgaatcaaacagtatacagatgatggaattgttgtgtggagtgggaatgatgatcaatgtcatgatgctagatggggttatggggctaccggagtggtatctgttgcgagcaacctggttcccggtttaatgcgagaactcatgtttggcggtgtaaaccctactctaaattctaaactcttgcctctgattgactggcttttccacatgccaaaccccattggtttgaacactgctcttgctcaacttggggtcatcagacccgtttttaggctaccttttgtacctctccctgtggacaaaaggatagagtttgccaatttggtgaaggaaattggtcgagagcattttgttggaaataaagttgttgaggttcttgatgatgatgactttttcttggttagtcgttattaagctacattgtaagatcgttgtatcctttctaggggtttgccaaatttaaaatccagatgagtctattgtagtgaactagttaatgatcatttagtttctttttactgactactttgtagttgcaaactggttcaaatttattctgaattttaagtgctctgcatattgtattgaaaaaaaaaaaaaaa

SEQ ID NO: 68384 - protein, 363 aa, Glycine max
MATLKSVCFRGSTFPVCPSNFTNTRNTRSSCWRPTQAAVKSNFHLPMRSFELKNRTSPEDIKALRLITAIKTPYLPDGRFDLEAYDDLVNMQIGQGAEGVIVGGTTGEGQLMSWEEHIMLIAHTVNCFGGKIKVIGNTGSNSTREAIHATEQGFAVGMHAALHINPYYGKTSLDGMVAHFQSVLSMGPTIIYNVPARTGQDIPPHVIQTLAESVNLAGVKECVGNDRIKQYTDDGIVVWSGNDDQCHDARWGYGATGVVSVASNLVPGLMRELMFGGVNPTLNSKLLPLIDWLFHMPNPIGLNTALAQLGVIRPVFRLPFVPLPVDKRIEFANLVKEIGREHFVGNKVVEVLDDDDFFLVSRY

SEQ ID NO: 68385 - DNA, 1407 bp, Zea mays
  CDS (84)..(1226)
gagcctcgtctactgatagtcctgtcctgtttcactctcgccagccaaagacgaccacgccctccgtgctccagccattccccatgatttcgccgacgaatctcctcccggcgcggaagatcacccctgtctcaaatggcggcgcagcgacggcgagcccctcttctccctcggtggccgcacggccacggcgactcccttcaggcctccaatctgtgactggtagagggaaggtttccttggcagccatcactctagatgattaccttccaatgcgaagcactgaagtgaagaaccggacatcaacagatgacatcacaaggctgagactaatcacagcagttaaaaccccctatttgccagatgggaggttcgatctggaagcatatgattctctcataaacatgcagatagagggtggtgccgaaggcgtaatagttggaggaacaacaggagagggtcacctcatgagctgggacgaacatatcatgctcattgggcacacagtgaactgctttggctctagaatcaaagtgataggcaacacaggaagcaactcaaccagagaagccgtccacgcaacagaacagggatttgctgttggcatgcatgcggctctccacatcaatccttactacgggaagacctcagctgaaggaatgatctctcatttcgaggctgtcctcccgatgggtccgaccatcatctacaacgtgccatccaggagcgcccaggacatcccccctgaagttattctagcgatttctggctacacaaacatggcgggtgtcaaggaatgtgttgggcacgagagggttaagcactacgctgacaaaggcataacaatttggagcggtaacgacgacgagtgccacgattctaagtggaaacatggcgctactggggtcatttccgttaccagcaaccttgttcccgggctcatgcacagcctcatgtacaaaggcgagaacgccacgctgaacgagaagctgtcgcccctgatgaaatggctgttctgccagccaaatcctattgccctcaacactgctctggctcagctcggcgtggcaaggcctgtcttcagactgccgtacgttccgctccctcttgaaaagagggccgagttcgtccggattgttgagtcaattggacgggaaaatttcgtggggcagaaggaggcccaggttctagatgatgacgatttcgtgttgatcagtaggtactaggaaaatgagtttgccagtctatgtatcttggcgaataaactagtagtttgtaccttgcgttcagacttcgtcctgttgttcatcagtcgttgggttcgtctatctatttattaattgccctactttggccgcattgtataatgtatatgtatcgcgtttatagtccaaaaaaaaaaaaaaa

SEQ ID NO: 68386 - protein, 380 aa, Zea mays
MISPTNLLPARKITPVSNGGAATASPSSPSVAARPRRLPSGLQSVTGRGKVSLAAITLDDYLPMRSTEVKNRTSTDDITRLRLITAVKTPYLPDGRFDLEAYDSLINMQIEGGAEGVIVGGTTGEGHLMSWDEHIMLIGHTVNCFGSRIKVIGNTGSNSTREAVHATEQGFAVGMHAALHINPYYGKTSAEGMISHFEAVLPMGPTIIYNVPSRSAQDIPPEVILAISGYTNMAGVKECVGHERVKHYADKGITIWSGNDDECHDSKWKHGATGVISVTSNLVPGLMHSLMYKGENATLNEKLSPLMKWLFCQPNPIALNTALAQLGVARPVFRLPYVPLPLEKRAEFVRIVESIGRENFVGQKEAQVLDDDDFVLISRY

SEQ ID NO: 68387 - DNA, 993 bp, Glycine max
  CDS (49)..(639)
cggcgtttgctaattgcttcgaccgagtgattcagaggaggagaagtaatggctgcgatcgcgggagcgcacgtgtttggtgttgtgagttttcagctcaagcaagctgaaatgccctttgcatgttccagcttaatccgcaagcatattggagattctcctcagcgcaatgtggctctaagacgcagagcaaatggaacaattcttccccaaatcagagcccagaacgttcttccagactatgttccaaaatcggagttttataaagtagaagccattctcaggccctggcgagtccctcaggtttcttcggctatgttgaaaatgggaattcgcggtgtcactgtatctgatgtcaagggctttggttctcagggtggttcaaaagagagacagggaggctctgaattttctgaagacaattttgttgccaaagttaaaatggaaatagtagtgagaaaggaccaggttgaggcagtaattgacaaaattatcgaggaggcaaggactggggagattggtgatggcaaaattttcttgatccccgtctcagatgttataagaattcgaacaggtgagcgtggggagcaggcagagaggatgactgggggccgaagtgatatgctatctgctgtatgactgattggaacgaaagatcagcatttgtaatctggttctcttaccctttctcctttttcccttgtggaatattgaatgcattacgatgctgtatgcttcatatgttttgcacttatatgtcggaagatgtatgacagacagtattgaaagggcactgtagttatgtggtgaagaaaaattgtgaaaaaataataaacaaatgctgagttgattcatatgttatcgtgaaaaagccaatttggtgtgtatttatataatcattttttcgccatgtcatgacaccaagatggcaagatgtatgacttgcaatcaaattaaggataagctgtaattttcgtcaaaaaaaaaaaaaaa

SEQ ID NO: 68388 - protein, 196 aa, Glycine max
MAAIAGAHVFGVVSFQLKQAEMPFACSSLIRKHIGDSPQRNVALRRRANGTILPQIRAQNVLPDYVPKSEFYKVEAILRPWRVPQVSSAMLKMGIRGVTVSDVKGFGSQGGSKERQGGSEFSEDNFVAKVKMEIVVRKDQVEAVIDKIIEEARTGEIGDGKIFLIPVSDVIRIRTGERGEQAERMTGGRSDMLSAV

SEQ ID NO: 68389 - DNA, 985 bp, Triticum aestivum
  CDS (94)..(693)
gaattcccgggtcgacttcgctgtcgagatttcgtgcactcagcagagcactactcagcagacgacactgaatcgccaacaactgcgttcatcatgtcgccggcgacttcttccgcggtgggtaccctatccggcggcctcctcaccaacgctgcacatcgccgacgacccttcccaaccgcccgcctcctcccgccgcgctggtctaggctccaggtcaacgcggcccgtcatcgccgcccggccactcccgcgcgcgcccagagcgctccctccccagagtacctgccggactcggagttctacaagatcgaggccatcctgaggccatggagggtgtcccatgtctcgtcgggtttgctagaaatggggatcagaggcgtgacggtgtctgacgtgcggggttatggggcgcagggcgggtcaacggagcggtatgaagggtcagaattttcagaagatacatttattgctaaagttaaaatggaaatagtcgtgtgcaaggagcaggtggagccagtgattgacaaaataattgaaaaggccagaactggagaaataggcgacgggaagatattcttgatacccgtcgcggacgttgtaagggtacgcacaggcgaacgcggagtgcatgcggagaggatgatcggcggtctgtcagacaaactgcctccggtgatcacaatctcataagtagaacttgactgctcttgctgcctgtatctgtaagcgcatccctcaggctggttgcttgtgacttgacctttgggaaataataatgtgtatgtaactttgtgtgttggcacgaataaatcggcaccagcgtccatacggtgggtggtgttgctgaatgggggtggttttagtgtggctcgtgtgccgaatgtggtgattgcaaacgttggtttgaaggtgaaaatctggatgtaatttctgccagttcagtctaagtttcattttcttttaactcaaaaaaaaaaaaaaa

SEQ ID NO: 68390 - protein, 199 aa, Triticum aestivum
MSPATSSAVGTLSGGLLTNAAHRRRPFPTARLLPPRWSRLQVNAARHRRPATPARAQSAPSPEYLPDSEFYKIEAILRPWRVSHVSSGLLEMGIRGVTVSDVRGYGAQGGSTERYEGSEFSEDTFIAKVKMEIVVCKEQVEPVIDKIIEKARTGEIGDGKIFLIPVADVVRVRTGERGVHAERMIGGLSDKLPPVITIS

SEQ ID NO: 68391 - DNA, 1513 bp, Brassica napus; identical to SEQ ID NO: 68271
  CDS (82)..(1320)

SEQ ID NO: 68392 - protein, 412 aa, Brassica napus; identical to SEQ ID NO: 68272

SEQ ID NO: 68393 - DNA, 1766 bp, Brassica napus; identical to SEQ ID NO: 68273
  CDS (57)..(1556)

SEQ ID NO: 68394 - protein, 499 aa, Brassica napus; identical to SEQ ID NO: 68274

SEQ ID NO: 68395 - DNA, 1955 bp, Brassica napus; identical to SEQ ID NO: 68277
  CDS (13)..(1797)

SEQ ID NO: 68396 - protein, 594 aa, Brassica napus; identical to SEQ ID NO: 68278

SEQ ID NO: 68397 - DNA, 1609 bp, Brassica napus; identical to SEQ ID NO: 68279
  CDS (140)..(1504)

SEQ ID NO: 68398 - protein, 454 aa, Brassica napus; identical to SEQ ID NO: 68280

SEQ ID NO: 68399 - DNA, 1762 bp, Zea mays; identical to SEQ ID NO: 68281
  CDS (185)..(1471)

SEQ ID NO: 68400 - protein, 428 aa, Zea mays; identical to SEQ ID NO: 68282

SEQ ID NO: 68401 - DNA, 2825 bp, Glycine max; identical to SEQ ID NO: 68283
  CDS (207)..(2402)

SEQ ID NO: 68402 - protein, 731 aa, Glycine max; identical to SEQ ID NO: 68284

SEQ ID NO: 68403 - DNA, 2189 bp, Glycine max; identical to SEQ ID NO: 68285
  CDS (45)..(1832)

SEQ ID NO: 68404 - protein, 595 aa, Glycine max; identical to SEQ ID NO: 68286

SEQ ID NO: 68405 - DNA, 1926 bp, Glycine max
  CDS (44)..(1636)
cgaaacttatcttgggaagctgcaacgagcgaagagcagagaaatggtggttgggcagcttgttccttcgaatttgttcctgaatcgttctgctgcgaccagacacagacaccttctttgtgtttctgcaaatgacacaacctcaaccaataacacggataacggttctccattctcaagtttcggaagactcaaggcccagaaagtgaagactctcctggtccacagaagaggaaaggaccaaagccatagacgccccgttcaccttgaagatgatgatgattatgtagccacccctagaccccgacgctctcagtctcgtacacgaggaggagaaagatgggatatgattcccaattatactccaccggcacaaagcaaatcggtgagcgacaccaagtttttcagcctcaagtcctttaaagaaatagggtgcagtgagtatatgattgaatccctccaaaaactcttgtttagccggccttcccatgtacaggccatggcattcacacctgttattagtggaaagacttgtgtcattgctgaccagagtggttctggtaagacatttgcttatctggctcctatcattcagcgccttagacaacaagagcttgaaggaattattagtaaatcctcttcacaagctcctagtcctagagtccttgttcttgcaccaactgctgagttggcttctcaggtcttagataattgtcgctccttgtctaaatctggcgttccattcaagtctatggttgtcaccggtggttttcgacaaaaaactcaactggaaaatttacagcagggagttgatgtcttaatagctacacctggccgttttctgttcctcatcaatcaaggcttcttgcatttaacaaatctaagatgtgctgtgttggatgaggtagatatactctttggtgatgaggacttcgaagtggctcttcaatccttgatcaattcatcaccagttgacacacagtatttatttgtgactgcaactttacctaaaaatgtttacaccaaattggttgaagtttttcctgattgtgaaatgattatggggcctggcatgcaccgaataagttctcgccttcaagagattatagtagattgcagtggagaagatggacaagaaaaaactcctgatacagcatttttgaacaagaaaactgcacttctgcagcttgtggaggaaagtcctgtcccaagaactattgtgttctgcaacaaaattgaaacctgcagaaaagttgaaaatttattaaagcgttttgatagaaaaggaaattgcgtgcaagttctaccattccatgctgccatgacacaagaatcacggcttgctagtatggaagagtttacacgttctccatcaaaaggagtctcccagtttatggtttgcaccgacagagcatcacggggaatagattttgcaagagtggatcatgtcatactctttgacttcccacgtgatccaagtgaatatgtacgacgggttggaagaacagccagaggtgccaagggagtgggcaaggcatttatctttgtggttggcaagcaagtatcccttgcacgcaaaataatggaaagaaatcagaagggtcacccactacatgatgtgccttcggcttattagctggtgaagtagaaagttgagttagtacttggagaggttgctctcaactcgactgctgaaacatactgtattaatttgagtgagctagcagctgcttaactacttctctcatcccaaaccaccttattaagagcaacttgctgatccatagttggcttattagtaacattcgcagaaggtgatttgcactttgcaacacatgttgtagcaaaagcatgacttacattaattatctacttctttaaagtatgaaatggaagattgactgttaccttaaaaaaaaaaaaaaa

SEQ ID NO: 68406 - protein, 530 aa, Glycine max
MVVGQLVPSNLFLNRSAATRHRHLLCVSANDTTSTNNTDNGSPFSSFGRLKAQKVKTLLVHRRGKDQSHRRPVHLEDDDDYVATPRPRRSQSRTRGGERWDMIPNYTPPAQSKSVSDTKFFSLKSFKEIGCSEYMIESLQKLLFSRPSHVQAMAFTPVISGKTCVIADQSGSGKTFAYLAPIIQRLRQQELEGIISKSSSQAPSPRVLVLAPTAELASQVLDNCRSLSKSGVPFKSMVVTGGFRQKTQLENLQQGVDVLIATPGRFLFLINQGFLHLTNLRCAVLDEVDILFGDEDFEVALQSLINSSPVDTQYLFVTATLPKNVYTKLVEVFPDCEMIMGPGMHRISSRLQEIIVDCSGEDGQEKTPDTAFLNKKTALLQLVEESPVPRTIVFCNKIETCRKVENLLKRFDRKGNCVQVLPFHAAMTQESRLASMEEFTRSPSKGVSQFMVCTDRASRGIDFARVDHVILFDFPRDPSEYVRRVGRTARGAKGVGKAFIFVVGKQVSLARKIMERNQKGHPLHDVPSAY

SEQ ID NO: 68407 - DNA, 2189 bp, Glycine max; identical to SEQ ID NO: 68287
  CDS (454)..(2049)

SEQ ID NO: 68408 - protein, 531 aa, Glycine max; identical to SEQ ID NO: 68288

SEQ ID NO: 68409 - DNA, 1535 bp, Glycine max; identical to SEQ ID NO: 68289
  CDS (98)..(1339)

SEQ ID NO: 68410 - protein, 413 aa, Glycine max; identical to SEQ ID NO: 68290

SEQ ID NO: 68411 - DNA, 1571 bp, Glycine max; identical to SEQ ID NO: 68291
  CDS (123)..(1187)

SEQ ID NO: 68412 - protein, 354 aa, Glycine max; identical to SEQ ID NO: 68292

SEQ ID NO: 68413 - DNA, 1790 bp, Glycine max; identical to SEQ ID NO: 68293
  CDS (205)..(1488)

SEQ ID NO: 68414 - protein, 427 aa, Glycine max; identical to SEQ ID NO: 68294

SEQ ID NO: 68415 - DNA, 1627 bp, Linum usitatissimum; identical to SEQ ID NO: 68295
  CDS (56)..(1297)

SEQ ID NO: 68416 - protein, 413 aa, Linum usitatissimum; identical to SEQ ID NO: 68296

SEQ ID NO: 68417 - DNA, 1940 bp, Zea mays; identical to SEQ ID NO: 68297
  CDS (3)..(1502)

SEQ ID NO: 68418 - protein, 499 aa, Zea mays; identical to SEQ ID NO: 68298

SEQ ID NO: 68419 - DNA, 1635 bp, Helianthus annuus
  CDS (139)..(1458)
acgcaaacacacagaagtcgcaggacaccacacgccgccactatcctctcgtctccagccaccacacacagccagtcgccggagccactccagcctccacacggagtcacacaaccccttctctcttcagattgaaaaatggaagaagagagagaagaattgaaatcattcaaagaacttggaattgttgacgaactgattgaggcttgtgatagtttgggctggaaaaatccttctaaaatacaagctgaggccattcctcatgctcttgaagggaaggatttgattgggttagcacaaactggttctgggaaaactggagcttttgctctgccaattattcaagctcttttggttgctaaacaagcattttttgcttgtgtgctttctcccactagggaacttgcgatacagattgctgagcagtttgaggccttgggatcgagcaatggcttaaggtgtgcagtgcttgttggaggggtggaccatgtacaacaaagcataacacttggaaaacgaccacacatcgttgttgcgacacctggacgtcttgtggatcacttgtctaataccaagggtttttctcttcgcacgattaagtacctggtgttagatgaggcagacaggttgctaaacgaggactttgagaaatcgcttgatgaaatccttagtgccattccccgtgagaggagaacatacttgttctccgctactatgactaaaaaggtgcaaaagctgcagagagcttgcctaagaaatcctgtaaagattgaagcagcatctaaatattctactgttgacaccttgaaacaacaatatcgttttgttcctgctaaatacaagaactgttatcttgtatacatcttgattgaaaaatccgcaagtacatcaatggttttcacccgtacatgtgaagcaacccgtcatttggctttgatgcttaggaaccttgggctacgtgcaatcccgatttccggtcaaatgactcagacaaagaggcttggtgcattgaacaagttcaaggctggtgagtgtaatattcttatatgcactgatgtagccagcagaggacttgatattccgtctgttgatatggttattaattatgatatccccacaaactcaaaggattatattcattgggttggaagaactgcacgtgcggggcgatctggggttgctatttcgctagtgaaccagtacgagctggagtggtatatccagatagaaaaacttattggcaaaaagttaccggagtttagtgcccaagaggaggaagttttgttactgttggaacgtgtgacagaggctgaacgattatctcggatgaaaatgaaggaaatgggaggtcctaagagaagaagagggggtgaaggtgaagaggaagaagttgaaaagttccaagggaagggcaagaagaagtcatcaaataaaaagtcaaaacgacaattcgtttaatttccaacagttttgttaactgcacggattttgtaaattagttgaaggttataaagttttgactgtggtaggatgtcatgagactactgttataaggttagatggatttattattattgtaaacaaagtctatggtatgaagtatgaacttgtttttgtcttaaaaaaaaaaaaaaa

SEQ ID NO: 68420 - protein, 439 aa, Helianthus annuus
MEEEREELKSFKELGIVDELIEACDSLGWKNPSKIQAEAIPHALEGKDLIGLAQTGSGKTGAFALPIIQALLVAKQAFFACVLSPTRELAIQIAEQFEALGSSNGLRCAVLVGGVDHVQQSITLGKRPHIVVATPGRLVDHLSNTKGFSLRTIKYLVLDEADRLLNEDFEKSLDEILSAIPRERRTYLFSATMTKKVQKLQRACLRNPVKIEAASKYSTVDTLKQQYRFVPAKYKNCYLVYILIEKSASTSMVFTRTCEATRHLALMLRNLGLRAIPISGQMTQTKRLGALNKFKAGECNILICTDVASRGLDIPSVDMVINYDIPTNSKDYIHWVGRTARAGRSGVAISLVNQYELEWYIQIEKLIGKKLPEFSAQEEEVLLLLERVTEAERLSRMKMKEMGGPKRRRGGEGEEEEVEKFQGKGKKKSSNKKSKRQFV

SEQ ID NO: 68421 - DNA, 1601 bp, Zea mays
  CDS (57)..(1238)
gaattcccgggtcgacttgctgtgacgatttcgtggcctttagcgcggcggcggcaatggcgcccacggcctgcctccggacccccttcttccccgcccgtgcccgatccaccaacgccaccccgttctcgccacaccgccgcttttctctcaaatgcagcgcctccaacggtgacaactccaaccccaactccatctccatctctcccacctcgccgcctcggctaacggtgtcggacggcgtcgagtctgtggacgttaacgggttgcgtcgcccgtcagcgcccgcctccgtccccgccgcccgcgatccccactggctgcctcgtccgctcacaagtgcggacgtcatggaggtggacgggaaggggctcaaggttgcttaccagggttgtgctggagcgtacagcgaagcagcagcaaagaaggcgtacccgaattgtgagactgtgccctgtgagcacttcgacactgcatttcaggctgttcaaaactgggtagctgatagggccgtactgccacttgagaattcattgggaggtagcatacataggaattatgatcttttgcttcggcatagtttgcacattgtaggagaagttcgccttgcggttcgccattgcttattagccaatcctggcgtgaagattgaaaacctgaaaagtgctatgagtcatccccaggctcttgcgcaatgtgagcacacattaacatcactaggaattgagcatagagaagctgttgacgacactgctggtgcagcaaagattgttgcagaacatatgctccaggacactggtgctattgctagttcgttggcggctaaactgtatggattggatgttcttgctgagaatattcaggatgacaaagataatgtcacccgttttatgatgctagctcgagaacccatcatacctcgcactgataaaccatttaagacaagcatagtcttttcactagaagaaggacctggacagctctttaaggcacttgctgtatttgcactgagggacatcaacctcacaaagattgaaagtcgtccacacaaggaaaggcctcttcgggtatctgatgactgttcctcactcttaaagaactttgattaccttttttatgttgaccttgaagcatcaatggctgatccaaagactcagaatgctcttggaaatctgaaggagtttgcaacatttttaagagttcttggaagctatcctacagatgtgaatgaaccttagattgaaagtactgcagattacatactgagtaaaaggatctactctagaccagtagggaccggtgcattcgaggctcacatttggttgtgatattgagaggaaagtctgatgttttgctggtgatttttctgatgatttaagtcttctccaatctcctatggataccaaagggttgaatattcggaaatacttcaatgtacaaggtttatatgtttcatgttggagaatctgtgtcatggtagcatgcaggttgctaaagcacagttacagtgaaataatgggacaatgtctaagaacaccgccctttttttgtgacaatataataagaactgaataactgatgtttccaaaaaaaaaaaaaaa

SEQ ID NO: 68422 - protein, 393 aa, Zea mays
MAPTACLRTPFFPARARSTNATPFSPHRRFSLKCSASNGDNSNPNSISISPTSPPRLTVSDGVESVDVNGLRRPSAPASVPAARDPHWLPRPLTSADVMEVDGKGLKVAYQGCAGAYSEAAAKKAYPNCETVPCEHFDTAFQAVQNWVADRAVLPLENSLGGSIHRNYDLLLRHSLHIVGEVRLAVRHCLLANPGVKIENLKSAMSHPQALAQCEHTLTSLGIEHREAVDDTAGAAKIVAEHMLQDTGAIASSLAAKLYGLDVLAENIQDDKDNVTRFMMLAREPIIPRTDKPFKTSIVFSLEEGPGQLFKALAVFALRDINLTKIESRPHKERPLRVSDDCSSLLKNFDYLFYVDLEASMADPKTQNALGNLKEFATFLRVLGSYPTDVNEP

SEQ ID NO: 68423 - DNA, 1956 bp, Brassica napus
  CDS (98)..(1870)
tgggtcccacttaccgccgccgtctcccgccggtttaaattcattttctatggaatcttaattgatttcttctaaaacgaagcagtgcaagtaaaaaatgatggagcagggagctttgttgcgttctgcgtcttttcaattacgccgaacgaggaacgatctttcgtctttcaagccggaaaataagttaaaccctggtcaaatccggtttaggtttaaaccggttggttccgtggcggcgaaatgcaatacgtacaacagctacgcggcgagtggaggcggcgacgcgggggctgagcatccagtggacgacaaagagttcgtgcgctggttccgtgaagcttggccttatctgtgggcccacggtggctgcactttcgtcgttgtcatctccggcgatatactcgccggcccttactgtgatcccattttaaaggacatagcgtttctccatcatcttgggataagattcgttctagttccaggaacacaagtgcaaatcgaccagcttctgtctgaaagaggacgcgaggctacatatgtgggacgttacagagtaacagacgcagcatcgttgcaagccgccacggaagctgcgggagctatctcagtgatgcttgaggctaaactatctcctggaccttccatttgcaatatccgtaggcatggtgatagtagtcgtttgcatgatataggtgtcagggttgataccggcaacttctttgcagcgaaaaggagaggcgttgttgatggtgttgattttggagcgactggtgaagtgaagaagatagatgttgaccggatttgtgagaggcttgacggtggttctgtagtcttgttgaggaacttgggtcactctagctccggagaagtcttaaattgcaatacctatgaggttgctacagcttgtgcattagctataggagcagataagcttatttgcataatggacggtccaattcttgatgagagtggacatcttattcgtttcttgacactccaagaagcagatacgttagtgagaaaacgtgtacagcaaagcgacattgctgctaactatgtaaaggctgttggtgatggaagcatggcttatcaagaacctcctggtaacgggagagcagcgttttggggaaacgggaaccacactccgatctttcaaaacggtgttggatttgacattgggagtgggttagggtctggtgagcaaggctttgctattggtggtgaggagagactaagccgccaaaacggttatctttccgaactggctgctgctgcttttgtctgcaggggtggagttaaaagagttcatttgttggatggtactataactggagttctattgttggagcttttcaaaagagatggaatggggactatggtcgctagtgatgtatacgaaggaacacgagacgccaaagtaaatgatcttgcaggaatcagacgtatcatcaaacctttggaggaagctgggatcttggtccgcagaaccgacgaggagttactccaagctttggactccttcgtggtagtcgaaagggaaggtcaaatcatcgcttgtgcagctctgttcccattcttccaagacaaatgcggagaagtcgcagccatcgcggttgcatcagactgccgcggtcaaggccaaggcgataaactactagattacatggagaagaaagcatcctctctcgggttagacacgctgtttctcctcacaacgcgagcagcagactggttcgtgagacgcgggttccaagaatgctcaatcgaggtcataccagagaccagaaggcaaagaatcaacctctcaagaaaatcaaagtactacatgaagaagctactacctgataagagtggcatctcaatataacacaaacagcaatcattattgtaaaaattaaaaaacattttgcaatcaagcttttatttctattattcaagaaaaaaaaaaaaaaa

SEQ ID NO: 68424 - protein, 590 aa, Brassica napus
MMEQGALLRSASFQLRRTRNDLSSFKPENKLNPGQIRFRFKPVGSVAAKCNTYNSYAASGGGDAGAEHPVDDKEFVRWFREAWPYLWAHGGCTFVVVISGDILAGPYCDPILKDIAFLHHLGIRFVLVPGTQVQIDQLLSERGREATYVGRYRVTDAASLQAATEAAGAISVMLEAKLSPGPSICNIRRHGDSSRLHDIGVRVDTGNFFAAKRRGVVDGVDFGATGEVKKIDVDRICERLDGGSVVLLRNLGHSSSGEVLNCNTYEVATACALAIGADKLICIMDGPILDESGHLIRFLTLQEADTLVRKRVQQSDIAANYVKAVGDGSMAYQEPPGNGRAAFWGNGNHTPIFQNGVGFDIGSGLGSGEQGFAIGGEERLSRQNGYLSELAAAAFVCRGGVKRVHLLDGTITGVLLLELFKRDGMGTMVASDVYEGTRDAKVNDLAGIRRIIKPLEEAGILVRRTDEELLQALDSFVVVEREGQIIACAALFPFFQDKCGEVAAIAVASDCRGQGQGDKLLDYMEKKASSLGLDTLFLLTTRAADWFVRRGFQECSIEVIPETRRQRINLSRKSKYYMKKLLPDKSGISI

SEQ ID NO: 68425 - DNA, 1417 bp, Brassica napus
  CDS (151)..(1176)
gaattcccgggtcgacagtaactattggttcattactgtttgcctgcgacatacaccgctgaagattttaactaatttgtaactaaacctgagagactctctcgcttcagtattatctccgccgcctactccggtaggagtcactcagatatggccaccgtcacatccaaaacgccgcctaaatccttctccttctccatttccaatcctctcaaacccctaacccccaaatctccatccctccgctttccacctcgcaacaatcatcaccaccaccgtttatccgtaaacgccgccgtatcaccaccgccttcagacacaccttcgccggattatagattcgagatcctctccgagtccctacccttcatccaaaaattccgaggcaaaaccatcgtcgtcaaatacggcggcgcggccatgacttcgccggagctaaaagcctccgtcgtcaccgacctcgtcctcctcgcgtgcgtcggtctccgccccatcctcgtccacggcggaggtcccgacatcaaccgctacctcaaacagcttaacatcccggccgagttccgcgacggactccgcgtcaccgacgccacgacgatggagatcgtctcgatggttctcgtcggaaaagtgaacaagaatctcgtttctttaataaacgccgccggagccaccgctgttgggctgtccggacacgacggtcgtcttatcaccgcgcggcctgttcctaactcggatcagttaggttttgtcggagaagtcgcgagggttgatccgagcgtgttgcgtcccttagtagaatccggttacattccggtgattgcctctgtggctgcggatgaagctggtcaggcttataacatcaatgcggatacggtggcgggggagctcgcggcggcgcttggagctgagaagctgattctgttgactgatgtggcggggatcttggaggatagagaggatgtggggagcttggtgaaggagattgatataaagggagtgaagaggatgattgatgatgggaaagttggtggtgggatgattcctaaggtgaagtgctgtataaggtcacttgctcagggagtgaagacggcgagtattatcgatgggaggaggcagcattctttgcttcatgagatcatgtctgatgaaggagctggaactatgattactggatgaaatgtgatgttataggtgatccatggttttgtatttgagaatgccaatgcctgtgtgtaggcaagatacattcatgatcgctgcttatgagtcttagaaagacaatttttttggcagctcttgtggtttgcatttgcaacttcgttgtttctgatttctaatgattatcattggtcttgaaaagttataaatttttgaagacaataagctgttctaaggaaaaaataaaaaaaaaaaaaaa

SEQ ID NO: 68426 - protein, 341 aa, Brassica napus
MATVTSKTPPKSFSFSISNPLKPLTPKSPSLRFPPRNNHHHHRLSVNAAVSPPPSDTPSPDYRFEILSESLPFIQKFRGKTIVVKYGGAAMTSPELKASVVTDLVLLACVGLRPILVHGGGPDINRYLKQLNIPAEFRDGLRVTDATTMEIVSMVLVGKVNKNLVSLINAAGATAVGLSGHDGRLITARPVPNSDQLGFVGEVARVDPSVLRPLVESGYIPVIASVAADEAGQAYNINADTVAGELAAALGAEKLILLTDVAGILEDREDVGSLVKEIDIKGVKRMIDDGKVGGGMIPKVKCCIRSLAQGVKTASIIDGRRQHSLLHEIMSDEGAGTMITG

SEQ ID NO: 68427 - DNA, 2096 bp, Triticum aestivum
  CDS (110)..(1852)
gaattcccgggtcgacttcgctgtcgacgatttcgtgagcgcggactgtttccctccccacttccccagtcacgaggcctagggttcgtaggtgggtccacttgcttacatggcctctatggttgccgccgcgcgcctcgccggcggggtctcgcggctgtcggctcagggttctactgcccggggccttccgcccggcagccttcgacttcccccgccgcgccggcgtctgcgcagcagcgtccggtgctgcgtggttcgccatcccggcggcggcggcggcgtggacgcgggggaggagttcgtcgggttcttccgggaggcgtggccgtacatacggggccatcgtgggagcaccttcgtggtcgttatatccagcgaggttgtgtcggggccacacttggaccgcattttgcaggatatttcactacttcatggtcttggcattaactttgttcttgttccgggaacacatgtccagattgataaactattgtcagaaagaggaaggaaggctaagtatgttggtcagtaccgagttaccgattctgattcactagaagctgcgatggaggcagctggcagaataaggttaacaatagaagcaaagctctctcctggccctccaatgttaaacctccgtagacatggtgttattggtcattggcatggtcttgtggataatgttgcaagtggcaatttccttggtgctaagagaagaggggtagttcatggtgttgattacggatttactggtgaagttaagaaaatagatgttgcacggataaaagaaaggcttgatagtgatagcattgttgttgtgagcaatatgggatactcgagctcaggagaagttctaaattgcaacacttacgaagtagccaccgcatgtgccttagccatagaggcggataaacttatctgcgttgtggacggtcagatatttgatgagaatggacgagtcattcatttcatgtctctggaggaagctgatatgttgatcagaaagcgtgctaagcaaagtgatattgctgcaaattatgtcaaggttgttgatgaggaggaccatgaaccatctttgaacggaaaggggcatcttaatgggtacgctgcttcttttcaaaacggtttgggttttaacaatggaaatggtatttgttctggtgagcaagggtttgctattggtggtgaagagcgattaagcaggtcaaatggctatctttctgagttggctgcagctgcttatgtatgccatgctggtgttcaaagagtgcatatcatagatggtacagttgatggatcactgctattagagttgtttacaagagatggtgctgggacaatgattgcgagggatgtttatgaaggaacaagaatggcgacggaggaagatcttcctggcataagaaaacttatctacccactagaggaatctggtgttttagtgcgaagaacagataaagagcttcttgaagcgttgtattcattctatgttgttgaaagagatggttcagtaattgcatgtgctgctctctttccatttcccgaggacaaatctggtgaagttgctgcaattgctgtatctgaagaatgccgaggaagaggtatgggggataagttgcttgattacattgagaaggaggcattatcccttggtcttggcaaattgttcttgcttactacacggacagccgattggtttgtgcgacgtggcttctcagagtgttcgattgaatctattcctgagcagagaagaaaacgcatcaatctgtcacgtggatcaaaatattatataaagcagctccagccaaagcatgctggtgtccctgtcaacaattttgctggcagatgatagggcttccaagaatttttgtgagagtgagacgagatatctgcactggttacatcaaggcttttatatatgttattagttgtaatttcagatagaaatataactgcagcctgtgatagcggcttaaattttttctcttttacttatggatgtaaaaaaggcactttgtgacacaacagaaaacaaatatcagaggaatttctatacagaaaccatctgcaagcagtataaaaaaaaaaaaaaa

SEQ ID NO: 68428 - protein, 580 aa, Triticum aestivum
MASMVAAARLAGGVSRLSAQGSTARGLPPGSLRLPPPRRRLRSSVRCCVVRHPGGGGGVDAGEEFVGFFREAWPYIRGHRGSTFVVVISSEVVSGPHLDRILQDISLLHGLGINFVLVPGTHVQIDKLLSERGRKAKYVGQYRVTDSDSLEAAMEAAGRIRLTIEAKLSPGPPMLNLRRHGVIGHWHGLVDNVASGNFLGAKRRGVVHGVDYGFTGEVKKIDVARIKERLDSDSIVVVSNMGYSSSGEVLNCNTYEVATACALAIEADKLICVVDGQIFDENGRVIHFMSLEEADMLIRKRAKQSDIAANYVKVVDEEDHEPSLNGKGHLNGYAASFQNGLGFNNGNGICSGEQGFAIGGEERLSRSNGYLSELAAAAYVCHAGVQRVHIIDGTVDGSLLLELFTRDGAGTMIARDVYEGTRMATEEDLPGIRKLIYPLEESGVLVRRTDKELLEALYSFYVVERDGSVIACAALFPFPEDKSGEVAAIAVSEECRGRGMGDKLLDYIEKEALSLGLGKLFLLTTRTADWFVRRGFSECSIESIPEQRRKRINLSRGSKYYIKQLQPKHAGVPVNNFAGR

SEQ ID NO: 68429 - DNA, 1647 bp, Glycine max
  CDS (139)..(1467)
gaattcccgggtcgacttcgctgtcgacgatttcgtgcttccgtggcagtggtagttgccaaactagtagcaagaagtaagtcacgtttttctccgttttcattcatcacaatattaaagcttttagtttccttcagtatgggggacacttacgttttggccacaccgaagcgcaaccgttccgatgacgtggacggcggcgaggcgaagaagctgctgttgcagcagggcgaggcggacccggcggcggcgctggcgagcgcgcggcacgagttcggggagcacggcggggtgaacatgtcgatcgaggcgtcggcgacgttcacggtgatggagccggagacgatgcggcgcatgttcgccggagaactcggccccgaccgcgacttcttcatctacagccgccacttcaacccgacggtgctgagcctcagtcgcctcatggccgccctcgaaggcaccgaggccgcctactgcaccgccagcggcatgtccgccatctccgccgtcctcctccagctctgcagccacggcgaacacgtggtcgcctccagaactctctacggtgggacccacgcgctcctctcacactttctcccgcgcacgtgcggaatatccactagcttcgtggaggtgacggatcttgacatggttgatgctgccatagtagaagggaaaacaaaagtgctttacttcgaatctgtttccaaccccacccttacggttgcgaacatacctgaactgtgccacatggcacaccggaagggagtgacggtggtggtggacaacacgttcgcgcccatggtgctttcgccagcgcgtcttggtgctgatgttgtcgttcacagtatctccaagttcatcagcggtggggccgatatcattgcaggagcggtgtgcggacccgcaagactggtgaacgcaatgatggatctgcaacaagggtcactaatgctgctgggtccaacaatgaatgcgaaagtggcattcgaactctcggagagaataccgcacctagggctaagaatgaaggagcatagcaaccgcgcactagagttcgcaacgaggctcaaaaggctaggaatgagggtaatatacccgggcctggaggagcacccacagcaccagcttctgaaatcaatgcacaacaaggactatggctacggcgggctcatgtgcgtggacatggaaacggaggagagggccaaccgcttcatgagccacttgcagaactacggccagttcggcttcatggctgtgagcttgggctactacgagaccctcatgtcctgctccggcagcagcaccagcagtgaactcagcactgaggagaaggagctcgccggaatctcgccggggctcgtgaggatgtcgattgggtacattggaaccttggagcagaagtggagccagctccaaaaggcgctcactagactaaacgactctggatacaacaagatcgcttgaattgcttttctcatcatgcacatgcacatgcaccctcgtcttcttcctgctcccttaatgttatgttatctataataataatttatgctcatctttatgtcttgtcttgctactcgatcgtgtctcctgtatcatggatatgaatatgaattgcctgtttcttttcaaaaaaaaaaaaaa

SEQ ID NO: 68430 - protein, 442 aa, Glycine max
MGDTYVLATPKRNRSDDVDGGEAKKLLLQQGEADPAAALASARHEFGEHGGVNMSIEASATFTVMEPETMRRMFAGELGPDRDFFIYSRHFNPTVLSLSRLMAALEGTEAAYCTASGMSAISAVLLQLCSHGEHVVASRTLYGGTHALLSHFLPRTCGISTSFVEVTDLDMVDAAIVEGKTKVLYFESVSNPTLTVANIPELCHMAHRKGVTVVVDNTFAPMVLSPARLGADVVVHSISKFISGGADIIAGAVCGPARLVNAMMDLQQGSLMLLGPTMNAKVAFELSERIPHLGLRMKEHSNRALEFATRLKRLGMRVIYPGLEEHPQHQLLKSMHNKDYGYGGLMCVDMETEERANRFMSHLQNYGQFGFMAVSLGYYETLMSCSGSSTSSELSTEEKELAGISPGLVRMSIGYIGTLEQKWSQLQKALTRLNDSGYNKIA

SEQ ID NO: 68431 - DNA, 1635 bp, Zea mays
  CDS (34)..(1434)
cggaggggtgccggtgtccggactccggagagaatggcggccactcttctcccgaccttatcgccgcccgtttcgcgcgccgccgccgctttcctcctccgacgagccccactgaagccctcccattatgtgcacccaccttctactctccgccgcttactcatctcctcctatccagcaatccctgccatgtgccccctctccaccatgtcgtccaccactgccgctcgcgccgtcccggtccgccgtgacctcctcatgctcggcatcgagaccagctgcgacgacactgcggctgctgtggtgagaggtgatggcgagatccttagtcaagtagtatcttcccaagcggatttgctcgcgaggtatggtggtgttgcccctaagatggccgaggaagcacacgcccttgtgattgaccaggttgttcaaaaggctcttgacgatgcaaaattgtcagaaagtgatctttctgcagtcgctgtgaccattggaccaggacttagtctatgccttagagttggtgttcataaagctagacaggtagcaaaagcatttggcttgcctattgttggagttcatcatatggaagcacacgcattagtttccaggctagcgaataaggaccttgatttcccatttctggctcttctaatttccggaggacacaaccttcttgttctcgctcatggtcttgggcattacattcaactggggactactatagatgatgcgattggtgaggcatatgacaaatcagcaagatggttgggccttgatatgcggaaaggtggtggtcctgctcttgaagagcttgctctagaaggtgatccaaatgctgttaagttcagagttccaatgcgacagcataaagattgcaatttttcttatgctggactgaagactcaagttcgattggcaattgaatctaagaacttatgtacagaggatattcccgtttcggctgcatcggaggaggacagacaatcaagggcgaacattgctgcctcttttcagcgagttgctgtgttacatttggaagaaaggtgtgagcgagcagttgaatgggcattgaatatggaaccttccatcaaatactttgttgtttcaggaggtgtcgcatcaaacaagtatgttacgactcgcttgaatcatgttgctgggaataatggcctacaacttgtatctcctcctccaagcctttgtactgacaatggtgtcatgattgcttggactgggattgagcattttgttgccgggaggtttgaggacccacctgctgctgatgagtctgatgatatgcagtatgagctgcggccaagatggcctcttggtgaggaatattcaaaaggaagaagtgttgcacgatcattgaagactgctcgagtccatccatcactaacgtccatgatacagggctcccttcaaaagtagttgagttggaagttggaaactaattattggtctcagctgctttatgcagttgagtttcccgtcttctagttttgggttcacaaatcagctgatttatctgtattcgctgaattgaagtaacaaacctgcaaaagggccgaactagtttaatagtagatgaggctatatacaaattcagttcataccaaaaaaaaaaaaaaa

SEQ ID NO: 68432 - protein, 466 aa, Zea mays
MAATLLPTLSPPVSRAAAAFLLRRAPLKPSHYVHPPSTLRRLLISSYPAIPAMCPLSTMSSTTAARAVPVRRDLLMLGIETSCDDTAAAVVRGDGEILSQVVSSQADLLARYGGVAPKMAEEAHALVIDQVVQKALDDAKLSESDLSAVAVTIGPGLSLCLRVGVHKARQVAKAFGLPIVGVHHMEAHALVSRLANKDLDFPFLALLISGGHNLLVLAHGLGHYIQLGTTIDDAIGEAYDKSARWLGLDMRKGGGPALEELALEGDPNAVKFRVPMRQHKDCNFSYAGLKTQVRLAIESKNLCTEDIPVSAASEEDRQSRANIAASFQRVAVLHLEERCERAVEWALNMEPSIKYFVVSGGVASNKYVTTRLNHVAGNNGLQLVSPPPSLCTDNGVMIAWTGIEHFVAGRFEDPPAADESDDMQYELRPRWPLGEEYSKGRSVARSLKTARVHPSLTSMIQGSLQK

SEQ ID NO: 68433 - DNA, 1389 bp, Linum usitatissimum
  CDS (57)..(1097)
atctttcatgccctgcacaattttccggcgaataaagaaccctaagaatcaatcaaatgaagaaactaatcgctctaggattcgaaggctcggcgaacaagatcggagtcggcgtcgtcgctttagacggaacaatcctctcaaacccacgacacacctacatcactccgccaggccacggcttcctccctcgagaaaccgcccatcaccacctccgccacgtcctacccttagtccgaaccgcgctcgacgccgccggactgactcccgacgatgtcgattgcatctgctacaccaagggccccggaatgggagcgccgctgcaagtctccgccattgtcgtccgtgtcctgtccctgctctggaagaagccgattgtcgccgttaaccactgcgtcgcccatattgagatgggccgggtcgtcactggggcgcatgatccggttgtgctctacgttagcggcgggaacactcaggtgattgcttatagtgaaggaaagtataggattttcggggagactattgatatcgctgtggggaattgtttggatcggtttgctagggtcttgcagctgtccaatgatcctgcccctggctacaacattgagcagcttgccaagaaaggagagaaatttgtggaccttccttacgcagtcaaaggaatggatgtttctttcagtgggatattaagctacattgagactactgctgaggagaagctgaaaagcaatgagtgcactccagcagatttgtgctactctttgcaagagacggtgtttgcgatgcttgtggagatcacggaacgggcgatggctcactgcgacaagaaggatgttcttattgttggcggtgtgggctgtaacgagcggttgcaggagatgatgaggacgatgtgctccgaacggggagggacgctctatgctacggatgatcggtattgcatcgacaatggagcgatgattgcttataccggtctgctcgcgtttgctcatggggcgacgactccgttggaggattcgacgtttacacagaggttccgaactgatgaagtcgatgcaatttggagagagaaggagaaagagaaggattctgtctaatgaaacccaatattgagcatcatccaagattgaggaggctcgaattgcagaaactctgaagcgttgccagagtgactagaaaatcaaggattgcgagccgaaattagagatccagaatcgatatgtattgtatggtatttgaagaacatgtggtttagcctactggtagttcttgttgattagaagattaaatttagcctaagaattgaactttgtatatggtgtcagataatggtactcagctgtgatatagtaatcaaaaactcgatcgcagtccaaaaaaaaaaaaaaa

SEQ ID NO: 68434 - protein, 346 aa, Linum usitatissimum
MKKLIALGFEGSANKIGVGVVALDGTILSNPRHTYITPPGHGFLPRETAHHHLRHVLPLVRTALDAAGLTPDDVDCICYTKGPGMGAPLQVSAIVVRVLSLLWKKPIVAVNHCVAHIEMGRVVTGAHDPVVLYVSGGNTQVIAYSEGKYRIFGETIDIAVGNCLDRFARVLQLSNDPAPGYNIEQLAKKGEKFVDLPYAVKGMDVSFSGILSYIETTAEEKLKSNECTPADLCYSLQETVFAMLVEITERAMAHCDKKDVLIVGGVGCNERLQEMMRTMCSERGGTLYATDDRYCIDNGAMIAYTGLLAFAHGATTPLEDSTFTQRFRTDEVDAIWREKEKEKDSV

SEQ ID NO: 68435 - DNA, 1708 bp, Glycine max
  CDS (20)..(1453)
tgtgctgtgctgtgtaacaatggctcaattgaaagcttctcctttgtgttcaacccctgccactgctccttcccttcatacaacagggcaccttctgtaccatcagttctggaaggcaaagccttcgtcattcaaagagttggggctaagaacaagcattggtgccactaaacttaaagttattaaagcagctgcacgcagtgatacagaggtagtttctgaatccacaaaaggtggtggcctacgtggaaaattgaataaggtggtgttggcttacagtggtggcttagacacatcagtcattgttccatggctcagagaaaattatggttgtgaagttgtttgcttcactgctgatgttgaccaaagtataaaggaattggaaggtttagaacagaaagccaaagccagtggggcctgtcaattagtggtaaaagatttgaaggaggaatttgttaaagattatatatttccttgcctgcgtgctggtgcaatttatgagaggaagtatttgcttgggacctcaatggcccgccctgtaattgcgaaggccatggttgatgttgccaaagaagttggagctgatgctgtttcccatgggtgtacagggaaaggaaatgatcaggttcgatttgagctcactttctttgctctaaaccccaagctcaatgttgtggctccatggagggagtgggatattacagggagagaagatgctattgagtatgctaaaaagcataatatacctgttcctgtgacaaagaaatccatatatagcagggataggaatctttggcaccttagccatgagggagatattttagaagaccctgctaatgaacctaaaaaggacatgtacatgatgtctgtagacccagaggatgctcctgatcaagcagaatatgtggaaattggattagagtcggggcttcctgtttcagtcaatgggaagaggctttcaccagcatctttacttgctgagctcaatgagattggtggaaagcatggaattggcaggattgacatggttgagaatcggcttgtaggtatgaagagccgaggagtgtacgaaactcctggtggaaccatactgtttgctgcagcacgagagttggagtctttgacacttgatcgtgaaacaatacaagtcaaagattcattagcccttaaatatgcagagttagtgtatgctggcagatggtttgatcctcttcgggagtccatggattcctttatgcagaagatcacagagaccacaacaggttctgtgactttgaaattgtacaaaggttctgttattgtaactagtcgaatgagtccctttagcctgtatagggaagacatttcatcatttgagagtgggcagatatatgatcaagctgatgctgctgggttcattcggctttatggtcttccaatgaaggttcgagcaatgcttgagcagggcatctaagatttcatttctcaacatgtacttgatataattgtccatagaaaatgtggattgacacagttcgttgtttgtcgtgactactattgtcattattggtgttactgagttaacttggataggataatgcaaataagtggtaaatgtaacgaaattacatgatccttgcagtgaaggttccaaattatgtacacttttcttacagaaaagaaaataaaaaaaaggaggtagcatcatggtagcaaaaaaaaaaaaaaa

SEQ ID NO: 68436 - protein, 477 aa, Glycine max
MAQLKASPLCSTPATAPSLHTTGHLLYHQFWKAKPSSFKELGLRTSIGATKLKVIKAAARSDTEVVSESTKGGGLRGKLNKVVLAYSGGLDTSVIVPWLRENYGCEVVCFTADVDQSIKELEGLEQKAKASGACQLVVKDLKEEFVKDYIFPCLRAGAIYERKYLLGTSMARPVIAKAMVDVAKEVGADAVSHGCTGKGNDQVRFELTFFALNPKLNVVAPWREWDITGREDAIEYAKKHNIPVPVTKKSIYSRDRNLWHLSHEGDILEDPANEPKKDMYMMSVDPEDAPDQAEYVEIGLESGLPVSVNGKRLSPASLLAELNEIGGKHGIGRIDMVENRLVGMKSRGVYETPGGTILFAAARELESLTLDRETIQVKDSLALKYAELVYAGRWFDPLRESMDSFMQKITETTTGSVTLKLYKGSVIVTSRMSPFSLYREDISSFESGQIYDQADAAGFIRLYGLPMKVRAMLEQGI

SEQ ID NO: 68437 - DNA, 854 bp, Brassica napus
  CDS (43)..(657)
cccgccgtcgcttatcaccggtcaactctgaacaacaaaaccatggccactcaagctgctgctgcctctttcaatggcaaccttaagaaagctgtggcaggtatcaaacgtatcaatctcgacggtcttcgttggcgtgtttttgatgccaaaggccaggttctcggtagacttgcttctcagatatctaccgtccttcaagccaaagataagcctacttattgtcctaaccgcgatgatggcgatatttgcattgttctcaatgctaaggatatcggcatcaccggcagaaagctcactgacaagttctaccgctggcatactgggtacgttggacacctgaaagaacggagtctgaaagatcagatggccaaagaccccaccgaggtcatccgcaaggctgtctggcgcatgcttccaactaacaatttgcgtgatgacagagatcggaagctgaggatatttgaaggcaatgagcatccttttggggacaagccacttgagccattcgtgatgcctcctcgtacagtgagagagatgcgaccgcgcgcaagacgtgcaatgatccgtgcccagaagaaggcagagctggcagaaaatggtggaacagaggtaaagaaaggcaagaagaggactccctctcaagtaactgcgtagaagaaaagccttcagagagaaacttagtaatgtgattcgtcttatataataagcaacgatcataatgcaggcgtggataagcttgtaaggttttcttgtttctggatgtctgacaatataccggacctgaagccaaacccaccccttctttttataaacaaaatatactctcgtttctggccaaaaaaaaaaaaaaa

SEQ ID NO: 68438 - protein, 204 aa, Brassica napus
MATQAAAASFNGNLKKAVAGIKRINLDGLRWRVFDAKGQVLGRLASQISTVLQAKDKPTYCPNRDDGDICIVLNAKDIGITGRKLTDKFYRWHTGYVGHLKERSLKDQMAKDPTEVIRKAVWRMLPTNNLRDDRDRKLRIFEGNEHPFGDKPLEPFVMPPRTVREMRPRARRAMIRAQKKAELAENGGTEVKKGKKRTPSQVTA

SEQ ID NO: 68439 - DNA, 827 bp, Brassica napus
  CDS (60)..(662)
cgccgccgtcgcttccggatcgtagttctgaagaaacttattcctgctgcagaataacgatggccactcaagctgcctcattcagtggcaacctaaagaaagctgtggcgggtataaagcgtatcaatctcgacggtcttcgttggcgagtttttgatgccaaaggccaggttctgggtagactagcatctcagatatcaactgtgcttcaagccaaagataagcctacttattgtcccaaccgtgatgatggggatatttgcattgttctcaatgctaaggatatcggcatcactggaagaaagctcactgacaagttctaccgctggcatactgggtacgttggacacctgaaagaacgcagtctgaaagatcagatggccaaagaccccaccgaggtcatccgcaaggctgtctggcgcatgcttccaactaacaatttgcgtgatgacagagatcggaagctgaggatatttgaaggcagtgagcatccttttggggacaagccactcgagccattcgtgatgcctcctcgtacagtgagagagatgcgaccgcgcgcaaggcgagcaatgatccgtgcccagaagaaggcagagcaggcagaaaatggtggagcagaggtaaagaaaggcaagaagagggctccttctcaagtgtaactgcctagaagaaaagcttcacacatgtgattcagtcttttatttaagcaacgatcataatgcaggcgtggtggataacgttttttctgtttgttgagtgccagacaatagacacggtcctaccatgaagcaaaacccgttcttccttataaaaaaaaaaaaaaa

SEQ ID NO: 68440 - protein, 200 aa, Brassica napus
MATQAASFSGNLKKAVAGIKRINLDGLRWRVFDAKGQVLGRLASQISTVLQAKDKPTYCPNRDDGDICIVLNAKDIGITGRKLTDKFYRWHTGYVGHLKERSLKDQMAKDPTEVIRKAVWRMLPTNNLRDDRDRKLRIFEGSEHPFGDKPLEPFVMPPRTVREMRPRARRAMIRAQKKAEQAENGGAEVKKGKKRAPSQV

SEQ ID NO: 68441 - DNA, 1154 bp, Glycine max
  CDS (225)..(827)
agcactctaagaagaacggcgcagcaactcgatcatcgatcttccccggtgatcttcaacgatccggcgaaaacacgattctcaccactcgcaaactcggacagggcacagaagatcgtgaaatcgtacgatcttacgagtcagatcgcggttttgagtaccatgaggtgaaagctttgttttttgaattgtgaggaagattgaccaaataaacagaggcaaaaatgaagatggtaactgctttcaacggcaacatgaagaaagctgctgctggacttagacgcattaatcttgatggtcttcgatggagggtttttgacgcaaagggccaggttcttgggaggttagcatctcaaatagctactgtagttcaaggaaaggataaaccaacttacacacctaatcgtgatgatggggatatgtgcattgttcttaatgcaaaagatatttgtgtgactgggagaaaacttacagacaaggtctactactggcatacagggtatattggccacctcaagcaaaggactctaaaggatcaaatggccaaagaccctactgaagtcattcgcaaagctgttctgcgtatgctgcctagaaacaaactacgtgatgacagggatcgaaaattaaggatctttcctggcagtgagcacccttttgttgatcgcccacttgaaccgtatgtgatgcctcctagaagcgtacgggaaatgaggccgcgagcaaggcgtgccatgattcgagcacagaagaaggcagagcagcaacaacagaaggctgatggaatgaagggcaaaaatggtgaagcacaggaagaaagtgcatgaagacgcaattttgctcaaaagatggcactgatcattggttatcattgaaatggaaagccatctgtctctgttagcaatcctacaatgccctattgaattgtgtttgaattttctttttttataagtcttttagtaagagcataattgattcacattataggcatttcttgcatccttttcagtgataattctgttaagttcatgcttagaagtttagactaactagcattttggtcctcagctacttccttcactgtcaaacagtgccacagtgcattcaagtattcaaaattgctttttgtgttttctcgcaaaaaaaaaaaaaaa

SEQ ID NO: 68442 - protein, 200 aa, Glycine max
MKMVTAFNGNMKKAAAGLRRINLDGLRWRVFDAKGQVLGRLASQIATVVQGKDKPTYTPNRDDGDMCIVLNAKDICVTGRKLTDKVYYWHTGYIGHLKQRTLKDQMAKDPTEVIRKAVLRMLPRNKLRDDRDRKLRIFPGSEHPFVDRPLEPYVMPPRSVREMRPRARRAMIRAQKKAEQQQQKADGMKGKNGEAQEESA

SEQ ID NO: 68443 - DNA, 998 bp, Linum usitatissimum
  CDS (118)..(732)
cgctcgatcggtgtttgattcgttctctacttcttttacattctaggtttgctggtacgtgtaggtgaatgctttgtgcgtgagaacgagtaacattattagatacctgcgtcggaaatggcgacccaagcagctactgctttcaatggcaacctaaagaaagcacttgctggaattaaacgtatcaagcttgatggtctgcggtggagagtctttgatgctaaaggccaggtactcggccgattagcatctcagctatcaattgttcttcaaggcaaggacaagccaacatatgcacctaatcgtgacgatggagatatgtgcattgtcgttaatgcaaaggatattgcagttacaggacggaaaatgaccgataaggtttatcactggcatacaggctatatagggcatctgaaggaaaggaccttaaaagaccagatggccaaggacccaacagaagtcattcgcaaagctgtgatgcgaatgctcccgagaaataaattgcgtgatgacagggatctaaagctgaggattttcgcagacggtgagcaccccttccatgaccggccagttgaaccatatgtgatgcctcccaggacagttagagagatgcgaccacgtgccagacgagccatggttcgagctgagaaaaaggctgagctacaagctcagggcggcagcaataccaggaaacataggaagaagggagttgaggagcaggaaaccgcctgagacggcaccattagcaaaccatcctagctgttcgaggaaaacctcgtagcccctactcgcatgctggtggattcccctccaactccacttccagcttgtgagaattcttagtgggtgtatgttgagttggataggtttcgaattattcaatcttcagtttttattttagtatatttactttttgattctgctgcatattatcgacttccatggcgaagtcataatgaaggctcatggtttggtttgtgaacaaaaaaaaaaaaaaa

SEQ ID NO: 68444 - protein, 204 aa, Linum usitatissimum
MATQAATAFNGNLKKALAGIKRIKLDGLRWRVFDAKGQVLGRLASQLSIVLQGKDKPTYAPNRDDGDMCIVVNAKDIAVTGRKMTDKVYHWHTGYIGHLKERTLKDQMAKDPTEVIRKAVMRMLPRNKLRDDRDLKLRIFADGEHPFHDRPVEPYVMPPRTVREMRPRARRAMVRAEKKAELQAQGGSNTRKHRKKGVEEQETA

SEQ ID NO: 68445 - DNA, 874 bp, Zea mays
  CDS (128)..(727)
gggggcggaggagcacgtacgcagtgcatcgcccaccgccctttgcctcgcctcgcctcgcctgcatatctagcagccggagccggagccggcgccggcgccggcgccgacaatcgttccaactgatatggctacgacgccaccaggattcacgggcaacctgaagaaagcacttgcaggtctgagaagaatcagtttagatgggttgcgatggcgcgtatttgatgctaagggtcaggtgctcgggcgattggcttcccaaatagctgttgtgcttcaaggcaaggataaaccgacctatgcaccacatgtagaaaatggagacatgtgcattgtacttaatgcaaaggatatcagtgttacaggaaggaaaatgacagataagatttactattggcatacagggtatgttggccatttgaaggaaaggaggctcaaggaccagatggagaaagacccaactgaagtgattcgcaaagctgtgttgcgcatgcttccccgcaacagactgcgtgatgatagggatcgcaagctgaggatattttctggaaacgaacatccattccatgaccgccctctggaaccttttgtgatgccgccacggcaagtacgcgagatgcgcccccgtgcaaggcgtgcaatgataagggctcagaaaaaacagcaggcaaacagagccaaagaggaggaagatgctaagaatgtcgcagctgaggtcactgcataggctcctgatgtggatttgcatgctgccaatttttttgcttggtagcatttcaagtggaataggcactaaaagctgggaatgtgccaacttcgttctgaatttattttgtattctattacaatttgtaactggaaaaaaaaaaaaaaa

SEQ ID NO: 68446 - protein, 199 aa, Zea mays
MATTPPGFTGNLKKALAGLRRISLDGLRWRVFDAKGQVLGRLASQIAVVLQGKDKPTYAPHVENGDMCIVLNAKDISVTGRKMTDKIYYWHTGYVGHLKERRLKDQMEKDPTEVIRKAVLRMLPRNRLRDDRDRKLRIFSGNEHPFHDRPLEPFVMPPRQVREMRPRARRAMIRAQKKQQANRAKEEEDAKNVAAEVTA

SEQ ID NO: 68447 - DNA, 908 bp, Hordeum vulgare
  CDS (7)..(696)
gctacaatggctacggccatctccgcctccgcgctcctctcctctgccttcgctggcgataggcgccatcgccgcgcggcgaggcccgcgccccgccgcgccgtcccggctggcctcacggtgcggtgcgagcagagcgacaagcagaagcggcagcctctttccgcactcgttccccgcgagcagcgcttcatgttcgagggcgacgagctctgcggccccgacatatggaacacaacatggtaccctaaagccgcagatcacgtaactaccgagaagacgtggtatgttgttgatgcagaggacaagattcttggcaggctagcatctgccattgcagtgcatatgagagggaaaaatgagcccacatacactccaagtgtggacatgggggcttttgttattgtggttaatgcagagaaggttgctgtttctggtaaaaagcggtcacaaaagctctataaaaggcactctggacgtcctggtggaatgaaagaggaaacttttgatcaacttcagaaaaggattccggagagaattatcgaacatgcagtgcgtggcatgcttcctaagggcaggctggggagaagactatttacccacctcaaggtgtacaaaggatcagaacacccacatgttgctcaaaaacctgttccactgcctatcagagacaaaagaataacaaagtctggctagagaatccccgggtattgaaaaagatacagcaactcggcccaagtgttaggaatgtgaccggaacattcatgtcatctgtccaaatggtgtatgattttttttgtaatttaatcatgtttgtgcaaaagcttacattcctttcggtcattattatgccgtatggtacgatttgatgcaatccaacatctcagctttccaaaaaaaaaaaaaaa

SEQ ID NO: 68448 - protein, 229 aa, Hordeum vulgare
MATAISASALLSSAFAGDRRHRRAARPAPRRAVPAGLTVRCEQSDKQKRQPLSALVPREQRFMFEGDELCGPDIWNTTWYPKAADHVTTEKTWYVVDAEDKILGRLASAIAVHMRGKNEPTYTPSVDMGAFVIVVNAEKVAVSGKKRSQKLYKRHSGRPGGMKEETFDQLQKRIPERIIEHAVRGMLPKGRLGRRLFTHLKVYKGSEHPHVAQKPVPLPIRDKRITKSG

SEQ ID NO: 68449 - DNA, 848 bp, Helianthus annuus
  CDS (21)..(629)
cggagatctactgccggaaaatgtcaggagcagctcaggccttcagcggcaatcttaagaaagcagtagctggtataagacgtatcaatttggaaggactgagatggagagtttttgatgccaagggccaggtcctagggagattagcatcacaaatatctacagtggttcaaggaaaagataagcctacatatgcacctaatcgtgatgatggtgatatgtgcattgtgcttaatgctaaagatatatgtgtcactggtagaaagctcactaataagttttaccgatggcacacggggtatattggacatctaaaggaaaggagcttgaaggaccagatggctaaggatccgacagaagtcatcaggaaagctgttctacgtatgctcccaagaaataaactgcgtgacgacagagatcgaaaactgagaatatttccaggcggtgagcacccattcggtgataagctgcttgagccatatgtgatgccacctagacaagttcgtgaaatgcgtccacgtgcaaaacgggccatgattcgggcccaaaagaaagctgagcaacaagaaggtggtaaaatttcaagcaaaggcaagaaaagagatgaacaaacagtgttgacatcctgaatttcttgaccagtcaatggttgctatggaagtcaaacttaaaaatgtgaaccctagtctgatcttggttatattgtagacatcacaatttgaaattcgcaggccttttctttttgttaagatgcggttaattcaaacagtcccgtcatcgttttcatgctgtgttaccagtttctcaataaaccttttcctgagttttcttcgaaaaaaaaaaaaaaa

SEQ ID NO: 68450 - protein, 202 aa, Helianthus annuus
MSGAAQAFSGNLKKAVAGIRRINLEGLRWRVFDAKGQVLGRLASQISTVVQGKDKPTYAPNRDDGDMCIVLNAKDICVTGRKLTNKFYRWHTGYIGHLKERSLKDQMAKDPTEVIRKAVLRMLPRNKLRDDRDRKLRIFPGGEHPFGDKLLEPYVMPPRQVREMRPRAKRAMIRAQKKAEQQEGGKISSKGKKRDEQTVLTS

SEQ ID NO: 68451 - DNA, 1032 bp, Zea mays
  CDS (91)..(789)
cgctccccactgcgcctaaaaatggccgcgtcccactgaaccaatcgtctgcacatcctcttgctgttgccgctcgctcgccgtgccgcaatggctacggccgtcgcctcccatacgttgctctcctccgccttcgctccgcgccactaccaccgccgcctgacccggaccgcgtccgtggggccgtgccgggccgccccggtgggactggccgtgcggtgcgagaagagcgacaagcagaagaggcagccgctcgccgcgctcgtgccccgcgagcagcgcttcatgttcgagggagacgagctctgcggccccgacatatggaatacaacctggtatcctaaggctgcagatcatgtaactaccgagaagacatggtatgttgttgatgcaacagacaagatcctaggcaggctagcatccaccattgcagtacatatcaggggaaagaatgaacccacttacactcccagtgtagacatgggagcttttgttattgtggtcaatgcagataaggttgctgtttctggtaaaaagcggtcacaaaagctttataggaggcactccggaaggcctggagggatgaaagaagaaacttttgaccaacttcagaaaagaattccagagagaatcattgaacatgcggttcgtggcatgctccccaagggaaggctgggaagaagattatttacccacctcaaggtatacaaagggacagaacatccgcacgaggctcaaaaacctgtcccactcccgatcagggataaaagaatacaaaaaacaggatagagaattcatcgactgaaaaggatgcagtggcgaattcctccccagaaggttttgccctttgtttggaatgctatcctcataaccatgcttctgatcgggggaggggggagtatcaatcctctttgtaattttgatgtttaccaatgcatgaaattcagtcaaatttctgtcaatgagtagtcatgtaatatggtacggtttaaatcaacctaaaatctttattttccgaaaaaaaaaaaaaaa

SEQ ID NO: 68452 - protein, 232 aa, Zea mays
MATAVASHTLLSSAFAPRHYHRRLTRTASVGPCRAAPVGLAVRCEKSDKQKRQPLAALVPREQRFMFEGDELCGPDIWNTTWYPKAADHVTTEKTWYVVDATDKILGRLASTIAVHIRGKNEPTYTPSVDMGAFVIVVNADKVAVSGKKRSQKLYRRHSGRPGGMKEETFDQLQKRIPERIIEHAVRGMLPKGRLGRRLFTHLKVYKGTEHPHEAQKPVPLPIRDKRIQKTG

SEQ ID NO: 68453 - DNA, 2071 bp, Glycine max
  CDS (130)..(1749)
ggatgaactagatttatatttaggcggagctttcaatttggcacctccctcgtttacatcgacacccgcatcaaaagtcactccattcccatcagaacacaaaacacagcatttcccttagcgtaggaaatggaagtcacactttcagcctgcaagtccgttagctcgccttctgttcccgtcgcaggtttgtttgcggggaatggaggaattaagagctcgcaatgcagtttcttagcgggagcgagcaaagtgaggtttcctaggcaagtaggtcaagttagccaccttcgcaaacagcgccaaacgcgtcactgcggtgctctccacgcgacttgcagcggtgacaagatcctgatcgcgaacagaggcgagattgccgtccgcgttattcgaaccgctcatgaattggggattccttgtgtggctgtgtactccaccatcgacaaggacgcgcttcatgtcaaattggctgatgaagccgtttgcatcggggaagcgccgagtagccagtcctacttgctgatcccgaatgttctgtcagctgctattagccgcagatgcaccatgttgcatcctggctatggttttcttgcggagaatgcagtgtttgttgaaatgtgcagagaacatggaatcaactttattgggcctaaccctgacagtattcgggttatgggtgacaaagcaactgccagagagacaatgaagaaagcaggtgttcccaccgttccgggaagtgatggccttttacagagcacagaagaagctatcagactggcaaatgagattggtttccctgtgatgatcaaggcaacagctggtggtggaggacgtggcatgcgtcttgctaaagaacctgctgagtttgtgaagtttttacagcaagctaagagtgaggcagctgctgcatttggcaatgatggggtttatttggagaagtacattcaaaacccaaggcacattgagttccaggttcttgcagataaatatggtaatgttgttcactttggagaacgtgattgcagcattcagaggcgcaaccagaaactgcttgaagaagcaccatctcctgccctgacccctgagttgcgaaaggcaatgggagatgcagcagttgcagctgctgcatctattggttacataggtgttggaacggttgagttccttttggatgaaagaggttccttttactttatggagatgaacactcgtatccaggttgagcatccggtgacagaaatgatttcctcaacggatttgatagaagagcaaattcgtgtagctatgggagaaaaacttcgatacaaacaggaggatattgtcctcagaggacattctattgaatgccgtatcaatgcagaagatgcttttaagggatttagaccagggccaggtagaattactgcatacttgccatccggaggtccatttgttagaatggatagccatgtttatcctgattatgtggttcctccaagctatgattcccttcttggaaagctgattgtatgggctccaactagagaaaaagcaattgaacgcatgaaaagggcacttgatgatactattatcacaggagttcctactacaattgattatcataaacttatccttgacatagaggatttcagaaatggcaaggttgatactgcttttattccaaaacacgaggaagagttggcaatgccaccgcagaagatggtactcgctaacagggtgaatgaactagctggttcaactgcctgatgaatatgattgtgtgatgccagaattgctttgttgtaatcaccgtgtcgttagtgccttgaagtcaatgttttattgaaattttgataattagtctcgtacattcctatttcttcacataattatattgtaatatcaattaatttcatcccaaatattagtgcaaggaataaggaataactccttgcatttttcttccaaagttagttgtctaaacggtttagaggatctttgtcccaaggcttgtttgtaattcttgtattaagagctcgttgctagatacactaataaaaacttaaccttatcataaaaaaaaaaaaaa

SEQ ID NO: 68454 - protein, 539 aa, Glycine max
MEVTLSACKSVSSPSVPVAGLFAGNGGIKSSQCSFLAGASKVRFPRQVGQVSHLRKQRQTRHCGALHATCSGDKILIANRGEIAVRVIRTAHELGIPCVAVYSTIDKDALHVKLADEAVCIGEAPSSQSYLLIPNVLSAAISRRCTMLHPGYGFLAENAVFVEMCREHGINFIGPNPDSIRVMGDKATARETMKKAGVPTVPGSDGLLQSTEEAIRLANEIGFPVMIKATAGGGGRGMRLAKEPAEFVKFLQQAKSEAAAAFGNDGVYLEKYIQNPRHIEFQVLADKYGNVVHFGERDCSIQRRNQKLLEEAPSPALTPELRKAMGDAAVAAAASIGYIGVGTVEFLLDERGSFYFMEMNTRIQVEHPVTEMISSTDLIEEQIRVAMGEKLRYKQEDIVLRGHSIECRINAEDAFKGFRPGPGRITAYLPSGGPFVRMDSHVYPDYVVPPSYDSLLGKLIVWAPTREKAIERMKRALDDTIITGVPTTIDYHKLILDIEDFRNGKVDTAFIPKHEEELAMPPQKMVLANRVNELAGSTA

SEQ ID NO: 68455 - DNA, 920 bp, Zea mays
  CDS (1)..(726)
atggctttggcgtctaaagcctcccctccgccatggaatgccaccgccgccgagcagccaattccaaagcgtgacaaagccgctgcaaatgattcaacatacctcaatcctcaagctcatgatagtgttcttggaatcattctgggaggtggtgctgggactagattgtaccccttgacaaagaagcgtgccaagcctgcagtgccattgggtgccaactatagactgattgatattcctgtcagcaattgtctcaacagcaacatatccaagatctatgtgctaacgcaatttaactctgcttccctcaaccgtcacctctcaagagcctacgggagcaacattggagggtacaagaatgaagggtttgttgaagtcttagctgcacagcagagcccagataatccaaactggtttcagggtactgcagatgctgtaaggcagtacttgtggttgtttgaggagcataatgtgatggaatttctaattcttgctggcgatcacctgtaccggatggactatgaaaagttcattcaggcacacagagaaacaaatgctgatattaccgttgctgccctaccgatggatgagaaacgtgcaactgcatttggcctcatgaaaattgatgaagaagggaggatcattgagtttgctgagaaaccgaaaggagagcagttgaaagcaatgatggtacacataatatgctttcctttcaagctaacttgatttacatttgtggacaatcattttgtaaacctacaatattccattttactcctttggattgtaggataagtaaaacatagggatagaaaaaatgtaggaatagagttgcatgacacttgcaattccataggaaaatttctaagaggttggacctcattttaaaaatcatccaaaatctcaaaaaaaaaaaaaaa

SEQ ID NO: 68456 - protein, 241 aa, Zea mays
MALASKASPPPWNATAAEQPIPKRDKAAANDSTYLNPQAHDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVHIICFPFKLT

SEQ ID NO: 68457 - DNA, 2252 bp, Brassica napus
  CDS (62)..(2167)
ccagatccaacctgcactacctccaactctcattctttctctctatcgttcgtctccttcaatggctgctgaagactccctctcctccaatcctctgttgcagaactttgagttccctccgttcgacgtcgtcgatgctcaccacgtcagacccgggatccgtgctctgttgcaccagctcgaagctgaattggagcagctagagaaaaccgtggagccttcatggccaaagctagtggagccgttggagaagatcattgatcgcttaaccgttgtttgggggatgatcaatcaccttaaggctgtcaaggacactcccgagcttcgtgctgccattgaagaagttcagccagagaaagtgaagttccagctcaggttgggacagagcaaacccatttacaatgcatttaagtctattcgagaatctccagactggaatacactgatcgaagctcgtcaacgattagtagaagcacaaataaaggaggcggttctcagtggtattgctcttgaagatgacaagagagaagagtttaacaaaattgaacaggaactcgagaaactttcccataagttttctgagaatgttttggacgctacaaagaagttcgaaaagttgataacggacaagaaagagatcgagggtttgccaccatctgcacttgggctatttgcgcaagcagctgtttccaagggccatgaaaatgcaactgctgacgctggaccatggcttattacactggatgctcctagttatctccccgtcatgcaacatgccacaaatcgtgctctgcgtgaggaggtttatcgtgcttacttatctcgtgcctcttcgggtgaattagataatacatcaattatcgaccaaatcttgaagctccggttggataaggctaagcttcttggctacaccaattacgctgaggtaagcatggccacgaaaatggctactgtagagacagcagatgagttattagaaaagcttcgcagtgcttcttgggctccggctgttcaagacatagaagaccttaagagttttgcaaaggaccaaggtgctatagaagctgacagtttgactcactgggacatcactttttggagtgagaggctccgtgaatcgaaatacgatattaatgaggaagaactgcgaccctacttctcactgccaaaggttatggctgggcttttcggtctagctaagaccctttttggaattgatgtagcaccggcggatggtgttgctccggtctggaacagcgacgttaggttctactgcatcaaagattcttctggaaatccaactgcttatttctactttgatccatactctcgtccttcagaaaagagagacggtgcttggatggatgaagttttttcccgtagccgagtcatggctcagaagggttcctccgtacggctacctgttgcgcagatggtctgcaaccaaactccaccggttggtgacaagccaagccttatgacattccgtgaggtagagactgtattccatgaatttggtcatgctctccagcatatgctgacgaaagaggatgagggactagttgctggtatcagaaatatcgagtgggatgcagttgaattaccttcacagtttatggagaactggtgctaccacagggatactttaatgagcattgctaagcattatcaaacaggggaaactcttcctgagaatgtatacaagaagctcctggctgcaagaacattccgtgcagggtcccttagtcttcgtcagttgaagtttgctacggttgatctggagcttcacacaaagtatgtaccaggtgggacagagtctatttacgatgttgatcaaagggtgtccatgaagacacaagtcatccctccccttcctgaggatagatttctctgtagcttcagccatatatttgcaggcggttatgcagctggatattatagttacaagtgggcggaggttttgtctgcggatgcgttttcagcttttgaagatgctggattagatgacatcaaggccgttaaagagacaggacagagattcagaaacaccatacttgctctgggaggaggaaaagcgcctctacaagtgtttgtggagttcagaggacgagaaccttcaccagagcctcttctcaggcacaacggactcttggttgctactgcttgaaacatatgcattttctttaaaactggcctcgtaccatgcttttcagatataaaattaaactttttacttcaaaaaaaaaaaaaaa

SEQ ID NO: 68458 - protein, 701 aa, Brassica napus
MAAEDSLSSNPLLQNFEFPPFDVVDAHHVRPGIRALLHQLEAELEQLEKTVEPSWPKLVEPLEKIIDRLTVVWGMINHLKAVKDTPELRAAIEEVQPEKVKFQLRLGQSKPIYNAFKSIRESPDWNTLIEARQRLVEAQIKEAVLSGIALEDDKREEFNKIEQELEKLSHKFSENVLDATKKFEKLITDKKEIEGLPPSALGLFAQAAVSKGHENATADAGPWLITLDAPSYLPVMQHATNRALREEVYRAYLSRASSGELDNTSIIDQILKLRLDKAKLLGYTNYAEVSMATKMATVETADELLEKLRSASWAPAVQDIEDLKSFAKDQGAIEADSLTHWDITFWSERLRESKYDINEEELRPYFSLPKVMAGLFGLAKTLFGIDVAPADGVAPVWNSDVRFYCIKDSSGNPTAYFYFDPYSRPSEKRDGAWMDEVFSRSRVMAQKGSSVRLPVAQMVCNQTPPVGDKPSLMTFREVETVFHEFGHALQHMLTKEDEGLVAGIRNIEWDAVELPSQFMENWCYHRDTLMSIAKHYQTGETLPENVYKKLLAARTFRAGSLSLRQLKFATVDLELHTKYVPGGTESIYDVDQRVSMKTQVIPPLPEDRFLCSFSHIFAGGYAAGYYSYKWAEVLSADAFSAFEDAGLDDIKAVKETGQRFRNTILALGGGKAPLQVFVEFRGREPSPEPLLRHNGLLVATA

SEQ ID NO: 68459 - DNA, 1270 bp, Brassica napus
  CDS (57)..(1163)
agaacaccaagccgccctctctctctctcggtgaactctcaaaatttattaaaaaaatggagataacgaacgtgatggaatacgagaagatcgcaaaggagaaactgccaaagatggtttatgattactacgcatctggtgcagaggatcagtggactcttcaggagaatcgtaacgccttctccaggattctgtttaggcctaggattctgatcgatgtaagcaagattgatgtgagcacaactgttttagggtttaacatatctatgccgatcatggttgctcccactgctatgcagaaaatggctcaccctgatggcgagctagcaactgctagagctacttctgctgctggaacaatcatgacattatcgtcatgggctacgtgtagtgttgaggaagttgcttccacaggacctgggattcgctttttccaactctatgtctataaggatagaaacgtggttaggcagcttgtgaaacgagctgaagaagctggtttcaaagcgattgctcttaccgttgatacccctaggcttggacgcagagaatccgacatcaaaaacagatttgcgcttcctagaggtctgaccttgaagaattttgaagggttggatcttgggaaaatagacaagaccaatgactcagggctagcttcatatgttgcgggtcaagttgatcaatcacttagctggaaggatataaagtggcttcagtctatcacaagcttgccaattcttgtcaagggtgttattacagctgaggatgcaagaatcgcggttgagtatggagctgcagggatcattgtttctaaccatggagctcgtcagcttgattatgtccctgcaactataatggctcttgaagaggtggttaaagcggtggagggtcggttaccggtgtttcttgacggtggagttcgccgtggaactgatgtctttaaagcattggctcttggagcttcaggtgtctttgttggaaggccgagcttgttctcgctagcagcggacggagaggcgggagtgaggaagatgctgcaaatgctaagagacgagtttgagctgacaatggcacttagtggctgccgttccctgagagagatcagtcggaaccacatcaagaccgattgggactttcctcattacctcccggccaagctataaggggaatcttattcacaaagacaatgaaaagagagatggttgtttgagtttatgacccaataatgtgtttccacatccaacttttataatcgaaaaaaaaaaaaaaa

SEQ ID NO: 68460 - protein, 368 aa, Brassica napus
MEITNVMEYEKIAKEKLPKMVYDYYASGAEDQWTLQENRNAFSRILFRPRILIDVSKIDVSTTVLGFNISMPIMVAPTAMQKMAHPDGELATARATSAAGTIMTLSSWATCSVEEVASTGPGIRFFQLYVYKDRNVVRQLVKRAEEAGFKAIALTVDTPRLGRRESDIKNRFALPRGLTLKNFEGLDLGKIDKTNDSGLASYVAGQVDQSLSWKDIKWLQSITSLPILVKGVITAEDARIAVEYGAAGIIVSNHGARQLDYVPATIMALEEVVKAVEGRLPVFLDGGVRRGTDVFKALALGASGVFVGRPSLFSLAADGEAGVRKMLQMLRDEFELTMALSGCRSLREISRNHIKTDWDFPHYLPAKL

SEQ ID NO: 68461 - DNA, 1292 bp, Brassica napus
  CDS (62)..(1132)
gaattcccgggtcgacatttcgtctgggatttactttctggatcatcgttcagacacatatatggatcaaatcgttaacgtgaatgagtttcaagagctagccaagcgagctctccccaagatgtactatgatttttatagtggaggagcagaagatcgacatactctcaaggaaaacgtggaagctttcactagaatcatgttccgacctcgggttctcgttgatgtgagcaagatagatatgtctaccagaatcttaggttacccaatctcagctccaatcatgattgctccaacagcaatgcatatgttggctcatccacaaggagaaaccgccactgcgaaggctgcagccacgtgtaacaccatcatgatagtatcatacatggcttcatgcactattgaggaagttgcttccagttgtaatgctatccggtttcttcaaatatatgtgtacaagagacgcgatgtaactgctcagatagtgaaaagagctgagaaagctggattcaaggccattgttctgactgttgatgttcctaaacttggcagaagaatggtatccccacagctgaggaactttgaaggattattttcaaccgaagtcatacctagtgaaggttcaggtgttgaagccttcgcttctagtacatttgatgcttctttaaactggaaggatattgaatggttaagatctattacaaagttgccaattatggtcaaagggatacttacccgtgaagacgctgttaaggctattgaagctggtgtagatggaatagttgtatcaaaccatggggcccgccagcttgactattcaccagctactataactgttttagaagagattgttcttgttgttggagggagggtgccggttttgcttgatggaggtgtgagacgaggaacagatgttttcaaagcgttggcactaggagcacaagctgttcttatagggaggcctgtagtgtatggacttgcagccaaaggtgaagatggagtgagaaaagtgatagagatgttgaagaatgagttggagttaactatggctctttctggttgtccaaccattgatgacatcacgagaaaccatgttaggactgagagtgatagacttaaatctatgctctgatcctcaaaagacatttgtggaaagtgagtactatgcgtggactttgtgtgatgtttttgtagtttatatgaacgcctatgagagaaggattttcagaaagattatcacattgtatacagtttcataagtgaaagctctggttgtgaaaaaaaaaaaaaaa

SEQ ID NO: 68462 - protein, 356 aa, Brassica napus
MDQIVNVNEFQELAKRALPKMYYDFYSGGAEDRHTLKENVEAFTRIMFRPRVLVDVSKIDMSTRILGYPISAPIMIAPTAMHMLAHPQGETATAKAAATCNTIMIVSYMASCTIEEVASSCNAIRFLQIYVYKRRDVTAQIVKRAEKAGFKAIVLTVDVPKLGRRMVSPQLRNFEGLFSTEVIPSEGSGVEAFASSTFDASLNWKDIEWLRSITKLPIMVKGILTREDAVKAIEAGVDGIVVSNHGARQLDYSPATITVLEEIVLVVGGRVPVLLDGGVRRGTDVFKALALGAQAVLIGRPVVYGLAAKGEDGVRKVIEMLKNELELTMALSGCPTIDDITRNHVRTESDRLKSML

SEQ ID NO: 68463 - DNA, 1503 bp, Glycine max
  CDS (157)..(1272): n means a or g or c or t/u
ttataatcatgcttctttgtttaagacagactatagcagaaacgaagattgaatagtagtgtttgtgttgtgtgtatgccaatgatttcaatcttggtggtttgttaaactcactttgtaatttttgaagggtagcatcaacaagaagttctggaaatggagatcaccaatgtcagcgagtatgaagctattgcaaagcagaagttgccaaagatggtgtttgactactacgcatctggtgcagaggaccagtggactctgcaggagaacagaaatgccttttccagaattttgtttcggccacgtattcttattgaggtgagcaagatagacatcacaactactgtcctgggcttcaaaatatccatgccaatcatgcttgccccaacagccatgcagaaaatggctcatcctgagggagaatatgcaacagcaagagctgcatctgctgctggaacaatcatgactttgtcttcatgggctacttcaagtgttgaagaggtagcttcaacaggacctggcattcgctttttccagctatatgtgtacaaggacaggaatgtggttgctcagcttgtgagaagagctgaaagggctggattcaaagccattgcccttactgttgataccccaagactaggacgcagagaagctgatatcaagaacagattcacactgccaccatttttgacattgaagaactttgaaggattggaccttggaaagatggacaaagctgatgactctggacttgcttcatatgttgccggtcaaattgatcgtactcttagctggaaggatgtgaagtggcttcaaacaatcaccaaactgccaattctggtgaagggtgtgctgactgctgaggacacaaggatagctgtacaaagtggtgcagctggaattatagtgtccaatcacggagctagacaacttgattatgttccagccactatatcagccttagaagaggttgtcaaagctgctgaaggtcgtgttcctgtatttttggatggtggtgttcgccgcggaactgatgtcttcaaggcattggcactaggtgcctctggcatatttattggacgcccagtgatgttctccttggctgctgaaggagaggctggtgtaagaaatgtgctgcggatgctacgtgaggagtttgagctaaccatggctttgagtggttgcacctcactcaaggatatcactcgtgatcacattgtcactgattgggaccaaccacgcactatcccccgcgccttgccaagattatgaaaaactttttccaatgggggaaacacttctatatatgtttcatgaacctgttcttctcatcctttcttttcctttttggacaactcatttaaacttgtatttggataactctatgcttaatttctaagcattaatatgatgatacttctgtggctactctgctgctgcattcactcattgtatattattaattttgagtcctttatcnnnnaaaaaaaaaantaataaaaa

SEQ ID NO: 68464 - protein, 371 aa, Glycine max
MEITNVSEYEAIAKQKLPKMVFDYYASGAEDQWTLQENRNAFSRILFRPRILIEVSKIDITTTVLGFKISMPIMLAPTAMQKMAHPEGEYATARAASAAGTIMTLSSWATSSVEEVASTGPGIRFFQLYVYKDRNVVAQLVRRAERAGFKAIALTVDTPRLGRREADIKNRFTLPPFLTLKNFEGLDLGKMDKADDSGLASYVAGQIDRTLSWKDVKWLQTITKLPILVKGVLTAEDTRIAVQSGAAGIIVSNHGARQLDYVPATISALEEVVKAAEGRVPVFLDGGVRRGTDVFKALALGASGIFIGRPVMFSLAAEGEAGVRNVLRMLREEFELTMALSGCTSLKDITRDHIVTDWDQPRTIPRALPRL

SEQ ID NO: 68465 - DNA, 1429 bp, Zea mays
  CDS (235)..(1338)
cctacatgtcatgcccacacgcaaatatgtcagatgctcagcgctcgacttagccctcgatcacgggcgcacaacaacacagcgacgctatctgaccgagtgttcaaataaatacccacacgggcacgccacgagacgacgagacccctctgctccaatccgccgctccactccaagtcacacggaggcagccatcgtagcctcgcccgactccgcttcccctgttctttgggcatggagctgatcacaaatgtcaccgagtacgagaagctcgcgaaggagaggctgccgaagatggtgtacgactactacgcctccggcgcagaagatcagtggacgctcaaggagaaccgggaggccttctccagaattctgtttaggccacgggtactgatcgacgtctcccgtatcgacatggccacaaacgttctgggcttcagcatttccatgcctatcatgatcgctccttcagccatgcagaaaatggctcatcctgatggagagcttgccacggcaagagctgcagcctctgcaggaacaataatgacattgtcctcatggtctacttccagcgttgaagaggtcaactcagttgggccggggatacgtttcttccagctctatgtctacaaggacaggaacatcgtacggcaactcgtgaaaagggctgagatggctggcttcaaggctattgcactcaccgtagacactccaatacttggccgcagggaagctgacattaagaacaggttcgccttacctccacatctggtgttgaaaaacttccaagcgctggatcttggcacgatggacaagacaaatgattccggccttgcttcctacgttgctggtcaagttgaccgtaccctttcctggaaggacgtcaagtggctgcagacaattacctcgttgccgatcctagtgaaagggatcgtgactgcagaagacactaggcttgcgatcgaatatggcgctgctgggatcatcgtgtccaaccacggcgcgcgccagctagattatgttcctgcgactatcagctgcctggaagaggtcgccagggaagcgaaaggccggctaccggtgttcctcgacggcggcgtccgccgtggcacggacgtcttcaaggccctggcgttgggagcttcaggagtgttcatcggccggcccgtgctgttctcgctggcggtggacggcgaggccggcgtgcggaaggtgctgcagatgctgagggacgagctggagctcaccatggcgctcagcggctgcacgtcgctgagggagataacccgcgcacacgtcatcaccgacagcgaccggatcggccgctcgcggctgtagaatcattgtgcagttcacctcaggaatgttggtctcgactgaactgtcctgattcgggatatataccgctatttgtaaaaaaaaaaaaaaa

SEQ ID NO: 68466 - protein, 367 aa, Zea mays
MELITNVTEYEKLAKERLPKMVYDYYASGAEDQWTLKENREAFSRILFRPRVLIDVSRIDMATNVLGFSISMPIMIAPSAMQKMAHPDGELATARAAASAGTIMTLSSWSTSSVEEVNSVGPGIRFFQLYVYKDRNIVRQLVKRAEMAGFKAIALTVDTPILGRREADIKNRFALPPHLVLKNFQALDLGTMDKTNDSGLASYVAGQVDRTLSWKDVKWLQTITSLPILVKGIVTAEDTRLAIEYGAAGIIVSNHGARQLDYVPATISCLEEVAREAKGRLPVFLDGGVRRGTDVFKALALGASGVFIGRPVLFSLAVDGEAGVRKVLQMLRDELELTMALSGCTSLREITRAHVITDSDRIGRSRL

SEQ ID NO: 68467 - DNA, 991 bp, Triticum aestivum
  CDS (52)..(795)
gtcgacgatttcgtagcctccctccctctgatccgccgcccggcccgaccaatggctcccaggaagttcttcgtcggcggcaactggaaatgcaacgggaccggagacgacgtgaagaagatcgtcaccgtcctcaacgaggccgaggtgccctccgaggacgccgtcgaggtggtggtgagcccgccgttcgtgttcctgcagcaggccacggggctgctgcgacccgacttcgccgtcgccgcgcagaactgctgggtgcgcaagggcggcgccttcaccggcgagatcagtgctgagatgctggtgaacctgcaggtgccttgggtcattttggggcactctgagaggagagcactgttgaatgaatcaagtgattttgttgctgataaagtggcttacgcactcgcccaaggactcaaggtaattgcttgcattggtgaaacccttgaacagagagaagcagggacgacaatggaagtcgttgctgctcagactaaagctattgcagagaaaatatcagactggacaaacgttgtgctaacatatgaaccagtttgggccattggaaccggcaaggttcatgatggtctgaggaagtggctccaagctaatgttggtcctgcagttgctgaatctaccaggattatctatggaggctctgtaaatggggcaaactgcaaagagcttgcggctcaacctgatcttgatgggttccttgttggcggcgcttcactgaagcctgagtttgtggacatcatcaagtctgccaccgtgaagtctgcttctgcttagttgtttttgagatggacgcagttgcttgtaggagtgaagtctgcttattatctttataagactgttcgaccatcttgttcaaattcgagtgcactgtcatgtcgtattgaccatcttatctttacggtgatgcatgcttatgtttgcttgttttggcatggatgtgtatattcgaaaactcaaaaaaaaaaaaaaa

SEQ ID NO: 68468 - protein, 247 aa, Triticum aestivum
MAPRKFFVGGNWKCNGTGDDVKKIVTVLNEAEVPSEDAVEVVVSPPFVFLQQATGLLRPDFAVAAQNCWVRKGGAFTGEISAEMLVNLQVPWVILGHSERRALLNESSDFVADKVAYALAQGLKVIACIGETLEQREAGTTMEVVAAQTKAIAEKISDWTNVVLTYEPVWAIGTGKVHDGLRKWLQANVGPAVAESTRIIYGGSVNGANCKELAAQPDLDGFLVGGASLKPEFVDIIKSATVKSASA

SEQ ID NO: 68469 - DNA, 1461 bp, Glycine max
  CDS (54)..(983)
gtcgacgatttcgttcaacgtccccaacactgtgttcctgttcttcttcttcgatggcggcaacctcaacatcactggcttctcaactctacattggcctgcgccgcccatgcctcaagcttgattctttcaattctcaatctttctctgtcttcgaccccaatcttcgcctatccctctctcctcccagaccctcacgcgccatcgtcgccatggcaggcaccggtaagttctttgttggcggcaactggaagtgtaacggaacaaaagactccatcagtaagcttgttgctgacttgaacagtgcaaaattggagcctgatgttgatgttgttgtcgcacctccctttctgtacattgatcaagtgaaaaactcactcactgagaggattgaaatatctgcccagaattcttgggtgggaaaaggtggtgctttcacgggagaaatcagcgcggaacaactaaaagatcttggatgcaagtgggttgttcttggacattctgagcgaagacatattattggagaaaatgatgagtttataggaaagaaagctgcctatgctttgagccaaggtcttggagtgattgcatgcattggagaattgttagaagaaagggaagctggaaaaacttttgatgtttgttttcagcaattgaaggcttatgcagatgcagttcctagctgggacaacattgttattgcatatgaacctgtatgggctattggaacgggcaaagtggccactccccagcaagctcaggaagtacatgtagctgttcgagattggctaaaaaagaatgtccctgatgaagttgcatctaaaacgcgaattatttatggagggtctgtaaatggagggaacagtgctgagctagcaaagcaagaagatattgatggatttctcgttggaggtgcttcattaaagggtcctgagtttgctaccattgtcaattcagtcacatccaagaaagttgcggcttgaacttgattacatattgtgattttggcaataagagagcattaaggatataaagacgggctagtcttaaatgtggcaataatatgggtgtacaataacagattggtttttattatcaaaattactgcgtcaatttctttgcaaaaaaaaaaaaaaaaaagcggttttggatgatcaaagcgagtctgtgagttgccattgccaaaggaactgtgaatggactcggttgagtgaggaagtgaagttcctaccttcaaacaaagcttattttttaagcataaaagaaaagaagaagaaagaatgataattgaggatgcacaattgaacgtagacactattcaactacccgttcattatattaatactcgttttctttttgcctatattttcctaacaaaaggaaacgggcagttgaaaataactgaaggtagcgccgtagcgagcttatgaggagagagagagaccgacacgcagcggccgc

SEQ ID NO: 68470 - protein, 309 aa, Glycine max
MAATSTSLASQLYIGLRRPCLKLDSFNSQSFSVFDPNLRLSLSPPRPSRAIVAMAGTGKFFVGGNWKCNGTKDSISKLVADLNSAKLEPDVDVVVAPPFLYIDQVKNSLTERIEISAQNSWVGKGGAFTGEISAEQLKDLGCKWVVLGHSERRHIIGENDEFIGKKAAYALSQGLGVIACIGELLEEREAGKTFDVCFQQLKAYADAVPSWDNIVIAYEPVWAIGTGKVATPQQAQEVHVAVRDWLKKNVPDEVASKTRIIYGGSVNGGNSAELAKQEDIDGFLVGGASLKGPEFATIVNSVTSKKVAA

SEQ ID NO: 68471 - DNA, 1193 bp, Glycine max
  CDS (93)..(854)
gtcgacttcgctgtcgacgatttcgtttgaacaagggtttctctgtctgcttcttcactttctctcgtttcaatcgaaaccaaaacaaaatcatgggcagaaaattcttcgttggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcgcaaaggtggtgcttataccggtgaggttagtgctgaaatgcttgttaatttgggaattccttgggttattattggtcactctgaacggaggcagcttttaaatgaatcaaatgagtttgtgggagataaagttgcctatgcacttcaacaaggtctaaaagttattgcatgcattggggagactctcgaacagcgtgaagctggtacaacaacggctgttgtttctgagcaaacaaaagcaattgcagctaaaatatcaaattgggacaatgtcgttttggcctacgagccagtttgggccattggaacaggaaaggttgctactcctgctcaggctcaagaggtccatgctgatttgaggaaatgggttcatgacaatgtgagtgctgaagttgctgcatctgtaagaattatctatggaggttctgtaaatggaggaaactgcaaagaattggccgcacagcccgatgttgatggatttttggttggtggtgcctccctgaagccggagttcgtggacatcataaatgctgccactgtgaagaagaattgaaattcgtagttaggaactgatataatgctgcctttcaagctgcttcggaaattgctgtttttgagttttggatctgtgctttgtggccaatgttttgaactctgtttagtactgaataaacacgctttcctttgagatctcatccataggcgatcaattggattttgattaaatttctgaatgcaaaaatagtgtaactaccataacatttggtgggtaaataatgttgaacgcctagttgactgtacttaatcgtcacgttctttactagttacttgactgtcataagtttacgaggtttatacaaatttgtttcatgacttcaaaaaaaaaaaaaaa

SEQ ID NO: 68472 - protein, 253 aa, Glycine max
MGRKFFVGGNWKCNGTTEEVKKIVTTLNEAKVPGEDVVEVVVSPPFVFLPVVKSLLRPDFHVSAQNCWVRKGGAYTGEVSAEMLVNLGIPWVIIGHSERRQLLNESNEFVGDKVAYALQQGLKVIACIGETLEQREAGTTTAVVSEQTKAIAAKISNWDNVVLAYEPVWAIGTGKVATPAQAQEVHADLRKWVHDNVSAEVAASVRIIYGGSVNGGNCKELAAQPDVDGFLVGGASLKPEFVDIINAATVKKN

SEQ ID NO: 68473 - DNA, 1091 bp, Hordeum vulgare
  CDS (80)..(841)
gtcgacatttcgtccaaatccaatctcgatctcccgtccgcccgtcccaaccaacccaatccgacccgcctccgtcgccatgggccgcaagttcttcgtcggcggcaactggaaatgcaatggaaccgtcgagcaggtagaggcgatcgtccaaactctgaacgctggacagatcgtctctccggatgttgtcgaggttgttgtcagcccgccctatgtcttccttcccatcgtcaaggctaagctgcgcccagagatccaagttgctgctcagaactgctgggtgaagaagggcggtgctttcaccggtgaagtcagtgctgagatgcttgccaaccttggcgttccctgggtcattcttggacactctgagaggaggagcttgttgggagagtcaagtgagttcgttggcgagaaagttgcatatgcactcgctcagggcttgaaggtcattgcatgtgttggtgagactctcgagcagcgagaagctggatcaaccatggaagttgtcgctgaacagacaaaagcaattgctggcaagatcaaggactggtccaacgtggtcgttgcttacgaaccagtgtgggccatcggcaccggtaaagttgcgacaccggctcaggcgcaggaagtccatgccaatctgagggactggctcaagaccaacgtgagccctgaggttgctgagtccacacgtatcatctatggaggatctgtgactggcgcaagctgcaaggagttggccgcgcaggccgacgtcgatggtttcctcgtcggtggagcttctttgaagccggagttcatcgacataatcaacgctgccgccgtgaagtccgcctaagagaaatctcgacgtggctcctctcggcgtggaggaagctggcgaagatgaagagagactccttttttttctcctgtgtttatgtttattatgtgtactatgctagtaattttgtggtggagcagctgctaccgtgtcgtttcctcccccctgacttgcatgcaagccaataatgataatgtttatcactgaacatatgtcagcaataatctttagctcttgttgctgtttagctaaaaaaaaaaaaaaa

SEQ ID NO: 68474 - protein, 253 aa, Hordeum vulgare
MGRKFFVGGNWKCNGTVEQVEAIVQTLNAGQIVSPDVVEVVVSPPYVFLPIVKAKLRPEIQVAAQNCWVKKGGAFTGEVSAEMLANLGVPWVILGHSERRSLLGESSEFVGEKVAYALAQGLKVIACVGETLEQREAGSTMEVVAEQTKAIAGKIKDWSNVVVAYEPVWAIGTGKVATPAQAQEVHANLRDWLKTNVSPEVAESTRIIYGGSVTGASCKELAAQADVDGFLVGGASLKPEFIDIINAAAVKSA

SEQ ID NO: 68475 - DNA, 1005 bp, Helianthus annuus
  CDS (28)..(789)
gtcgacgatttcgtatcgtgatcggaaatgggccggaaatttttcgtcggcggtaactggaaatgcaatggaactactgaggatgtgaagaagattgtggcaacacttaatgctggtgaattgccatcaactgacattgttgaggtggtggtgagccctccttttgtgtttcttcctactgtcaaaagtgaattgaggcctgaaatccaagttgctgcccaaaattgctgggttaagaaaggtggtgcattcaccggtgaggttagtgctgagatgctcgtcaatttgggcgtcccttgggttattctaggtcactctgaaaggagagcattattaaatgaaacaaatgagtttgttggagacaaagtcgcgtatgcactttctcaaggtctgaaggtgattgcttgtgttggagagactcttgagcagcgggaagccggaaccactatgaaagtcgttgctgaacaaaccaaggcaattgctgacaaaatctcaagttgggataatgtggttttggcttatgagccagtttgggctattggaaccggaaaggttgcatctccagctcaggctcaagaagtacatgcaggactaaggaaatggttcgaggaaaacatcagtgctgacgttgctgctacaaccagaattatctacggaggatctgtaagtggttccaattgcaaagaattggcagggcaaccagacgtcgatggtttcttagttggtggagcttctctcaagccggaatttattgacatcatcaaggctgcggaagtgaaatgcgcataaatagtgtatcattttggaaacaatgacatcgtgtggtgcgtttctggtttgaaataaggatatgaacaacttggtgtgctagctatgttacaaggtgacaccgttgttttttgtcaataactcggttgttttgagcactgagtgttttgtaaactgatcggatacaaattttgcgggtatccacttttgcttattcttattaaaaaaaaaaaaaaa

SEQ ID NO: 68476 - protein, 253 aa, Helianthus annuus
MGRKFFVGGNWKCNGTTEDVKKIVATLNAGELPSTDIVEVVVSPPFVFLPTVKSELRPEIQVAAQNCWVKKGGAFTGEVSAEMLVNLGVPWVILGHSERRALLNETNEFVGDKVAYALSQGLKVIACVGETLEQREAGTTMKVVAEQTKAIADKISSWDNVVLAYEPVWAIGTGKVASPAQAQEVHAGLRKWFEENISADVAATTRIIYGGSVSGSNCKELAGQPDVDGFLVGGASLKPEFIDIIKAAEVKCA

SEQ ID NO: 68477 - DNA, 1905 bp, Hordeum vulgare
  CDS (173)..(1771)
cctccctccctccgccccgctgccgcagtccgctctcagctcccaaccgcttcccagtttgacgccgcccccctcctcggttgttccaccagctcactcccgccgccgctcccctctgtccgcccgccggcggagcttgctctaggcgtgtggggactgggactctgagagcatggcagggaagggggaggaggtgtacgtggcgtcgatcgatcaggggacgaccagcaccaggttcatcgtctacgaccgccacgccagccccgtcgcctcccaccagctcgagttcaagcagcactacccggaggccggatgggtcgagcatgatcctatggagatcatggagagtgtgaaggtctgcatggcaaagacactcgaaaaagctgcagccagtggacttaatgtggatgctagtttgaaggccattggaatcacaaatcagagggagactaccgttgtgtggagcaaatccacaggccttccgctctacaatgccattgtgtggatggatgttcgcactagctctatttgcaggagactggaaagtaagctatcaggtggtagaacgcactttgtggagacatgtggtttaccaatcagtacctacttcagtgctctgaagttattatggttgatggagaatgttgacgctgtcaaggatgcagtcaaggctggtgatgcattatttggcacaatcgatacctggttgatctggaacctaactggaggcattggtgggaaagactgtgatggaaaggagttagttgggcggcatgtcacagactgctcaaacgcatcacggacaatgcttatgaatctgaaggcacttgactgggacaagcctacacttgaggcattaggcattcctgctggcatcttgccaaagattgtcagcaactccgagaaaattggtgttgttgccagtgggttccctttggctggtgtgtctatctcagggtgtctaggagatcagcatgctgcgatgcttgggcagctatgccagaaaggtgaagcaaaaagcacctatggaactggtgccttcatccttctcaacacaggggaggaggttactcagtccacccacggtcttcttagcaccattgcttacaaacttggcccagatgtgccaactaattatgctctagaagggtcaattgcaattgctggtgcagcagttcagtggttgagggacagccttggaatcatttcctcggctgcagaaattgaagggttagctgaaagtgtgcaggattcaggtggcatatactttgtgccagcattcaatggattgttcgcgccatggtggagggatgatgctagggggatctgcataggaatcacgaggttcaccaacaaggggcacattgctcgagcagtgctcgagagtatgtgctttcaggtgaatgatgtcctcagctccatgcataaggatgctggggaggcaggagaagtcaagagtgcagaaggggagttcttgctacgtgttgatggtggtgctactgttaacaaccttctcatgcagatccaggctgatttgctgggtagccctgttgtcaggccagccgacattgagacaacggccctcggggccgcatacgcagcagggttagctgccggagtctggacgaaggaggaaatattcgcaggcctgcacaaggagaacacaacggtgttccgccccaagttagacgatgcacacaggaagaaaagaggagactcctggtacaaggcggtttcgagatcatttgacctggctgacctttctctctagtttgttacacattgctgcgccgtaaattggaccagtttgtgccagcccttgtttgtcttgtcaacgaataaacggtgtgttgtacattatttcggtgcgattcttctttggctttatagaaaaaaaaaaaaaaa

SEQ ID NO: 68478 - protein, 532 aa, Hordeum vulgare
MAGKGEEVYVASIDQGTTSTRFIVYDRHASPVASHQLEFKQHYPEAGWVEHDPMEIMESVKVCMAKTLEKAAASGLNVDASLKAIGITNQRETTVVWSKSTGLPLYNAIVWMDVRTSSICRRLESKLSGGRTHFVETCGLPISTYFSALKLLWLMENVDAVKDAVKAGDALFGTIDTWLIWNLTGGIGGKDCDGKELVGRHVTDCSNASRTMLMNLKALDWDKPTLEALGIPAGILPKIVSNSEKIGVVASGFPLAGVSISGCLGDQHAAMLGQLCQKGEAKSTYGTGAFILLNTGEEVTQSTHGLLSTIAYKLGPDVPTNYALEGSIAIAGAAVQWLRDSLGIISSAAEIEGLAESVQDSGGIYFVPAFNGLFAPWWRDDARGICIGITRFTNKGHIARAVLESMCFQVNDVLSSMHKDAGEAGEVKSAEGEFLLRVDGGATVNNLLMQIQADLLGSPVVRPADIETTALGAAYAAGLAAGVWTKEEIFAGLHKENTTVFRPKLDDAHRKKRGDSWYKAVSRSFDLADLSL

SEQ ID NO: 68479 - DNA, 682 bp, Brassica napus
  CDS (1)..(471)
atggcggcggctgcgaaagacatcgtgacacggcgagctgtggcggcgacgatcaagctgactgtcccagccggaggagcacgaccagcacccccggtgggccctgcgctaggtcagtacaggctgaacctgatggcgttctgcaaggacttcaacgcgaggactcaaaagtacaagcctgacactccgatggccgtgaagataacggcgtacaaggacaactcattcgagttcaccgtcaagtctccgtccgtgtcgtggtacatcaagaaagcggcgggggttgataaagggagcacgcgtccggggcatttgacggtgacgacgctttccgtgagacacgtgtacgagatcgcgaaggtgaagcagacggatccgttttgtcagtatatgccgttggagtcgatctgcaagtctatcattggtaccgctaactccatggggatcaagatcgttcaggatttggagtgatgaaatgagagtggaatcgatcaaatcttattgcacttcgaaatggtcttttgtcttgtctaataatcgtgaattttagattgctctgttttctgcatgttattgcttgtttcaatggatagctgagctccaaaactttgcaattatcattacgaatctaagtagagattgaaactgagattcagttttgttctggaaaaaaaaaaaaaaa

SEQ ID NO: 68480 - protein, 156 aa, Brassica napus
MAAAAKDIVTRRAVAATIKLTVPAGGARPAPPVGPALGQYRLNLMAFCKDFNARTQKYKPDTPMAVKITAYKDNSFEFTVKSPSVSWYIKKAAGVDKGSTRPGHLTVTTLSVRHVYEIAKVKQTDPFCQYMPLESICKSIIGTANSMGIKIVQDLE

SEQ ID NO: 68481 - DNA, 790 bp, Glycine max
  CDS (90)..(539)
ataacccctctttgtttctagacctggcccatgaaatagaatcttaaggcttaaaccctcactgctcctccgaaatcccatccacgaagatgagcataccaaaggcagtggcagcgacgatccggctcacggtgccggccggaggggctcggccagctccaccggttggaccggcgctgggacagtaccggctgaacctgatggcgttctgcaaggacttcaacgcgcggacccagaagtacaaggcggacacgcccatggccgtcacgataacggcgtacaaggacaacaccttcgagttcgccgttaagtcgccgccggtgtcgtggtacctgaagaaagccgccggcgtggaatccggcagcagccggcccggtcacgtgacctcgtcctcggtgtccgtgcggcacgtgtacgagatcgcgaaggcgaaacagtcagatccgtacctccagaacatgcctctcgagtccatttctaagtccatcattggaaccgccaacagcatggggatcaagatcgtcaaggacctcgattgaatcaatctttatatgcagtatcaattgttttgttgtgttgtggttttaggattagggtttctcttttaaacctcttttgagtttgagcctgcacatatgttttgttattttggctaatggatgttttgatttgacatatcttatgatatggataaagttgttaacaagatcggtcatgtgctttaatcctttggcaggaaaatgtgttaaattttactttggactattttatcagtaaaaaaaaaaaaaaa

SEQ ID NO: 68482 - protein, 149 aa, Glycine max
MSIPKAVAATIRLTVPAGGARPAPPVGPALGQYRLNLMAFCKDFNARTQKYKADTPMAVTITAYKDNTFEFAVKSPPVSWYLKKAAGVESGSSRPGHVTSSSVSVRHVYEIAKAKQSDPYLQNMPLESISKSIIGTANSMGIKIVKDLD

SEQ ID NO: 68483 - DNA, 750 bp, Glycine max
  CDS (1)..(750)
atggtgaagataactcttggtactttcgatgactcttttggtgttgcctctcttaaggcttatttggcagagttccatgcaactctgattttcgtgttcgctggtgttggttcagccatcgcttacaacgagcttacaaaagatgcagccttggatccaacggggctggtgacagtagctgtggcccatgcatttgcactgtttgtaggtgtctccgtcgcagccaacatctcgggtggccatttgaacccagctgttacttttggattggccattggaggcaacatcaccctcattactggtttcttatactggattgcccagttgttgggttccattgtggcatgcctcctcctcaatttcatcaccgccaagagcattccaagccacgcaccggcaactggtgtgaacgattttcaagctgtagtgtttgagattgtaatcacatttgggttggtttacactgtgtatgcaactgcagcagacccaaagaaggggtcattgggtatcattgcacccattgctattgggttcgttgtgggtgccaacatcttagcagcaggcccattcagtggcggttcaatgaacccagctcgctcattcggcccagctgtggtcagtggagacttcgctgctaactggatctattgggttggcccattgattggaggaggtttggctggcttgatttatggagacgtcttcattggttcatatgcggctgtcccagcctctgaaacctacccttga

SEQ ID NO: 68484 - protein, 249 aa, Glycine max
MVKITLGTFDDSFGVASLKAYLAEFHATLIFVFAGVGSAIAYNELTKDAALDPTGLVTVAVAHAFALFVGVSVAANISGGHLNPAVTFGLAIGGNITLITGFLYWIAQLLGSIVACLLLNFITAKSIPSHAPATGVNDFQAVVFEIVITFGLVYTVYATAADPKKGSLGIIAPIAIGFVVGANILAAGPFSGGSMNPARSFGPAVVSGDFAANWIYWVGPLIGGGLAGLIYGDVFIGSYAAVPASETYP

SEQ ID NO: 68485 - DNA, 1981 bp, Brassica napus
  CDS (97)..(1761)
gtcgacgatttcgttttttttcgagacacttgcaagaacaagcaaaagaagaaaaaaagaaatctcaacttttgatttcttggaccatccaagaagatgactgttgaacgacaagattgtgtagccttggaccagtttcctgtaggaatgagagttcttgctgttgacgatgaccagacttgtcttcgtatcctcgaatccttgcttcatcgttgccaataccatgttacaacgacgaaccaggcccaaaaggctctagagttattgagagagaacaagaacaagtttgatctggttattagcgatgttgacatgcctgacatggatggtttcaaactgcttgagcttgttggtcttgaaatggacctacctgtcattatgttatctgcccatagcgatccaaagtatgtgatgaaaggagttactcacggggcttgtgactatctactgaaaccggttcgtatcgaggagctgaaaaacatatggcaacatgtggtgagaaagaaccgtgggagtaataacggtgacaagaaagatggatcgggtaacgaaggtgttgcaaactctgatcagaacaatgggagagcaaatagaaaacgtaaagatcagtacaatgaagatgaagacgaggaaagagatgataacgatgatccatcatctcaaaagaagcctcgtgttgtttggaccgttgagctccacaagaaattcgtagcagcggttaaccaattgggttttgagaaggcaatgcctaaaaagattcttgatctgatgaatgttgagaagctcactagagagaatgtggctagtcatcttcagaagtttcgcctttacttgaagaggatcagtgggaatcaacaagctattatggccaactctgacttacatttcttgcaaatgagcaatggacttgacggtttccaccaccgaccgattcccgttggatccggtcagttccatggtggagccgccgctgcggggatgagaccgttccctccaaataatgggattcttggccgactcaacactccttctggaatcggtggtgtccgcaacctttcttctcctccttcttcaggaatgttcttgcaaaacccaaccgatcttggaaagtttcaccatgtctcatcacttcctcttaaccacattgacggaggaaacatacttcaaggtttaccaatacctttagagttcgaccagcttcagacaaacaacaacaagagcatcatcgccgggaactcaatggcttttcctagcttccctacttcccttcctaataacaacaatcacttggttctagaaggtcacccacaagcatctccttcagccttccctggtcaccagatcaataaacgtttggaacattggtcaaacgctgtatcatcatcatcgtccactcttcctcctcctggtcagaacagtaatagcctcatcagtcatcagttcgatgcctcctcatcaaactattccatcccattctgtgactctacaattccattgaatccagcgttggatcatacaaatccccgagctttctacagagccacggacttggattcaaatgcaaatgtgcagcctggagtctattatgattcattgcagatgagacaatcaggcaactacggtccaaccacggatgctatgctgagtagtaaccccaaggaagggttcaccgtgggacagcagaagttacagagtggattcatgggaggagaagctggttctttagacgatatagtcaattccactatgaaacaggtgtgagacgtaagtggggaacccctggattatcaaaaaaaaaactagtgcaatcaccatctttaatttctaaacactattggcaatcagtatctttatatctacgaattgtttgtgcagatttattctttaattaattgttgactatataaaattatgaacgaaatagtcaaaacgtcaatgaataaaaaagaaaactaacagtttctgcaaaaaaaaaaaaaaa

SEQ ID NO: 68486 - protein, 554 aa, Brassica napus
MTVERQDCVALDQFPVGMRVLAVDDDQTCLRILESLLHRCQYHVTTTNQAQKALELLRENKNKFDLVISDVDMPDMDGFKLLELVGLEMDLPVIMLSAHSDPKYVMKGVTHGACDYLLKPVRIEELKNIWQHVVRKNRGSNNGDKKDGSGNEGVANSDQNNGRANRKRKDQYNEDEDEERDDNDDPSSQKKPRVVWTVELHKKFVAAVNQLGFEKAMPKKILDLMNVEKLTRENVASHLQKFRLYLKRISGNQQAIMANSDLHFLQMSNGLDGFHHRPIPVGSGQFHGGAAAAGMRPFPPNNGILGRLNTPSGIGGVRNLSSPPSSGMFLQNPTDLGKFHHVSSLPLNHIDGGNILQGLPIPLEFDQLQTNNNKSIIAGNSMAFPSFPTSLPNNNNHLVLEGHPQASPSAFPGHQINKRLEHWSNAVSSSSSTLPPPGQNSNSLISHQFDASSSNYSIPFCDSTIPLNPALDHTNPRAFYRATDLDSNANVQPGVYYDSLQMRQSGNYGPTTDAMLSSNPKEGFTVGQQKLQSGFMGGEAGSLDDIVNSTMKQV

SEQ ID NO: 68487 - DNA, 2195 bp, Triticum aestivum
  CDS (78)..(1829)
gaattcccgggtcgacttcgctgtcgacgatttcgttcgaagataacgaacgcatccacctgctcggatacgcgctaatggaggcgctgcgggtatggagggcttcctccaatctcctcggcttcgcggcctcccgcgccgccgccgccgccgccgcctcggccggtagggcccaccgtttccacatccgctgctgctccccggccgctgccgccaccacgaagccgccccaggaccggcgccgccgcagcgcctcctcatcctccacctccgaccgcgactctatccgcgccattcgcttaaaaaaggtcgaggagctaagagggaagggttacgaaccgtacgcgtacaagtgggacaggactcacacgaccaaggagcttcaggagaggtacacccatctcgagaatggtgaagtctgcaccgaggcgtcggtttccattgctggtaggatcgttgcccgaagagcatttggaaagcttgttttcatgaccataagagacgactccggaactattcagctttactgtgagaaagacagccttacggaggagcagtttgagcaactgaaggcatttattgatgttggcgatatcttaggtgcaagtgggtccataaagaagacagaaaaaggggaactatctgtttatgtcagctttttcgaaatccttacaaaatccttactcccgctaccagataagtatcatggcttgacagatgtggacaagcggtatcgccaaaggtacattgacatgattgcaaatcctgaggttgctgatgtgtttcgaacaagagcaaaggttgtttctgaaatccgcaagacaatggaatcatttgggttcattgaagttgaaacgccagttctacagggagaagcaggtggcgctgaagcaagaccttttataactcaccataactccctccaaagggatctttacttgaggattgcaacggagctgcatttgaaaagaatgctggttggagggctcgagaaagtttatgagattgggagaatattccgaaatgaaggcatctctactcgtcataatcctgaatttaccaccattgaaatgtatgaagcatattcagactatgaaagcatgatgaatttggccgaagaaatcgtaactcgatgtgctatggctacgactggaaagcttaagattgattaccagggaactgaaatctctctggaaagaccatggagaagggaaaccatacatcgtcttgtcgaagaagcaacaggagtagacttcaatagctttggagatgttgaatctgctaagaatgctgcaaaagggctgctggggttcaaaacagagagcagtgagaatacttcattgcaagcttgttcatctgttggacatgttctcaacgaggtctttgagactgttgttgaatcaactcttgttcaaccaacatttgttcttgactacccagttgagatatcaccattagcgaaaccacatcggaggtatgctggtcttactgaacgatttgaactttttgtatgtggccgtgaaattggaaatgcattttctgagctcacagacccaattgatcagaggagtcgttttgaaaatcaaataaagcagcacaatgctaaacgtgctgcgatggataagaatgtgaaatcggacgagagtaagggggatgatgagtattcctatgaagtttccttggatgaagacttcttgacttctctggaatatggaatgccacctgcttccggaatgggccttggtatcgaccggttagtaatgcttttgacaaactctgccagcataagggacgttatcgcctttccagtcctgaagcttcagcaataggacctttgctcaatgtgagagatgcaattttgacaatgccgagccgagaagagattcggcgcatcctgtgtcttatgttgaagcagttgtgttgtgtctgaccaatatttcgactggtagatcttgtgtgcaattatatactgctcattacttcattggtaaacggatggggaggagggtcgagagtgttaggcgaaatagtcactagttgcctacgctggaataaaaaaccggttcacatatttatggtttcctacaagtactcttaggttggaatgctacgaatgtaaacgatacctcttcaattgaaagggcagtcttgtccatttttagagagagagagagagaccgacacgcagcggccgc

SEQ ID NO: 68488 - protein, 583 aa, Triticum aestivum
MEALRVWRASSNLLGFAASRAAAAAAASAGRAHRFHIRCCSPAAAATTKPPQDRRRRSASSSSTSDRDSIRAIRLKKVEELRGKGYEPYAYKWDRTHTTKELQERYTHLENGEVCTEASVSIAGRIVARRAFGKLVFMTIRDDSGTIQLYCEKDSLTEEQFEQLKAFIDVGDILGASGSIKKTEKGELSVYVSFFEILTKSLLPLPDKYHGLTDVDKRYRQRYIDMIANPEVADVFRTRAKVVSEIRKTMESFGFIEVETPVLQGEAGGAEARPFITHHNSLQRDLYLRIATELHLKRMLVGGLEKVYEIGRIFRNEGISTRHNPEFTTIEMYEAYSDYESMMNLAEEIVTRCAMATTGKLKIDYQGTEISLERPWRRETIHRLVEEATGVDFNSFGDVESAKNAAKGLLGFKTESSENTSLQACSSVGHVLNEVFETVVESTLVQPTFVLDYPVEISPLAKPHRRYAGLTERFELFVCGREIGNAFSELTDPIDQRSRFENQIKQHNAKRAAMDKNVKSDESKGDDEYSYEVSLDEDFLTSLEYGMPPASGMGLGIDRLVMLLTNSASIRDVIAFPVLKLQQ

SEQ ID NO: 68489 - DNA, 1726 bp, Brassica napus; identical to SEQ ID NO: 68299
  CDS (76)..(1554)

SEQ ID NO: 68490 - protein, 492 aa, Brassica napus; identical to SEQ ID NO: 68300

SEQ ID NO: 68491 - DNA, 1860 bp, Glycine max; identical to SEQ ID NO: 68303
  CDS (135)..(1622)

SEQ ID NO: 68492 - protein, 495 aa, Glycine max; identical to SEQ ID NO: 68304

SEQ ID NO: 68493 - DNA, 1480 bp, Brassica napus
  CDS (57)..(1301)
ccaaacacacaaaactcccatcagctaaaaaattttcaaaacacaaacgcacaaaaatggcagcaacaacgtcatcgtctcatcttcttctctcaagctctcgccacgtggcagcctcatctcagccacaaatccttttccagagatctctgttttccggcgggaaacgatcagcagctggaaaaaaccatcatgctagtggtggagtgaggtgtatggcggttgcagcggatgcttcggcggaggctaagccggcggcagcgaggaagaagagtgggtacgagcttcagacgctgacgggttggttgctgagacaagagcagaaaggagagatagatacagagctgacgatagtgatgtcgagcatagcgatggcttgtaagcagatcgcttcgcttgtacagcgcgccggaatctctaatctgaccggcgttcaaggagccgttaacattcagggagaggatcagaaaaagctcgacgtcgtctctaatgaggtattttcaaactgtttgagatcaagtggaaggacagggatcattgcgtcagaggaagaggacgtccccgtagcagttgaagagagttactccggaaactacattgtcgtctttgatcctctcgacggttcctccaacatcgacgctgcagtctccactggttcaatcttcggtatctacagccccaatgacgagtgtatcgttgacgactccgacgatatctcctctcttggttcagaagaacaaaggtgtatagtaaacgtgtgtcaaccagggaacaacttgctcgcagctggctactgtatgtactcgagctcagtcatcttcgttctcaccttaggcaagggcgttttctccttcacactcgacccaatgtacggcgagttcgtcctcactcaagagaacattgagatccccaaagcagggaaaatctactctttcaacgaagggaactaccagatgtgggacgagaaactgaagaagtacattgatgatcttaaggaccctggtccaagtgggaagccttactctgcaaggtacattggtagtttggtcggagactttcacagaactttgttgtacggtgggatttacgggtaccctcgtgacgccaagagcaaaaacggtaagcttaggcttttgtatgagtgtgcaccgatgagtttcatcgttgaacaagctggaggaaaaggatcagatggccaccaaagagtactagatatccaacccaccgagatacatcagagggttccactttacattggaagcaaagaagaagtagagaagctggagaagtacttggcttgagtcatgtaccaaacataagccttttgatttctgttgtagccatttgtctgactacatggcacatcccaatagatgcataaacgatgaaagttctattttgttatcctgagattttggaggttaaatacaaaactaaaaaaatatattttaaataaaaaaaaaagaaaaaaaaaaaaaaa

SEQ ID NO: 68494 - protein, 414 aa, Brassica napus
MAATTSSSHLLLSSSRHVAASSQPQILFQRSLFSGGKRSAAGKNHHASGGVRCMAVAADASAEAKPAAARKKSGYELQTLTGWLLRQEQKGEIDTELTIVMSSIAMACKQIASLVQRAGISNLTGVQGAVNIQGEDQKKLDVVSNEVFSNCLRSSGRTGIIASEEEDVPVAVEESYSGNYIVVFDPLDGSSNIDAAVSTGSIFGIYSPNDECIVDDSDDISSLGSEEQRCIVNVCQPGNNLLAAGYCMYSSSVIFVLTLGKGVFSFTLDPMYGEFVLTQENIEIPKAGKIYSFNEGNYQMWDEKLKKYIDDLKDPGPSGKPYSARYIGSLVGDFHRTLLYGGIYGYPRDAKSKNGKLRLLYECAPMSFIVEQAGGKGSDGHQRVLDIQPTEIHQRVPLYIGSKEEVEKLEKYLA

SEQ ID NO: 68495 - DNA, 1340 bp, Glycine max
  CDS (12)..(1214)
cttatcacattatgcaggcagcagcaacaacaccactctatcaactcgtgagcttcaagccaaagcttcaaactttcccttcaaaatctcaactttgccccttagggacccctttctgcagactaggaatggcttctgtttctgggtttaggttgagacccctgagggctgtgggtggttcttcatcatcttctgcatcaggtgatgatggatttgtcacactgatagagtatgtggcgaaggaaggaatgaatgtgaaagatgatttggtggtgttgcttgatcacattcagtatgcttgcaagagaattgcagcacttgtggcttctcctttcaattacagccttggcaaacaaactggtcatggttctgttggttctgatagggatgccccaaagcctcttgatattgtctcgaatgaaattatcttgtcatcactccgaaaatccagaaaagttgctgtcatggcttcagaagaaaatgatgcgccaacttggataagtgacgatggtccttacgtggttgtaacagatcccctagatggttctcgaaatattgatgcatccattccaacaggcacaatttttggtatttataagcgccttgaggaacttgataatctacccacagaggagaaggctatgctaaattcactccagagtggaagtaagctgattgctgccgcgtatgttctctattcttctgcaactatactctgcatcacctttggttctggaacacaggcattcactcttgatcattcaacaggagactttattctcacaaatccaagcatcaaaattcctccccgtgggcaaatttattcagtaaatgatgcgcggtattttgactggccggaaggtttaaggcaatatatagacactgttagacaaggaaaaggtagataccccaagaagtactctgccaggtatatatgttccctggtggctgatctccacagaactttgctgtatggaggtgtgacaatgaatccaagggaccatcttcgtcttgtttacgaagcaaaccctcttagtttcattgtagagcaggctggtgggagagggtctgatggcaaaaataggattctttcccttcaaccagttaaacttcaccaaagacttcctctctttttgggaagcttggaagacatggaagagttagaaagttatggggatatccaacaaaaagttaatcctggttatgaggtttgatgctgctgtatatagcatcatgcatacaaattttgaatattcaaccatcatggtgcctgactaattgttccagtgtttttcacctgtgttttatgtacttcgttatccatcaaaaaaaaaaaaaaa

SEQ ID NO: 68496 - protein, 400 aa, Glycine max
MQAAATTPLYQLVSFKPKLQTFPSKSQLCPLGTPFCRLGMASVSGFRLRPLRAVGGSSSSSASGDDGFVTLIEYVAKEGMNVKDDLVVLLDHIQYACKRIAALVASPFNYSLGKQTGHGSVGSDRDAPKPLDIVSNEIILSSLRKSRKVAVMASEENDAPTWISDDGPYVVVTDPLDGSRNIDASIPTGTIFGIYKRLEELDNLPTEEKAMLNSLQSGSKLIAAAYVLYSSATILCITFGSGTQAFTLDHSTGDFILTNPSIKIPPRGQIYSVNDARYFDWPEGLRQYIDTVRQGKGRYPKKYSARYICSLVADLHRTLLYGGVTMNPRDHLRLVYEANPLSFIVEQAGGRGSDGKNRILSLQPVKLHQRLPLFLGSLEDMEELESYGDIQQKVNPGYEV

SEQ ID NO: 68497 - DNA, 1159 bp, Glycine max
  CDS (10)..(1029)
agtgaaaaaatggatcacagtgcggatgctcaacgcacggacctgatgaccatcacccgtttcgtgctgaacgaacagtcgaagcacccagagtctcgtggcgatttctcaatcctgctcagtcacattgttctcggctgcaagttcgtctgctctgctgttaacaaggcgggtcttgctaagcttattggacttgcaggagagacaaatgttcagggtgaagagcaaaagaaattggatgtcctatccaatgatgtcttcatcaaggcattgatcagcagtggacgaacatgcatcttggtgtctgaagaagatgaggaagcaacatttgtggaaccttctaagcgtggaaaatactgtgttgtttttgacccgctggatggttcctctaacattgattgtggtgtttcaattggcacaatctttgggatttatttgataaaagaagaccatgaaccaaccgtagaagatgttttgcaacctgggaagaacatgttggcagctggttattgcatgtatggaagctcttgcacgcttgtgttaagcactggaagtggtgttaatggtttcacccttgatccatctcttggggagttcattctaactcaccctgacatcaagatcccaaagaaaggcaagatctattcagtgaatgaaggaaatgctaaaaactgggatggccctactaccatgtatgtggaaaactgcaagtatccaaaagatggttcatcaccaaagtccctaagatatattggaagcatggttgctgatgttcaccgcacattgctttatggaggtatctttctgtacccggctgataaaaagagtccaaatgggaaacttcgtgtactctatgaagtcttcccaatgtcattcttgatggaacaagcaggaggacaggctttcaccggcaaccaaagggcacttgatttggttccaaagaagttgcacgagcgatctcccatattccttggtagctatgaagatgtagaggaaatcaaggctctttactctgctgatgaaaaataggaatgaagctggaagaaagctatctttgtctttcgctactcacaagcaattgttatctaattgttacacatgtcatgtatatgttaagaaaagttattaatgttttgtgatttagaaaaaaaaaaaaaaa

SEQ ID NO: 68498 - protein, 339 aa, Glycine max
MDHSADAQRTDLMTITRFVLNEQSKHPESRGDFSILLSHIVLGCKFVCSAVNKAGLAKLIGLAGETNVQGEEQKKLDVLSNDVFIKALISSGRTCILVSEEDEEATFVEPSKRGKYCVVFDPLDGSSNIDCGVSIGTIFGIYLIKEDHEPTVEDVLQPGKNMLAAGYCMYGSSCTLVLSTGSGVNGFTLDPSLGEFILTHPDIKIPKKGKIYSVNEGNAKNWDGPTTMYVENCKYPKDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYSADEK

SEQ ID NO: 68499 - DNA, 1343 bp, Glycine max
  CDS (86)..(1114)
atagccccatctctttctccttctccctaaacctcgaactcagcacccccatccactggtgattgtttgattgagccttgaagaaatggaccacagcgctgatgcacatcgcacggacttgatgaccataacgcggttcgtgctgaacgagcaatccaagcaccccgagtcacgcggcgatttcaccatcttgctcagtcacattgttctcggttgcaagttcgtttgttccgctgtcagcaaggctggtcttgctaaacttattggactcgctggagaaaccaatgttcagggtgaagaacagaagaaactggatgttctttccaatgaggttttcatcaaggctctcataagcagtggccgaacatgcatcttggtttctgaagaagatgaagaagcgataattgtggagccttctaagcgcggaaagtactgtgtttgctttgacccattggatggctcgtccaacattgattgtggggtttccattggcacaatttttggggtttatgcgttgaaagatgtccatgaaccaaccatagaagatgtcctgcttcctgggaagaacatggtggcagctggttactgtatgtatggaagctcttgcacgcttgtgttaagcactggagcaggtgttaatggtttcacccttgacccatctcttggtgagttcatcctaactcaccctaacattaagatcccaaagaaaggtaaaatttattcagtgaatgaaggaaatgccaaaaactgggatcgtcctactgctacttacgttgaaaaatgcaagtttcctgaagatggttcatcaccaaagtctctaagatatattggaagcatggtagctgatgttcatcgtacgttgctttatggaggcatctttttgtaccctgctgacaaaaaaagtccaaatggaaaacttcgtgtcctgtatgaagtcttcccaatgtcattcttgatggaacaggcaggaggacagtctttcacgggcaaggaacgggcacttgatttagttccaacgaagttgcacgagcgatctcccatattccttggtagctatgatgatgttgaggaaatcaaagctctttatgctgctgctgagggtgaacaagaatgaaattggaaaggtttcttgtatctttcgctacttacaagcgcttgttttctaattgttactagcaggtgcttataagaaaactagttatctggtcatgtatatgttaataaaattggttgatgtgcctgtcagggctatagaatttatttagataaaatacttagattaaagtatcattttgttgctgaagaagtataactgcttactttccctcaaaaaaaaaaaaaaa

SEQ ID NO: 68500 - protein, 342 aa, Glycine max
MDHSADAHRTDLMTITRFVLNEQSKHPESRGDFTILLSHIVLGCKFVCSAVSKAGLAKLIGLAGETNVQGEEQKKLDVLSNEVFIKALISSGRTCILVSEEDEEAIIVEPSKRGKYCVCFDPLDGSSNIDCGVSIGTIFGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 68501 - DNA, 1462 bp, Triticum aestivum
  CDS (103)..(1332)
gaattcccgggtcgacttcgctgtcgacgatttcgtcaccaccacggtgcgcgccaagacaaggcaggggagagaaattcgtcaatccgcagcaccaaagcaatggccgccgcgaccaccaccacctcccgcccgcttctgctgtcccgccagcaggcggcggctagctccctccaatgccgcctccccaggaggcccggaagcagcctctttgccggccagggccaggcgtcgactccgaatgtgcggtgcatggcagtcgtggacacggcctcggcgccggcgccggcggcggctaggaagaggagcagctacgacatgatcacgctgacgacgtggctgctgaagcaggagcaggagggggtcatcgacaacgagatgaccatcgtgctgtccagcatatccacggcgtgcaagcagatcgcctcgttggtgcagcgcgcgcccatctccaacctcaccggcgtccagggcgccaccaacgtgcagggcgaggaccagaagaagctcgacgtcatctccaacgaggtgttctcgaactgcctgaggtggagtggccgcaccggcgtgatcgcatcggaggaggaggacgtgccggtggcggtggaggagagctactcgggcaactacatcgtggtgttcgacccgctcgacggctcctccaacatcgacgccgccgtctccaccggctccatcttcggcatctacagcccatccgacgagtgccacattggcgacgacgcaacccttgacgaagtgacgcagatgtgcatagtgaacgtgtgccagccagggagcaacctgctcgccgccggctactgcatgtactcgagctcggtcatcttcgtgctcaccatcggcaccggggtgtacgtgttcacgctggacccgatgtacggcgagttcgtgctgacgcaggagaaggtgcagatcccaaagtcgggcaagatctactccttcaacgagggcaactacgcgctctgggacgacaagctcaagaagtacatggacagcctcaaggagcccggcacctccggcaagccctactccgcgcgctacatcggcagcctcgtcggcgacttccaccgcaccatgctctacggcggcatctacgggtaccccagcgaccagaagagcaagaacggcaagctgcggctgctctacgagtgcgcgcccatgagcttcatcgccgagcaggccggcggcaaaggctccgacggccaccagagggtactcgacatcatgcccacagcggtccatcagagagtgcctctgtacgtcgggagcgtggaggaagtggagaaggtggagaaattcttgtcttcagagtagaacaagaacgagggagggatacacaggctgtttcttccaagaaattattgtaactaatatataatgtagcccttttcttgtgatgcggaaaatatatttgaagaatgagagaccgacacgcagcggccgc

SEQ ID NO: 68502 - protein, 409 aa, Triticum aestivum; identical to SEQ ID NO: 40172

SEQ ID NO: 68503 - DNA, 1231 bp, Linum usitatissimum
  CDS (28)..(1050)
ttaaaattcgaaatctgatcggagaagatggatcacgcggcggatgcgatgaggaccgacttgatgacgataactcggtacgtgctgaacgagcagacgaagcaccccgagtcacgcggcgacttcaccatcctcctcagtcacattgtcctcggctgcaagttcgtctgctcctccgttaacaaggctggtctggcaaaattgattgggcttgctggggagaccaatgttcaaggtgaagagcagaagaaactggatgtgctctctaatgaagtcttcatcaaagccttagtaagcagcggccgaacctgcattcttgtgtctgaggaagatgaagaagcaacctttgtggaaccagccttgcgtggcaagtactgtgtcgttttcgatccgttggatggatcctccaacatcgactgtggtgtctccatcggaacgatatttgggatttacatgatcaaagatggctctgagccaactgtggaggatgcattgcagccggggaagaacatggttgcagccggttactgcatgtatggaagctcgtgcacgttagtgctgagcacgggtggaggagtcaacgggttcactcttgatccgtctcttggggagttcatactcactcaccctgatatcaagattccgaagaagggcaagatctattcggtcaacgaagggaatgccaagaactgggatggtccaacggccaagtatgtggagagctgcaagtaccctaaagatggttcctctccaaagtctcttagatacattggaagtatggttgctgatgtgcaccggacattgctgtatggaggcatattcttgtacccagctgacaagaagagtcccagcggaaaacttcgtgtgttgtacgaagtcttcccaatgtcgttcctgatggagcaagctggaggccaagctttcaccggcaaggaaagggcactggacttggtcccgacgaagatacacgagcgatctcccatattcttgggaagttcggatgacgtggaggaaatcaaagccctctatgctgctgaggcaaagaactaaggactttgaagcaattgtctagatatcccattcctccctctaatgatacttttctcctttgatttcttgtaagataatttgcccaaatcccacatctttgaataagctatattgtaatctgattatgaaagtgtatactctgttattgatatgggttttgatcattaaaaaaaaaaaaaaa

SEQ ID NO: 68504 - protein, 340 aa, Linum usitatissimum
MDHAADAMRTDLMTITRYVLNEQTKHPESRGDFTILLSHIVLGCKFVCSSVNKAGLAKLIGLAGETNVQGEEQKKLDVLSNEVFIKALVSSGRTCILVSEEDEEATFVEPALRGKYCVVFDPLDGSSNIDCGVSIGTIFGIYMIKDGSEPTVEDALQPGKNMVAAGYCMYGSSCTLVLSTGGGVNGFTLDPSLGEFILTHPDIKIPKKGKIYSVNEGNAKNWDGPTAKYVESCKYPKDGSSPKSLRYIGSMVADVHRTLLYGGIFLYPADKKSPSGKLRVLYEVFPMSFLMEQAGGQAFTGKERALDLVPTKIHERSPIFLGSSDDVEEIKALYAAEAKN

SEQ ID NO: 68505 - DNA, 1521 bp, Linum usitatissimum
  CDS (15)..(1259)
caaaatttacatccatggcgactgcggccggagctgctcgtcttctatcctcctcctcaactccccgctctctttcccgcctctcgcctttccaagtctgtgttatcgactccaaatctctggtttcattcggtaggaggaggaacaacgtcgccgggggttctggtttcaaatgctctgccgtcgggacggcgccgtcggaggcggcaacgacgacgaagaagaggagtagctacgagattctgacgctgacgacctggcttctgcagcaggaacaggccggagtgatcgacgccgagctcacgattgtgctctccagcatctccacggcgtgtaagcagatcgcttctctagttcagcgatccgggatttctaacctcaccggcgtccagggcgccgtcaatgtccagggtgaggatcagaagaagctcgacgtcgtttcgaacgaggtgttttcaaattgcttgaggtcgagcggcaggacggggatcatagcgtcggaggaagaagacgtgccggtcgccgtggaggaaagctactccggtaactatatcgtagtgttcgatccacttgatggatcgtcaaacatcgatgccgcagtctccaccggctcaatcttcggaatctacagtcccaacgatgagtgcctggccgacatcggagacggagacgagtcaaatctagatactcaggagcagaagtgtgtggtgagcgtgtgccagccggggagcaacctactcgccgccggctactgcatgtactcaagctcggtgatcttcgtcctcacgatcggaaacggcgttttcgccttcaatctggacccaatgtacggcgaattggtgttgactcaagagaacattcagatcccgaaagcgggaaagatctactcattcaacgaagggaactaccaaatgtgggatgagaaattgaagaagtacatcgacgacctcaaggatcctggtcccagcgggaagccttactccgctcgctacatcggaagcttggtcggggatttccaccggacgttgctctacggtgggatttacgggtacccgagggatatgaagagcaagaacgggaaattgaggctgttgtatgaatgtgcaccgatgagctttattgtggagcaggctggtggaaaaggatcggatggccatgggaggattcttgatatacaaccagttgagattcatcagcgtgtgccactgtacattgggagcgtggaggaagtggagaagctggagaagtatttagcttgattctcaatgtaaagtgcagagaaagcttgcctttttgtttggaatggaattttgtcatgatgcaatgttgcatttgctcagaaacttggaaaacaattagctagatgatgctagaacaaaattacacagttaaaattcgagattgtaggagatcgttatgtagggttctctgataaatcatgtactggtagcagtcgtcagcttccggagtcattcaaaagttcaatgtcacaaccattcactaaagaaaaaaaaaaaaaaa

SEQ ID NO: 68506 - protein, 414 aa, Linum usitatissimum
MATAAGAARLLSSSSTPRSLSRLSPFQVCVIDSKSLVSFGRRRNNVAGGSGFKCSAVGTAPSEAATTTKKRSSYEILTLTTWLLQQEQAGVIDAELTIVLSSISTACKQIASLVQRSGISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDGDESNLDTQEQKCVVSVCQPGSNLLAAGYCMYSSSVIFVLTIGNGVFAFNLDPMYGELVLTQENIQIPKAGKIYSFNEGNYQMWDEKLKKYIDDLKDPGPSGKPYSARYIGSLVGDFHRTLLYGGIYGYPRDMKSKNGKLRLLYECAPMSFIVEQAGGKGSDGHGRILDIQPVEIHQRVPLYIGSVEEVEKLEKYLA

SEQ ID NO: 68507 - DNA, 988 bp, Brassica napus
  CDS (30)..(752)
ttttgtctaaaccactttgaagaacaataatgttgggacctcagtgctgcgaaaacccgccggttcttaacccgctctccgggtcgggtcatgtggagaaactgggtggcctcgatgtatacgtctctggctctccagattccaacaagtgcgtcctcctcgtctcggatatttatggctatgaagctccaaacttgagggcgcttgcggacaaggttgcagcttcaggattctatgttgtggttcctgattacttctatggagatccttatgatccctctcatcaagacagatccgtccctatctggatcaaagaccatggccctgataaggggtttgaagacacaaagccagtacttgaagccataaagaacaagggcataactgccattggagctgcagggatgtgctggggtggaaaagtggttgtggaattgtctaaagaagagctgatccaagcagctgttttgcttcatcctacttacgtcactgtcgatgatatcaaggatgtgaaggttccaatagctatactaggagctgaggatgattttttgaccccaccagcactcgtgaagcaatttgaggagattcttgcttctaaacccgaggtgagtagttatgtgaagattttccccaatgtctcacacggttggacaactcggtatgatatcaatgatccagaggcggttaaagctgcggaagaagctcacaaggagatgcttgattggtttgtgacttacgtcaaagaatgattgagagaaggctatctcttaagtgatcacatttgctactgtttgttgaattgtaaataaggagagaactaataagtataataaaactctggggttgtgtgtgtctctccactctctgttcttatctgaggtatgttggataaatataagtatgttgttcctatgtagtgaatttggcctgtgatgcctttcgtttatcattgcaaaaactttaccctttccaaaaaaaaaaaaaa

SEQ ID NO: 68508 - protein, 240 aa, Brassica napus
MLGPQCCENPPVLNPLSGSGHVEKLGGLDVYVSGSPDSNKCVLLVSDIYGYEAPNLRALADKVAASGFYVVVPDYFYGDPYDPSHQDRSVPIWIKDHGPDKGFEDTKPVLEAIKNKGITAIGAAGMCWGGKVVVELSKEELIQAAVLLHPTYVTVDDIKDVKVPIAILGAEDDFLTPPALVKQFEEILASKPEVSSYVKIFPNVSHGWTTRYDINDPEAVKAAEEAHKEMLDWFVTYVKE

SEQ ID NO: 68509 - DNA, 966 bp, Glycine max
  CDS (19)..(738)
cgtctgcggaaagcaacaatgtcaggacctgagtgttgctcaaacccaccagttctgaaccccaatgcaggagctggccatgttgaaaaactcgctggtctcaattcctatctctccggttcccctaattccattgccattcttctcatctccgacatttatggctatgaagcaccaaatttgaggaatattgcagacaaggttgcagctgctggttattatgtggttgttcctgacttcttccatggtgatccatataatcctgagaatgctagcaggtctatccctgtttggttaaaagatcatggcacggacaaaggatctgaagctgcaaaatccataattgaagctttgaaaagtaaaggtgtgatggctattggggctgctggattttgttggggggctaaagtcgtggttgaacttgcaaaatccagactaatccaagctgccgtgctattacatccatcgtttgtctctgtggatgatatcaagggtgttgatactccaactgccgtgcttggagctgagattgacaaaatgtctcctccagagcttgtgaaacagtttgaacaagtcctaactgctaaacctggggttgattgttttgttaaaatatttcctaaagtttcacacggttggactgtgagattcaaccctaaagacgcagaaactgtgaaggctgcagcagaggaagcccatcaggacatgctaaactggtttgctaaacatcttaagtgagaaattttgttatgctaagaacataggacttctacgtggattattgtcattttctgcggtggaggatgtaaaacatctaatcattcagtgtagttgtagtttacaagaaaataagtgctgtatttttgcttattgggaatacatcacattactgaaagttttattgtactgctatacctccgtttatattgcagaaagggcattattgaacaataaaaaaaaaaaaaa

SEQ ID NO: 68510 - protein, 239 aa, Glycine max
MSGPECCSNPPVLNPNAGAGHVEKLAGLNSYLSGSPNSIAILLISDIYGYEAPNLRNIADKVAAAGYYVVVPDFFHGDPYNPENASRSIPVWLKDHGTDKGSEAAKSIIEALKSKGVMAIGAAGFCWGAKVVVELAKSRLIQAAVLLHPSFVSVDDIKGVDTPTAVLGAEIDKMSPPELVKQFEQVLTAKPGVDCFVKIFPKVSHGWTVRFNPKDAETVKAAAEEAHQDMLNWFAKHLK

SEQ ID NO: 68511 - DNA, 306 bp, Triticum aestivum
  CDS (1)..(306)
atgcctaaggctgctgctcccgccaagcgtgcgaccagaactaagcgggccaagaaggaccccaacgctcccaagcgcggcctgtctgcctacatgttctttgccaacgaacagcgtgagaacgtccgtgaggagaaccctggtatctctttcggtcaagtcggcaagctcctcggtgagcgatggaaggccctcaacgagaagcaacgtgctccctatgaggccaaggctgccgctgacaagaagcggtacgaagacgagaagcaggcttacaatgccgatcaggaagaagaggagtcttcttag

SEQ ID NO: 68512 - protein, 101 aa, Triticum aestivum
MPKAAAPAKRATRTKRAKKDPNAPKRGLSAYMFFANEQRENVREENPGISFGQVGKLLGERWKALNEKQRAPYEAKAAADKKRYEDEKQAYNADQEEEESS

SEQ ID NO: 68513 - DNA, 1913 bp, Brassica napus
  CDS (272)..(1768)
gccggcaagaaactcgagtttgaatcggtttggagcatcgccggagatttctatcgtaatcaaggcagttagttttcacggtgtatagaagaaacagctgagcgagaaaggcggtcgagagagagaagaagaggaagaagataaaaaaaagtcgtcgatgacggtgaaacggagtcgttttggttcttctgaccggcggtactcactcctcaactctttattggagtaggtgcctagtaccgtcgagaggagagaagaaggaagtgttgtgatggggaaggttgcggttgcgtttgcggcggctgcggttttagtgtcttgctccgtggcggcggtgatggtggggaggaggattaagagtcgggcgaaatggagggccgtggtggagattttgaaggagttggaggaagcttgtgatactccggtggggaggctgaggcaagtggtggatgccatggcggtggagatgcacgctgggttggcttctgaaggtggctccaagcttaaaatgcttctcactttcgtccatcatttgcccaatgggacggagaaaggaacttattatgcacttcatcttggaggcacttactttaggattttgagggttcatctgggtggtgaaaggtcttatctagatgttcaagacgttgaacgacaccccataccttcacatttgatggatagcaccagcgaggttcttttcaactttctcgccttttccatggaaaggtttatcgaaaaagaaggaaaggaatctaattcacaaggtgtgaaaagggaactggcatttacgttttcgttccctgtcaagcattcttctatatcttccggagttctaatcaaatggaccaaaggttttgagattagtgaaatggttgggaaagatgtagctgaatgtctacaaggagcgatgaacagaagaggcctagatatccatgttgcagctcttgtgaatgatactgtgggagccctgtcacttggatattatcatgatccagatacagttgttgccgttgtatttggaacaggtagtaatgcatgttacttggaacgcactgatgccataatcaagtctcagggtctgcttaccacttctggaagcatggtagtcaatatggagtggggtaatttttggtcctcacacctgccaagaacttcatatgacattgacttggatgcagagagttcaaatccaaatgatatgggatttgaaaagatgatagcaggattgtatctgggtgacattgttagaagagtaatccgtcacatgtcacaagtctccgacatctttggacccacctcgtccatgttatctgagccttatgttctaagaacaaattcagtttcagccatgcatgaagatgacacacccgagttgcaacaagtagcaagaatcttgaaagacttgggggtatcagatgtaccattgaaggtgagaaaactcgtagtgaagatatgcgacgtggtgacacgaagagcagggaggctagcagcagcgggtattgcaggaatcttgaagaaggtaggtcgagatggtagcggaggaatcacgagcgggagaagcagaagcgaaatgcggatgcagaaaagaacagttgtcgcagtagaaggaggattgtacatgaactacaccatgtttagagaatacatggaagaagctttggtggagatattaggagaagaagtgagccaatacgtggtcgttaaagccatggaagatggttctagcattggctctgcccttctcgttgcctctttacagtcataaatcatcatcatcaattcatcatcgttgtttatataattggttatgtgcgtctgtgcagtgtgtgtgtgtgtgtatatatttattcaatatttgtttgttaattattattgttttttttttgttcaaatgttaaaaaaaaaaaaaa

SEQ ID NO: 68514 - protein, 498 aa, Brassica napus
MGKVAVAFAAAAVLVSCSVAAVMVGRRIKSRAKWRAVVEILKELEEACDTPVGRLRQVVDAMAVEMHAGLASEGGSKLKMLLTFVHHLPNGTEKGTYYALHLGGTYFRILRVHLGGERSYLDVQDVERHPIPSHLMDSTSEVLFNFLAFSMERFIEKEGKESNSQGVKRELAFTFSFPVKHSSISSGVLIKWTKGFEISEMVGKDVAECLQGAMNRRGLDIHVAALVNDTVGALSLGYYHDPDTVVAVVFGTGSNACYLERTDAIIKSQGLLTTSGSMVVNMEWGNFWSSHLPRTSYDIDLDAESSNPNDMGFEKMIAGLYLGDIVRRVIRHMSQVSDIFGPTSSMLSEPYVLRTNSVSAMHEDDTPELQQVARILKDLGVSDVPLKVRKLVVKICDVVTRRAGRLAAAGIAGILKKVGRDGSGGITSGRSRSEMRMQKRTVVAVEGGLYMNYTMFREYMEEALVEILGEEVSQYVVVKAMEDGSSIGSALLVASLQS

SEQ ID NO: 68515 - DNA, 1432 bp, Brassica napus
  CDS (39)..(1244)
ttacatccactcattgttttcttttttgctcatctactatggcgacgaagagaagcgttggaactttgaaggaagcggatctgaagggaaagagcgtgttcgtgagggttgatctcaacgttcctttggatgataactctaacatcaccgacgacactaggattcgtgccgctgttcccaccatcaagtacttgatgggtaacggatctagggttgttctctgcagtcacttgggccgcccaaaaggtgttacccctaaattcagcttgaagcctcttgtgccgagattgtctgagcttcttggtgttgaggttgtgatggcaaatgactctattggtgaggaagtccagaaactggttgcaggactacctgaaggtggagttcttctcttggagaacgtgaggttctacaaggaagaagagaagaacgaccctgagtttgccaagaagcttgctgcccttgctgatgtctacgtcaacgatgctttcggaactgctcacagagctcatgcttctaccgagggagttgccaaatacttgaagccttccgttgccggtttcctcatgcagaaggagcttgattaccttgtcggagctgtggcaaaccccaagaagccttttgctgccattgtcggaggctcaaaggtttcgacaaagattggtgtcattgagtcgctcttgtccaccgttgacatcctcttgctcggtggaggtatgattttcactttctacaaggcgcaaggacattcggttggatcttcccttgtggaagaggacaagcttgacttggccaagtcactcatggagaaggcgaaagccaaaggtgtctctctgttgctcccaaccgatgtggttattgctgataagttcgctcccgatgctaacagcaagatagtgccagccacggcaatcccagatggctggatgggactcgatgttgggccagactctatcaagacattcagcgaggctctggacacaacccagaccatcatctggaatggtcccatgggtgtttttgaattcgaaaagtttgcagctggaactgaggccgtagcaaagcagctagcggagctgagcggaaagggagtgaccacaatcataggaggaggtgactctgtggctgccgtggagaaggttggtttggctgacaagatgagtcacatctctaccgggggaggtgcaagtttggagcttctagagggaaagccacttccaggagtcctagctcttgacgacgcgtgaatttcatctctcttgtgatatgtgatatgtgatatgtattacaagtcttatgcttttcttatgaccagattagcaaagcccttgtacttgtccgcttgagattttctttctacggctctttttcgagttttttgcttggagcctttttaataaaagaaagagattaaactctgaaaaaaaaaaaaaaa

SEQ ID NO: 68516 - protein, 401 aa, Brassica napus
MATKRSVGTLKEADLKGKSVFVRVDLNVPLDDNSNITDDTRIRAAVPTIKYLMGNGSRVVLCSHLGRPKGVTPKFSLKPLVPRLSELLGVEVVMANDSIGEEVQKLVAGLPEGGVLLLENVRFYKEEEKNDPEFAKKLAALADVYVNDAFGTAHRAHASTEGVAKYLKPSVAGFLMQKELDYLVGAVANPKKPFAAIVGGSKVSTKIGVIESLLSTVDILLLGGGMIFTFYKAQGHSVGSSLVEEDKLDLAKSLMEKAKAKGVSLLLPTDVVIADKFAPDANSKIVPATAIPDGWMGLDVGPDSIKTFSEALDTTQTIIWNGPMGVFEFEKFAAGTEAVAKQLAELSGKGVTTIIGGGDSVAAVEKVGLADKMSHISTGGGASLELLEGKPLPGVLALDDA

SEQ ID NO: 68517 - DNA, 1437 bp, Brassica napus
  CDS (54)..(1259)
tcgtcctctctcttagcatcagtcaactcattgtttacatctgttcatctactatggcgacgaagagaagcgttggaacgttgaaggaagctgatctgaagggaaagagcgtgttcgtgagggttgatctcaacgttcctttggatgataactctaacatcactgatgacaccaggattcgtgccgctgttcctaccgttaagtacttgatggaaaacggatctagagttgttctctgcagtcacttgggtcgtccaaaaggtgttacccctaaattcagcttaaagcctcttgtgccgaggttgtctgagcttcttgggattgaggttgtaatggcaaatgactctattggtgaggaagtccagaaactagtcgcaggactacctgaaggaggtgttctgctattggagaatgtgaggttctacaaggaagaagagaagaacgaccctgaatttgccaagaagctcgctgcccttgctgatgtctatgtcaacgatgctttcggaactgctcacagagcccatgcttccactgagggagttgccaaatacttgaagccttctgtcgctggtttcctcatgcagaaggaacttgattacctcgtcggagctgtggtaaaccccaagaatccttttgccgccattgttggaggttcaaaggtttcgacgaagattggtgtcattgagtcgctcctgtccaccgttgacatccttcttcttggtggaggtatgatttatactttctacaaggcacaaggacactctgtcggatcttctcttttggaagaggacaagcttgacttggccaggtcgctcatggagaaggccaaagccaaaggtgtctctcttttactcccaaccgatgtggttattgctgacaaattcgctcctgatgctaacagcaagatagtgccggccacggcaatcccagatggctggatgggactagatattggtccagactccatcaagacattcagcgaagcgctggacacaaccaagaccatcatctggaatggtcccatgggtgtttttgaatttgaaaagtttgcagctggaactgaggctgtagcaaagcagctggcggagctgagcggaaagggagtgaccacaatcataggaggaggtgactctgtcgctgccgttgaaaaggttggtttggctgacaagatgagtcacatctctacaggaggcggtgcaagtttggagcttctagagggaaagccactcccaggagtcctcgctctcgacgacgcttgagaatattttaagttcctgtccatgttatttattatacatcgtgtaccaagtcgtctggttttcttgtagccagagcaagccattaatattgtcagcttgagagttctctacggctttcttttagtttggagcctatttaataataaagagatgaaactctgagtaaaaaaaaaaaaaa

SEQ ID NO: 68518 - protein, 401 aa, Brassica napus
MATKRSVGTLKEADLKGKSVFVRVDLNVPLDDNSNITDDTRIRAAVPTVKYLMENGSRVVLCSHLGRPKGVTPKFSLKPLVPRLSELLGIEVVMANDSIGEEVQKLVAGLPEGGVLLLENVRFYKEEEKNDPEFAKKLAALADVYVNDAFGTAHRAHASTEGVAKYLKPSVAGFLMQKELDYLVGAVVNPKNPFAAIVGGSKVSTKIGVIESLLSTVDILLLGGGMIYTFYKAQGHSVGSSLLEEDKLDLARSLMEKAKAKGVSLLLPTDVVIADKFAPDANSKIVPATAIPDGWMGLDIGPDSIKTFSEALDTTKTIIWNGPMGVFEFEKFAAGTEAVAKQLAELSGKGVTTIIGGGDSVAAVEKVGLADKMSHISTGGGASLELLEGKPLPGVLALDDA

SEQ ID NO: 68519 - DNA, 1641 bp, Glycine max
  CDS (194)..(1399)
ccccaaacagggctaatcccaaaaaaaggccacaaccctctcacacgtgtcgttcacacgagtgccacccacctctctctataaatctttctagaaagttccctcactccctgaacctgatcgatctctttaccagttgccacactacaccgagattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttgggacgtcctaaaggtgtaacacctaaatacagtttgaagcctcttgtgccaaggctgtctcaacttctcggaattgaggttacgatggcaaatgactctattggggaggaagttgagaagttggttgcacaacttccagaaggtggtgttttgcttctagagaatgtgaggttctataaggaggaagagaagaatgaccctgagtttgcaaagaagttggcttctcttgctgatctctacgtgaatgatgctttcggcactgcccacagagctcatgcttctacagaaggagtggccaaatacttgaagccctctgttgcaggattccttatgcagaaggaacttgactatctagttggagctgtgtcaaaccccaagagaccatttgctgctatcgttggtgggtcaaaggtgtcttccaagattggagttattgagtccttgttggagaaagttaacgttctcttgcttggtggaggaatgatctttaccttttacaaggctcagggttattcagttggttcatctcttgtggaggaagacaagcttagccttgcaactacacttctcgaaaaggccaaggctaaaggggtttctttgttgcttccaactgatgtggtcatagcagacaagtttgctgctgatgctaacagcaagactgtgccagcatcaagcatcccagacgggtggatgggattagatattggtcccgattccatcaagacatttggtgaagcattggataagacccagaccgtcatttggaatggaccaatgggtgtttttgagtttgataagtttgccacaggaacagaggccatagccaagaaactggcagagctgagtgggaagggagtaacgaccatcattggaggaggtgactctgttgccgctgtggagaaggttggtcttgcagacaagatgagccacatctccactggtggtggtgccagcttagagcttcttgaggggaagcaactccctggtgtccttgcccttgatgatgcttgagtaaacatcactagttcctctgtaatttgtgctttatattattattatggttggatttcagccaacagtggattgaggtacaatgagagagctcttgttgctcctgtagaggcttaatataggttaggtttcgaaataagagggttttgtggcatccttggtgttgcattgagctttgatctaattgttcttgaacaatgttcatttcaaaaggagttttactttgttaaaaaaaaaaaaaa

SEQ ID NO: 68520 - protein, 401 aa, Glycine max
MATKRSVGTLKEGDLKGKRVFVRVDLNVPLDDNLNITDDTRVRAAVPTIKYLTGHGAKVILSSHLGRPKGVTPKYSLKPLVPRLSQLLGIEVTMANDSIGEEVEKLVAQLPEGGVLLLENVRFYKEEEKNDPEFAKKLASLADLYVNDAFGTAHRAHASTEGVAKYLKPSVAGFLMQKELDYLVGAVSNPKRPFAAIVGGSKVSSKIGVIESLLEKVNVLLLGGGMIFTFYKAQGYSVGSSLVEEDKLSLATTLLEKAKAKGVSLLLPTDVVIADKFAADANSKTVPASSIPDGWMGLDIGPDSIKTFGEALDKTQTVIWNGPMGVFEFDKFATGTEAIAKKLAELSGKGVTTIIGGGDSVAAVEKVGLADKMSHISTGGGASLELLEGKQLPGVLALDDA

SEQ ID NO: 68521 - DNA, 1838 bp, Glycine max
  CDS (167)..(1618)
cgataagagaaatccaaaatcctctcaccacacccaatcgttcccgcgttgtcctccacgtcctcatcctttcatcacctctctcttccaccaaacaataaaaacctccaaacccactccagttaactccatacactctctctctctctctctctctctctctacaatggcctcagccgcagcccccacaactttctctctcctccactccaccaccccggcctcctcctcctccgccacctccgcctccccctcgcgcgtgcagctctcctcctccctccgctcgcgcccgctcgcgcgccgccttggcttcgccgcggcggacccgctgctcgcggcgaatgtcgcagcgcgcgtcgcggcggtgagaggaggaaagggcgcgaggggggtggtgtcgatggcgaagaagagcgtgggggagctgagcgcggcggacctgaaggggaagaaggtcttcgtcagggccgacctcaacgtcccgctcgacgacaaccagaacatcaccgacgacaccagaattcgcgccgccattcccaccatcaaacacctaatccaaaacggcgccaaagttattctctccagccacttggggaggccgaagggtgtcactcccaaatacagcttggcacctcttgtgccccggctttctgagctcattggtatccaggttgtcaaggctgaagacagtattggtccagaagtagaaaagttggtggcttctcttccagatggaggtgttcttcttctagaaaatgtgaggttttacaaggaggaagaaaagaatgatcccgagcatgcaaaaaagcttgcctctctggcagatctgtttgtgaatgatgcatttggtactgctcacagggcacatgcatcaacagagggtgttactaaatacctgaagccatctgttgctggttttcttttgcaaaaggaacttgattaccttgttggggcggtatcaagccccaaaaggccatttgctgccattgttggtggttccaaggtctcatctaaaattggagtgattgagtcacttttggaaaaagttgacattcttcttcttggtggaggaatgatcttcacattttacaaggcacaaggtctttcagtgggttcatcccttgtagaagaagataagttggatcttgctacatcactacttgcaaaagccaaggaaaagggggtgtctctcttgttaccaagtgatgtggtgattgcagacaaatttgcccccgatgcaaacagcaaggtcgtgccagcatctgccatccctgatggctggatgggattggatattggtccagattctgttaaatcattcagtgaagcattggatactacccaaaccatcatatggaatggaccaatgggagtgtttgagtttgacaagtttgctgttggtacagaggctattgcaaagaagctggctgatctcagtggaaagggggtgaccacaattatcggaggaggagattctgttgcagctgtggagaaagtaggagttgctagtgtcatgagccacatatctactggtggtggtgccagtttggagttattggaaggcaaagagcttccaggagtccttgctctcgatgaagccgtcccagttgccgtgtaagacaattttcagcttggaaaatttttccatcctcagatttcggtgttgtcaatcttgtaaaagagcatatgttgtaggacccttcggagtctgttagtgtaaattttatcatgcttgagttattattggcttcacacataaattgcgtgtaactgtaaaccctggctgagagccataaattcgaataaatcttttagttgctgccaaaaaaaaaaaaaaa

SEQ ID NO: 68522 - protein, 483 aa, Glycine max
MASAAAPTTFSLLHSTTPASSSSATSASPSRVQLSSSLRSRPLARRLGFAAADPLLAANVAARVAAVRGGKGARGVVSMAKKSVGELSAADLKGKKVFVRADLNVPLDDNQNITDDTRIRAAIPTIKHLIQNGAKVILSSHLGRPKGVTPKYSLAPLVPRLSELIGIQVVKAEDSIGPEVEKLVASLPDGGVLLLENVRFYKEEEKNDPEHAKKLASLADLFVNDAFGTAHRAHASTEGVTKYLKPSVAGFLLQKELDYLVGAVSSPKRPFAAIVGGSKVSSKIGVIESLLEKVDILLLGGGMIFTFYKAQGLSVGSSLVEEDKLDLATSLLAKAKEKGVSLLLPSDVVIADKFAPDANSKVVPASAIPDGWMGLDIGPDSVKSFSEALDTTQTIIWNGPMGVFEFDKFAVGTEAIAKKLADLSGKGVTTIIGGGDSVAAVEKVGVASVMSHISTGGGASLELLEGKELPGVLALDEAVPVAV

SEQ ID NO: 68523 - DNA, 608 bp, Brassica napus
  CDS (58)..(477)
cagctccccagctccggccaggccgtacagtttaagtaaaaaaaagtgtggtgaaagatgggtcgtgttcgtaccaaaaccgtgaagaaatcatcacgtcaggtgatagagaagtactactcaaggatgacactagacttccacacgaacaagaagatcttggaggaagtcgcgatcatcccgtcgaaaagactacggaacaagatcgctggattctccacacacttgatgaaacgtatccaaaagggtccagtccgcgggatctcgctcaagctgcaagaggaggagcgcgaacggagaatggactttgtccccgacgagtcggcgattaaaacggatgacgttaaggtggataaagagacgctagagatgcttgcttcattggggatgtctgatgtttccgggttttctcaagtggagacacaagcagccgtggtaccgagcaatgcgtttggccgtggtggaagaagattctaaggcatttttttgaatcaacaaatgagttttgttttgttttttggagtgtttatggattaattcaacgttgtttccatggattcgagattaaaaatttacgagctctcactttgttctaaaaaaaaaaaaaa

SEQ ID NO: 68524 - protein, 139 aa, Brassica napus
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDDVKVDKETLEMLASLGMSDVSGFSQVETQAAVVPSNAFGRGGRRF

SEQ ID NO: 68525 - DNA, 520 bp, Brassica napus
  CDS (13)..(426)
agaggcgaaaagatgggacgcgtgcgcacgaagacggtgaagaagtcctctcgccaggtgatcgagaagtactactctcgcatgacgctcgatttccacacgaacaagaagatcctcgaggaagtcgcgatcattccttcgaagcgcctccgcaacaagatcgccggattctccactcatctgatgaagaggatccagaagggacccgtccgcgggatctccctcaagctccaggaggaggagcgcgagcgccgcatggacttcgtccccgacgagtccgccattaaaaccgatcgcatcgaggtcgataaggagacgctggacatgcttgcctccttggggatgggagatttgccaggtgtcgtcaaggtggagccggtctcggctgcccctatcgcaggctttggccgtggaaggaggttctagaagaatcgatcctttaagtatcttttcgtatgtgtttgttttgctgaacgttgaatgttcttataagctttaatgttaacaaaaaaaaaaaaaa

SEQ ID NO: 68526 - protein, 137 aa, Brassica napus
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDRIEVDKETLDMLASLGMGDLPGVVKVEPVSAAPIAGFGRGRRF

SEQ ID NO: 68527 - DNA, 626 bp, Brassica napus
  CDS (54)..(464)
cgcttcttcatcttcctcgcaggtaagtaagtaagtcaagagataactgaaagatggggcgtgtccgtaccaagaccgtgaagaaatcttctcgccaagtcatcgagaagtattactctcgcatgacactcgacttccacacgaacaagaagatcctcgaagaagtcgcaatcatcccttcgaagcgtctccgcaacaagatcgccggattctccacccatttgatgaagaggatccagaagggaccagtccgtggtatctcgctcaagcttcaagaggaagagcgtgagcgccgcatggactttgtccccgatgagtctgctatcaagaccgatgtgatcaaggtggacaaggagactctagagatgcttgcttcccttggaatggctgacactcctggcttctctgaagtcgagacacaggctccggctcctgcttttggcaggcctcccagaaggttctgaggagtttgctctttattatcagccaatcaaaatgctgttgctttttcaatcttagggacacaagagttgcagttctctgagtgtttatgtcttttgattcgagacttatgtctgaaactgaaatttaagacttttttctatattccataaaaaaaaaaaaaa

SEQ ID NO: 68528 - protein, 136 aa, Brassica napus
MGRVRTKTVKKSSRQVIEKYYSRMTLDFHTNKKILEEVAIIPSKRLRNKIAGFSTHLMKRIQKGPVRGISLKLQEEERERRMDFVPDESAIKTDVIKVDKETLEMLASLGMADTPGFSEVETQAPAPAFGRPPRRF

SEQ ID NO: 68529 - DNA, 599 bp, Brassica napus
  CDS (33)..(437)
gaattcccgggtcgacaggtgagcgaatggcgatggttgggcaccgtcctcgccgtgttgaagtcacggcggttcacatactcctaatactagcggtggttcccagcgatctgtcaatctctgcaggagctgagaaatcggtggctgcatttgtgcagaacgccatattgtccaacaagattgtcatcttctccaagtcctactgcccgtattgcttgcgctcgaaacgcattttcagagaacttaaggaacagccttttgtcgtggagcttgatctcagagaggacggagataaaatacagtacgagcttctggaatttgttggtcgccgtaccgtcccccaagtttttgttaacggcaagcatattggtggctctgatgatcttgcagattctgtggagaatggtcagttgcaaaagcttcttgctgctagttagacttttcagaagctggaacttatgttgtgatttaaaagaatagaagaatctttggtagtaaacttgaatcaatgaattggtgtgtcacatgtttactgacttggttttgctccttatatataataaagttatgatggggcttggtattaaaaaaaaaaaaaa

SEQ ID NO: 68530 - protein, 134 aa, Brassica napus
MVGHRPRRVEVTAVHILLILAVVPSDLSISAGAEKSVAAFVQNAILSNKIVIFSKSYCPYCLRSKRIFRELKEQPFVVELDLREDGDKIQYELLEFVGRRTVPQVFVNGKHIGGSDDLADSVENGQLQKLLAAS

SEQ ID NO: 68531 - DNA, 727 bp, Zea mays
  CDS (94)..(474)
gaattcccgggtcgacgatttcgttgggtcaggaaaaggacgagagcggaaaggaccgaacggctcgggttgatccatcggatccgaaggggcatggctctggtcagattggcgtttcccgtgttcttcttcctcgcagcggcggagttcgcggcggggacgcggtcgccgtcggctttcgtacaaaacgccatctactccaaccgcatcaccatcttctccaagacttactgcccctactccatgcgtgctaagcacatatttcgagaccttaaggaagacccatatgttgttgaactagatacccgagtggatgggcgtgacattcaaagtgttctcctggacctagttgggcgtcgtactgtgccacaggtgtttgtcaatggacagcatattggtggctcagacgatacagtaaatgcgctttcaaatggacagctccagaaacttctcgggaagagtcagtcacaatgatgggtcgctggacaagcttgcactgtcaagaacacgtgagtatatgtttgggaggggtgttcttttgtgtttagggctgaacagaatctggtgttgtgacaaccatctgtactgctggatttgtgatctgctcaattgcacccatccatgttttaccttgttcattaaaaaaaaaaaaaaaaaaaaaaaaaaaaaaaaaaaaaaaaaaaaaaaaaaaaaaaaaaaataaaaaaaaaaaaaaaaaagcggccgc

SEQ ID NO: 68532 - protein, 126 aa, Zea mays
MALVRLAFPVFFFLAAAEFAAGTRSPSAFVQNAIYSNRITIFSKTYCPYSMRAKHIFRDLKEDPYVVELDTRVDGRDIQSVLLDLVGRRTVPQVFVNGQHIGGSDDTVNALSNGQLQKLLGKSQSQ

SEQ ID NO: 68533 - DNA, 1374 bp, Glycine max
  CDS (118)..(1200)
actttcactcgaagaaccttgaagcgagtctgggccacagcaaccagcgacaacaactcaatcagctagggttgctttgcttgctatcttgttggaggattttctgttcaagagaagatggtaactagaattgtggatcttcgttcagacacagttacaaagccaactgaagcaatgagagctgctatggcaagtgctgaagttgatgacgatgttctaggctatgatccaactgcttttcgcttagaaacagagatggcaaagacaatgggcaaagaagctgctctttttgttccatctggcactatggggaaccttgtatctgtacttgttcattgtgatgtcaggggaagtgaggttattcttggagacaattgccatatcaacatttttgagaatggaggcattgcaaccattgggggagtgcatccaagacaagtgaaaaataacgatgatggaaccatagacattgatttgattgaggctgctataagggacccaatgggggagctattctatccaaccaccaagcttatttgcttggaaaacactcatgcaaactctggtggcagatgcctctcagttgaatatacagacagagttggagagttagctaagaagcatggactgaagcttcacattgatggggcccgtatttttaacgcatcagttgcacttggtgttccagtggataggcttgtccaggcggctgattcagtttccgtttgcctatctaaaggtataggtgctccagttggatctgttattgttggttccaagaattttattgccaaggctagacgactccggaaaaccttaggaggtggaatgagacagattggcctcctttgtgccgctgcacttgttgccttgcaggaaaatgttgggaagctggaaagtgatcacaagaaagctagacttttggctgatggattaaaagaagttaaaggactgagagtggatgctggttctgtggagaccaatatggtatttattgacattgaagagggtacaaagactagggcagaaaagatatgcaagtacatggaagaacgtggtatccttgtgatgcaagagagttcatcaagaatgagagttgttctccaccaccaaatatcagcaagtgatgtgcaatatgcattgtcgtgctttcagcaagctctagctgtcaagggagtacaaaatgaaatgggcaactagtggaagaatttgaatatggcacgttgctgccatattagtcattaaaaaggaattccgtgttccatttgcctttgctcatttgattttcttaaatgtaccctaaagaacatgcaaagatttacatctttgatgttgttccctgttatgaattatgttgactaaaaaaaaaaaaaa

SEQ ID NO: 68534 - protein, 360 aa, Glycine max
MVTRIVDLRSDTVTKPTEAMRAAMASAEVDDDVLGYDPTAFRLETEMAKTMGKEAALFVPSGTMGNLVSVLVHCDVRGSEVILGDNCHINIFENGGIATIGGVHPRQVKNNDDGTIDIDLIEAAIRDPMGELFYPTTKLICLENTHANSGGRCLSVEYTDRVGELAKKHGLKLHIDGARIFNASVALGVPVDRLVQAADSVSVCLSKGIGAPVGSVIVGSKNFIAKARRLRKTLGGGMRQIGLLCAAALVALQENVGKLESDHKKARLLADGLKEVKGLRVDAGSVETNMVFIDIEEGTKTRAEKICKYMEERGILVMQESSSRMRVVLHHQISASDVQYALSCFQQALAVKGVQNEMGN

SEQ ID NO: 68535 - DNA, 1450 bp, Glycine max
  CDS (61)..(1089)
ccattcgtccaattccaattccgcagacacactactacttctctccttccgattcttctgatggcaaaccaagcttcactctccttctcttcggggtctccagttcacgcgcctctgaagcgcgtgggcacgcacaacggaagcttccactgcgacgaggcccttggctgcttcatgattcgcctcacgaacaaattcaacagcgccgaaatcgttcgctcccgagaccctcaggtgttggaggatcttgatgctgttcttgatgttgggggagtgtatgaccctgctcgagatcggtatgatcatcatcaaaaaggatttgaagaagtttttgggcatggtttctccactaaattgagtagtgctggtcttgtttataagcattttggaaaggagattatagccaaagaacttaaggtagatgaggaacaccgagatgtgcattacatatatttggctgtttacaagagcttcatggaggcaattgatgctatagacaatggaatcaatcggtatgatacagaccaacctccaagatatgtgaataatactcatttatcctcaagagtaggaaggctaaatttagattggacagatcctgatcagtcacctgagaaagaaaatgaggcctttcaacgtgcaatggctcttgctggcagtgagtttctggatagtgttcgatttcatgtcaattcatggttaccagcaaggtcaattgtaatggagaccctagaggctagacatactgttgatcctagtggagaaattctagttttgactaaattgtgtccttggaagcttcacttatttgagcttgagggagagttgaaaaatgacccttctgtcaaatatgttctgtatcaggatgaaagaagcaaacaatggcgagtgcaggcagttgcagtatctcctgacagttttcagagccgaaaggctctaccctcacagtggcaagggttaagggatgaagaattgtcgaaggagtctggcattccaggatgtgtttttgtgcatatgagcggatttattggtggaaacaaaaactttgacggtgccttggccatggcgaaggctgctttgacaatgtagacgaggatcatatgaaccaagggctatcgtttttgcacgctcattcactgtacagtttactgattacattgaaaaatcaaatggagactgggaacagtggtttaaagatagttctatatcaagttctttaactcatttcctgacaggggagtctatcttatccaaattttctttcaatagtttaaccgtgtataagttaatgaatttgttgtgtctattatgttgttatcattgatcttattgttataaccatctgtttataacaatgaacttcttgtgtctatttggttcacttgagaattagaacttcagaaaaaatgacaaatcatttctaaaggtcttctaccaaaaaaaaaaaaaa

SEQ ID NO: 68536 - protein, 342 aa, Glycine max
MANQASLSFSSGSPVHAPLKRVGTHNGSFHCDEALGCFMIRLTNKFNSAEIVRSRDPQVLEDLDAVLDVGGVYDPARDRYDHHQKGFEEVFGHGFSTKLSSAGLVYKHFGKEIIAKELKVDEEHRDVHYIYLAVYKSFMEAIDAIDNGINRYDTDQPPRYVNNTHLSSRVGRLNLDWTDPDQSPEKENEAFQRAMALAGSEFLDSVRFHVNSWLPARSIVMETLEARHTVDPSGEILVLTKLCPWKLHLFELEGELKNDPSVKYVLYQDERSKQWRVQAVAVSPDSFQSRKALPSQWQGLRDEELSKESGIPGCVFVHMSGFIGGNKNFDGALAMAKAALTM

SEQ ID NO: 68537 - DNA, 1427 bp, Triticum aestivum
  CDS (40)..(1107)
cttccccgcgtgcgaccccaaatcctaaaccctttccccatggccgccgccgccggcgccacctcgcccaagcgcctgagggtctactcgtccgccgccggcgacgccgactcctccaacggcgcgggcaacggcaggcgcgtggggacccacaacggcagcttccactgcgacgaggcgctcggctgcttcctcatccgcctcacctcccagttcgcaggcgccgacgtcgtccgcacacgcgactcccagatccttgattcgctggaggccgtgcttgacgttggtggtgtctatgatcccagccggcatcgctatgatcatcaccagaagggcttcaacgaggtctttggacatggctttaacacgaaacttagcagtgctgggcttgtttacaagcattttggtaaggagataattgcaaaggagcttcagcttaatgaggagcatgaagatgttcaccgcgtgtatcttgccatatacaaaagctttgttgaggcacttgatgcaatcgataatggaatcaatcaatatgatacagagcaaacccccaagtatgtgaacaatacacacttgtcttcacgtgttgggcgccttaatccagactggactgatccagatcaatcacctgagaaggaaaatgctgcatttcaacaggcgatggctcttgccggaagtgagtttatggagagtgtccgctttcatgttaagtcgtggctacctgcaagatctattgtcatggagtgtttgctgtcaagaggaaatgttgatccaagtggagaaatcatggttttagatagattctgcccgtggaaacttcatctgtttgagctagagcaggagctgaagactgatcctctgaccaagtatgtgctgtatgaggatgagaggagcaaaggctggcgagtgcaggccgtctctgttgcacctgacagattcgagagccggaaggctcttccagagaagtggaggggcatgagagatgatgaactgtcgaaggaaaccggcatccctggctgtgtgttcatccatatgagtggcttcattggtgggaacaagacctacgaaggagcgctggaaatggcaagagccgccctcaaatgctaattcaaccaaagcaacaagcagtaaaacagtcttacccatgctacgactgattgaggttcatatgcagcgctgcacttgcaccaattttaccattgactagttggcatttgaatatgtacgttccgtggcataaaacatccacctgatagcagagattggttatcttatccgtatgaggctgaacaagtagagttatatttgatgaaagacgatgaaactcattaatttcttgcccttcaccagtgtttcattactgctacaagcataagcgactgaataactgtatcttaaaaaaaaaaaaaccgacacgcagcggccgc

SEQ ID NO: 68538 - protein, 355 aa, Triticum aestivum
MAAAAGATSPKRLRVYSSAAGDADSSNGAGNGRRVGTHNGSFHCDEALGCFLIRLTSQFAGADVVRTRDSQILDSLEAVLDVGGVYDPSRHRYDHHQKGFNEVFGHGFNTKLSSAGLVYKHFGKEIIAKELQLNEEHEDVHRVYLAIYKSFVEALDAIDNGINQYDTEQTPKYVNNTHLSSRVGRLNPDWTDPDQSPEKENAAFQQAMALAGSEFMESVRFHVKSWLPARSIVMECLLSRGNVDPSGEIMVLDRFCPWKLHLFELEQELKTDPLTKYVLYEDERSKGWRVQAVSVAPDRFESRKALPEKWRGMRDDELSKETGIPGCVFIHMSGFIGGNKTYEGALEMARAALKC

SEQ ID NO: 68539 - DNA, 1604 bp, Brassica napus
  CDS (42)..(1469)
cgcgactgtgtgtaatctaaagcaatcgtagatcttcgaagatgggtggtgcggtgaaggatattgcttcaaagcccgagcttgataacattcgccagagcggcgcaccggtggtgcttcacttctgggcttcgtggtgtgatgcttcgaagcagatggatcaagtcttctctcacctcgctaccgacttccctcgcgcccacttctttagggtagaagctgaggaacatcctgagatatctgaagcttactctgtttctgctgttccctatttcgtcttcttcaaggatggcaaagctgtggatacacttgagggagcagatccatcaagtttggccaataaagttgacaaagtcgctggttccagcacttctgctgagcctgctgctcctgcaagcctaggcctggctgcaggtccaacgattctagaaaccgtgaaggagaatgcgaaagctacttcgaaagaccgagctcagcctttatcctccaccaccaaggaagctctcaatacccgtttggagaaactcaccaactctcaccctgttatgttgttcatgaaaggtacccctgaggagcctaggtgcggtttcagcaagaacgtagttaacatcttgaaggaggaggaagttgagttcggaagtttcgatatactttcggacaatgaagtccgtgaaggtctgaagaagttctccaactggccaacgtaccctcagctgtacagcaacggagagctactcggtggagctgacattgtgatagcgatgcacgagagcggcgagctgaaggaagctttgactgatgaagctggaaaaggaggaggtgggatcacttcaggcagcacaggagggttaagcgagacgctccgagctcggctcgaagggcttgttaactcgagtccagtgatgctgttcatgaaaggaaagccagaagagccaaagtgcgggttcagtgggaaagtggttgagattctcaaccaagagaagatcgagttcgcaagctttgatatactcttggatgatgaagttcgccaagggcttaaagtgtactcaaactggtcgagctaccctcagctctacgtcaaaggcgagcttctagggggatcagacattgtcttagagatgcaaaagagcggcgagctgaaacaagttttttccgagaaaggaaagagtcttgaagagagattaaagtcgttgattaactctgagaaggttatgcttttcatgaaaggctcaccggatgaaccaaagtgcgggtttagctccaaagttgtgaaggcgctgagagatgaagatgtgagttttgggtcgtttgatatattgagcgacgaagaagtgaggcaagggattaagagcttctcgaactggcctacgtttcctcagctttactataaaggtgagttggttggagggtgtgatatcattatggagctgagtagcagtggtgatctcaaagcaacattgtccgagtaaaagcaatagtttctctcttctttttttttttttgccttttggtgagaagatgctatttctgtttaggtgttgcaaacattgtttttacttattgtttttacttaaagttatggttatttggaaaaaaaaaaaaaa

SEQ ID NO: 68540 - protein, 475 aa, Brassica napus
MGGAVKDIASKPELDNIRQSGAPVVLHFWASWCDASKQMDQVFSHLATDFPRAHFFRVEAEEHPEISEAYSVSAVPYFVFFKDGKAVDTLEGADPSSLANKVDKVAGSSTSAEPAAPASLGLAAGPTILETVKENAKATSKDRAQPLSSTTKEALNTRLEKLTNSHPVMLFMKGTPEEPRCGFSKNVVNILKEEEVEFGSFDILSDNEVREGLKKFSNWPTYPQLYSNGELLGGADIVIAMHESGELKEALTDEAGKGGGGITSGSTGGLSETLRARLEGLVNSSPVMLFMKGKPEEPKCGFSGKVVEILNQEKIEFASFDILLDDEVRQGLKVYSNWSSYPQLYVKGELLGGSDIVLEMQKSGELKQVFSEKGKSLEERLKSLINSEKVMLFMKGSPDEPKCGFSSKVVKALRDEDVSFGSFDILSDEEVRQGIKSFSNWPTFPQLYYKGELVGGCDIIMELSSSGDLKATLSE

SEQ ID NO: 68541 - DNA, 2173 bp, Zea mays
  CDS (138)..(1922)
gaattcccgggtcgacttcgctgtcgacgatttcgtcgacttcatactgctcgcctcgccgtctttcccccaatctgttgctcctccaagctgcgggcgatcgccgtaccccggccgccgcagggaaccccctcgccatggccttgcaggggaagaagctcatcaacaaccccgacgatgtggtgacggagttcatcgaagggttggtggagacttacccgggtctgcagtacctcgacgggttccctcagattaaggtcgttcttcgtgctgatgtcgagcgcggttcctatgacaaagttgcagtcatctcgggtggtggaagtggccatgaaccttcccatgctggatttgttgggccagggatgttgacagctgctgtttctggagatgttttcgcctctccacctgttgattctattttagctgctattcgagctgtaactggtcccatggggtgccttctaatagtaaagaactacactggtgatagactcaattttggattagctgctgagcaggcaaaatctgaaggctataagatggagatggtcattgttggagacgattgtgcccttcctccacctagagggatagctggtagaagaggtttagctggaacaattcttgtgcataaggttgctggggccgcagcagatgctggtttatctcttgcagaggttgccgcagaagcaaaacatgcatctgaggttgttggtacgatgggagttgcactttctgtttgcacattgcctgggcaaataacttctgatcgtctaggtccaaggcaaatggagcttggccttggaattcatggagaacctggagttgctgttgttgaactccagccagttgacgtagtggtagaacatgtccttaaacagatattgtcacaggaaactcagtatcttcctgtcacaagaggttgcaatgctgttctcctagtgaatggattaggagccactcctatcatggaacttatgattgcagcgagaaaagcagttcctgagttgcaattggtgtatggcattgctgttgacagagtctacactggcacacttatgacatcacttgatatggcaggattatctattaccattatgaagtccggcgaaagcattttgaagagacttgatgctcccactaaagctccagcttggcctgttggttctgaaggaaaccgtccaccagcaaagtttcctgttcctctaccaccatcaccttcaatgaaggatgacgagattcttgctccatctcaggagctgagcaagcaagggtgtatcctggaggctgttattgaagcaagtgctactgaaattatcaatctcatggatagcctaaatgaatgggacagtaaagtgggcgatggtgactgtggaagcacaatgtatagaggtgcaacagctattcttgaagatatgaaaaagcgttaccctatgaatgatgcagcgggaacaataaatgaaattggggcaacaatccgaagggtgatgggtggaacaagtggaatcttgtatgccatactctgcaaggctgcgtatgcaagcttaaagcagagctcaactgtcactgcgaataaatgggctgatgctttagaggcctccattgctgctgttagcaaatatggtggtgccagcgcaggataccgcacaatgttggatgccctaattcctgcttctgctgttctgaaacagagacttgaggctggggatgatcccgtgactgctttcatcgcgtcttctgaagcagcatcagctggcgctgaatccaccaaacaaatgcaagcgaaggctggacggtcatcatacatcgctccagatctcctggcctcaatccctgatcctggtgcaatggctgcagctgcatggtacagagctgctgcccttgcagtgaagaacaaagtgcacggttcaaagagctagtagcatacgcaatgcttcattgctagacccaaaatagactgacaggaaaaatcactggggcattttctcactccccttagatttggtttccgcttgtgcttttgcatgggccgagaaaaaaaatgacttccatattgtctcacccttctcacatcatacaaagagatgttcaaagagttcgtcgtccgtacaagttaagggaagctatgcttttgcactgccgtgaaaaaaaaaaaaaaaaaagcggccgc

SEQ ID NO: 68542 - protein, 594 aa, Zea mays
MALQGKKLINNPDDVVTEFIEGLVETYPGLQYLDGFPQIKVVLRADVERGSYDKVAVISGGGSGHEPSHAGFVGPGMLTAAVSGDVFASPPVDSILAAIRAVTGPMGCLLIVKNYTGDRLNFGLAAEQAKSEGYKMEMVIVGDDCALPPPRGIAGRRGLAGTILVHKVAGAAADAGLSLAEVAAEAKHASEVVGTMGVALSVCTLPGQITSDRLGPRQMELGLGIHGEPGVAVVELQPVDVVVEHVLKQILSQETQYLPVTRGCNAVLLVNGLGATPIMELMIAARKAVPELQLVYGIAVDRVYTGTLMTSLDMAGLSITIMKSGESILKRLDAPTKAPAWPVGSEGNRPPAKFPVPLPPSPSMKDDEILAPSQELSKQGCILEAVIEASATEIINLMDSLNEWDSKVGDGDCGSTMYRGATAILEDMKKRYPMNDAAGTINEIGATIRRVMGGTSGILYAILCKAAYASLKQSSTVTANKWADALEASIAAVSKYGGASAGYRTMLDALIPASAVLKQRLEAGDDPVTAFIASSEAASAGAESTKQMQAKAGRSSYIAPDLLASIPDPGAMAAAAWYRAAALAVKNKVHGSKS

SEQ ID NO: 68543 - DNA, 1314 bp, Triticum aestivum
  CDS (139)..(960)
gcggctcaggcgcggctgctccggccgccggctgatcttccctggctcgcctcgcctcctcaaaggcgcaatgtccctgcctcttcaggatacatatcttgtaggagttttgccgtgagaagcaaagtgaccaaggcgatgccttcactgagtgtgagcattcagcctgcatttcctcagccagttactcgggctacatggaagaagaaacacaatgttacatgctatcagagacaaggagctccacagatagaagccaagtcaatggaggaagtatatgattctttggctgagcacattctttctgtcttcaagagtatcgataatcttgattcaaaatatattgttggtctggctggcccacctggtgcaggcaagtctactgttgcctctgaagtggttcgacgcgtcaatatgcgttggtctcagaagcatacaaaagatagttcactgaattcaaatgaagatattgcgacaatgcttcccatggatggtttccacctttatcgatcccagcttgatgcaatgaaggatccaaaagaagcacatgcaagaagaggaacaccatggacattcaatccatcactttttctgaaatgcctacagaccctaaaggaagaggggtcagtctatgctccatcatttgatcatggtgttggtgacccagtcgagaatgacatatttgtaaagccgcagcacaaaatagtgatcgtcgaggggaattatttattactggaagaagatttttggagggaaattagagacatgttcgatgagaaatggttcattgacattgacattgatgtctccatgcaaagagtgctccagaggcatattggcacagggaaagagccagatgtagcagcatggcggatttcatacaatgaccggccgaatgctgagcttatcatggagtcaaaaaaggctgcagatcttgtaatcagatcggtggactactgaagctagaccccatgtttctgatggcaattttgattttcgatttcgtacaatgaccgcccgaatgctgggcttatcatggagtcaaaaaggactgcagatcttgtgatcagattgatggactactcaagctagaccccatgtttctgatggcaattttgattttcggtaataatagttgccctatggcgatgtttgtacatagaataagtcagctggctgtttccatccgtgttgatttagcgcatagaataaggtatgcccccatcaatttgttcttgaggaagaactcaataaatgacactcttcaagtatctaatcattatatcattttattttagcaaaaaaaaaaaaaaa

SEQ ID NO: 68544 - protein, 273 aa, Triticum aestivum
MPSLSVSIQPAFPQPVTRATWKKKHNVTCYQRQGAPQIEAKSMEEVYDSLAEHILSVFKSIDNLDSKYIVGLAGPPGAGKSTVASEVVRRVNMRWSQKHTKDSSLNSNEDIATMLPMDGFHLYRSQLDAMKDPKEAHARRGTPWTFNPSLFLKCLQTLKEEGSVYAPSFDHGVGDPVENDIFVKPQHKIVIVEGNYLLLEEDFWREIRDMFDEKWFIDIDIDVSMQRVLQRHIGTGKEPDVAAWRISYNDRPNAELIMESKKAADLVIRSVDY

SEQ ID NO: 68545 - DNA, 1344 bp, Glycine max
  CDS (98)..(997)
gcagacttagaaagagagagagagagagaatgggtctcatctcaatgcaatttaggttctgaaaaccaaagcttttcataggaaaagttgtgctaagatgccagggaaacctgacactgatgattggcgtgtagagcgtggggagcagattcagtttcagtcttccatttactctcatcatcagccttggtggcgcggagtgggggaaaatgcctccaaatcatcttcagatgatcagttaaatggttcaatcgtgaatggtatcacgcggtctgagaccaatgataagtcaggcggaggtgttgccaaagaataccaaaacatcaaacatgccatgttgtcaaccccatttaccatggagaaacatcttgctccaaatccccagatggaacttgttggtcattcagttgttttaacatctccttattcagatgcacagtatggtcaaatcttgactacttacgggcaacaagttatgttgtatggaatgcatcatgctagaatgcctttgccacttgaaatggaagaggagcctgtttatgtcaatgcgaagcagtatcatggtattttgaggcgaagacagtcacgtgctaaggctgagattgaaaagaaagtaatcaaaaacaggaagccatacctccatgaatcccgtcaccttcatgcaatgagaagggcaagaggcaacggtggtcgctttctcaacacaaagaagcttgaaaataacaattctaattccacttcagacaaaggcaacaatactcgtgcaaacgcctcaacaaactcgcctaacactcaacttttgttcaccaacaatttgaatctaggctcatcaaatgtttcacaagccacagttcagcacatgcacacagagcagagtttcactataggttaccataatggaaatggtcttacagcactataccgttcacaagcaaatgggaaaaaggagggaaactgctttggtaaagagagggaccctaatggggatttcaaataacacttccctcagccatacagcaagagttaggtgaagatgaagggctttatctcatccaacttgtgatgctgtatagaaggcaattcattcttggcttagttaagtggtgagaccagtgacatggtgtacactatggccttgtttggtctctcccttgcttttgtttctctctacaagtccatatgtaaaatggataacagaaagaaaaagaaaaatcactttggtttgagaactttttaaagtttatattaactgtgttaaggttcataaaactgtagactgatttgtgtgacatgctccacagaaccttaaattttcctctattttgtcctgaaaaaaaaaaaaaa

SEQ ID NO: 68546 - protein, 299 aa, Glycine max
MPGKPDTDDWRVERGEQIQFQSSIYSHHQPWWRGVGENASKSSSDDQLNGSIVNGITRSETNDKSGGGVAKEYQNIKHAMLSTPFTMEKHLAPNPQMELVGHSVVLTSPYSDAQYGQILTTYGQQVMLYGMHHARMPLPLEMEEEPVYVNAKQYHGILRRRQSRAKAEIEKKVIKNRKPYLHESRHLHAMRRARGNGGRFLNTKKLENNNSNSTSDKGNNTRANASTNSPNTQLLFTNNLNLGSSNVSQATVQHMHTEQSFTIGYHNGNGLTALYRSQANGKKEGNCFGKERDPNGDFK

SEQ ID NO: 68547 - DNA, 1344 bp, Brassica napus
  CDS (263)..(1180)
gtggcagtggtggtgctcatggcgatggtggtttcccagtaaagctaagagagatagaaatcgacatagacaaagaatcaaaagaaggatcacaccagtccaatacgacacgcaccctctgattcacttagtttcattcaaaatttcaaagagacaacaacagtccactttgttctgtaaggacagggagacatgcaaaactaatcgtcgtttcatccaactcaaaaggtactcttcttgtgaggacagcttgttgggcgttatgcatcagatgaataagaaagattccactttgccatacctgaacactagcatctcatggggtggtgtggatgcaagacctgaacatatgcaaaccactaagcaaatcagttttcaggatctggattcaccttcatctcagtccacttgtcaatcttacactgaagttgcaagcagtggggatgataatccttccatacaaatctcgttttcaacaaagtcaggatctgaagaaactcaacataaaggatttgcaactcatcctaactcagcctcaatgacaggagtcccaagtattcactttgctcctacgcagattggtggtttattggctgcaacatatctaccacatgcaccgacatgccatccccaaatggtgggtatggttcttggtcgagttccactaccagtggagatcacagaaactgagccagtttttgtcaatgcgaagcaataccacgcaatcatgaggagaagagagcaacgtgccaagcttgaggctcaaaacaaactaatcaaagccaggaagccttatcttcatgaatcacgacatgttcatgctctcaaaaggccaagaggatctggtggaagattcctaaacaccaaacaacttctccaagaatccgaacaaactgctgctaaagaacaagaacgtgacaagctggtccaacagggaagcaaaaaggcaaacatgtctagattggacgctcatatgctgcagcacaacaaagaccgtggctcaaccacttctggctcagacatcacatctgtttccgacggtgctgatatcttcggacacaccgagtttcagttgtcaggttttccaacaactcagactaaccgagctatgcttgttcatggacaatccaatgacatgcatggaggtggggacttgcaccatttctctatccatatctgagacattggatctttggtgctgtttcaatgtttcccaccaaaaggggaagtcatccttggctactactactagttcttttgcttgttgttacttgttattgttttcatgtatgtggtatacatcacaagaacaaccaaaatatttactttgaaaaaaaaaaaaaa

SEQ ID NO: 68548 - protein, 305 aa, Brassica napus
MHQMNKKDSTLPYLNTSISWGGVDARPEHMQTTKQISFQDLDSPSSQSTCQSYTEVASSGDDNPSIQISFSTKSGSEETQHKGFATHPNSASMTGVPSIHFAPTQIGGLLAATYLPHAPTCHPQMVGMVLGRVPLPVEITETEPVFVNAKQYHAIMRRREQRAKLEAQNKLIKARKPYLHESRHVHALKRPRGSGGRFLNTKQLLQESEQTAAKEQERDKLVQQGSKKANMSRLDAHMLQHNKDRGSTTSGSDITSVSDGADIFGHTEFQLSGFPTTQTNRAMLVHGQSNDMHGGGDLHHFSIHI

SEQ ID NO: 68549 - DNA, 1285 bp, Hordeum vulgare
  CDS (190)..(921)
ccaagccaagccaagccaagcagagagagagagaggagactttgcagaggaggggaggggagagagagagagagagagaggcggagcaagttgcggaggagggaggaggggtcgccggaaaggggacatgctcccttcacatctcacatctcacagcttgaactgaaagcaagagtagaagcccatgagatgagacgcaagcaaaatatgcatgaaaatggcacaatcatgattcagtttggtcagcaagtgcctaattacgagtcatcagctagcgattctcctcaagaagtgtccggaatgagcgaaggaagctttaatgagcagaatgatcaatctggtaatcgtgatggttacacgaagagtgatgaaggcaagatgatgtcggctttatctctgggcaattcagaaacagcgtacacaccgccaaaacctgaccgcactcatcccttcgccatatcatacccatatgctgatccttactatggtggtgcggtggcagcttatggcacgcatgctattatgcacccccagatggtgggtatggtaccatcctctcgagtgccactaccaattgaaccagctgctgccgaagagcccatctatgtaaatgcgaagcaataccatgccattctccgaaggagacagctccgcgcaaaattagaggctgaaaataagcttgtcaaaagtcgcaagccgtacctccatgagtccaggcatcagcacgcgatgaagcgggctcgggggacaggcgggcggttcctcaacgcgaaggagaagtccgaggcggcttccggcggcggcaatgcatcggcgaggtctgggcatgccagcgttcctgcggacggcggcatgttctcgaagcacgaccacaccttaccgtccggtgacttccattaccgcgcgagagggggcgcctagggcggcgccgttgccccctggcaaatcatccttggcttatgtgtgtggcgaccgtcaactcggtcgaatgataatactgtagtaaactgaaagatttggggattgaaactgttacttggggtgtttggtagacagtctgttccgtttggggacgatgcgggccagtctctctgttggtggtagattcgtggcatggcaggtgctgctaagctggagcctgcttgaactgtttttcctgtcacttttatggggtaataaggaccatcatgtatgatactggagtagtactgagttggagtaattaccattcccggcgtgatgccttgcgcccgtggtggtgtctcttttgaaaaaaaaaaaaaaa

SEQ ID NO: 68550 - protein, 243 aa, Hordeum vulgare
MRRKQNMHENGTIMIQFGQQVPNYESSASDSPQEVSGMSEGSFNEQNDQSGNRDGYTKSDEGKMMSALSLGNSETAYTPPKPDRTHPFAISYPYADPYYGGAVAAYGTHAIMHPQMVGMVPSSRVPLPIEPAAAEEPIYVNAKQYHAILRRRQLRAKLEAENKLVKSRKPYLHESRHQHAMKRARGTGGRFLNAKEKSEAASGGGNASARSGHASVPADGGMFSKHDHTLPSGDFHYRARGGA

SEQ ID NO: 68551 - DNA, 1369 bp, Brassica napus
  CDS (29)..(1018)
gggacgcgggtgatcgatcggagagaatatgagcaacgtcaccgccgatccaactaccgacggaccttccaccgccgtcgcagtctccggctctgcagcaatccaggcttcgcctcctaccgatcgtcccgtccgcgtctacgccgacgggatctacgatctcttccactttggccacgctcgatctctcgaacaggccaagaaatcgtttccaaacacttaccttcttgtgggatgttgcaacgatgagactactcataagtacaagggaaggactgttatgactgctgaagagcgttatgaatcacttcgtcactgcaagtgggtggatgaagtcattcccgatgcaccgtgggtgatcaaccaagagtttcttgataaccaccggattgactacgttgcccatgattcccttccgtatgcagacaccagcggagctggaaaggatgtctatgaatttgttaagaaagttgggaggtttaaggaaacaatgcgaactgaagggatatcgacctcggacattatcatgagaatagtgaaagattataaccagtatgttatgcgtaacctggatagaggttattcaagggaagatcttggtgttagctttgtcaaggaaaagagacttagagttaatatgaggcttaagaaactccaggagagagtcaaagaacagcaagaaaaagtgggagaaaagattcaaactgtaaaaatgctgcgcaacgagtgggtagagaatgcagatcgatgggtcgctggatttctggaaatatttgaagaaggttgccataagatggggactgcaatcagagacagtatccaagagaggttaatcagacaaattcccagaaagaagctggagaacggtgaggatgatgatacagacgatcagttctatgaagaatatttcgaccatgacatgggcagtgacgaggatgaagatgaacgatactatgacgaagaggaagatgttgaagaagagaaaagtgttaagaaggatgcacaagacaacaagtaagatcattattctcatgatcacttctactaaactcccttagtgtctcactcttatctcccttagtgtctcactctctcctctctcagtaatacgcgtctacttaacatataatatcaaatgtttagaaagggagagctaagtgagcgtgtttgtgatgtgtgttttaaaaaatcgaacgtgcgtgcttgtctttagtaagttgtctcatcgttgttgatttttgtatgcgcatgatttctctttaatttggatacttggtgtcttgtgcatcttttatttcatagtttttcttacctttgtataacaggcaaagtgttatgaataatgcaatggtgtgaaaaaaaaaaaaaa

SEQ ID NO: 68552 - protein, 329 aa, Brassica napus
MSNVTADPTTDGPSTAVAVSGSAAIQASPPTDRPVRVYADGIYDLFHFGHARSLEQAKKSFPNTYLLVGCCNDETTHKYKGRTVMTAEERYESLRHCKWVDEVIPDAPWVINQEFLDNHRIDYVAHDSLPYADTSGAGKDVYEFVKKVGRFKETMRTEGISTSDIIMRIVKDYNQYVMRNLDRGYSREDLGVSFVKEKRLRVNMRLKKLQERVKEQQEKVGEKIQTVKMLRNEWVENADRWVAGFLEIFEEGCHKMGTAIRDSIQERLIRQIPRKKLENGEDDDTDDQFYEEYFDHDMGSDEDEDERYYDEEEDVEEEKSVKKDAQDNK

SEQ ID NO: 68553 - DNA, 1783 bp, Zea mays
  CDS (140)..(1414)
gaattcccgggtcgacgatttcgtccaccctccccccccccactctctcctcgcatggcgacagccccttgccggtagccctagatccagacatccctcgcccacgcagcaacagccctcctccctcccacctccatccatgcccatggacgcggggaatggctgcagtgcccgggcgctggtggcgtgcgtcatcggcagcatcgtgctgggcgcctcggtgctcgcgctccacctcgcgggcgggcctgccgccatcccgcacctgcccctgcctccgcttttcggcacgctccgccgccgccgccgccgccccgtgcgggtctacatggacggctgcttcgacatgatgcactacggacactgcaacgcgctgcgccaggcgcgcgcgctcggggacgagctcgtcgtcggcgtcatcagcgacgacgagatcaaggccaacaaggggccccccgttacgccgctccacgagagaatgataatggtccgtgctgtgaaatgggtagatgacatcattccagatgcaccttatgccataactgaagaattcatgaacaagctgttcaatgagtataacatagattacatcatccatggagacgatccttgtttgctaccagacggtactgatgcatatgctcttgccaaaaaggctggtcgatacaagcagattaagagaaccgagggagtgtcaacaacagacattgttggacggatgcttctttgtgttagagagagatcatctgatgcacataatcattcttcactacaaaggcagttcagtagcggacatggtcagaaagtcgatgatactggatctggaactggtacaagagtatctcatttccttcccacatctaggcgaatagttcagttctcaaatagcaggggtccaggtccagattctcgaatagtttacatggatggtgcttttgatctgttccatgctggacacgtcgagatattacgacttgctcgagaacttggagattttttgcttgtggggattcacacagatcagaccataagtgcaacacgaggacgacatcgcccaatcatgaatctccatgagcgaagtttgagtgttttggcttgtcgttatgttgatgaggtgatcattggtgctccatgggatgtttcaaaagacatgattaccacattcaatatttcgttagttgttcatggaactattgctgaaaacatggactttacggaggatgatttacacccatatgctgttccaatggctatgggcatttaccgccgactggagagtcccttggatatcactacaagtactatcatcaggaggattgttgctaaccacgaagcctaccagaagcggaacgagaagaaggaagcaagcgagaagaagtactacgagagtaaaagcttcgtcaacggggagtgaagttacgagtagcagaacttggatgaagattgctgcctagaccgtttagcaactgcaacagttgggcgatctacagactacagccgtaccttttcttcggtatctttgatgttccgctgacatagcttaggaagcatgagcaaaaatgactaggcagaggagatggcgagtctaggagcatttccatcgtttccctagcgtcttcagccaattccctgcccccgctgtattgtatgtatatgcgccttccagctgagttgcatttgagatctataggcttttccacccattgaaactatgcgccacagtatgaaaaccctgaatgttagcgtggttgacaactaaaaaaaaaaaaaaaaaagcggccgc

SEQ ID NO: 68554 - protein, 424 aa, Zea mays
MPMDAGNGCSARALVACVIGSIVLGASVLALHLAGGPAAIPHLPLPPLFGTLRRRRRRPVRVYMDGCFDMMHYGHCNALRQARALGDELVVGVISDDEIKANKGPPVTPLHERMIMVRAVKWVDDIIPDAPYAITEEFMNKLFNEYNIDYIIHGDDPCLLPDGTDAYALAKKAGRYKQIKRTEGVSTTDIVGRMLLCVRERSSDAHNHSSLQRQFSSGHGQKVDDTGSGTGTRVSHFLPTSRRIVQFSNSRGPGPDSRIVYMDGAFDLFHAGHVEILRLARELGDFLLVGIHTDQTISATRGRHRPIMNLHERSLSVLACRYVDEVIIGAPWDVSKDMITTFNISLVVHGTIAENMDFTEDDLHPYAVPMAMGIYRRLESPLDITTSTIIRRIVANHEAYQKRNEKKEASEKKYYESKSFVNGE

SEQ ID NO: 68555 - DNA, 1866 bp, Glycine max
  CDS (224)..(1486)
gaattcccgggtcgacttcgctgtcgacgatttcgtgttttgttgcaaagcaaaaaaactacgaggagctttcctccatacgaatccaaggaggagagaggagacacagacacaaaggaaacggaaaaagcaacacacacaaaaaaggtctgtgcctcctcttatatgtaatagatagtttctgaaacaaaagaaaaaaataaaataaaaataaaaggaccacatggattatgaaaacaacagttggatttgggagggggtaaactactacccgcgtgtgtttggtggtctaatggttacagcagccttgctgggcttgtcaaccagctactttggtgggattggggttccatatttgtcactgccatgttcctggtctaatttggggatttttcacaagaagaaatcggggaagaggcgcattcgggtgtacatggatggctgttttgatctgatgcattatggccatgccaatgcactcaggcaagcaaaggctctaggagatgaactggttgtgggtcttgtgagtgatgaggagatcgtggccaataaagggccacccgttttgtccatggaggagaggctggcccttgtcagtggattgaagtgggtggatgaggtcataactgatgctccttatgcaattaccgagcaattcttgaatcgtctctttcatgaatacaagattgactatgtcatacatggcgatgatccttgcctgcttccagatggaacagatgcatatgctgcagcaaagaaagctggtcgttacaagcaaattaaacgtactgaaggagtttccagtacagatatcgtaggaagaatactgtcttctttaagagatcaaaagaattgtgacgatcataatggcactgaggtaaaacctcaagaagaaaaccagtcacaggcttcccacatagcccaattcctaccaacttctcgacgtattgtccagttttcaaatggcaagggtcctggaccaaattcacgtattgtatacattgatggggcatttgatctcttccatgcaggccatgttgagatacttaagagggctagggagcttggagactttcttctagttggtatccactcagatgagacagtgagtgagcatagaggaaatcactatccaattatgcatctgcatgagcgtagccttagtgtgttagcttgccgttatgttgatgaagttattattggttcaccttgggaaattacaaacgacatgatcaccactttcaatatctcagtagttgtgcatggtactgtttctgagaagtcattaaattgtgaactagatccatatgagatccctaagagcatgggaatattccgcttgctcgaaagcccaaaagatattactactgccacagttgcccaaaggataatggctaatcatgaagcttatgtgaaacgcaatgctaagaaaactaggagtgagcagagatactatgaagagaaaaaatacgtctctggagactagagtgtatataatgatcttttacattagttcggtactgctcttcaagcttgaccctgtcacagagatgccaccactatagtatgaattgaatctatacacactttgtgaaggacattagtacagggtatgtataacataggagtggcgataactcgggaataccgatgtactttaatgtcctgacgttttatttctgttttctgaaaggcaaccatgtggtttgctcaccagttttatgccatttggtttttgctgtggttttgatgtttttagtgtactccaattagagattccttactctgatagtatgtattgtgactatcagaagttatacgcatcagaagggccttgcctttatttatttctaaaaaaaaaaaaaa

SEQ ID NO: 68556 - protein, 420 aa, Glycine max
MDYENNSWIWEGVNYYPRVFGGLMVTAALLGLSTSYFGGIGVPYLSLPCSWSNLGIFHKKKSGKRRIRVYMDGCFDLMHYGHANALRQAKALGDELVVGLVSDEEIVANKGPPVLSMEERLALVSGLKWVDEVITDAPYAITEQFLNRLFHEYKIDYVIHGDDPCLLPDGTDAYAAAKKAGRYKQIKRTEGVSSTDIVGRILSSLRDQKNCDDHNGTEVKPQEENQSQASHIAQFLPTSRRIVQFSNGKGPGPNSRIVYIDGAFDLFHAGHVEILKRARELGDFLLVGIHSDETVSEHRGNHYPIMHLHERSLSVLACRYVDEVIIGSPWEITNDMITTFNISVVVHGTVSEKSLNCELDPYEIPKSMGIFRLLESPKDITTATVAQRIMANHEAYVKRNAKKTRSEQRYYEEKKYVSGD

SEQ ID NO: 68557 - DNA, 1262 bp, Hordeum vulgare
  CDS (27)..(905)
ccacccctgtcccggagcaaccagcgatggcgcgcgtctccagttccaggaagcgcatgctccacaccaacagcaacaagaagggcgacgaggttgtcgccaccgccaccgccagcgccacggccagcgacggccgccccgtccgcgtctacgccgacggcatcttcgacctcttccacttcggccacgcccgcgccctcgagcaggccaagctgctgttccctaacacgtacctgctggtgggatgctgcaacgacgacctcacgcggcgctacaagggcaagaccgtcatgaaccaggaggaacgatacgagtccctgcgccactgcaagtgggttgatgaggtcattcctgatgccccctgggttctcacgccagaattcattgagaagcatcagattgattatgtcgcacatgatgctttgccttatgctgatacaagcggtgcttcaaatgacgtctatgagtttgtcaagaagattggaaaattcaaggaaacaaaaaggactgatggagtatcgacatcggacctcataatgaggatagtgaaggattacaaccagtatgtcatgaggaatttagcacgaggttactcaaggaaagatatgggcgtgagctatgttaaggagaaacaactgcaagtgaatatgaagatcaataaactgcgggagactgtgaaggcgcagcaagaaaagttgcaaacggtggcgaagacggctgggataaaccacgaagagtggctggcgaacgcggatcgctgggtggcgggcttcctggagaagttcgaggagcactgccacgtcatggagactgccatcaaggaccggatacaggagaggctggggaggcaggccggcaaaggcatagcggccggtctcatgcggcagccggtggcggcggcctgatcttccagaccaggtcttggtgatggtttgaacgaacaccgagaaagcgagaagttgctagttgtgtgcttgtgtcatggaatgtgatgcttgtgcgagtaaagtggttgagttagctgagcaaatcctttgtattattgttttttttgtttgttggtggaggatgtgcgtgcgtgtgtgtattgtttcacagttttgtactacgcagatgtctatagcagaggcgtttggtgtcgagcgtctacctactatgtggagagagttttttttttaaagctatgtggagagagttttgttgcccttgttctttgtaggctgtatcttttgtaatgagggatggacaaaaaaaaaaaaaaa

SEQ ID NO: 68558 - protein, 292 aa, Hordeum vulgare
MARVSSSRKRMLHTNSNKKGDEVVATATASATASDGRPVRVYADGIFDLFHFGHARALEQAKLLFPNTYLLVGCCNDDLTRRYKGKTVMNQEERYESLRHCKWVDEVIPDAPWVLTPEFIEKHQIDYVAHDALPYADTSGASNDVYEFVKKIGKFKETKRTDGVSTSDLIMRIVKDYNQYVMRNLARGYSRKDMGVSYVKEKQLQVNMKINKLRETVKAQQEKLQTVAKTAGINHEEWLANADRWVAGFLEKFEEHCHVMETAIKDRIQERLGRQAGKGIAAGLMRQPVAAA

SEQ ID NO: 68559 - DNA, 1321 bp, Zea mays
  CDS (103)..(975)
gaattcccgggtcgacgatttcgtctgagcagttcgaccaggcagccatccacctccaaccccccttcgcctgcgcaaatcgttaccatcccagcgagaaagatggcgcgcgtctccaatgccaagaagcggcagggcgccaagcccgcctccgcgctcagcagcaccgacaccagcaccgccgcaaagaggaaggccgaggacgaccgccccgtgcgcgtctacgccgacggcatcttcgatctcttccacttcggccacgcccgcgccctcgagcaggccaagatgctgttccccaacacctatcttctcgtcggatgctgcaacgacgagctaacctaccgctacaagggcaagaccgtcatgacccaggaagagcgatacgaatccctgcggcactgcaagtgggttgatgaggtcattcctgatgcaccgtgggttctcacacaggagtttattgataagcatcagattgactatgttgctcatgatgcgctgccttatgctgatactagcggaacagcaaatgatgtctatgaatttgttaaaaagattggaaaattcaaggaaacaaaaaggacagacggggtttctacttcagatctcataatgaggatcttgaaggactataaccagtatgtcatgaggaatttagcacggggctactcgaggaaagatcttggtgtgagctatgtcaaggagaaacaattgcaagttaatatgaagatcaataaactgcgggagactgtgaaggcacatcaggaaaagttgcaaacagtggcaaagactgctggtttgaatcatgaagaatggcttgctaatgcggatcgctgggttgctggtttcctagagaagtttgagcaacactgccacaatatggaaactgcgatcaaggatcggatacaggagaggctagggaaacagttgagcaaaggaataatcgctggtcttgtgcaggaaccggtgacagcctaaaacaggtgatgctgtcaatgaaacgcactgatgcttttcagatcatcctcccgatgtggttctggtgcgaggcttgtaagggtgcaacgcggttgctgagacgttttaattttgtggtgcatgtgaactcttcccgtatacaaatgtctataggagaggcgtttggtgttttgggcatcgtcgtgggcgtgtttctttgtatctaacgggttagattaaccttttttttgtatcgagattgatgttctttcgtggttataataataataaataataataatattgtcaaagcacaatgttgatgacattctagatttggcaaaaaaaaaaaaaaaaaagcggccgc

SEQ ID NO: 68560 - protein, 290 aa, Zea mays
MARVSNAKKRQGAKPASALSSTDTSTAAKRKAEDDRPVRVYADGIFDLFHFGHARALEQAKMLFPNTYLLVGCCNDELTYRYKGKTVMTQEERYESLRHCKWVDEVIPDAPWVLTQEFIDKHQIDYVAHDALPYADTSGTANDVYEFVKKIGKFKETKRTDGVSTSDLIMRILKDYNQYVMRNLARGYSRKDLGVSYVKEKQLQVNMKINKLRETVKAHQEKLQTVAKTAGLNHEEWLANADRWVAGFLEKFEQHCHNMETAIKDRIQERLGKQLSKGIIAGLVQEPVTA

SEQ ID NO: 68561 - DNA, 913 bp, Brassica napus
  CDS (35)..(742)
cgaaggtttttttgaggtaagcttaaggtgtgcaatgggagacagtcagtactcgttttctctcactacgttcagcccatcagggaagcttgttcagatagaacatgctctaacagctgttggatcaggccaaacatctctgggaatcaaagcttcaaacggagttgtcattgcaacagaaaagaagcttccctctattttggttgatgaagcgtctgttcaaaagattcagcatttgactcccaacattggagttgtttacagtggtatgggtcctgatttccgagttcttgtacgaaagagtaggaagcaggctgagcaatataaccgattgtacaaagaacctattcccgttacgcaacttgtaagggaaacagctactgtgatgcaagagttcactcaatcaggtggtgtgaggccgtttggagtttctctactagtcgctgggtacgatgacaagggtccacagttgtatcaggtggatccttctggctcttacttctcatggaaagcttcggcaatgggaaagaatgtatcgaatgctaagacatttcttgagaagaggtacactgaagacatggaacttgatgatgccattcacactgccatattgacattgaaggaaggatttgagggggaaatctcaagcaaaaacattgagattggcaaaattggtgctgacaaagtgttcagggtgctaactccggcagaaatcgatgattacttggctgaagtcgagtaaacttcaccttggccgtgcaacaaaaccaggatttgaatcccagtactatcttttgtttcttcttgctggttgcacaaacttgttggtggctggtgttgcttctgtaactcttttggaacttgttaaagactcgagactcaatttagaatctgttttcaaaaaaaaaaaaaa

SEQ ID NO: 68562 - protein, 235 aa, Brassica napus
MGDSQYSFSLTTFSPSGKLVQIEHALTAVGSGQTSLGIKASNGVVIATEKKLPSILVDEASVQKIQHLTPNIGVVYSGMGPDFRVLVRKSRKQAEQYNRLYKEPIPVTQLVRETATVMQEFTQSGGVRPFGVSLLVAGYDDKGPQLYQVDPSGSYFSWKASAMGKNVSNAKTFLEKRYTEDMELDDAIHTAILTLKEGFEGEISSKNIEIGKIGADKVFRVLTPAEIDDYLAEVE

SEQ ID NO: 68563 - DNA, 1069 bp, Brassica napus
  CDS (33)..(848)
ttgcgatcgacgaagcaagatcaaagaagaagatgttcaggaatcagtacgacacagatgtgacgacatggagcccaacaggtcgtctcttccaagtagaatacgccatggaagcagtgaagcaaggctccgccgcaattggactgagatctagctcccatgtcgtcctcgcatgcgtcaacaaagcccaatctgagctctcttctcaccagaagaagatcttcaaagtggatgaccacataggcgtcgcaatcgctggactcacagccgatggacgtgttctctcccgttatatgagatcggaatcaatcaatcactccttcacctatgagtctccacttcccgttggtcgtctcgtcgttcatctcgctgataaggcccaggtctgtacccaacgatcatggaaacggccctatggcgtgggtttgttggtaggtggattggatgagtctggagcccacctttactacaactgccctagtggaaactactttgagtatcaagcttttgctattggatctcgttcacaagccgccaagacctatctggaacgcaggtttgagagctttgcggattcttcaagagaagatctgatcaaagatgctatcttggctgttagggagacactccaaggagaaacactcaagagttctctctgcaccgtatctgtactaggagtcggtgagccattccacttcttggaccaagaagctatacagaaaatgatcgacacatttgagaaagtaccagaggaagaggaaggtgatgccgaagttgctgcaccagcagaacagggtggtggtgctgatggtttaggtgaccaagacgtggctccaatggaaatgtaaggcttttgtgtgtaacgctggaatcgttttaaatcgtgttagttggattttcgttggatgatttttatatgaatcatttgcaaattggctgtggcttttagattttatgcacgagaacctcgtgagatgaaatcactgggttatatcaacttaaaagctacctttaagactattgtattttgctcttttgatttaaatctgtttacgaaaaaaaaaaaaaa

SEQ ID NO: 68564 - protein, 271 aa, Brassica napus
MFRNQYDTDVTTWSPTGRLFQVEYAMEAVKQGSAAIGLRSSSHVVLACVNKAQSELSSHQKKIFKVDDHIGVAIAGLTADGRVLSRYMRSESINHSFTYESPLPVGRLVVHLADKAQVCTQRSWKRPYGVGLLVGGLDESGAHLYYNCPSGNYFEYQAFAIGSRSQAAKTYLERRFESFADSSREDLIKDAILAVRETLQGETLKSSLCTVSVLGVGEPFHFLDQEAIQKMIDTFEKVPEEEEGDAEVAAPAEQGGGADGLGDQDVAPMEM

SEQ ID NO: 68565 - DNA, 1025 bp, Brassica napus
  CDS (10)..(828)
gaagcaaagatgttcaggaaccagtacgacacagacgtgacaacatggagtcccaccggtcgtcttttccaagtagagtacgccatggaagccgtcaagcaaggctccgccgcaatcgggctcagatctcgctcccacgtcgtcctcgcctccgtcaataaagcccagtcggagctctcttctcaccaaaggaagatcttcaaagtagacgaccacatcggtgtcgccatcgctggtctcaccgccgatggccgtgtgctctcgcgttacatgagatctgaatccatcaatcactctttcacctatgagtctcctcttcccgttggccgtctcgtcgttcgtcttgctgataaggctcaggtatgtacccaacggtcatggaaacgaccttatggtgtgggtttgctggttggtggactggacgagtctggagcccacctctactacaactgccccagcggaaactactttgagtaccaagcgttcgccatcgggtctcgctcacaagctgcgaaaacttatctagaacgaagattcgagagcttcaatgagtcatcaagagaagatctgatcaaagatgctattttggccataagggaaactttgcaaggggagacactcaagagctcgctctgcaccgtttctgttctaggagtcgatgaaccattccatttcttggaccaggaaagcatacagaaggtgattgatacgtttgagaaggttcccgaggaagaggaggatggcggtgaggccgaggccgaggctgctgctgcacctacggaacaaggtggtgcaggtgatcaagatgttgcaccaatggaaatgtgagcaagtgagagagtttgatcacaaatgactttggaattataactgtgtccgtctttagcttctgaatttaaaaatcagtctgtcccaagtacattttgctttttactcagcgtgaaatctttgtttttttttgaggttacaattttcagtaatagtttttacctaagctaaaaaaaaaaaaagaaaaaaaaaaaaaa

SEQ ID NO: 68566 - protein, 272 aa, Brassica napus
MFRNQYDTDVTTWSPTGRLFQVEYAMEAVKQGSAAIGLRSRSHVVLASVNKAQSELSSHQRKIFKVDDHIGVAIAGLTADGRVLSRYMRSESINHSFTYESPLPVGRLVVRLADKAQVCTQRSWKRPYGVGLLVGGLDESGAHLYYNCPSGNYFEYQAFAIGSRSQAAKTYLERRFESFNESSREDLIKDAILAIRETLQGETLKSSLCTVSVLGVDEPFHFLDQESIQKVIDTFEKVPEEEEDGGEAEAEAAAAPTEQGGAGDQDVAPMEM

SEQ ID NO: 68567 - DNA, 991 bp, Glycine max
  CDS (167)..(880)
gttcgtggtctcaatttacgtctatttatttttttgttagttttgagaaggccccttgaacaagcaaaattaagcacaaaagcccaaccctctctctcgctgttggtctctcctatttggcattcgcagatcgattacgaagtaatttcactgaatcttattgaagatgtttctcacaaggactgagtatgaccgaggagtcaacaccttttctcctgaaggccgtttatttcaggttgaatatgcaatcgaagccatcaagctgggatcaactgcaattgggttgaagacgaaagagggtgttgtccttgcagttgaaaagcgcatcacttcgccgcttctggagccaagtagtgttgagaaaattatggaaattgatgagcatataggttgtgcaatgagtggattgattgctgatgctcgaacacttgttgagcatgcacgggttgaaactcagaatcataggttctcatatggtgaaccaatgactgttgagtccacaacccaagctctttgtgatctagccttgcgttttggtgaaggtgatgaagaatccatgtctcgaccatttggagtatctcttctcattgctggtcatgatgagaatggacctagcttatattacactgatccatctggcacattttggcaatgcaatggaaaagctattggttcagggtcagaaggtgccgacagttctctgcaagaacaatacaataaggacctaactcttcaagaagctgagactattgctttatccattttgaagcaagttatggaagagaaggtcactcccaacaacgtggacattgccaaagtggctccaacatatcatctttataccccatctgaggtggaagctgtgataagtcgtctatgattttctttttgtgactttctgtattcaacatttgtgtttcctatcattcctacccgtacgtctaattattgagtattacgcggaaacttttttggtcaaaaaaaaaaaaaa

SEQ ID NO: 68568 - protein, 237 aa, Glycine max
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNGKAIGSGSEGADSSLQEQYNKDLTLQEAETIALSILKQVMEEKVTPNNVDIAKVAPTYHLYTPSEVEAVISRL

SEQ ID NO: 68569 - DNA, 1109 bp, Glycine max
  CDS (190)..(930)
gaattcccgggtcgacttcgctgtgacgatttcgtgtatggagtaaaagcaccgtctccgtctccactctcggcttcttcttcgttgcgctttttcccaaaaccaattgcatcactctcgtccgttaccgccgctgccctagaccaccgcaagcgacgtcgcacaccgccttcatccgttagggcaaaaatgagtcgaggaagtggaggtggatacgatcgtcacatcactattttctcccctgaaggacgtctctttcaagtggagtatgctttcaaggctgtgaaggctgcaggaatcacctcgattggtgtccgaggaaaggattcaatttgtgtcgttactcagaagaaggttccggataagcttttggacaacacaagtgttacacacctctttccaatcaccaagtaccttggattattggctactggcatgacagctgatgctaggacactggtccaacaagcaagaaatgaagcagctgagtttcgctttacatatggatatgagatgcctgtagatgtattagctaaatggattgcagataaatcacaagtctatactcaacatgcttatatgagaccactcggagtagttgctatggttttgggtattgatgatgaatatggacctcagctatacaaatgtgatccagctggtcattactttggtcacaaggcaacaagtgctggattgaaggaccaagaggcaattaatttcttggaaaagaagatgaagaatgacccttcatttacatatgaggagacggttcagactgccatttctgccctgcaatcagttcttcaggaggattttaaggccactgagattgaggttggagtggtgcggaaggataatccagaattcagagttttaaccaccgacgaaattgatgagcacttgactgcaataagtgagcgtgactgagttcttgataaggatgtagttgttcaaactttctgatggtagagattatattatgtacttgtttctggaatcatcgaattgatttccttgtgatatttgagtggtgagttactcaagaatgatgttgaagatggtatttgatttcctattacaagtttacttgggaaaaaaaaaaaaaa

SEQ ID NO: 68570 - protein, 246 aa, Glycine max
MSRGSGGGYDRHITIFSPEGRLFQVEYAFKAVKAAGITSIGVRGKDSICVVTQKKVPDKLLDNTSVTHLFPITKYLGLLATGMTADARTLVQQARNEAAEFRFTYGYEMPVDVLAKWIADKSQVYTQHAYMRPLGVVAMVLGIDDEYGPQLYKCDPAGHYFGHKATSAGLKDQEAINFLEKKMKNDPSFTYEETVQTAISALQSVLQEDFKATEIEVGVVRKDNPEFRVLTTDEIDEHLTAISERD

SEQ ID NO: 68571 - DNA, 1043 bp, Brassica napus
  CDS (20)..(862)
gaagaagaagaaagctaaaatgttcaggaatcagtacgacacagatgtgacgacatggagcccaacaggccgtctcttccaagtggagtacgccatggaagcagtcaagcaaggctccgccgcaatcgggctcagatctcgctcccatgtcgtcctcgcctgcgtcaacaaggcccaatccgagctctcctctcaccagaagaagatcttcaaagtcgatgaccatataggcgtcgcgatcgctgggctcaccgccgatggccgtgtcctctctcgttatatgagatcggaggctatcaaccactccttcacctatgagtctccgctccccgttggacgcctcgtcgttcacctcgctgataaggcccaggtctgtacccaacgatcatggaagcggccatatggcgtgggtcttttggtaggtggactggatgagtctggagcccatctttactacaactgcccaagcggaaactactttgagtatcaagctttcgctattgggtcccgttcacaagccgcaaagacctatctggagcgtaggtttgagagctttggggattcttccagagaagatctgataaaagatgctattctggctgtgagggagacactgcaaggagaaacacttaagagttctctctgcacggtctctgttctaggtgtcggtgagccgttccacttcttggaccaggaaactatacagaaagtgattgacacatttgagaaagtaccagaggatgaggctggtgaggctggtgaggctggtgagggtgaggctgaagctgctgctgctgctgcaccagcagaacagggtggtggtggtgcaggtgaccaagacgtggctccgatggaaatgtaaggcgtgtgcaacgctagaactgttttaattgaatgtttgttggatttactttggataatttcatatgaatcatttgcaaatcgctgcggctttacattatatgctcgcaaacctcgtggggttgaaatcatttggtcattttaatttcatagctaccgttaagatccaaaaaaaaaaaaaa

SEQ ID NO: 68572 - protein, 280 aa, Brassica napus
MFRNQYDTDVTTWSPTGRLFQVEYAMEAVKQGSAAIGLRSRSHVVLACVNKAQSELSSHQKKIFKVDDHIGVAIAGLTADGRVLSRYMRSEAINHSFTYESPLPVGRLVVHLADKAQVCTQRSWKRPYGVGLLVGGLDESGAHLYYNCPSGNYFEYQAFAIGSRSQAAKTYLERRFESFGDSSREDLIKDAILAVRETLQGETLKSSLCTVSVLGVGEPFHFLDQETIQKVIDTFEKVPEDEAGEAGEAGEGEAEAAAAAAPAEQGGGGAGDQDVAPMEM

SEQ ID NO: 68573 - DNA, 790 bp, Glycine max
  CDS (7)..(759)
ctcaatatggctcgcagatatgatgctagaactaccattttctcaccagaaggtagactataccaggttgaatatgctatggaagctatttcccatgccggtacagctttaggtattctcgcgtctgatggtattgttattgctgctgagaagaaagtaacatcaaaattattggaacaggcaacaacaagtgaaaaaatttatcttttaaacgataatgtcatttgtggcgtagcaggaattactgctgatgctaatattttgataaattatgctcgtcaagcagctcaacaatatctttttacttatgatgaagatattcctgttgaacaattagtacaaagattatgtgatttaaaacaaggatatactcaatatggaggattgcgaccctttggcgtatcatttatttatgctggtcatgatagtcattatggttttcaactttatcattctgatccatccggtaattatggtgggtggaaagcaacatgtattggagctaataacgcgtccgcacaatctttattgaagcaagattataaagatgacattactcttaaagaggcaaaagaattagccgctaaggttttaagtaaaacaatggattctactactttaagtagcgaaaaactggaatttgctactattagtcttaatgacgagaataaggttgtttatcatctttataaacctgatgaaattgatctcttattaaaagaatacaatttggggggtcaagaaaccgaacaacaataaatttatttttaaaatacaaaaaaaaaaaaaa

SEQ ID NO: 68574 - protein, 250 aa, Glycine max
MARRYDARTTIFSPEGRLYQVEYAMEAISHAGTALGILASDGIVIAAEKKVTSKLLEQATTSEKIYLLNDNVICGVAGITADANILINYARQAAQQYLFTYDEDIPVEQLVQRLCDLKQGYTQYGGLRPFGVSFIYAGHDSHYGFQLYHSDPSGNYGGWKATCIGANNASAQSLLKQDYKDDITLKEAKELAAKVLSKTMDSTTLSSEKLEFATISLNDENKVVYHLYKPDEIDLLLKEYNLGGQETEQQ

SEQ ID NO: 68575 - DNA, 1269 bp, Triticum aestivum
  CDS (143)..(1009)
ccgcaccgcaccacgccaacaaaaggaggaaaacagcacgcccgaaccctactactgctacgggcacgcaccactagcacaccccgcatcgtcgccggatcggaagagcaggggggagagccgaggaggaagaaggccgaggatgttccgcaaccagtacgacaccgatgtcaccacctggagcccgcaggggcggctgttccaggtggagtacgccatggaggcggtgaagcagggctcggcctgcgtcggcctccgctccgccacccacgccgtcctcgccgccgccaacaagtccgccaacgagctctcctcccaccagcgcaaggtcttccgcgtcgccgaccacgccggggtcgcgctcgccggcctcaccgccgacggccgcgtcctctcccgcttcctccgcaacgagtgcatcaaccacgccttcgtctacgacgcgccgctccccgtctccaggctcgcgctccgcctcgccgacaaggcgcaggtttgcacacagcgttcatggaagaggccctatggtgtcggtctccttgttgcgggtctagatgagtctggagcccatctctactacaactgccccagtgggaactactttgagtaccaggcattcgccattggctcccgctcccaggcagcgaagacttacctcgaacgcagattcgagaaattcaacgcctacaccccggacgagctcatcaaggatgcgctctcagccataaaggagaccctccaaggtgagaagctgaccagctccaactgcaccattgccattgtcggcagaacggaggatggcaccgtcgagcccttctccatgattgactccaagaggatccaggaaatcatcgactccatggaggccgccgatgaggcgccagcggccgacgcccctgctgaatcaagctcgatgcaggaggacaggggcgatgcgcctgcggcaggggatgccccagcagcggatgagccggcagcaccggacgcaccggcacccatggacatctaggcgtcttctgatgatctatacatgtcatgtccgtccacccccattgccgcagcgctattcagagtttcaaaaagactagactgttgttttagaaaggttgccatccattgtgtgtactctttgcttctgtgccactacagctttgtggtgcctgcgtctggactgattgatttttatctatcatgtgatgatgtcgcggacagaatcgtctggttgggggaacagatttacgttttatttatcataaaaaaaaaaaaaaa

SEQ ID NO: 68576 - protein, 288 aa, Triticum aestivum
MFRNQYDTDVTTWSPQGRLFQVEYAMEAVKQGSACVGLRSATHAVLAAANKSANELSSHQRKVFRVADHAGVALAGLTADGRVLSRFLRNECINHAFVYDAPLPVSRLALRLADKAQVCTQRSWKRPYGVGLLVAGLDESGAHLYYNCPSGNYFEYQAFAIGSRSQAAKTYLERRFEKFNAYTPDELIKDALSAIKETLQGEKLTSSNCTIAIVGRTEDGTVEPFSMIDSKRIQEIIDSMEAADEAPAADAPAESSSMQEDRGDAPAAGDAPAADEPAAPDAPAPMDI

SEQ ID NO: 68577 - DNA, 1253 bp, Triticum aestivum
  CDS (111)..(980)
gaaaacagcacgcccgaaccctactgctgctgcggacacgcaccactagcacacctcgcatcgtcgccggatcggaggaggaggggagccgaggaggaagaaggccgaggatgttccgcaaccagtacgacaccgatgtcaccacctggagcccgcaggggcggctgttccaggtggagtacgccatggaggcggtgaagcagggctcggcctgcgtcggcctccgctccgccacccacgccgtcctcgccgccgccaacaagtccgccaacgagctctcctcgcaccagcgcaaggtcttccgcgtcgccgaccacgccggggtcgcgctcgccggcctcaccgccgacggccgcgtcctctcccgcttcctccgcaacgagtgcatcaaccacgccttcgtctacgacgcgccgctccccgtctccaggctcgcgctccgcctcgccgacaaggcgcaggtttgcacacagcattcatggaagaggccctatggggtcggcctccttgttgcgggtctagatgagtctggagcccatctctactacaactgccccagcgggaactactttgagtaccaggcattcgccattggctcccgctctcaggcagcgaagacttacctcgaacgcagattcgagaaattcaatgcctacaccccggacgagctcatcaaggacgcgctctcagccataaaggagaccctccaaggtgagaagctgacgagctccaactgcaccattgccattgtcggcagaaaggaggatggcaccgtcgagcccttctccatgatcgactccaagaggatccaggagatcattgattccatggaggctgccgacgaggcaccagcggccgatgctccggctgaatcaagctcgatgcaggaggacaggggcgacgcacctgccgcaggggatgcccccgcggcggcggacgagcctgctgcaccggacgccccggcgccgatggacatctaggcgtcgtctgatcgatacatgtcatgtccgtccacccccccttgtcgcaccaccattcagagtttccaaaaagactagactgttgttttagaaaggttgccatccattgtgtgtactctttgcttctgtgccactacagctttgcggtgcctgtgtctggacagattgatttttatctatcatgtgatggtgcggacagactcgtttggttggggcagacagaattacgttttatcataaaatcctgctaccttttgtaaaaaaaaaaaaaaa

SEQ ID NO: 68578 - protein, 289 aa, Triticum aestivum
MFRNQYDTDVTTWSPQGRLFQVEYAMEAVKQGSACVGLRSATHAVLAAANKSANELSSHQRKVFRVADHAGVALAGLTADGRVLSRFLRNECINHAFVYDAPLPVSRLALRLADKAQVCTQHSWKRPYGVGLLVAGLDESGAHLYYNCPSGNYFEYQAFAIGSRSQAAKTYLERRFEKFNAYTPDELIKDALSAIKETLQGEKLTSSNCTIAIVGRKEDGTVEPFSMIDSKRIQEIIDSMEAADEAPAADAPAESSSMQEDRGDAPAAGDAPAAADEPAAPDAPAPMDI

SEQ ID NO: 68579 - DNA, 708 bp, Triticum aestivum
  CDS (1)..(708)
atgggcgacagccagtactccttctccctcaccaccttcagcccgtcggggaagctggtgcagatcgagcacgcgctcacggccgtcggatcgggccaaacctcgcttggcatcaaagctgccaatggtgtagttattgccaccgagaagaaattgccttctattttagtggacgaaacatctgtgcagaagattcagtcactgactccaaatattggagttgtctacagtgggatgggtccagatttccgcgttcttgtcagaaaaagtcggaagcaggcacagcagtattatcggttgtacaaggaaaccatcccagtgacccagcttgtccgagagactgctgctgttatgcgtgagttcacacaatctggtggtgtaagaccatttggtgtatcactgttgattgctgggtacgatgacaatggtccgcagttgtatcaggttgacccatcaggatcttacttctcctggaaagcatcagcgatggggaaaaatgtgtcaaatgcaaagacatttcttgagaaaagatacaccgaagatatggagcttgatgatgccattcatactgcaattttgactctgaaagaaggatatgaaggtcaaatctctgccaacaacattgaaattggagttatccgggctgaccgcgaattcaaagttttaactccagcagagatcaaggatttcttggaagaggtggagtaa

SEQ ID NO: 68580 - protein, 235 aa, Triticum aestivum
MGDSQYSFSLTTFSPSGKLVQIEHALTAVGSGQTSLGIKAANGVVIATEKKLPSILVDETSVQKIQSLTPNIGVVYSGMGPDFRVLVRKSRKQAQQYYRLYKETIPVTQLVRETAAVMREFTQSGGVRPFGVSLLIAGYDDNGPQLYQVDPSGSYFSWKASAMGKNVSNAKTFLEKRYTEDMELDDAIHTAILTLKEGYEGQISANNIEIGVIRADREFKVLTPAEIKDFLEEVE

SEQ ID NO: 68581 - DNA, 1071 bp, Triticum aestivum
  CDS (70)..(783)
gcggccgctgcgtgtcggtctctcttctctcccatcttcccctagcccaagcaaaccgcacacgccaccatgttcctcacgaggacggagtacgaccgcggcgtgaacaccttttcgccggagggacgcctattccaggtcgagtacgccatcgaggccatcaagttgggatctactgcaatcgggttgaagacgaaggatggggttgttcttgctgtggagaaacgtgtgacgtctccgttgctggaacctagcagtgttgagaaaatcatggaaattgatgagcatgtaggctgtgccatgagtggccttattgctgatgcaagaacattggttgagcatgctcgagtggagacccaaaaccatagattctcatatggggaaccgatgacagttgagtccaccacacaagctatttgcgatctagctcttcgctttggagaaggtgaaggagagtctatgtcacgaccttttggagtttctctccttattgctggtcatgatgaaaatgggccgagcttgtactacactgacccatctggaaccttttggcagtgcaatgccaaggcaatagggtcaggctctgagggtgccgatagttccttgcaggagcagttcaacaaggagctgacccttcaggaggctgaaaccattgctctatctatcctgaaacaggttatggaagaaaaggtgactccaaataatgtcgacatcgccagggtcgcgccgaactaccacctttacacccctgcagaggttgaagcagtcatagcacgattgtgaaacgcagaaatctttgtcgaatgtcaaccaggattcgtatgttccttgtgctgtgtgtctgacatccagatgccttcaaattagcagaagcacaattgctctatgatatggacactgatgtttgcctcttttcatttgattatcttgtgttaacaaggtgtagaggcctagctgttgttgccttgtcacttgccggtaaggagattgtactacacccttttgtttgatatacgaaggatttgtggcaatagcacgaaatcgtcgacagcgaagtcgacccgggaattc

SEQ ID NO: 68582 - protein, 237 aa, Triticum aestivum
MFLTRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPMTVESTTQAICDLALRFGEGEGESMSRPFGVSLLIAGHDENGPSLYYTDPSGTFWQCNAKAIGSGSEGADSSLQEQFNKELTLQEAETIALSILKQVMEEKVTPNNVDIARVAPNYHLYTPAEVEAVIARL

SEQ ID NO: 68583 - DNA, 902 bp, Triticum aestivum
  CDS (28)..(741)
gaattccgatccgcatccgccgacacgatgtttctcacgaggacggagtacgaccgtggggtcaacaccttctccccggaggggcggctgttccaggtcgagtacgccattgaggccatcaagttgggctccaccgcaatcggcttgatgactaaggatggtgttgtactggctgttgagaaacgtgtcacctcaccgctgctggaaccaagcagtgtggagaaaatcatggaaattgatgagcatgtcggctgtgccatgagtggccttattgctgacgccagaacactggttgagcatgctcgtgttgagactcagaatcataggttctcatatggggagccaatgacagtagagtctaccacacaagctatctgtgacttggctttgcgctttggtgaaggtgatgaagaatcaatgtcacggccatttggagtctctctccttattgctggtcatgatgaaaatggacccagcttgtactacacagacccgtcggggaccttctggcagtgcaatgccaaggcaattgggtcgggctctgaaggagctgatagctcattacaagatcagtacaacaaggaactgaccatcgctgaggcagagaccatagccctttctatcctgaagcaggttatggaagaaaaggtgaccccgaacaacgttgacattgcgaaggtctcccctagctaccacctctacacccctgcagaggttgaagcggtcatcgcgaggttgtgaaggattgccactttgtgagacagcctcttgtattcccatgaaccctataaagcacaatgaacgtatgaactctgttgtgggtttgggttgtctgcctactgttgaagggatattagtgcctgcttgggcgttgcatccggagaccgacacgcagcggccgc

SEQ ID NO: 68584 - protein, 237 aa, Triticum aestivum
MFLTRTEYDRGVNTFSPEGRLFQVEYAIEAIKLGSTAIGLMTKDGVVLAVEKRVTSPLLEPSSVEKIMEIDEHVGCAMSGLIADARTLVEHARVETQNHRFSYGEPMTVESTTQAICDLALRFGEGDEESMSRPFGVSLLIAGHDENGPSLYYTDPSGTFWQCNAKAIGSGSEGADSSLQDQYNKELTIAEAETIALSILKQVMEEKVTPNNVDIAKVSPSYHLYTPAEVEAVIARL

SEQ ID NO: 68585 - DNA, 1006 bp, Zea mays
  CDS (122)..(835)
gaattcccgggtcgacgatttcgttcaacttcgttcgcaagaagctcagaagtcagatcagaagccgccgaggggaggcgccgacgccgagtttttgctccatcccgcatccaccgccagaatgtttctcacgaggacggagtacgaccgcggggtgaacaccttctcgccggaggggcggctgttccaggtcgagtacgccatcgaggccatcaagttgggatccactgcgatcgggttgaaaacaaaggatggtgttgtccttgctgttgagaaacgtgtgacctcgccactgctggaaccaagcagtgtggaaaaaatcatggaaattgatgagcacataggctgtgccatgagtgggcttattgctgatgctagaacactagtcgagcatgctcgtgttgaaactcagaatcataggttctcatacggggagccaatgaccgtagaatcttcaacacaagctatttgtgacttagctctgcgctttggcgaaggtgacgaagagtcaatgtcacggccatttggagtctctctcctaattgctggacacgatgagaatggacctagtctgtactacaccgacccatctggtactttttggcaatgcaacgcgaaggcaattggatctggctctgaaggagctgatagctccttgcaggagcagtacaacaaggagctggcccttgaggaggcggagaccatagccctttctattctgaagcaggttatggaggagaaggtgaccccaaacaacgtcgatattgccaaggttgctcccaagtaccacctctacacccctgccgaggtcgaagccgtgatcgcgaggctgtgaaacgctttcggagctcgtgttattcatgtcatcaatcggtaatagacgatccttgtacgaagcgtggacatcttttgttcttgattatggctgtcatcgtactctgttgttaactccccaaggacagtcgatggtactttgatccaaaaaaaaaaaaaaaaaagcggccgc

SEQ ID NO: 68586 - protein, 237 aa, Zea mays
MFLTRTEYDRGVNTFSPEGRLFQVEYAIEAIKLGSTAIGLKTKDGVVLAVEKRVTSPLLEPSSVEKIMEIDEHIGCAMSGLIADARTLVEHARVETQNHRFSYGEPMTVESSTQAICDLALRFGEGDEESMSRPFGVSLLIAGHDENGPSLYYTDPSGTFWQCNAKAIGSGSEGADSSLQEQYNKELALEEAETIALSILKQVMEEKVTPNNVDIAKVAPKYHLYTPAEVEAVIARL

SEQ ID NO: 68587 - DNA, 1156 bp, Hordeum vulgare
  CDS (74)..(940)
ccgccgcacccccacaaaagaggaagaggaaccacagctctcgccgccccgaaccctacgagcagctccgacgatgttccgcaaccagtacgacaccgatgtcaccacctggagcccgcaggggcggctgttccaggtggagtacgccatggaggcggtgaagcagggctcggcctgcgtcggcctccgctccgccacccacgccgtcctcgccgccgccaacaagtccgccaacgagctctcctcccaccagcgcaaggtcttccgcgtcgccgaccacgccggggtcgcgctcgcgggcctcaccgccgacggccgcgtcctctcccgcttcctccgcaacgagtgcatcaaccacgccttcgtctacgacgcgcccctccccgtctccaggctcgcgctccgcctcgccgacaaggcgcaggtttgcacacagcgttcatggaagaggccctatggggtcggcctccttgttgctggtctagatgagtctggagcccatctctactacaactgccccagtgggaactactttgagtaccaggcattcgccattggctcccgctctcaggcagccaagacttacctcgaacgcagattcgagaaattcaacgcctacacccccgacgagctcatcaaggacgctctctcagccataaaggagaccctccaaggtgagaagctgacgagctctaactgcaccattgccattgtcggcagaagggaggatggcaccgttgagcctttctccatgatcgactccaagaggatccaggagatcatcgactccatggaggctgctgacgaggcgccagcggccgatgctccggctgaatcaagctcgatgcaggaggacaggggcgatgctcccccagctgcggatgcccctgcagcggacgagcccgcagcaccagatgccccggcaccgatggacatctaggcgtcgtctcgtctgatcgatacgtgtcatgtctgtcccacccccttgtcccaacaccattcagagtttccaaaaagactagactattgttttagaaaggttgccatcattgtgtgtactctttgcttctgtgccactacagctttgtggtgcctgcgtctggacagattgatttttatctatcatgtgatgatgtcgcggaaaaaaaaaaaaaaa

SEQ ID NO: 68588 - protein, 288 aa, Hordeum vulgare
MFRNQYDTDVTTWSPQGRLFQVEYAMEAVKQGSACVGLRSATHAVLAAANKSANELSSHQRKVFRVADHAGVALAGLTADGRVLSRFLRNECINHAFVYDAPLPVSRLALRLADKAQVCTQRSWKRPYGVGLLVAGLDESGAHLYYNCPSGNYFEYQAFAIGSRSQAAKTYLERRFEKFNAYTPDELIKDALSAIKETLQGEKLTSSNCTIAIVGRREDGTVEPFSMIDSKRIQEIIDSMEAADEAPAADAPAESSSMQEDRGDAPPAADAPAADEPAAPDAPAPMDI

SEQ ID NO: 68589 - DNA, 1035 bp, Hordeum vulgare
  CDS (29)..(742)
ccatagcccaagcaaaccacgcgctaccatgttcctcacgaggacggagtacgaccgcggcgtgaacaccttctccccggaggggcggctgttccaggtcgagtacgccatcgaggccatcaagttgggatctactgcaatcgggttgaagacgaaggatggggttgttcttgctgtggagaaacgtgtgacgtctccattgctggaacctagcagtgttgagaaaattatggaaattgatgagcatgtaggctgtgccatgagtggccttattgctgatgcaagaacattggttgagcatgctcgtgtggagacccaaaaccatagattctcatatggggaaccgttgacagttgagtccaccacacaagctatttgcgatctagctcttcgctttggagaaggtgaagaagagtctatgtcacgaccttttggagtttctcttcttattgctggtcatgatgaaaatgggccgagcttgtactacactgacccatctggaaccttttggcagtgcaatgctaaggcaatagggtcaggctctgaaggtgccgatagttccttacaggagcagtttaacaaggagctggcccttcaggaggctgaaaccattgctctatctatcctgaaacaggttatggaagaaaaggtgactccaactaatgtagacatcgccaaggtcgcaccgaactaccacctttacacccctgcagaggtcgaagcagtcatagcacgattgtgaaaagcggaaatctttgtcgaatgtcaatcaggattcatatgttccttctgctgtgtgtctgacatcctgatgcctttaatttagcagaagcacaattgctcgatgatatggacactgatgtttgcctcttttggtttgattatgtggtgttgtaaaattcaaaaaataataattattatgtggtgttgacaagaaggtttagaggcctagatgttgttgccttctcacgtgccgggaaggagattgtacaccttttttttatacgaaggatttgtggcaaaaaaaaaaaaaaa

SEQ ID NO: 68590 - protein, 237 aa, Hordeum vulgare
MFLTRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPLTVESTTQAICDLALRFGEGEEESMSRPFGVSLLIAGHDENGPSLYYTDPSGTFWQCNAKAIGSGSEGADSSLQEQFNKELALQEAETIALSILKQVMEEKVTPTNVDIAKVAPNYHLYTPAEVEAVIARL

SEQ ID NO: 68591 - DNA, 1002 bp, Hordeum vulgare
  CDS (35)..(748)
gggcttcaaactccgatccgcttccgccgacacgatgtttctcacgaggacggagtacgaccgtggggtcaacaccttctccccggaggggcggctgttccaggtcgagtacgccatcgaggccatcaagttgggctccactgccatcggcttgatgactaagtatggtgttgtcctggctgttgagaaacgcgtcacctcaccgctgctggaacctagcagtgtggagaaaatcatggaaattgatgagcatgttggctgtgcaatgagtggccttattgctgacgccagaacacttgttgagcatgctcgtgtcgagactcagaatcataggttctcatatggggagccaatgacagtagaatctaccacacaagctatctgtgacttggctttgcgctttggtgaaggtgatgaagaatcaatgtcacggccgtttggagtctctctccttattgctggtcatgatgaaaatggacccagcttgtactacacggacccatctgggaccttctggcagtgcaatgccaaggcaattgggtcgggctctgaaggagctgatagctcattacaagagcagtacaacaaggaattgacaatcgctgaggcagagaccatagccctttctatcctgaagcaggttatggaagaaaaggtgaccccaaacaatgttgacattgcgaatgtctcccccagctaccacctctacactcctgcagaggttgaagcggtcatcgcgaggttgtgaaggattgccactttgtgagacagcctcttgaagggatagtagtgcctgccaggtcgttgcatctgaattctcatatgccagtccagtcattcgtttgtttacagtagcactaagacgttgtaccaccaaaaagaattatttttcagcattccagccagcgcgtaggtatcaccggctgcatttgtgtgtgtttggttcgtaaaacatctctactactaaaggcgacttggtgatggtttaaaaaaaaaaaaaaa

SEQ ID NO: 68592 - protein, 237 aa, Hordeum vulgare
MFLTRTEYDRGVNTFSPEGRLFQVEYAIEAIKLGSTAIGLMTKYGVVLAVEKRVTSPLLEPSSVEKIMEIDEHVGCAMSGLIADARTLVEHARVETQNHRFSYGEPMTVESTTQAICDLALRFGEGDEESMSRPFGVSLLIAGHDENGPSLYYTDPSGTFWQCNAKAIGSGSEGADSSLQEQYNKELTIAEAETIALSILKQVMEEKVTPNNVDIANVSPSYHLYTPAEVEAVIARL

SEQ ID NO: 68593 - DNA, 1003 bp, Hordeum vulgare
  CDS (38)..(751)
caagggcttcaaactccgatccgcttccgccgacacgatgtttctcacgaggacggagtacgaccgtggggtcaacaccttctccccggaggggcggctgttccaggtcgagtacgccatcgaggccatcaagttgggctccactgccatcggcttgatgactaagtatggtgttgtcctggctgttgagaaacgcgtcacctcaccgctgctggaacctagcagtgtggagaaaatcatggaaattgatgagcatgttggctgtgcaatgagtggccttattgctgacgccagaacacttgttgagcatgctcgtgtcgagactcagaatcataggttctcatatggggagccaatgacagtagaatctaccacacaagctatctgtgacttggctttgcgctttggtgaaggtgatgaagaatcaatgtcacggccgtttggagtctctctccttattgctggtcatgatgaaaatggacccagcttgtactacacggacccatctgggaccttctggcagtgcaatgccaaggcaattgggtcgggctctgaaggagctgatagctcattacaagagcagtacaacaaggaattgacaatcgctgaggcagagaccatagccctttctatcctgaagcaggttatggaagaaaaggtgaccccaaacaatgttgacattgcgaatgtctcccccagctaccacctctacactcctgcagaggttgaagcggtcatcgcgaggttgtgaaggattgccactttgtgagacagcctcttgaagggatagtagtgcctgccaggtcgttgcatctgaattctcatatgccagtccagtcattcgtttgtttacagtagcactaagacgttgtaccaccaaaaagaattatttttcagcattccagccagcgcgtaggtatcaccggctgcatttgtgtgtgtttggttcgtaaaacatctctactactaaaggcgacttggtgatggtaaaaaaaaaaaaaaa

SEQ ID NO: 68594 - protein, 237 aa, Hordeum vulgare; identical to SEQ ID NO: 68592

SEQ ID NO: 68595 - DNA, 973 bp, Hordeum vulgare
  CDS (135)..(908)
actccccttccgtcccgtcccgtcccccctctgtctctcttcttcagcagccgcctcgctcgctcgctcgctcgctccacccgatctcctccggcgacccgagagagccgacgaggtagtcccgcgctccggccatgggcgacagccagtactccttctccctcaccaccttcagcccgtcgggcaagctggtgcagatcgagcacgcgctcacggccgtcggatcgggccaaacctcgcttggcatcaaagctgccaatggtgtagttatcgccaccgagaagaaattgccttctattttagtggacgaaacatctgtgcagaagattcagtcactgactccaaatattggagttgtctacagtgggatgggtccggattttcgtgttcttgttagaaaaagtcggaagcaggcacagcagtattatcggttgtacaaggaaaccatcccggtgacccagcttgtcagagagactgctgctgttatgcaggagttcacacaatctggtggtgtaagaccatttggtgtatcactgttgattgctgggtatgatgacaatggtccgcagttgtatcaggttgatccatcaggatcttacttctcttggaaagcatcagcgatggggaaaaatgtgtcaaatgcaaagacatttcttgagaaaagatacaccgaagatatggagcttgatgatgccattcatactgcaattttgactctgaaagaaggatatgaaggtcaaatctctgccaacaacattgaaattggagtaagctacccattgacaaattacggtctccaacaagaaaaagtttcggagcagtccatgaagcttgtctcatgtttttattggccagttaaacatagtaaactgatttgctccagtgacaccggaagaacttacatttgaatccttgtgaatgacattgtagacaatgaagataacctaatgttaggtgtaaaaaaaaaaaaaaa

SEQ ID NO: 68596 - protein, 257 aa, Hordeum vulgare
MGDSQYSFSLTTFSPSGKLVQIEHALTAVGSGQTSLGIKAANGVVIATEKKLPSILVDETSVQKIQSLTPNIGVVYSGMGPDFRVLVRKSRKQAQQYYRLYKETIPVTQLVRETAAVMQEFTQSGGVRPFGVSLLIAGYDDNGPQLYQVDPSGSYFSWKASAMGKNVSNAKTFLEKRYTEDMELDDAIHTAILTLKEGYEGQISANNIEIGVSYPLTNYGLQQEKVSEQSMKLVSCFYWPVKHSKLICSSDTGRTYI

SEQ ID NO: 68597 - DNA, 1103 bp, Zea mays
  CDS (128)..(961)
gaattcccgggtcgacttcgctgtcgacgatttcgtccgaaatcggccagacattccccaaaccctacgctcgctcgctcgccggagccctcgttgaaccgagcaggcgggcgaaggaggctcgacgatgttccgcaaccagtacgacaccgacgtgaccacgtggagcccccaggggcggctcttccaggtggagtacgccatggaggccgtcaagcagggctccgcctgcgtggggctccggtcccgcacccacgccgtcctcgccgccgtcaacaagcctgcctccgagctctcctcctaccagcggaaggtgttccgcgtcgccgaccacgccggggtcgcgctcgccggcctcaccgccgacggccgcgtcctctcgcgcttcctccgcaacgagtgcatcaaccactccttcgtctacgaggcgccgctccccgtctccaggctcgcgctcaggctcgccgacaaggcgcaggtctgcacacagcggtcatggaagaggccctacggtgtcggcctcctcgttgccggactggacgagtcaggagcccacctgtactacaactgccccagcgggaactacttcgagtaccaggcgtttgccatcggctcccgctcccaagccgccaagacgttcctggagcgcaggttccaggggtacgacgactacaccccggagcagctcgtcagggacgccctctctgccgtgaaggagacgctgcagggcgagaagctgtccggatccaactgcaccgtggccatcgtcggcaggaaggacgacggcaccgtcgagccgttcgaggtgatcggcgcggcgagggtccaggaacttatcgactccatggagatggaggtcgccgagcaggcaccgcctccggaggctgctgctgctagctcctccatgcaggaggagggggagaggggctcggatgacgctgctgcacccatggacatctagagggctgggatagggggagactcatatgaaacccgtacactgcattccgagttccaaaagactaaaaaccacttatttgaaaaaaaaagtaaattatgttgttttggtttggactgaaaaaaaaaaaaaaaaaagcggccgc

SEQ ID NO: 68598 - protein, 277 aa, Zea mays
MFRNQYDTDVTTWSPQGRLFQVEYAMEAVKQGSACVGLRSRTHAVLAAVNKPASELSSYQRKVFRVADHAGVALAGLTADGRVLSRFLRNECINHSFVYEAPLPVSRLALRLADKAQVCTQRSWKRPYGVGLLVAGLDESGAHLYYNCPSGNYFEYQAFAIGSRSQAAKTFLERRFQGYDDYTPEQLVRDALSAVKETLQGEKLSGSNCTVAIVGRKDDGTVEPFEVIGAARVQELIDSMEMEVAEQAPPPEAAAASSSMQEEGERGSDDAAAPMDI

SEQ ID NO: 68599 - DNA, 195 bp, Glycine max
  CDS (1)..(195)
atgtatcttcagttttacataaacgataacggcgacaaagtctacaccactaagaaagagtcgccggtagggctacctacacaatctgctcatccagcccggttttcacccgatgataaatattcaagacagagagttcttctgaagaagcgttttggattattaccaacccagcagccacctccaaagtattga

SEQ ID NO: 68600 - protein, 64 aa, Glycine max
MYLQFYINDNGDKVYTTKKESPVGLPTQSAHPARFSPDDKYSRQRVLLKKRFGLLPTQQPPPKY

SEQ ID NO: 68601 - DNA, 195 bp, Triticum aestivum
  CDS (1)..(195)
atgtatctccagtactacatcaacgagaagggcgtcaaggtgtacaccaccaagaaggaatcccctctcggtgtgccgacgcagtctgcccacccagctcgtttctccccggatgacaagtacgcccgtcagcgttacctgttgaagaagaggtttggattgctgccaacccaacagccagcacaaaagtactga

SEQ ID NO: 68602 - protein, 64 aa, Triticum aestivum
MYLQYYINEKGVKVYTTKKESPLGVPTQSAHPARFSPDDKYARQRYLLKKRFGLLPTQQPAQKY

SEQ ID NO: 68603 - DNA, 195 bp, Zea mays
  CDS (1)..(195)
atgtatctccagtactacatcaacgagaagggggacaaggtctacaccaccaagaaggagtcacctcttggggtgccaacgcagtctgctcacccagctcggttctcaccagatgacaagtactctcgccagcgatacctgttgaagaagagatttggacttctgccaacgcagaatccaggaccgaagtactga

SEQ ID NO: 68604 - protein, 64 aa, Zea mays
MYLQYYINEKGDKVYTTKKESPLGVPTQSAHPARFSPDDKYSRQRYLLKKRFGLLPTQNPGPKY

SEQ ID NO: 68605 - DNA, 195 bp, Zea mays
  CDS (1)..(195)
atgtatctccagtattacatcaacgagaagggtgacaaggtctacaccaccaagaaggagtcgcctcttggggtgccgacgcagtctgctcacccagctcgcttctcactagatgacaagtactctcgccagcggtacctgttgaagaagagatttggacttctgccaacgcagaagccagcactgaagtactga

SEQ ID NO: 68606 - protein, 64 aa, Zea mays
MYLQYYINEKGDKVYTTKKESPLGVPTQSAHPARFSLDDKYSRQRYLLKKRFGLLPTQKPALKY

SEQ ID NO: 68607 - DNA, 195 bp, Linum usitatissimum
  CDS (1)..(195)
atgttgctgcagtactacatcaatgataacggcgacaaagtctacaccaccaagaaggaatcgccggttgggttagctacgcagtctgctcatcctgctcgcttctctcccgatgacaaatacgcaaggcaaaggtatctattgaagaagcgattcgggttgctgcctactcaacaacctcctcagaagtactga

SEQ ID NO: 68608 - protein, 64 aa, Linum usitatissimum
MLLQYYINDNGDKVYTTKKESPVGLATQSAHPARFSPDDKYARQRYLLKKRFGLLPTQQPPQKY

SEQ ID NO: 68609 - DNA, 2620 bp, Glycine max
  CDS (91)..(2382)
cttaaatcaacacgttggacgagtttttttctgtctgtagctgtcggaagtttgaaacatacatattcttcttaattttgggtcagtagtatgtggaagttgaagatagcagaaggaggagatgggttaatctctgtgaacaatttcattggacgtcaacactgggagtttgatcctaatgctggaactccacaagaacgtgctcaagttgaaagggtacgagaggaatacaaaaagaaccggttttgcattaagcaaagcggtgacctactcatgagaatgcagctcacaaaggagaacacgtgtgggcccattctagcaagagtgaacgtgaaagacacggaaaacgtaacggaggaagcattgatcactacaatgagaaaggctatcaatttctattcctctattcaagcccatgatggccactggccagcagaatctgctggccctttgtttttccttcaacctttggtaatggcactctatattacagggtccctaaatgatgttttaggaccagaacaccagaaggaaattattcgttatttgtataatcatcagaacgaagatggaggttggggattgcatatagagagtcacagcacaatgtttgggtcagcgttgagctacattgccttgagaattcttggagaagggcctgaagatggtgaagacagggcaatggctagaggcagaaaatggatcctcgaccacggtggtttggaagctattccatcctggggaaagttctgggtcacggtacttggagtttatgagtggtcaggctgcaacccacttccaccagagatatggcttttgcccaagtacgcccccattcatccagggaaaatgttatgctactgtcgcttagtttacatgcccatgtcatacttatttgggaagagatttgtgggtccaattaccgggttaatcatatctctaagagaagaaatgtacaaccagccttatgatcaaatcgattggaataacgcccgaagcacagttgccaaggaggatctctattacccacatcctctgattcaagatatgttatgggcatctcttcatcacgtggcagagcctcttctgaattgctggcccttttccatgctgagagagaaggcactagaagtcgcaattgatcatattcgttatgaggacgagaacagtggatacctttgtattggtagtgtagagaaggtgttgtgtttgattgcacgttgggtcgaagatccaaactcagaggcatacaagcttcatttagccagaatccctgattacttttggcttgcagaagatggattgaaaatccagagtttgggttctcaactgtgggatgctacattagctatacaagcaataatatcatgtgatttgagtgaagagtatggacctacacttcgtaaagcacaccactttgtcaaggcttcccaggtgcttgaaaatccatcaggtaatttcaaagcaatgcatcgacacatatccaaaggagcatggacattctcaatgcaggatcagggttggcaagtctctgactgcacagcagaaggattaaaggctgcacttctattgtcacaaatgtctcctgacctaataggcgagaaaatggaagatgagaggttctatgatgctgttgatgtgattttatctcttcagagcggcaatggcggcttccctgcttgggagcctcaaagagcgtaccgttggttagagaagttcaatccaacggaaatcttcaaagacactctcattgagatggagtatgtggagtgcacatcatcggcattgcagggcctggctttgtttagaaagttatatccaaaacacagaagaaaggaagtcgatctctgtatttctaaagcaatccgttacattgaaaaaacacaaaatcctgatggatcatggtttggctgttggggaatttgctatacctatggtacattgttttctgtaaaagggttaacagactgtggaaaaaactaccgtaatagtcctgccttgcgtaaagcttgcaaatttttgttgtcaaagcagcttcctaatggaggatggggtgagagttacttgtcaagccaaaacaaggtttacacaaatctaaaaggcaacagggcaaacttagttcaaacttcatgggctttgatgtccctcattgatgcagggcaggttgagatagatccaacacccgtagagcgtggaataaggttattaataaattctcaaatggaagatggagactttccacaacaggagatcactggagtattcatgaggaattgtacgctgaactattcttcatatcgaaacatttttctcatatgggctctgggagagtatcgtcgccgtgtctttacgcataaaagtcaaatacttagctccacctaactccaatccaactcattttgttgcctcaatgcacccattattatacttagcaactaagcgcagtgcaatttttgcggagccacccttcgcccttgtaaacacagcacatgttgcaagggtatctgccatgatgcttgttcactttagttcttatcattttttataggtcttatctcatgttacattatatttaaaaactttaatggtagagagagagagaccgacacgcagcggccgc

SEQ ID NO: 68610 - protein, 763 aa, Glycine max
MWKLKIAEGGDGLISVNNFIGRQHWEFDPNAGTPQERAQVERVREEYKKNRFCIKQSGDLLMRMQLTKENTCGPILARVNVKDTENVTEEALITTMRKAINFYSSIQAHDGHWPAESAGPLFFLQPLVMALYITGSLNDVLGPEHQKEIIRYLYNHQNEDGGWGLHIESHSTMFGSALSYIALRILGEGPEDGEDRAMARGRKWILDHGGLEAIPSWGKFWVTVLGVYEWSGCNPLPPEIWLLPKYAPIHPGKMLCYCRLVYMPMSYLFGKRFVGPITGLIISLREEMYNQPYDQIDWNNARSTVAKEDLYYPHPLIQDMLWASLHHVAEPLLNCWPFSMLREKALEVAIDHIRYEDENSGYLCIGSVEKVLCLIARWVEDPNSEAYKLHLARIPDYFWLAEDGLKIQSLGSQLWDATLAIQAIISCDLSEEYGPTLRKAHHFVKASQVLENPSGNFKAMHRHISKGAWTFSMQDQGWQVSDCTAEGLKAALLLSQMSPDLIGEKMEDERFYDAVDVILSLQSGNGGFPAWEPQRAYRWLEKFNPTEIFKDTLIEMEYVECTSSALQGLALFRKLYPKHRRKEVDLCISKAIRYIEKTQNPDGSWFGCWGICYTYGTLFSVKGLTDCGKNYRNSPALRKACKFLLSKQLPNGGWGESYLSSQNKVYTNLKGNRANLVQTSWALMSLIDAGQVEIDPTPVERGIRLLINSQMEDGDFPQQEITGVFMRNCTLNYSSYRNIFLIWALGEYRRRVFTHKSQILSST

SEQ ID NO: 68611 - DNA, 606 bp, Glycine max
  CDS (1)..(606)
atgaagaaggaagcttcaccttggttaattgttggcctcggcaatccaggcaaaaagtacgctgccacccgccacaatgtgggctttgagatggttgataccatagctgaagctgaagggatatctatgaccactgtttccttcaaatccttatttggaaaaggttttataggtgatgtaccagtcatacttgcaaaaccacagacttatatgaattcaagtggtgaatctgttggggccatagtttcatattacaagattccactgaagcaagtacttgtgatctttgacgacttggatttgccttttgctaaattgcggcttctaccaaagggtggacatggaggtcacaatggaatgaagagtgttattaatcacttcaaagggaattctggttttccccgtttaagaattggcattggacgacctcctgggaaaatggaccctgtagcttttgttcttcgcaccttcactaaacatgaaagggaagagttgaattttacattacaagatggattagaagctgtgcggattcttttgcttgagggatttgataaaagtgcaacatttgttaatagtgccaaaaagatagagcaaacaggttga

SEQ ID NO: 68612 - protein, 201 aa, Glycine max
MKKEASPWLIVGLGNPGKKYAATRHNVGFEMVDTIAEAEGISMTTVSFKSLFGKGFIGDVPVILAKPQTYMNSSGESVGAIVSYYKIPLKQVLVIFDDLDLPFAKLRLLPKGGHGGHNGMKSVINHFKGNSGFPRLRIGIGRPPGKMDPVAFVLRTFTKHEREELNFTLQDGLEAVRILLLEGFDKSATFVNSAKKIEQTG

SEQ ID NO: 68613 - DNA, 957 bp, Brassica napus
  CDS (68)..(742)
cttctgagaagaaattattttcttcaaataaaaaatccacaagagaaataaaaaacaaaaaaaaacaatgcaaactgctatggataagagaatagaaacagtgaagtcgagattcaagagggtttgtgttttctgtggaagcagcagcggaaacaaagactgttacagagatgctgccattgatctagctcaagagctgattgagaggaaactgaatcttgtgtatggaggaggaagcattggtctcatgggtctggtctcacaagctgttcatgaagctggaggtcatgtgctagggatcataccaagaactcttatggacaaagagatcaccggagaaacatttggtgaggtaagagctgtggctgatatgcatcaacggaaagccgaaatggcaagccactccgattgtttcattgcactaccaggtgggtatggaacattggaggagttattggaagtaataacatgggcacaacttggaatccacgacaagcctgtgggattgttaaatgtggatggttattacaatgacctcctcactttcattaataaagccgttgatgatggctttatcaagccatctcagcgtcacatctttgtctctgctcctaatgccaaagagcttgtccaaaaacttgaggcatatgagcctgtgattgatggagtcatatcaaaatcaaagtgggaggttgagaagaaagtgcaacatccacaaacaacaagttgtgttctgtcctaacacaagcattcctactgagattgctctttagacttctagagtgtctttatgtatcctacccgtattatgtttatcatccaaaaatgcttaataactgaatctatagtctattcactcccttgttcatatcttcaagtgaatgtttttggttgtattattttttactgtttcttcacttttatcatagtaatacattttcagaaaaaaaaaaaaaa

SEQ ID NO: 68614 - protein, 224 aa, Brassica napus
MQTAMDKRIETVKSRFKRVCVFCGSSSGNKDCYRDAAIDLAQELIERKLNLVYGGGSIGLMGLVSQAVHEAGGHVLGIIPRTLMDKEITGETFGEVRAVADMHQRKAEMASHSDCFIALPGGYGTLEELLEVITWAQLGIHDKPVGLLNVDGYYNDLLTFINKAVDDGFIKPSQRHIFVSAPNAKELVQKLEAYEPVIDGVISKSKWEVEKKVQHPQTTSCVLS

SEQ ID NO: 68615 - DNA, 969 bp, Brassica napus
  CDS (49)..(696)
ttaagctcgagagggagagagagaacaaagaaaaaaaaaagagaagagatggaagagacaaaatcaagattcaataggatctgtgtcttctgtggaagcagttccggcaaaaaaccttcttaccaagaagctgccattgaattgggtaacgagctggtggaaagaaggattgatttggtatatggaggtggcagcgtggggcttatgggtctcgtctctcaggctgttcatcatggtggtcggcatgttctaggggtcatcccaaaaaccttgatgccaagagagataaccggtgagaccatcggggaagtgaaagccgtcgctgatatgcatcaaaggaaagctgaaatggctcgacaagccgacgccttcattgctcttcctggtggatatggtacgttggaagaattgctggaagtcattacatgggctcaactcggaatccaccgtaagccggtgggtcttcttaacgtggatggttactacaactcgctgttaacgtttatcgacaaggccgtggacgaaggatttatatccccaatggctcgtagaatcatcgtctctgcaccaaacgctaaagagttggttcgacaactcgaggaatatgaacctgagttcgatgagataacgtcaaaattggtttgggatgaagtggaccggctcagttatgtaccgggttcggaggttactacgtgagcaatttaaccacattatgggggaagtttttcttgggtaaaatcagtcggtgtacagcggaattgaaactttcataacgtcagaaggaaaggtcgggaaggagacaaaagtattggggtcgtttaagtagcattattttgtaaggggggcttaatgtgtgaagtggataaaccacgtgggtaactactaaccgcgtatataccaaaccccatcttccccatttgtcttttgtacattttggttaatgccatggttaaggaaaaaaaaaaaaaa

SEQ ID NO: 68616 - protein, 215 aa, Brassica napus
MEETKSRFNRICVFCGSSSGKKPSYQEAAIELGNELVERRIDLVYGGGSVGLMGLVSQAVHHGGRHVLGVIPKTLMPREITGETIGEVKAVADMHQRKAEMARQADAFIALPGGYGTLEELLEVITWAQLGIHRKPVGLLNVDGYYNSLLTFIDKAVDEGFISPMARRIIVSAPNAKELVRQLEEYEPEFDEITSKLVWDEVDRLSYVPGSEVTT

SEQ ID NO: 68617 - DNA, 891 bp, Brassica napus
  CDS (78)..(728)
tgttttgtttgttctctcattcgatcacgtccctcccgtcgtatataatctcatcacacaaaagattgtatccattgatggaggagaaccagagaagcaggtttaaaaaagtttgcgtcttttgcggaagccactctggtaatagagaagtcttcagcgatgctgccatcgaactcggcaatgaactcgtgaagaggaagatagacttggtttatggaggaggaagtgttgggctgatgggtcttatctccaggagagtctatgaaggtggtttccatgtactcgggatcattcccaaagctttgatgccaattgagatatctggtgagactgttggagaagtaagggttgttgctgacatgcacgaacgcaaagctgcaatggcacaagaatctgaggccttcattgctctccctggaggttatggaacaatggaggagctgctggagatgataacatggtcacaactcggtatccataagaaaacggttggtatattgaatactgatggctactataacaatttgcttgcgttatttgacactggcgtccaagaaggttttatcaaaccaggggcacgtaatattgtggtttctgcaccaacagccaaagagcttatggagaagatggaggaatatactccttcacacaagcatgttgcatcccacgaaagctggaatgttgaggagcttggagcttaccctggacaacaaagcaatcatcaataaagaacaaggaaaaaaaacattcttattgattagcatatgctgctacttccatttcaagttttagtttgatttatttgcagattccacaacaatgtgtataagaaaactcaaaatcttgttgcaatttgaaacatcacattggggtcccgaaaaaaaaaaaaaa

SEQ ID NO: 68618 - protein, 216 aa, Brassica napus
MEENQRSRFKKVCVFCGSHSGNREVFSDAAIELGNELVKRKIDLVYGGGSVGLMGLISRRVYEGGFHVLGIIPKALMPIEISGETVGEVRVVADMHERKAAMAQESEAFIALPGGYGTMEELLEMITWSQLGIHKKTVGILNTDGYYNNLLALFDTGVQEGFIKPGARNIVVSAPTAKELMEKMEEYTPSHKHVASHESWNVEELGAYPGQQSNHQ

SEQ ID NO: 68619 - DNA, 1042 bp, Glycine max
  CDS (60)..(725)
gttctcctatcctagctacttactctctcttccttcaattcctcaactctctagctcttatggaaactcaacaccaacaacccaccatcaagtctaggttcagacgcatctgtgtctactgtggtagcagccctggcaaaaaccccagctaccagctcgctgctattcaactcggaaaacaactggtggagaggaacattgacttggtttatggaggaggaagcatagggttgatgggtctaatctcacaagttgtgtatgatggtggacgccacgtgttaggggtgattccagagacacttaatgcaagagagataactggagagagtgttggagaagtgagagctgtatcgggcatgcaccaacgcaaagccgaaatggcccgacaagccgatgcatttattgcactgccaggtggatatggcacccttgaagaactactggaaattatcacctgggctcaactaggcatccatgataaaccggtggggttgttgaacgtggatgggtactacaactcgctgctggcattcatggacaaagctgtggacgaaggtttcgtaacaccagctgcccgtcacattattgtttctgcccacactgcccaagaactcatgtgcaaacttgaggaatatgtccccgagcactgtggcgtggcccccaagctaagttgggagatggagcaacagttagttaacactgcaaagtcagatatttcccgttgactaataactaaataattaatcttctacaagctcactaatgcaccatcaaagaccctagatttagtgtataagtataaagtataatataacctcaaccccatgatgtagttgtaagctccacagaatagggcgaccacagtcgtttttagtttagctgtggatctaatcatttgtaatttctatggttcaagttcaagatattcaccatgtaatttctttaattttctttcttgattggctttcatggctgagactatgtattttaattatttcttagttaccaactaattgtgcattagaattaaaaaaaaaaaaaa

SEQ ID NO: 68620 - protein, 221 aa, Glycine max
METQHQQPTIKSRFRRICVYCGSSPGKNPSYQLAAIQLGKQLVERNIDLVYGGGSIGLMGLISQVVYDGGRHVLGVIPETLNAREITGESVGEVRAVSGMHQRKAEMARQADAFIALPGGYGTLEELLEIITWAQLGIHDKPVGLLNVDGYYNSLLAFMDKAVDEGFVTPAARHIIVSAHTAQELMCKLEEYVPEHCGVAPKLSWEMEQQLVNTAKSDISR

SEQ ID NO: 68621 - DNA, 941 bp, Glycine max
  CDS (29)..(730)
ctcaaactcaagctagcctttgggggatatgatagagaagaagacacagtgtgagaaaaaggaaaaaatggaaggtgaagaaactgagatgaaacaacaatccaggttcaaaaggatttgtgtgttctgtggcagcagccctgggaacaagagtagctataaggacgctgctattgagcttgggaaagagttggtgtcaagaaatattgatctggtttatggaggaggaagcattggtttgatggggttggtttcccaggctgtttatgaaggaggtcgccatgtaattggagttattcccaagacactgatgccaagagagattactggagagacagtgggggaagtgatggcagtagcagacatgcatcaaagaaaagcagagatggctaagcactctgatgcctttattgccttgcccggtggctatgggactcttgaggagcttctagaggtgataacttgggctcagcttggcatccatgataaaccggtggggttgctgaatgtagatggatactacaattccttgttgtgtttcattgacaaagctgtggaagaaggcttcattagccccaaagctcgccacataattgtatctgccccatcaacaaaagagcttgtcaaaaagatggaggaatattttccacaacatgaaagagttgcctctaagctaagctgggaaactgagcagatagattactcctcaaattgtggcatgtctaggtgattagatgattatggaagaatcgtgtagagacatttgttagtttaatggtttaagagactactactactattatggccacaatttcctttcttttattatgctattgcatttacttgttagtgtaaactacagagctgacttcaatctagctgtgaagcctaactactcttctgctcaatgtgaattctggttttttcaaaaaaaaaaaaaa

SEQ ID NO: 68622 - protein, 233 aa, Glycine max
MIEKKTQCEKKEKMEGEETEMKQQSRFKRICVFCGSSPGNKSSYKDAAIELGKELVSRNIDLVYGGGSIGLMGLVSQAVYEGGRHVIGVIPKTLMPREITGETVGEVMAVADMHQRKAEMAKHSDAFIALPGGYGTLEELLEVITWAQLGIHDKPVGLLNVDGYYNSLLCFIDKAVEEGFISPKARHIIVSAPSTKELVKKMEEYFPQHERVASKLSWETEQIDYSSNCGMSR

SEQ ID NO: 68623 - DNA, 849 bp, Brassica napus
  CDS (64)..(705)
agattcttctttctatttcttaaaaataaaactctgtgttgggaaataagaggagagagagggatggagattgaaccaaagttcaagagaatatgtgtgttttgtggaagtagtgctggtaataaaaccagttacagagatgctgctatcgaactcggagccgaactggtatccagaaatatcgatcttgtctatggcggagggagcataggtttaatgggtttgatttctcaagctgtttacaatggaggtcgccatgtcatcggggttatccccaagacactaatgccaaaagagataacaggagagacagtgggagaagtgaaggcagtagcagacatgcaccaaaggaaagctgagatggctaagcactctgatgcctttatcgctttacctggtgggtatgggacacttgaagagcttcttgaagtaatcacttgggcacagcttggaatccatgataaaccagtgggattactgaatgtggaaggatactacaattcattgttatcattcatagataacgcagttgaagaaggtttcatttcaccaactgctcgtcatatcattgtctctgctccttctgcgaaagaccttgtcaagaaacttgaggaatatgtaccaaggcacgagaaggtagcctcaaagaaaagctgggagatagaacaaattgggctgagtcccacttgtgaaatctcaagataaaaatgataaaagcccaattgtatgttttttctaaattggggttccttgttgcaaaacacaaattgactttatttgtgtagttgattctgttgttttaatgtattttaggatttcatttcggaaaagaactaaaaaaaaaaaaaa

SEQ ID NO: 68624 - protein, 213 aa, Brassica napus
MEIEPKFKRICVFCGSSAGNKTSYRDAAIELGAELVSRNIDLVYGGGSIGLMGLISQAVYNGGRHVIGVIPKTLMPKEITGETVGEVKAVADMHQRKAEMAKHSDAFIALPGGYGTLEELLEVITWAQLGIHDKPVGLLNVEGYYNSLLSFIDNAVEEGFISPTARHIIVSAPSAKDLVKKLEEYVPRHEKVASKKSWEIEQIGLSPTCEISR

SEQ ID NO: 68625 - DNA, 1176 bp, Glycine max
  CDS (106)..(747)
gaattcccgggtcgacttcgcttcgacgatttcgttctcattctcaaccctcttttctttgctccctctctctcggttgtagccgagacctcacaccaacgacaaatggaagagaccaattccagattcaagaggatttgcgtcttctgtgggagcagttcagggaagaaacctacctatcaggaagctgctgttcaacttggcagggaactggtggaaagaaggattgatttggtctatggaggtggtagcgtggggctgatgggtctcgtttctcaggcagttcatgatggtgggcgccatgttctaggggttatcccaacaagtcttatgccaagagagataacaggtgatcctattggggaagtgagagccgtatctagtatgcaccaaaggaaagccgagatggcccgtcaagccgatgcttttattgccctccccggaggatatggaacccttgaagaattgctggaagtcattacatgggcgcagcttgggatccacagcaaacccgtgggcctgttgaatgtggatggattttacaattccttgttgtcgttcattgacaaagccgttgatgaaggctttatatcccctaaggcacgtcgcattatcgtgtcagcacccacagccaaacaattgatgctagagctagaggaacatgttcccgagcaagatgagtttgcgtccaagttggtgtgggaagaaagactgaattacgtgactgaatcagaagttgccatgtgaccaatcctctttgtggacgattcaatgatccacggttttttaggtttttacatttatagcatattctgggtacataggattaggactcatccatcatatacgggcataggaaccgtgcagtagaagtcaatactttttttttttgccaacctttttggtaaagcccctagtatacggaaacgagcgttgttcaaaatttggaaaatcctaattaaaatttatgtttccattgcctcggcaaatggcaatgaagatccgaatcattcacggcaacatttgtccttcaggaatttttttttcctgttagttcagtgttgtctctttgaaccaaccgttacttttagataaattctttaataacaacttggtcaaaattgccagttgaaaaacactagagaatatgtactctttaatcaaaaaaaaaaaaaa

SEQ ID NO: 68626 - protein, 213 aa, Glycine max
MEETNSRFKRICVFCGSSSGKKPTYQEAAVQLGRELVERRIDLVYGGGSVGLMGLVSQAVHDGGRHVLGVIPTSLMPREITGDPIGEVRAVSSMHQRKAEMARQADAFIALPGGYGTLEELLEVITWAQLGIHSKPVGLLNVDGFYNSLLSFIDKAVDEGFISPKARRIIVSAPTAKQLMLELEEHVPEQDEFASKLVWEERLNYVTESEVAM

SEQ ID NO: 68627 - DNA, 799 bp, Triticum aestivum
  CDS (31)..(735)
gaattcccgggtcgaccgacggatcaggcgatggctgttgaggccacggcagagaagaacaccggcgccgctgccccggagagcggggacaggcgctcccgcttcaggcggatctgcgtctactgcggcagcgccaagggccggaaggccagctaccaggacgccgccgtcgagctcggcaaggagctggtggagaggggcatcgacctggtctacggaggaggctccattgggctcatgggcctcgtctcccacgcagtccatgatggaggacgccatgtgattggggtcatccccaagtccttgatgcccagagaggtcactggagagcctgttggggaagtcagagccgtctccggcatgcacgagaggaaggccgagatggttcgctctgctgatgccttcattgccttacccggtggctacgggactctggatgagctgctcgaggtcctcacgtgggcccaacttgggatccacaagaagccgatcgggttgctgaacgtggatgggttctacaatttcttcctgtccttcatcgacatggctgtgagcgaaggattcatacaggaggacgcgaggcacctcgtcatctcagctccaaccgccaaggagctagttctcaagctcgaggagtatgttccggactacgagatcgggctggtgtgggaggatcagggccagatcacgcacggcttcgtgccggagctggagcccggcattgcgtcgtcatgatacgattcatcgtggaagcgtttctgaactaagtaacatctgaccgtgcaaaaaaaaaaaaaaa

SEQ ID NO: 68628 - protein, 234 aa, Triticum aestivum
MAVEATAEKNTGAAAPESGDRRSRFRRICVYCGSAKGRKASYQDAAVELGKELVERGIDLVYGGGSIGLMGLVSHAVHDGGRHVIGVIPKSLMPREVTGEPVGEVRAVSGMHERKAEMVRSADAFIALPGGYGTLDELLEVLTWAQLGIHKKPIGLLNVDGFYNFFLSFIDMAVSEGFIQEDARHLVISAPTAKELVLKLEEYVPDYEIGLVWEDQGQITHGFVPELEPGIASS

SEQ ID NO: 68629 - DNA, 873 bp, Triticum aestivum
  CDS (25)..(645)
gggaaggagaggccaaggagaaggatgaggcagcaggcgagcaggttcaagaggatgtgcgtcttctgcggcagcagccagggcaacaagagcagctaccacgacgccgccatcgacctcgccaaccagctcgtgggcgggggcatcgacctggtgtacggcggcggcagcatcgggctgatggggctcgtctcgcaggccgtctaccacggcggcaggcacgtcatcggggtcattcccaagactctgatgacccccgagatcgtcggggagatggtgggggaggtgaggccggtgggcgacatgcaccagcgcaaggcccagatggccagcctctccgacgccttcatagccctgcccggtgggtacgggacgctggaggagctgctggaggtgatcacctgggcgcagctagggatccatcacaagccggtgggtctgctgaatgtggaggggtactacgactcgctgctgaccttcatcgaccaggccgtggaggaaggattcatcagccccgccgcccgccgcatcatcgtctccgcccccaccgcccaccaactcatggagaaactcgaggagtacgtcccttactacgaaatggtcgcgtccgggctggactgggagacggatcgcctagacttctgatcatcgagcaggcattcgccatttctgtcatcgtgatgcatgcgcgcggatcgagcgaacaatgtgttgaagattagcgtaaaataatactagctagttcagttgtactcgatcgtcttctgtaagggtgcgctcaatatgaactttcggcaggtagctagctagcgcccaacctttatatatctcattaattcagtcactagtattagttccaaaaaaaaaaaaaaa

SEQ ID NO: 68630 - protein, 206 aa, Triticum aestivum
MRQQASRFKRMCVFCGSSQGNKSSYHDAAIDLANQLVGGGIDLVYGGGSIGLMGLVSQAVYHGGRHVIGVIPKTLMTPEIVGEMVGEVRPVGDMHQRKAQMASLSDAFIALPGGYGTLEELLEVITWAQLGIHHKPVGLLNVEGYYDSLLTFIDQAVEEGFISPAARRIIVSAPTAHQLMEKLEEYVPYYEMVASGLDWETDRLDF

SEQ ID NO: 68631 - DNA, 930 bp, Hordeum vulgare
  CDS (34)..(708)
gcgcccgagcccgcgaggagacaagccaaagccatgggcgacaccaccgcgccctcgccgccgaggaggttcggcaggatctgcgtcttctgcggcagcaactccggcaaccgcgccgtgttcggcgacgccgcgctcgagctcggccagggcctggtgacgaggggggtcgatctggtctacggcggcggcagcatcgggctgatgggcctgatcgcgcagacggttctcgacggcggctgccgcgtcctcggggtgattccaagagcactcatgcccctcgagatatccggtgcaagtgttggagaagtaaagattgtctccgacatgcatgagaggaaagctgagatggcgcgacaagccgatgcattcattgctcttccgggtgggtatggaacaatggaagagctgttagagatgatcacttggtcgcagcttggaatccatgacaaaccggtcgggttgctaaacgtcgatgggtactatgatccgttactcgcgctgttcgacaagggcgcggcggaagggtttattaaggccgattgcaggcagataatcgtgtcggcaccaactgcccacgaactgctgacaaaaatggagcaatacacccgttcacaccgggaggtggcctcgcggacgagctgggagatgaccgagatgggctacgggaaagcaccggagccggaggaggaggcggcggcatcgtagcaatgcctcgccgatgcgtgtcgttgtcatcgtcatcgatatcccttggtgctcaactggccgctgggattgcaattgcaataatcttacgtagtgctctcttgtgatttcttcgttgttggttgcctttcatgtaaccccgtagtacgttggattgtgactttgatctggcgaagaagcctaaggtattgtgtgcctagttattataaaaaaaaaaaaaaa

SEQ ID NO: 68632 - protein, 224 aa, Hordeum vulgare
MGDTTAPSPPRRFGRICVFCGSNSGNRAVFGDAALELGQGLVTRGVDLVYGGGSIGLMGLIAQTVLDGGCRVLGVIPRALMPLEISGASVGEVKIVSDMHERKAEMARQADAFIALPGGYGTMEELLEMITWSQLGIHDKPVGLLNVDGYYDPLLALFDKGAAEGFIKADCRQIIVSAPTAHELLTKMEQYTRSHREVASRTSWEMTEMGYGKAPEPEEEAAAS

SEQ ID NO: 68633 - DNA, 927 bp, Brassica napus
  CDS (40)..(672)
cggaatctaagccaggtgtggaaatttgagatatatccaatggctggacagactgatcctcatgtctcactattttctcctgaagaggttgagtttatggcagaggacgaactggtggagattgttcctaatatgaacatggagcccctcaatttcatcgctggggattttggccggttcattcctcagattccaatacaagtgcctctgtggcttgcagtggctctgaagcgtagaggaaaatgtactttccggcctccagggtggttgtctgttgacaatttgactcaggtcttggaagcagagcgggaacctcagtcgaaatttcaggcattaccatttagttacgtggagattgctagactactttttgatcatgcacgtgatgatattccagacatgtatatggtaagatcgctagttgaggacattagagatgtgcggcttcacaaactggagaataacttgggcacatttctaggtacatctgcagtaaagatggagaatgtatcggcaatggaagtgaacctagtccgcccatttgctagaagagccttagaagcgttttataagcatgacaagccagaggctgctgcagacagaaacactagaagtagcagacaaccccgtgaagctaacgatgaaccaaggagacctctaaggcaacgctaaggagcttctgtgtccttgcctaagtgagaaagaagaagtcaggtatcttctgtgccaatatttgtggagctcccctgagaagtgatagcaccaacaacatctagctacgtgtcttaaatatatgcattgtttctcttgttctgttacgtactcttggtactattaagcatctttgcaaattgtagatggaacccatattgtttcattttcaagtacgtgggttaaaactaatgttagcaacaaaaaaaaaaaaaa

SEQ ID NO: 68634 - protein, 210 aa, Brassica napus
MAGQTDPHVSLFSPEEVEFMAEDELVEIVPNMNMEPLNFIAGDFGRFIPQIPIQVPLWLAVALKRRGKCTFRPPGWLSVDNLTQVLEAEREPQSKFQALPFSYVEIARLLFDHARDDIPDMYMVRSLVEDIRDVRLHKLENNLGTFLGTSAVKMENVSAMEVNLVRPFARRALEAFYKHDKPEAAADRNTRSSRQPREANDEPRRPLRQR

SEQ ID NO: 68635 - DNA, 633 bp, Glycine max
  CDS (1)..(633)
atggccgggcaatcaaaccatgacctttcattgttttcagctgaggagcttgagttcattgctgaagatgagatcgtggacattgtacccaatctcaaaatgagtgctctcaatttcatttctggagattttggcccatttacgccccagattgttacccaagtaccactgtggttggccactgctctcaagaagagaggcaagtgctccatttgccctccccaatggatgtctgttgagaagttgagtcaagttttggaggcagagcgagactctcaagagatgtcagatcaattgccatttcattatgtggaaatctcaagacttctttttgatcatgcacgtgacaacattcctgatgtatatatggtgaggtctctaattgaggacatcagaaatgttcggtttcataaagttgaaactgatttggaagcatttaatggtcgtacaattgctgttaagattaaaaatttatctgcaatggaagtgaatattgttcgtccatttattggaagagctttacaggcattttataagcatgatagtccagagctgataccagacccagagagagtttctgataggcgcccccaagttatcaacaatgctccaagaagacaactacgaagatag

SEQ ID NO: 68636 - protein, 210 aa, Glycine max
MAGQSNHDLSLFSAEELEFIAEDEIVDIVPNLKMSALNFISGDFGPFTPQIVTQVPLWLATALKKRGKCSICPPQWMSVEKLSQVLEAERDSQEMSDQLPFHYVEISRLLFDHARDNIPDVYMVRSLIEDIRNVRFHKVETDLEAFNGRTIAVKIKNLSAMEVNIVRPFIGRALQAFYKHDSPELIPDPERVSDRRPQVINNAPRRQLRR

SEQ ID NO: 68637 - DNA, 1113 bp, Triticum aestivum
  CDS (201)..(836)
ccaatcccaaatcccaccactcccactcccacctccactcccacctctcacgtgcggcgccgccgccgccgccattccggttcttcctcgccggcgcgtcgcgttcccgccatctccaccccgccccggtcttcggccatcgggcttcgaggcacccggcgcaccatccagatccgcccctgccctccccccaaatcggcatggcggggcagtccgacccgcatctctccctcttctcgccctccgaggtggagttcgtggccgaggacgagatcgtcgagatcgtccccaacatccggatggaggccctgaacatgatctgcggggatttcggacccttcttcccacaaattccaagcaaggtccctctgtggcttgctgtggcactcaagaggcgtggcaagtgcaccatacgtgcacccgagtggatgactgttgagcgcttaacacaggtgttggatgctgaaagagagtcacctagggaatttcagccattaccattccactatatcgaaatttctaagcttctgtttgatcatgctcgtgatgacatcacagatgcttacttggtgagatctttgatcgaggatatcagagatgtcaggttccataaggtcgagactggattagagacaatatctggccgtactcatgctgtgaagctcaaaaatctctctgcaatggaggtgaatatcgtgcgtccatttatggtgagaactttgcaggcgttctacaagcatgatagcccacagatgattcagcaggcagacaacacagggagcagatcaacaccagtcacagatcgtggtccaaggagagacctaaggcgcaggtaacgagcatactcgtgccgaaacagctgaggcgcgggttgtgagcgggacatccatgagcgtgtcacttgtattttgcggataattctctgcataggagtggaattgtagtgaacaaaggtacccgctgcgctgttgtcgtgtgctgtatgttattagctgaagagccattttagttccctcagcgcgtctattttatcctactgtatcggatcatgaatggatgtgtgtttatctattaaccacaaggttttagaattggccgaaaaaaaaaaaaaaa

SEQ ID NO: 68638 - protein, 211 aa, Triticum aestivum
MAGQSDPHLSLFSPSEVEFVAEDEIVEIVPNIRMEALNMICGDFGPFFPQIPSKVPLWLAVALKRRGKCTIRAPEWMTVERLTQVLDAERESPREFQPLPFHYIEISKLLFDHARDDITDAYLVRSLIEDIRDVRFHKVETGLETISGRTHAVKLKNLSAMEVNIVRPFMVRTLQAFYKHDSPQMIQQADNTGSRSTPVTDRGPRRDLRRR

SEQ ID NO: 68639 - DNA, 1013 bp, Zea mays
  CDS (103)..(738)
gaattcccgggtcgacctcgctctcgcctcgccgcctccgacccgcagcagcgcctccattgctctctctcacgagtcccggcgttccagtggggggcattcatggcggggcagtccgacccgcacctctccatcttctcgccctccgaggtggagttcgtggctgaggatgagattgtcgaaatcgtccccaacatccgcatggacgccctcaacatgatctgcggggatttcgggcccttcttcccccagattcccaccaaggtgcctctctggctcgctgtcgcgctcaagaagcgtagcaagtgcaccatccgcaccccggactggatgactgttgaccgcttgacacaggtattggaagcggaaagagagtcgccacgagaattccagccattaccattccactatattgaaatttctaagcttctgtttgatcatgctcgtgatgacatctcagatgcatacctggtaagatctctaattgaggacatcagagatgtcagatttcacaaggttgagactggattagagacgatatctggacgcacccatgccgtaaagctcaaaaatctctctgcaatggaagtgaacattgtccgccctttcatggtgagaactttgcaggcattctataagcacgatagtgcacagatgattcagcaagcagataatatagggagcagagcaacactggttacagaccgtggcccgagaagagatctaaggcgcaggtagtccacttgtattctgccaaaaaaaatgtatatctgaggacagcagcaagtggttgctttcttgcaataataccagctaagtatgtgctaatgagtcctgagatgtatcagatagtaaagcaatggtggatcatagtttgtctacttttatagagggaactggcattgctcttccccgctttgaaattgtactgctttattcctactgatgttatatgcaagtgtgtgtgtgtggctcattgatctctccaaaaaaaaaaaaaaaaaagcggccgc

SEQ ID NO: 68640 - protein, 211 aa, Zea mays
MAGQSDPHLSIFSPSEVEFVAEDEIVEIVPNIRMDALNMICGDFGPFFPQIPTKVPLWLAVALKKRSKCTIRTPDWMTVDRLTQVLEAERESPREFQPLPFHYIEISKLLFDHARDDISDAYLVRSLIEDIRDVRFHKVETGLETISGRTHAVKLKNLSAMEVNIVRPFMVRTLQAFYKHDSAQMIQQADNIGSRATLVTDRGPRRDLRRR

SEQ ID NO: 68641 - DNA, 249 bp, Brassica napus
  CDS (1)..(249)
atgcagaacgaagagggtcaggtcacggaactctacattcctaggaaatgctctgctactaaccggatgatcacatcaaaggatcatgcctctgtgcaactcaacattggtcatttagatgctgatggcatctacaccggtcaattcactaccttggctctctgcggttttgttcgtgcccagggagacgctgacagtggggtggacaggctgtggcagaagaagaaggtcgaagccaaacaaatctaa

SEQ ID NO: 68642 - protein, 82 aa, Brassica napus
MQNEEGQVTELYIPRKCSATNRMITSKDHASVQLNIGHLDADGIYTGQFTTLALCGFVRAQGDADSGVDRLWQKKKVEAKQI

SEQ ID NO: 68643 - DNA, 246 bp, Triticum aestivum
  CDS (1)..(246)
atgcagaacgaggtgggtgatatggtggacctctatgtcccaaggaagtgctctgccaccaacaggatcataactgccaaggaccatgcctctgtccagatcaacatcgggcatgtggatgcgaatggactgtataatggcagtttcaccacgtttgccctctctggattcgtccgcgcccagggtgatgctgatggttctttggacaggctctggcagcagaagagggctgagatcaagcagtag

SEQ ID NO: 68644 - protein, 81 aa, Triticum aestivum
MQNEVGDMVDLYVPRKCSATNRIITAKDHASVQINIGHVDANGLYNGSFTTFALSGFVRAQGDADGSLDRLWQQKRAEIKQ

SEQ ID NO: 68645 - DNA, 249 bp, Glycine max
  CDS (1)..(249)
atgcagaacgaggaaggacagatcaccgagctttacattcctaggaagtgctctgccacaaaccgattgattaccgctaaggaccatgcttcggttcaggttaacattgggcatgtggatgagaatggcgtctacaatggccatttctccacttttgctctctgcggcttcatacgtgctcagggtgatgctgacagtgccctagatcgcttgtggcagaagaagaaagttgaagttaagcaacagtag

SEQ ID NO: 68646 - protein, 82 aa, Glycine max
MQNEEGQITELYIPRKCSATNRLITAKDHASVQVNIGHVDENGVYNGHFSTFALCGFIRAQGDADSALDRLWQKKKVEVKQQ

SEQ ID NO: 68647 - DNA, 246 bp, Zea mays
  CDS (1)..(246)
atgcagaacgaggagggtaagactgtggacctctatgtccccaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggcgacgcagacagctccttggacaggttgtggcagaagaagaaggttgatatcaagcagtag

SEQ ID NO: 68648 - protein, 81 aa, Zea mays
MQNEEGKTVDLYVPRKCSATNRIITAKDHASVQINIGHLDANGLYDGHFTTFALSGFVRAQGDADSSLDRLWQKKKVDIKQ

SEQ ID NO: 68649 - DNA, 1481 bp, Zea mays
  CDS (44)..(1348)
gaattcccgggtcgacttcgctgtcgacgatttcgtccaacccatggcgacccacgccagcgacaatggcagcgggcacgcggagtggcggttcgctcgggcggcgaaggagggtgcgctggccgtggccggggacaagatgagcatccgggcggcgcggttcaagatcagcgcgagcgtggacgggcgcgacccgcggcccgtgctgccgcttgcgcacggggacccctcggtgttcccggccttccgcaccgccgccgaggccgaggacgccgtggccgccgcgctccggacgggcaagttcaactgctaccccgccggcgtcggcctccccgaagcccgccgtgctctggcggagcacctgtcaagtgatcttccatacaagctgtcaactgatgacatcttcctcaccgctggaggcactcaagccattgaggttgtcgtctcagtccttgcccaaccgggcgccaacatattgctcccaagaccaggctatccaaattatgaggcgcgtgcaggactgcacaacttacaagttcgccatttcgatctgattcctgagagagggtgggaaattgatatcgactctctggagtcgattgctgacaagaacaccaccgcaatggtcatcataaaccccaacaatccttgcggcagtgtctacacccgtgaacatttagccaaggtcgcagaggtagcaaggaagcttggaatactagtcatcgctgatgaagtgtatggaaacctggtgtttggggacaccccttacgtcccaatgggtgtctttggccacattgcccctgtcttgagcataggatcactatcgaagagatggatagtgcctgggtggcgacttggttgggtagctgtatgtgatcccaacaagattctgcaagaaaccaagatcattgcatcaataacaaacttccttaacgtttcaactgatccggcaacttttgttcagggagcacttccccatattcttgagaacacaaaggaagattttttcaggaggatcattggtctgctagcagaaacctcagagatatgttacagagaaataaaggacatcaagtgcatcacctgccctcacaagccagaaggttccatgtttgtcatggtgaaattaaatttgtatcttttggaggggattcatgacgatattgatttttgctgcaagctggcaaaagaagagtctgtgattttgtgtccagggagtgttttgggaatggaaaactggatccgcatcactttcgccattgattcatcttctcttcttgatggtcttgagaggatcaaatctttctgccaaaggcataagaagaagaatttgcttaatggccattaactgtatctacgttcaaagttacccagttccattgtttttcattgtatcatcaacaaatgtggaactttgaaatccctctgaattaataaagttttccttgaatacgcaaaaaaaaaaaaaaaaaagcggccgc

SEQ ID NO: 68650 - protein, 434 aa, Zea mays
MATHASDNGSGHAEWRFARAAKEGALAVAGDKMSIRAARFKISASVDGRDPRPVLPLAHGDPSVFPAFRTAAEAEDAVAAALRTGKFNCYPAGVGLPEARRALAEHLSSDLPYKLSTDDIFLTAGGTQAIEVVVSVLAQPGANILLPRPGYPNYEARAGLHNLQVRHFDLIPERGWEIDIDSLESIADKNTTAMVIINPNNPCGSVYTREHLAKVAEVARKLGILVIADEVYGNLVFGDTPYVPMGVFGHIAPVLSIGSLSKRWIVPGWRLGWVAVCDPNKILQETKIIASITNFLNVSTDPATFVQGALPHILENTKEDFFRRIIGLLAETSEICYREIKDIKCITCPHKPEGSMFVMVKLNLYLLEGIHDDIDFCCKLAKEESVILCPGSVLGMENWIRITFAIDSSSLLDGLERIKSFCQRHKKKNLLNGH

SEQ ID NO: 68651 - DNA, 826 bp, Brassica napus
  CDS (10)..(684)
gatccaacaatggcgatttctactttaacactcacatcatctcactacacgcgttcctttagacccaccatctcttcttcttcttcgtcgtcatcgtcattctcatgtctctgttcttcttcttcttcttccaccgattgccagcagaaacagaggagcttcaccgccgcgaagacgaatgttttcggagtgggtttaggccttttagctgccacgattctctctataacgcctctggacgcagacgccacgaggattgagtactacgccactgttggagaccctctctgcgaatacagctacgcaaaatcagggcttggattctgcgatatcgcagttgggttcggtgataaagccccacgtggcgtactcgtcaatgtccattacacggctaggtttgcagatggaacgttgtttgacagtacatataagcgtgcaagaccacttactatgcggattggagtgggcaaggttataaggggtctcgaccaggggattcttggaggcgaaggagtacctcctatgcgagtaggaggaaagcgtaaacttcagattccacctaagctagcttatggaccagagcctgcaggatgcttttctggtgactgtaacatacctggcaatgcaactttgctatatgatatcaattttgttgagatctaccctggaagtaacacaagatgaagcctgccaacctccagtttcgttcggtaaaggaagaaataactatgtatatcgccagattctctagctcttatcatatgtaaacattgacatttttcaactataacccaatgagtagcttgctcttgaaaaaaaaaaaaaa

SEQ ID NO: 68652 - protein, 224 aa, Brassica napus
MAISTLTLTSSHYTRSFRPTISSSSSSSSSFSCLCSSSSSSTDCQQKQRSFTAAKTNVFGVGLGLLAATILSITPLDADATRIEYYATVGDPLCEYSYAKSGLGFCDIAVGFGDKAPRGVLVNVHYTARFADGTLFDSTYKRARPLTMRIGVGKVIRGLDQGILGGEGVPPMRVGGKRKLQIPPKLAYGPEPAGCFSGDCNIPGNATLLYDINFVEIYPGSNTR

SEQ ID NO: 68653 - DNA, 1936 bp, Brassica napus
  CDS (76)..(1797)
gcttttacaaactctctaaactttgtggataattttatacaatctcttttaagctttcattcttaaagcagaaaaatggctgacgatttcgacatggagattccggcagaggaggcggaggagatggacttggatctcgaggacgatgccgagtctgatccttccctgaaagtgggcgaggagaaggagattgggaagtcaggactgaagaaaaagctcgtcaaggaaggtgaaaagtgggacactcctgagagcggagacgaagttgaagtgcattatacgggaactttgttggacgggaccaagtttgattcaagccgtgacagaggaactcctttcaaattcacgcttggccaaggacaagtgatcaaaggatgggacatggggatcaagacgatgaagaaaggtgaaaacgctgttttcaccattcctcccgagctggcatatggtgaaaccggttcaccgcccaccattcctccgaatgctactcttcagttcgatgtggagctgttatcgtggaggagcgttaaggatatttgtggtgatggtggtttgttcaagaaggttattgcggaaggagagaagtgggagaagccaaaggaccttgatgaagtgtacgtcaagtatgaagctcggctcgaggatggaactgttgtgggaagatctgatggtgcaaagttcactgtcatggatggccatttctgtcctgcgatcgctaaggctgtcaagaccatgaaaagaggggaaaaggtgctcctaactgtcaagccacaatatggctttggggaaactggaagagcagcgtccgattgtattcaagctgcagtccctccgaatgcgactcttcagatggaccttgagttggtgtcttggaagacggtggtggaagtaactgatgacaagaaggtcattaagaaaatactgaaggagggagaaggatatgagcgtccgaatgaaggagcagttgtcaaattgaagttgattggtaagcttcaagatggaactgtgttctttaagaaaggtcatggagaagacgaggagccgttcgagttcaagactgatgaagaacaagttattgaagggctggagaaagctgtgatgggcatgaagaagggtgaggtggctctcatcaccatctctcctgaatatgcctttggttcctctgaatcaaaacaggagctagctgtgataccaccagactcgacagtttgctacgaggtcgagctggtatccttcattaaggagaaagagtcctgggacatgaacacacaggaaaagatagaagctgctggcaagaagaaggaagaagggaatactctattcaaggctggaaaatatgcaagagcttcaaaaagatacgagaggggtgtcaagttcatagagtatgactcctctttcgatgaagaggacaaaaagaaggctaaagctctgaagattgcttgtaacctgaacaatgcagcttgcaagctgaaactgaaagattacaaagaggcggcgaaactgtccactaaggtattggagatggacggaagcaacgtgaaggcaatgtacaggagagcacaggcgtatatggagacggctgatcttgatcttgctgagctcgatatcaagaaagtccttgaaatcgatccggacaacaaggaggtgaagatggagtacaagaagctcaaggagaaggtgagggagtacaacaagaaagacgctaagttctacagcaacatgctggccaaaatgctcgagccacataaagaagcacgcaaggatgcacaagcgatgagcattgacgccaaggcatgagtcgaaacaccattgcgccacaaaatgtattacaaatttctttctgtcccattttgtaaacgatctttgtgtgtggtgtactgttgtggatgattttgctcttataataaatcagactttgtaataaaaaaaaaaaaaa

SEQ ID NO: 68654 - protein, 573 aa, Brassica napus
MADDFDMEIPAEEAEEMDLDLEDDAESDPSLKVGEEKEIGKSGLKKKLVKEGEKWDTPESGDEVEVHYTGTLLDGTKFDSSRDRGTPFKFTLGQGQVIKGWDMGIKTMKKGENAVFTIPPELAYGETGSPPTIPPNATLQFDVELLSWRSVKDICGDGGLFKKVIAEGEKWEKPKDLDEVYVKYEARLEDGTVVGRSDGAKFTVMDGHFCPAIAKAVKTMKRGEKVLLTVKPQYGFGETGRAASDCIQAAVPPNATLQMDLELVSWKTVVEVTDDKKVIKKILKEGEGYERPNEGAVVKLKLIGKLQDGTVFFKKGHGEDEEPFEFKTDEEQVIEGLEKAVMGMKKGEVALITISPEYAFGSSESKQELAVIPPDSTVCYEVELVSFIKEKESWDMNTQEKIEAAGKKKEEGNTLFKAGKYARASKRYERGVKFIEYDSSFDEEDKKKAKALKIACNLNNAACKLKLKDYKEAAKLSTKVLEMDGSNVKAMYRRAQAYMETADLDLAELDIKKVLEIDPDNKEVKMEYKKLKEKVREYNKKDAKFYSNMLAKMLEPHKEARKDAQAMSIDAKA

SEQ ID NO: 68655 - DNA, 870 bp, Glycine max
  CDS (10)..(660)
ctggtggagatgggtttagtggcaccttactctgctggaacatgtcttccttcccttcaacgccttccaaccctgcaagcccaaaaatggaacaacttctcagcacctcttagttgccaccgccaagtgaaatgtgctgtccaagtccaaccacaagtagcaccacgaattacacctgatgagagcctgcaggtgaagagaagaactctcataggccttctagcatttgatgctgtccttgcttattcttcattgcaagcagcaccagcagctgaaaatccgtgtgaatttcaagtggcaccttcaggccttgccttctgtgacaaacttgtgggagctggtcctcaagcagtgaagggacagcttattaaggcgcattatgtggggagattggagaatgggaaagttttcgatagcagctacaatcgtggcaagccactaacctttcgcgtcggtgttggagaggtcattaaaggttgggatgaaggcattataggaggtgatggagttccccccatgcttgcaggagggaaacgtacactgaagattcctccagaacttggatatggctcaagaggggctggttgtaggggaggttcatgtatcattcctcctgattcggtattattgtttgacgtggagttcgttagcaaagcatgatttacaaagccgtgagctggcaaattgccttcttttttgtttggagtttggagcttacatttcatatagtagaaattttataatttaatatcaaagtaaaaattacttgataaatgcatgactaagtaataaacatgctatgttgttgattatccagctttgatttcagtatagaaattgtagccgaaagttgaacaaaaaaaaaaaaaa

SEQ ID NO: 68656 - protein, 216 aa, Glycine max
MGLVAPYSAGTCLPSLQRLPTLQAQKWNNFSAPLSCHRQVKCAVQVQPQVAPRITPDESLQVKRRTLIGLLAFDAVLAYSSLQAAPAAENPCEFQVAPSGLAFCDKLVGAGPQAVKGQLIKAHYVGRLENGKVFDSSYNRGKPLTFRVGVGEVIKGWDEGIIGGDGVPPMLAGGKRTLKIPPELGYGSRGAGCRGGSCIIPPDSVLLFDVEFVSKA

SEQ ID NO: 68657 - DNA, 766 bp, Glycine max
  CDS (99)..(563)
ggatcgtccttgtcctattaaataacaccgcccaccgactgtgtgagtccgagtgtgagagaaaccagtgactgacttttcgagaaagaaaaacaaaaatgagtttccgtcattccatcatgaacgctcttcccattctcctcttcttcctcttcgtttctgcattagtttctgcgaagaaaactggtgatgtgacggagctgcaaattggcgtgaagcataaaccagtatcatgtgaagttcaggcacacaaaggtgacagagtcaaagtacactataggggaaaactcactgatggaactgttttcgattctagctttgaaagaaataatccaattgaatttgagcttggtactggtcaagtgatcaaaggttgggaccagggattattgggaatgtgtcttggtgagaagcgtaagctgaaaataccatcaaaacttggctatggagagcagggttccccacccactattccaggtggtgctacactcatatttgacgctgagcttgtgggagtgaacgacaaaagtttaggcgaaggaaaaggaaacaacgaactgtagacaaatcaaaacaaatggatagtcgagcttttgctatcttagcttatttttgttcctcaataatatgcttttatgacccaaggtttaactgttttactatgaggctaatttagaaagatttatctggtgtacccctatcatctgaattcatctctacctagtatttagtagctattaaggacctgtttgaaaaaaaaaaaaaa

SEQ ID NO: 68658 - protein, 154 aa, Glycine max
MSFRHSIMNALPILLFFLFVSALVSAKKTGDVTELQIGVKHKPVSCEVQAHKGDRVKVHYRGKLTDGTVFDSSFERNNPIEFELGTGQVIKGWDQGLLGMCLGEKRKLKIPSKLGYGEQGSPPTIPGGATLIFDAELVGVNDKSLGEGKGNNEL

SEQ ID NO: 68659 - DNA, 2030 bp, Glycine max
  CDS (173)..(1921)
ctactcaccctgatacgcttgccgtggaactctctggaacccctcaccgctgcttctccttttaaaccctattcgctacttcacaacacatctctctgaactgaattaaactacatagaaaaataaaaccaaacctttcttcctactactcccattcccacatttcgacaacatggacgaggacttcgacatgccgacggcggaggcaatgggcgaggacttcgacttcgccggcgccaccggcggcgacctcgacggcagcagcagcaaccccatcttgaaggtcggcgaggagaaggagattggaaaagagggtttgaagaagaaactacttaaagaaggtgaaggatgggacactcctgaagttggtgacgaagttcaagttcactatactgggacgttgcttgatggcactaagtttgattccagcagagataggggaactcctttcagtttcacgcttggacaagggcaagttattaaaggatgggatcaaggtattataacgatgaagaaaggtgaaaattcccttttcaccatcccggctgagctagcttatggtgaaactggttctcctccaacaattccccctaatgcaactcttcaatttgatgtggagctgttgtcttggactagtgtgaaagacatatgtaaggatggaggtttatttaagaagatacttaccaagggggagaaatgggagaacccaaaggatcctgatgaagttttagtcaagtatgaagcatgccttgaagatggaactcttgtggcaaaatctgatggagtggagttcacagtcaatgatggttatttttgtcctgctttgtcaaaggctgttaaaaccatgaagaagggagagaaagtgcttctgacagtgaagccacaatatggatttggtgagaagggtaagccagcacatgatgaagaaggtgcagttccaccaaatgcaacattgcagattactcttgagttagtttcttggaagactgtctcagaagtaacggaggacaagaagatcattaagaagatcctcaaggaaggggaaggatatgagcgtccaaatgagggagccattgtgaaattgaaagtaattggtaagctgcaagatggtactttgtttttgaaaaagggccatgacgatgaaggagagctgtttgaattcaaaactgatgaggagcaagtaattgatgggcttgacagagctgtgttgactatgaagaagggtgagatagcattgttgattataggacctgaatatgcttttggttcatcagagtctcagctggaacttgcagtggttccacctaactccacagtatattacgaggttgagctagtatcatttgagaaggagaaggaatcctgggacatggacacgccagagaagattgaagctgctggtaagaagaaagaagaaggaaatgcattatttaaagctggtaaatatgcaagagcttctaaaagatacgagaaggctgtaaagttcatagagtacgatactgcctttagcgaagaggagaagaagagctccaaagccttgaaggttgcctgtaatctaaacaatgcagcatgcaagttgaaattaaaagattataaacaagcagagaaattgtgcacaaaggtactggaccttgagagtactaatgtgaaggctctctatagaagggcccaggcatatatccagttggctgatttagacttggccgaatttgatattaagaaagcgcttgagattgaccctaacaacagggatgtcaagcttgagtacaagactttgaaggaaaagatgaaggagtacaacaaaaaagaggcaaaattttatggaaatatgttcaacaaactgcacaagctagattctcttgacagtaataaaccagcgtcgaaggatgcccaaccgatgaatatcgacagcaaggcataaacatcatggaaattcagctaatttcgagggtctgttatttattattatttgtggacatttggaattatgatggattattcaatgtgtatggagataaaaaaaaaaaaaa

SEQ ID NO: 68660 - protein, 582 aa, Glycine max
MDEDFDMPTAEAMGEDFDFAGATGGDLDGSSSNPILKVGEEKEIGKEGLKKKLLKEGEGWDTPEVGDEVQVHYTGTLLDGTKFDSSRDRGTPFSFTLGQGQVIKGWDQGIITMKKGENSLFTIPAELAYGETGSPPTIPPNATLQFDVELLSWTSVKDICKDGGLFKKILTKGEKWENPKDPDEVLVKYEACLEDGTLVAKSDGVEFTVNDGYFCPALSKAVKTMKKGEKVLLTVKPQYGFGEKGKPAHDEEGAVPPNATLQITLELVSWKTVSEVTEDKKIIKKILKEGEGYERPNEGAIVKLKVIGKLQDGTLFLKKGHDDEGELFEFKTDEEQVIDGLDRAVLTMKKGEIALLIIGPEYAFGSSESQLELAVVPPNSTVYYEVELVSFEKEKESWDMDTPEKIEAAGKKKEEGNALFKAGKYARASKRYEKAVKFIEYDTAFSEEEKKSSKALKVACNLNNAACKLKLKDYKQAEKLCTKVLDLESTNVKALYRRAQAYIQLADLDLAEFDIKKALEIDPNNRDVKLEYKTLKEKMKEYNKKEAKFYGNMFNKLHKLDSLDSNKPASKDAQPMNIDSKA

SEQ ID NO: 68661 - DNA, 740 bp, Brassica napus
  CDS (36)..(500)
agagagagatgagcaagtaagatagatcgaagacgatgaggagctctgcatcatccgccatgaaagctgctggagttttggttctccttgccgtcttaacatcagtttatgcgaagaagtcaggtgatgtgacagagttgcagattggtgttaagttcaagccgaagacatgtgatgttcaggctcacaaaggggacaagatcaaggtccactatcgaggaaagttaacagatggaactgtgtttgattcaagttttgagagaggtgatccttttgagtttgagcttgggagtggtcaagtcattccaggatgggaccagggtctacttggagcttgtgtaggtgagaagagaaagctcaaaatcccgtccaagcttggttatggtgacaacggctcaccaccgaaaatccccggtggggcgacattgatattcgacaccgagctagttgctgtgaacgggaaaccatccggcgatgcaaaaacgaagaatgagctttgattgcatccatttcctacttttttcatttcaaatgaaacttgttaagtcgtgttcatttgcaattgaatctcgaacatggtagagactagggtcgtttactttttggctggttaaggacaataattgtgtgtttggtcataacattagttatgttggcacttggcagttggaaaataacgtggaagcgcagaaagtcggtctataaatccattttactgtttagtccaaaaaaaaaaaaaa

SEQ ID NO: 68662 - protein, 154 aa, Brassica napus
MRSSASSAMKAAGVLVLLAVLTSVYAKKSGDVTELQIGVKFKPKTCDVQAHKGDKIKVHYRGKLTDGTVFDSSFERGDPFEFELGSGQVIPGWDQGLLGACVGEKRKLKIPSKLGYGDNGSPPKIPGGATLIFDTELVAVNGKPSGDAKTKNEL

SEQ ID NO: 68663 - DNA, 714 bp, Brassica napus
  CDS (15)..(506)
ggcgagagagcaagatgtgtctccgttactccatttgcttgatcttattctctctcatttcacttcaagcttttgccaagaagacaggagatgtgtctgaattgcagatcggtgttaagtttaagccagcaacgtgtgaagtgaaggctcacaaaggtgatatgatcaaggtgcactacagggggaaacttactgatggaacagtattcgattcgagctttgaaagggatgaaccgttcgagtttgagttaggaagtggtcaggttatcaaaggttgggatcaaggtttgctaggtgcgtgtgtaggggagaagaggaagttaaagatacctgctaaacttggatatggtgaacaaggctctcctcctactatcccaggtggggcaacactgatatttgacacagagcttcttgcggtaaatgaaaaaccagctggtggagaagaacaccaagaagaagatgacggagaagatgtagacgacacatatggagctgacgagctgtgattgaatctcctttctccaaccgtttagcttcagagttcctctacgaataaaatgtctatgtgcgtttgctttttaatcattggatgctttagttttgcttctttctaagttatcaacaattgtacttccttttggtttggcttttggagtagtaaagataaataaacagtgagactgggcaacacgcttcaagtaaaaaaaaaaaaaa

SEQ ID NO: 68664 - protein, 163 aa, Brassica napus
MCLRYSICLILFSLISLQAFAKKTGDVSELQIGVKFKPATCEVKAHKGDMIKVHYRGKLTDGTVFDSSFERDEPFEFELGSGQVIKGWDQGLLGACVGEKRKLKIPAKLGYGEQGSPPTIPGGATLIFDTELLAVNEKPAGGEEHQEEDDGEDVDDTYGADEL

SEQ ID NO: 68665 - DNA, 905 bp, Brassica napus
  CDS (163)..(735)
gaattcccgggtcgacagtctttatcatttttggacagtctatggccaccgatctctttccggttataacttcgccgcttctcagtcgcttcttccctttcggtatcgcatcagaaacgattcatctttccttgagtcaggtttctttgaaggtttgaaggaatgggggatgagattgatttgagtggagatggaggcgtcttgaaacagattgtaaggagagctaaacctgatgctattgcaccttctgatgattttcctgtcgttgatgttcactatgagggtatattggctgaagatggaaaggtctttgatactacacgcgaagacaatctggttttctcctttgagttgggttcaggcagtgttatcaggtcgtgggacattgcacttaagaccatgaaggttggggaagttgcaaaactcacatgtaagccagagtatgcttacggaagtggtggatctcctcccgacatcccacctgatgctactttgattttcgaagtggaattggttgcttgtagaccgaggaaaggtgctagtgttggaagtgtttctgaggatagagccaggctagaagatctgaagaagcagagagagattgctgcagctgccaaggaggatgataagaagaagagagaagaagcaaaagctgctgcagctactaggattcaagctaagctagacgctaagaagggtcaaggcaagggaaaaggcaaaggcaaatctaaatgagtgatgagtccagcgttgttgtaaactcctaagattatacaatttcatgattttaagcttgaatgttaagtggcagtcatcaattatcataatgaccatacatgtgttgtttttgggtctaagatatttctgattttggttcttacacattgaattaaaaaaaaaaaaaa

SEQ ID NO: 68666 - protein, 190 aa, Brassica napus
MGDEIDLSGDGGVLKQIVRRAKPDAIAPSDDFPVVDVHYEGILAEDGKVFDTTREDNLVFSFELGSGSVIRSWDIALKTMKVGEVAKLTCKPEYAYGSGGSPPDIPPDATLIFEVELVACRPRKGASVGSVSEDRARLEDLKKQREIAAAAKEDDKKKREEAKAAAATRIQAKLDAKKGQGKGKGKGKSK

SEQ ID NO: 68667 - DNA, 818 bp, Glycine max
  CDS (98)..(664)
gaattcccgggtcgacgtttcgtggcgctttcatcaattacagccttctctcgcttcgttccacccttcacctgaaaagcaaaaaggagtgcaaaccatgggcgatgcaattgatttgactggtgacggaggagtcattaaaaccattgtaagaaaaagcaaagctgatgctgtcggtccaacagaaaatttccctcttgttgatgttcattatgaaggcacacttgctgatactggtgaagtttttgacactacacatgaagataacaccatcttctctttcgagattggaaagggcagtgttatcaaggcttgggaaattgcagtgaaaaccatgaaggttggagaagttgcaaaaataacttgcaagccagaatatgcatatggtagtgcaggatctcctccagatattcctccagatgcaacacttgtttttgaagttgagctagttgcctgtcggccaaggaagggctccagtttgggaagtgtttcagaggagagggctaggcttgatgaactgaagaagcagagagagctagctgctgctgccaaagaggaggagaaaaagaagagagaagaagcaaaagcagcggctgccgcacgtgtgcaagccaagttagaagccaaaaaaggtcaaggaaagggtaaaggtaaagcaaagtaggaagttatcaaacatctacatgagtttggtatatgatgacaatcaaatagttatgtattatacacaattcagtatctcacttccccgttgtcccgtacgaaacattatataaatgaaatgctactttggtttatccatctaaaaaaaaaaaaaa

SEQ ID NO: 68668 - protein, 188 aa, Glycine max
MGDAIDLTGDGGVIKTIVRKSKADAVGPTENFPLVDVHYEGTLADTGEVFDTTHEDNTIFSFEIGKGSVIKAWEIAVKTMKVGEVAKITCKPEYAYGSAGSPPDIPPDATLVFEVELVACRPRKGSSLGSVSEERARLDELKKQRELAAAAKEEEKKKREEAKAAAAARVQAKLEAKKGQGKGKGKAK

SEQ ID NO: 68669 - DNA, 700 bp, Triticum aestivum
  CDS (43)..(609)
gtacctcggcggctgaccaggtagcgagcgcagggaagggcgatggggacgaagaagccgcagctcctccgcctcgccgtcgtcgccgtcgccgtcgcggccgtccttctgaccgcttcggccaagaagtccgcggatgttacacagctccagatcggcgtcaagtacaagcctgaatcatgtaccctacaagctcacaaaggcgacaagattaaagtgcattatcatgggacactcactgatggatcagtatttgactctagctatgacagaggtgatcccttcgaattcactcttgggaatgggcaggtgataaaaggttgggaccaaggtttactaggtatgtgcgtcggcgaaaagcggaagctaaggatacccgcaaagatgggttacggggagcgaggctccccaccaaagattccaggtggtgcgactctggttttcgacacggagctcatcgccgtgaatgggaggacgtctgctggcgctgccgcggagagcgacgacagcgagctttgctacatacatggatgtagttttgcttgcatttctgcgagtccttcggctaaaagggccgccgttttcgaacgattccatcatcatgtttaaagtgttacagagaccggttagattgctgtatcaatgatcgcagtgaccaacaattagtaatccatattcatgcgataaaaaaaaaaaaaaa

SEQ ID NO: 68670 - protein, 188 aa, Triticum aestivum
MGTKKPQLLRLAVVAVAVAAVLLTASAKKSADVTQLQIGVKYKPESCTLQAHKGDKIKVHYHGTLTDGSVFDSSYDRGDPFEFTLGNGQVIKGWDQGLLGMCVGEKRKLRIPAKMGYGERGSPPKIPGGATLVFDTELIAVNGRTSAGAAAESDDSELCYIHGCSFACISASPSAKRAAVFERFHHHV

SEQ ID NO: 68671 - DNA, 339 bp, Triticum aestivum
  CDS (1)..(339)
atgggattcgagaaggagatcctgaaagccggcaccggccccaagcccgtcaagggccagaaggtcaccgtccactgcaccggctacgggaaggatggtgatctgtctaagaagttttggagtaccaaggaccctgggcagcagccattctctttcaacattggtctgggttcagtgatcaaaggatgggatgagggagttatgggcatgcaattgggtgaagtcgcccgtcttacgtgcaccccagactacgcttacggtgaaggtggctttccagcctggggaattcaaccaaactccgtgctgatattcgagatcgaagttcttagcgccaagtga

SEQ ID NO: 68672 - protein, 112 aa, Triticum aestivum
MGFEKEILKAGTGPKPVKGQKVTVHCTGYGKDGDLSKKFWSTKDPGQQPFSFNIGLGSVIKGWDEGVMGMQLGEVARLTCTPDYAYGEGGFPAWGIQPNSVLIFEIEVLSAK

SEQ ID NO: 68673 - DNA, 832 bp, Zea mays
  CDS (87)..(554)
gaattcccgggtcgacgatttcgtggaacgaggaaggaaggttccagcgaccgcggtcgtggagtaggactgtaggagaaagcgcgatggggaagaagcggcagcttatctgcctcgcagccgccgtcgccgccgcggccatcctcctgacagcgtcggccaagaagtccagcgacgtcaccgagcttcagatcggcgtcaagtacaaacctgagtcatgtatcctgcaagcacacaaaggagacaaaattaaggttcattatcgtggggcactcactgacggatcagtttttgattctagctatgacagaggtgacccgtttgaatttactcttggaaatggccaagtgataaaaggctgggaccaaggattgctaggtatgtgcgtcggtgaaaagcggaagctaaagatacctgcaaagatgggctatggcgagcgaggctccccaccgaagattccaggcggagcgactctggtcttcgacacggagcttatcgccgtcaacgggaagacatctggcggtgcaaatccagaaactgaaagtgagctctgatacgatgcatttggatggagagtttcagctcgagggagtagtagcagagtcacgtagttcatttggtgccgtgaaagggctgttgtcttgtttccttcatgcatggcaatttatgttttagagatgtcatactctggaaacagttcccttttttttgatggtacgaaagctcgatttgtcaagctaccatggccttcaacattgaagcaggtctggactgttgttgcatcgatccacgggtcggaaaatttcaaaaaaaaaaaaaaaaaagcggccgc

SEQ ID NO: 68674 - protein, 155 aa, Zea mays
MGKKRQLICLAAAVAAAAILLTASAKKSSDVTELQIGVKYKPESCILQAHKGDKIKVHYRGALTDGSVFDSSYDRGDPFEFTLGNGQVIKGWDQGLLGMCVGEKRKLKIPAKMGYGERGSPPKIPGGATLVFDTELIAVNGKTSGGANPETESEL

SEQ ID NO: 68675 - DNA, 339 bp, Zea mays
  CDS (1)..(339)
atgggcttcgagaagcagatcctgagatccggcaccggccccaagccgataaagggccagaaggtcaccgttcactgcaccggctacgggaaggatcgtgatctgtccaagaaattttggagcaccaaggaccctgggcagcagccattcagtttcagcattggtcagggttcagtgatcaaaggatgggacgagggagttatgaccatgcaagtgggtgaagttgctcgtatccagtgcacgcctgattatgcttatggagccggcgggttcccagcctggggaattcaaccaaactcagtgcttgtgttcgagattgaagtcctcagtgcccagtaa

SEQ ID NO: 68676 - protein, 112 aa, Zea mays
MGFEKQILRSGTGPKPIKGQKVTVHCTGYGKDRDLSKKFWSTKDPGQQPFSFSIGQGSVIKGWDEGVMTMQVGEVARIQCTPDYAYGAGGFPAWGIQPNSVLVFEIEVLSAQ

SEQ ID NO: 68677 - DNA, 369 bp, Hordeum vulgare
  CDS (1)..(336)
atgggaatccagaaggagatcctgagagccggcaccggccccaagcccgtcaagggccagaaggtcaccgtccactgcaccggctacggcaaggacggtgatctgtccaagaagttttggagtaccaaggatcctgggcagcagccattcgctttcaacattggcctgggttcagtgatcaaaggatgggatgagggagttatggacatgcaattgggtgaagtcgcccgtcttaagtgcaccccagactacgcttatggatctggtggctctccagcctggggaattcaaccaaactccgagctgatattcgagatcgaagttcttagcgccaagtgatgcgcaatgcgattcatgatggatctatag

SEQ ID NO: 68678 - protein, 112 aa, Hordeum vulgare
MGIQKEILRAGTGPKPVKGQKVTVHCTGYGKDGDLSKKFWSTKDPGQQPFAFNIGLGSVIKGWDEGVMDMQLGEVARLKCTPDYAYGSGGSPAWGIQPNSELIFEIEVLSAK

SEQ ID NO: 68679 - DNA, 809 bp, Hordeum vulgare
  CDS (19)..(483)
caaacccctgccgcatccatggcgaagccggggcttcttctctgcctgctggtcgtggccgccgcgctcctgctcgtcgcctccgccaagaagtccggcgacgtgtcggcactccagatcggcgtcaagtacaagccagaatcgtgcagcatctcggctcacaaaggagacagagttaaagttcactaccgtggaacacttaccgatggaacagtttttgattctagctatgaaaggggtgacccaattgaatttgaattgggcactggtcaagtgatcaaaggatgggatcagggaattttgggcatgtgcattggtgagaagaggaagctgaagatcccttcaaagctcggctacggggatcagggatcaccacctaccattccaggcggagcaactctcatattcgacacagagcttgtcgcagtcaatggcgagccttctagcaaatcagacgaggatgtcgctgatagtgatctgtaggcagctcggcgcagcaagttcgcccagttaccaaatcgaataggactatgtatggggaacttactcttgtagggcagacgcaatgagacatgaacattctattaccatggtcaaacaaaggagtctagttgtcaaaatcgaatagatcaagtgactttagttatcctatgtaattctctggaataattctcatatctaccatgttacatttgcttttgttcgtggaatggttataaagacaagtcatgtcgatttggatctgactccaatgccccatggatttaacaagtcaagagaaattgcagattgttaaaaaaaaaaaaaaa

SEQ ID NO: 68680 - protein, 154 aa, Hordeum vulgare; identical to SEQ ID NO: 1262

SEQ ID NO: 68681 - DNA, 936 bp, Hordeum vulgare
  CDS (133)..(693)
ctccccctcgtcccatccagatctgtcctcactgtccatcatcccctccccatctccgccaaggtcctcgccggcgtccccggtgccacggcagtcgctccaaaccgagaatctccattctacagcaaggccatggcagaaaccatagatttaacaggggatggaggcgtccttaagacggtggttagaaaagcaaaggatgatgctataagcccatctgacagccttccattagttgatgttcattatgaagggacacttgctgaaaatggggaagtttttgacaccacacatgaagacaattctattttttcatttgaagttggccagggagctgtcattaaagcatgggatctagccttaagaactatgaaagttggtgaggttgcaaaaataacatgcaagccagaatatgcctatggaagtgcaggctccccaccagagataccagcgaatgcgacactcatttttgaggtggaattagtggcgtgcaagccaaggaaaggttcaagtctgggcagtgtatctgatgagaaagccaggctagaggagcttaagaaacagcgggagctagctgccgctaccaaagaggaagagaagaagaagagggaggaggcaaaggctgcagcggcggcccgtgtgcaagccaaacttgacgcgaagaagggcaagggaaaaggaaagggcaaataagttacatttgctgctgggtgcggactgttgtaacctagtagaaaagcatcagaccacaagattgcttattggctacagtgctttcggtactctacatggcgtgtgcagccagcactatagccgtagtgagaacactaaataattacggcaatctttggtttttgcacaagatgtggaatgtttcccttttctgaccaagtggtctttactgggcagcaatgacattttaaaaaaaaaaaaaaa

SEQ ID NO: 68682 - protein, 186 aa, Hordeum vulgare
MAETIDLTGDGGVLKTVVRKAKDDAISPSDSLPLVDVHYEGTLAENGEVFDTTHEDNSIFSFEVGQGAVIKAWDLALRTMKVGEVAKITCKPEYAYGSAGSPPEIPANATLIFEVELVACKPRKGSSLGSVSDEKARLEELKKQRELAAATKEEEKKKREEAKAAAAARVQAKLDAKKGKGKGKGK

SEQ ID NO: 68683 - DNA, 793 bp, Zea mays
  CDS (131)..(601)
gaattcccgggtcgacgatttcgtcgtccttttcctttcataaaccccaagccgcgccgcaatagctcgccccctcgttcgccgcctctcctgctcctaccgcagctctccctcaggtttagtgttcgcaatggcggccttcaacaagcttggtggccttctaaggcacagtgctctggtgagcggtatcactggtggctcttctcctgcagtgttcaatgctgcacggctcatgtctaccaagctatttattggtggtcttgactggggtgttgatgacgtgaaactaagagaagcatttagcagctttggagaggttactgaagcgagggtgatcacagacagggagactgggaggtcaagaggctttggctttgtgaactactccgacagtgatgctgccaaggaagctatttctgcaatggatggcaaggaaattgatgggcggcaggtacgtgtcaacatggctaatgagagacctgctgggaaccgtggtggtggtggctatggcggcggcggctatggaggtggtggctacggaggtggcggcggctacggaggtggtggctatggtggtggcagccaaagctatgatgcttgaggggggcaggatcctattaggtgcattatcaaccaagatatttgaaataatgaactttaggacttggtatgacgttttatgttaagcgttgtcaggttttgctattcgtgttatgctgaattgttggaactcctagatgcagaatcttacgtattggttttggttcaaaaaaaaaaaaaaaaaagcggccgc

SEQ ID NO: 68684 - protein, 156 aa, Zea mays
MAAFNKLGGLLRHSALVSGITGGSSPAVFNAARLMSTKLFIGGLDWGVDDVKLREAFSSFGEVTEARVITDRETGRSRGFGFVNYSDSDAAKEAISAMDGKEIDGRQVRVNMANERPAGNRGGGGYGGGGYGGGGYGGGGGYGGGGYGGGSQSYDA

SEQ ID NO: 68685 - DNA, 2228 bp, Zea mays
  CDS (435)..(1847)
gaattcccgggtcgacgatttcgtcgcatttccgcgttccccaccctcctctttctcaatccagccaagcaccggaatcgcagggaaccaggagcgattaaaaaagacagcctcccccgcaaaggtaaaaaacaaccaccgcatcgcggcaggcaaggcatcgctcgccagcccccgagcggagggggaagcaaaagatcgataaaaaggagaggaggagacgaggcgtgccatccgaacccaagcaacttcctcccaccaccacctccctggctccctcccatgcccgcatcgagatcttagcgggacagcgagaggagaggcgacgcggacgcgggcgctccccgatccctcctcgctgcccgtcgccgcctccgccgccgaccgaccgaccggggccagggggaggaggagggaaggggagtacggacacgatggaagccgactctgggaagctcttcgtcggcggcatctcgtgggagacggacgaggatcgcctccgcgagtacttcggtcgcttcggcgacgtcaccgaggccgttatcatgcgggaccgcaacaccggccgcgcccgtgggttcgggttcgtcgtcttcgccgactctgggatcgccgagcgcgtcaccatggagaagcatatgatcgacggccgcatggtggaagcaaagaaggccgttcccagggacgaccaaagtattgcgagcaagaacaatagcagcatagggtcacctggaccaggacgtactagaaagatctttgttgggggtctggcttcaaatgttaccgaggtcgaattcagaaggtactttgagcaattcggtgtgataaccgatgtggtggtgatgtatgaccacaatacgcagaggcccaggggctttggtttcatcacatatgactcagaagacgcagtggataaggcactgcacaagaacttccatgagctcaatggtaaaatggttgaggtcaagagggctgtaccaaaggagcagtctcctggacctattgcacgttcacctgcaggggggcagaactatgctatgagcagggttcataactttctaaatggttttaaccagggttacaacccgaacccccttggtggttatggcatgcgggtggatgcaaggtatggtctccttgcaggtgcacggaatgggttctcttcgtttggtccaggttatggaatgggcatgagcgttgaaggtggaatgcgtggatattttggtgcaagttctggtttcgtcaatagctccaatgggcggcaaataggttcttactttaatggtagttcaaaccgattaggtagtccaattgggtatgttggccttaacgatgattcaggatcaatactgagttcaatgtctagaaatgtctggggtaatggaaatctgaactacataggcaaccatacaaacatgaattcttttcctcaacctggaagtggtgggggtatttctggtgatgaaattagttggggaagccttacttctgctcatgggatgagcaacatttcaagccttggatcgggaaaccttggccgtggaaccggagataacaactttggcttgccttctggaaactatgttaggagcaactcaactggtacaattggtgagccattttctgcatcagccaatgcatatgaatcgaacaatccaggtgcatatggcagcagctctatttatggtgactcaacctggaggttcaactcatctgaggttgatatgcctccttttggtcatgatcttggaaatgatgatccagatatcaaatcagaaatatcagcaagctatatgggcaactatactgttaataacaatcagacaagcagaggtatcacttcctagggagagtactattatattcatatatgacttgggataggtgaaacacccactactatatcaggctttcaggtgcatgactgtgaattggtgatgtcagattaatatacaggttagttgcttgtttctaggtaaccagaggtgtggtttacaacaccaaaatgctagaggagccgatacaaacattttagtttaatttctacatctattaggccttttgttttttgaatgagatgtgcagtgttgattgcggcacatacttagaagtgttccaacataagctggaattctgtcatacggaaggataaacttgtataccaagggaatgctgtattattatctttgcccatttatggccaaaaaaaaaaaaaaaaaagcggccgc

SEQ ID NO: 68686 - protein, 470 aa, Zea mays
MEADSGKLFVGGISWETDEDRLREYFGRFGDVTEAVIMRDRNTGRARGFGFVVFADSGIAERVTMEKHMIDGRMVEAKKAVPRDDQSIASKNNSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPIARSPAGGQNYAMSRVHNFLNGFNQGYNPNPLGGYGMRVDARYGLLAGARNGFSSFGPGYGMGMSVEGGMRGYFGASSGFVNSSNGRQIGSYFNGSSNRLGSPIGYVGLNDDSGSILSSMSRNVWGNGNLNYIGNHTNMNSFPQPGSGGGISGDEISWGSLTSAHGMSNISSLGSGNLGRGTGDNNFGLPSGNYVRSNSTGTIGEPFSASANAYESNNPGAYGSSSIYGDSTWRFNSSEVDMPPFGHDLGNDDPDIKSEISASYMGNYTVNNNQTSRGITS

SEQ ID NO: 68687 - DNA, 1428 bp, Zea mays
  CDS (128)..(1201)
gaattcccgggtcgacgatttcgtcttgccaccgccgcgtcgctcggcgccccgtcgggaactctccgccgccacccagagacccgccgcgccttgcagtggcgacggagggaccagccagccagcgatgacgacccgcatagcgccgggcgtaggtgcgaacctactcgggcagcactcggcggagcgcaaccaggacgccaccacctacgtcggcaacctcgaccctcaggtttctgaggagcttctatgggaattgtttgtccaagcaggccctgttgtgaatgtgtatgtcccaaaagacagagttacaaacttacaccagggatatggatttgtagaattcaggagcgaggaagatgcagattatgctattaagactttgaacatgatcaaactatatgggaagcccataagagtaaacaaggcttcccaggataagaagagcttggacgttggagcaaatctgtttattggcaatcttgatccggatgttgatgagaagctcctctatgataccttcagtgcatttggagtgattgtaactaatcctaagataatgcgagatcctgaaacaggaaattctagaggctttggctttgtgagctatgagtcctttgaatcatctgatcaagcaatagaggccatgaacaaccaacatttatgcaaccgcccaatcactgtctcttatgcttacaagaaagacacgaaaggagaacgccatggcacaccagcagagagactgctggcagcaaacaatccaggatctcaaaagaataggccacacacaatgtttgcaagtggtccgccgacccaaggtcatccaaatggtggtccgcctgtgccacggccttatggcaatggcacaattcctggacagattcaacacattcggcaaccacctccaccacctgttggacaatttccccctccaatgcagatgcacgggcaaccaacttggcccgctcaacattctatgccgcctcccatgccatcgcaactccagtacaggctcccaatgaggccaccaccaccaaatatgatgccccctccggttggcatggtaaggccgccacctcctcccactggtatgtcagcaccacctatgtggatgccacccccacccccaccacatcaaggtggtggaatgcctccgcctcccatgtctatgccaccaccgcctccaccaccatctagttaaacacatgcaaaggacagtaccgtctggtcaatgtgtaagctgtaactgtagactaaggatgctggttcctttcatgtctccatgtaacttcgtcaacactaggttaagaggaggtttgagagttaacctgacagatacactcaagattaacagctatttattcatgttctgttgaagataaatgaattttgtgcttgtctgaaaaaaaaaaaaaaaaaagcggccgc

SEQ ID NO: 68688 - protein, 357 aa, Zea mays
MTTRIAPGVGANLLGQHSAERNQDATTYVGNLDPQVSEELLWELFVQAGPVVNVYVPKDRVTNLHQGYGFVEFRSEEDADYAIKTLNMIKLYGKPIRVNKASQDKKSLDVGANLFIGNLDPDVDEKLLYDTFSAFGVIVTNPKIMRDPETGNSRGFGFVSYESFESSDQAIEAMNNQHLCNRPITVSYAYKKDTKGERHGTPAERLLAANNPGSQKNRPHTMFASGPPTQGHPNGGPPVPRPYGNGTIPGQIQHIRQPPPPPVGQFPPPMQMHGQPTWPAQHSMPPPMPSQLQYRLPMRPPPPNMMPPPVGMVRPPPPPTGMSAPPMWMPPPPPPHQGGGMPPPPMSMPPPPPPPSS

SEQ ID NO: 68689 - DNA, 1172 bp, Brassica napus
  CDS (5)..(961)
agcaatggcaccttcgtcgtcgagcggtttgaccttcaagctccatcctctagtaatcgtcaacatatcggatcactacaccagggtcaagactcagctaaaccctccgccttcagtctgcgcaaccgagaacgcctcctccaacaacggcgaagcaatgttgcagccgaaccctagggtttacggatgcgtgatcggcgtccagagaggccgcactgtggagatcttcaacagcttcgagcttttgttcgatccttcgactgaaaccctcgataggtccttcctcgagaagaagcaagagctctacaagaaagtgttccctgacttctacgtgttgggatggtactctacggggagtgacgctgaggagtctgatatgcttatccacaaagccttgatggatatcaatgagtctcccgtttatgtgcttcttaacccggcaatcaatcacgcacagaaggatctcccagttaccatttatgaaagtgagttgcatgtcattgatggaatcccacagctcatttttgctcatacaagctacacaatcgagacagttgaagctgaacggatatcagtcgatcatgttgcacatctcaaaccgtctgatggaggctcagcagcaacccagttggctgctcatcttactgggatacatagtgccatcaaaatgcttaatagcagaatcagagtgctccaccagtaccttgcagctatggagaaaggtgatattccttgtgaaaactcacttctgagacaagtatctagcctgctaagaaggttgcctgccatggaatcagagaggtttcatgataactttttgatggagtacaacgacaaattgctagtaacttacctagcaatgattacaaattgtaccagcaccatgaacgagatggtggacaaattcaacattgcgtatgacagaaacgctcgaagaggtggaagaactgcgttcatgtaaaagtgttttttttccagcagattcaagctgaaaaatatcttcttctttttttttgcgtttgcctcggagttaatctataaatgagtcttagtcttcctcgtgattgtttctatctatgtacgaagcttctccgtactgaaaactcttgtttgattttttccaaatttccattgttagtaaaaagatttttacggttgaaaaaaaaaaaaaa

SEQ ID NO: 68690 - protein, 318 aa, Brassica napus
MAPSSSSGLTFKLHPLVIVNISDHYTRVKTQLNPPPSVCATENASSNNGEAMLQPNPRVYGCVIGVQRGRTVEIFNSFELLFDPSTETLDRSFLEKKQELYKKVFPDFYVLGWYSTGSDAEESDMLIHKALMDINESPVYVLLNPAINHAQKDLPVTIYESELHVIDGIPQLIFAHTSYTIETVEAERISVDHVAHLKPSDGGSAATQLAAHLTGIHSAIKMLNSRIRVLHQYLAAMEKGDIPCENSLLRQVSSLLRRLPAMESERFHDNFLMEYNDKLLVTYLAMITNCTSTMNEMVDKFNIAYDRNARRGGRTAFM

SEQ ID NO: 68691 - DNA, 2381 bp, Triticum aestivum
  CDS (71)..(2179)
gaattcccgggtcgacttcgctgtcgacgatttcgtgtgacactaccggcactgcagcagcacgggagccatggcgcgggaggaggaaggacccgcaatgatggacgccgcggagcgacgcctccgcgtggtctccgcgcacctcgagccgcaggccggcgccaccgccggcctcgccgctaaccccaccgccggcgagtacgcccacgtgcagggctacagcgttgttcttcctgaaaagttgcaaactggaaagtggaacgtgtaccgatctgcagagtcacctctgcgtttaattaacagatttcctgctactccagacattggaacactgcatgataattttgtgtacgcagtcgagacttttacagattgtagatatctgggtacaagagtgtgcgctgatggagcagtcggagactacaaatggatgacgtatggagaagctagtacgagcagaactgcaataggttctggtcttatttatcatggaatatctgaaggtgcacgcattggtctgtattttataaacagacctgagtggatcataattgatcatgcttgtgctgcatattcatatgtatctgtaccactttatgatactcttggtccagatgcagttcagttcattgtgaaccatgcaacagtagaagctattttctgtgtgcctcaaacgctaagcactctgctaagcttcctaactcaaatgccatgtgttcgccttatagtggtagttggtggagacaatgcaaatacgccatctacaacagcagctgctggagtggaaatcataacttactccaggctacacagccagggaaagatgagttctcaaacttaccgtcctccaaaacctgaagatgttgccactatctgctacacgagtggcactactggcacaccaaagggagctgttctttctcacgagaacttaatcgcgaatgttgcaggatcaagcttgggcgttaagttttacccctccgacgtgtatatctcatacctacctttagctcacatctatgagagagctaaccaaattgcactgcttcactatggtgttgccattggattttaccaaggggataatttgaagctgatggatgatttggctgctttgagaccaaccgtattcgcaagtgttccccggctatataacagaatttattctgcaatcacaaatgctgtgaaggattctggtgggctaaaagaaagattattccgtactgcgtacaatgccaagaggcaagcgcttgtgaatggacgaaatccttccccaatgtgggataagttagtatttaacaaaataaaagctaggcttggtggacgtgtgaggcttatgacttcaggcgcttctccattgtcagcagatgtaatggaattcctaagaatatgctttggtggtgaggttcttgaaggctatggaatgacagagacatcttgtgtcatcactacaatggatattggtgacaaattaattggtcatgttggatcaccaaatccttcttgtgaggttaaacttgtggatgtcccagaaatgaattacacttgtgaggatcaaccatatcctcgtggagaaatctgtgttagaggacctacaatattccgcggttactataaagacgaagtccaaacaagggatgtcattgacaatgatggctggttgcacactggagacataggtttgtggctgcctggagggcgtctaaaaattatagataggaaaaagaacattttcaagttggctcaaggagaatacatagctccagagaagattgagaatgtgtatgctaagtgcaagttcattgctcaatgctttatatatggtgatagtttcaactcttttctagttgccattgtagcagttgaaccagatgttttgaaggcttgggctgcatctcaaggaatacaaagcgaggacttaagacagctttgtgtcgacccgagagcaaaagctgctgtcttggctgacatggattctattggaaaggaagcacagctaagaggttttgaatttgccaaagctgttactcttgttgctgaacctttcacagtagaaaatggtctcctcacccccacgttcaaggtcaaaagaccgcaagctaaggcctacttcacgaaagagctcgcagatatgtatgcacaactgcgtgacgccgaatcagctaggcagaagttgtaattactcgagaaatgttcaggagtaaggttcaaaccaatacaggacaggttcacacaatggagcaaggatttctcatttgctttatgagcaggaatacctttcaccccaggagtggtgttgggtgtggttatatttataaaggaataaaccgaaggccccattatagaatttcgttcgttattttggtaaaaaaaaaaaaaaa

SEQ ID NO: 68692 - protein, 702 aa, Triticum aestivum
MAREEEGPAMMDAAERRLRVVSAHLEPQAGATAGLAANPTAGEYAHVQGYSVVLPEKLQTGKWNVYRSAESPLRLINRFPATPDIGTLHDNFVYAVETFTDCRYLGTRVCADGAVGDYKWMTYGEASTSRTAIGSGLIYHGISEGARIGLYFINRPEWIIIDHACAAYSYVSVPLYDTLGPDAVQFIVNHATVEAIFCVPQTLSTLLSFLTQMPCVRLIVVVGGDNANTPSTTAAAGVEIITYSRLHSQGKMSSQTYRPPKPEDVATICYTSGTTGTPKGAVLSHENLIANVAGSSLGVKFYPSDVYISYLPLAHIYERANQIALLHYGVAIGFYQGDNLKLMDDLAALRPTVFASVPRLYNRIYSAITNAVKDSGGLKERLFRTAYNAKRQALVNGRNPSPMWDKLVFNKIKARLGGRVRLMTSGASPLSADVMEFLRICFGGEVLEGYGMTETSCVITTMDIGDKLIGHVGSPNPSCEVKLVDVPEMNYTCEDQPYPRGEICVRGPTIFRGYYKDEVQTRDVIDNDGWLHTGDIGLWLPGGRLKIIDRKKNIFKLAQGEYIAPEKIENVYAKCKFIAQCFIYGDSFNSFLVAIVAVEPDVLKAWAASQGIQSEDLRQLCVDPRAKAAVLADMDSIGKEAQLRGFEFAKAVTLVAEPFTVENGLLTPTFKVKRPQAKAYFTKELADMYAQLRDAESARQKL

SEQ ID NO: 68693 - DNA, 1608 bp, Brassica napus
  CDS (18)..(1529)
caccaatctctcccaacatgtcgggatctttatcttgctctgctgccgacctcgcagtcttgttaggccctaatgccacggctgcagctgactacatctgcggccaacttagcaccgttaacaacaaatttaccgacgttgctttcgccgtagacaacacataccttctcttctccgcttacctcgtcttctctatgcaactgggcttcgctatgctctgcgctggctctgtaagagccaagaacacgatgaacatcatgcttaccaacgtccttgacgctgcagctggaggtctcttctattatcttttcggttacgcctttgcctttggatctccctcaaacggcttcatcggaaaacacaaccttggtctcaaggactttccttcagcctccgccgactactctaactttctataccaatgggcttttgctatcgccgctgccggaatcaccagcggctccatcgctgaacggactcagtttgttgcatacctgatctattcatccttcttaacaggctttgtttacccagttgtttctcactggttctggtctgctgatgggtgggctagtccttttaggaccgacggagatctacttttcagcacaggagcaatcgatttcgctggctcgggtgttgttcacatggttggaggcatcgctggtctatggggtgcgttgatcgaaggtccacgacttggtcggtttgataacggtggacgagctatagccctacatggccactcggcctcactagttgtccttggaacattcctcctttggtttggatggtatggattcaaccctggttccttcaacaagatcctcgtcacttatgaatcaggcacgatcaacgggcagtggagcgctgtcggacggactgctgtcacaaccactttagctggctgcactgcggcgctcacaaccctcttcgggaaacgtcttctctcgggacactggaacgttactgacgtatgcaacggcctccttggagggtttgcagctataaccggtggctgttcggtcgtagagccttgggcggcgatcatctgcgggttcgtagcggccctggtactcctcgggtgcaacaagctcgcggagaaactcaaatacgatgacccgctcgaggcagcccagttacacggtgggtgcggagcctgggggctaatatttactgcactttttgctagagaaaagtacttgaaccagatctacggcgagaagcccggaaggccccacggtttgttcatgggcggtggaggaaaactgcttggagctcagcttattcaaatacttgttatcacaggttgggtaagtgcgaccatgggaacgcttttcttcatcctcaagaaaatgaaactgttgcgtatatctgctgaggatgagatggccggtatggatatgaccaggcatggtggctttgcttatatgtactatgatgatgatgagtctcacaaagccattcagctaaggaaagttgagcatagatctccttcaccttcgggtgttactaccacttctgtttgatttagatttttattttgtaagagtatttatcatggtctgggatactctaatatatgtttgatattaaaaaaaaaaaaaa

SEQ ID NO: 68694 - protein, 503 aa, Brassica napus
MSGSLSCSAADLAVLLGPNATAAADYICGQLSTVNNKFTDVAFAVDNTYLLFSAYLVFSMQLGFAMLCAGSVRAKNTMNIMLTNVLDAAAGGLFYYLFGYAFAFGSPSNGFIGKHNLGLKDFPSASADYSNFLYQWAFAIAAAGITSGSIAERTQFVAYLIYSSFLTGFVYPVVSHWFWSADGWASPFRTDGDLLFSTGAIDFAGSGVVHMVGGIAGLWGALIEGPRLGRFDNGGRAIALHGHSASLVVLGTFLLWFGWYGFNPGSFNKILVTYESGTINGQWSAVGRTAVTTTLAGCTAALTTLFGKRLLSGHWNVTDVCNGLLGGFAAITGGCSVVEPWAAIICGFVAALVLLGCNKLAEKLKYDDPLEAAQLHGGCGAWGLIFTALFAREKYLNQIYGEKPGRPHGLFMGGGGKLLGAQLIQILVITGWVSATMGTLFFILKKMKLLRISAEDEMAGMDMTRHGGFAYMYYDDDESHKAIQLRKVEHRSPSPSGVTTTSV

SEQ ID NO: 68695 - DNA, 378 bp, Escherichia coli; identical to SEQ ID NO: 44321
  CDS (1)..(378)

SEQ ID NO: 68696 - protein, 125 aa, Escherichia coli; identical to SEQ ID NO: 44322

SEQ ID NO: 68697 - DNA, 474 bp, Gluconobacter oxydans 621H; identical to SEQ ID NO: 44323
  CDS (1)..(474)

SEQ ID NO: 68698 - protein, 157 aa, Gluconobacter oxydans 621H; identical to SEQ ID NO: 44324

SEQ ID NO: 68699 - DNA, 405 bp, Wolbachia endosymbiont strain TRS of Brugia malayi; identical to SEQ ID NO: 44325
  CDS (1)..(405)

SEQ ID NO: 68700 - protein, 134 aa, Wolbachia endosymbiont strain TRS of Brugia malayi; identical to SEQ ID NO: 44326

SEQ ID NO: 68701 - DNA, 384 bp, Xanthomonas oryzae pv. oryzae KACC10331; identical to SEQ ID NO: 44327
  CDS (1)..(384)

SEQ ID NO: 68702 - protein, 127 aa, Xanthomonas oryzae pv. oryzae KACC10331; identical to SEQ ID NO: 44328

SEQ ID NO: 68703 - DNA, 465 bp, Caulobacter crescentus CB15; identical to SEQ ID NO: 44329
  CDS (1)..(465): transl_table=11

SEQ ID NO: 68704 - protein, 154 aa, Caulobacter crescentus CB15; identical to SEQ ID NO: 44330

SEQ ID NO: 68705 - DNA, 402 bp, Agrobacterium tumefaciens str. C58; identical to SEQ ID NO: 44331
  CDS (1)..(402): transl_table=11

SEQ ID NO: 68706 - protein, 133 aa, Agrobacterium tumefaciens str. C58; identical to SEQ ID NO: 44332

SEQ ID NO: 68707 - DNA, 426 bp, Brucella melitensis 16M; identical to SEQ ID NO: 44333
  CDS (1)..(426): transl_table=11

SEQ ID NO: 68708 - protein, 141 aa, Brucella melitensis 16M; identical to SEQ ID NO: 44334

SEQ ID NO: 68709 - DNA, 405 bp, Bradyrhizobium japonicum USDA 110; identical to SEQ ID NO: 44335
  CDS (1)..(405)

SEQ ID NO: 68710 - protein, 134 aa, Bradyrhizobium japonicum USDA 110; identical to SEQ ID NO: 44336

SEQ ID NO: 68711 - DNA, 375 bp, Bordetella bronchiseptica RB50; identical to SEQ ID NO: 44337
  CDS (1)..(375): transl_table=11

SEQ ID NO: 68712 - protein, 124 aa, Bordetella bronchiseptica RB50; identical to SEQ ID NO: 44338

SEQ ID NO: 68713 - DNA, 378 bp, Erwinia carotovora subsp. atroseptica SCRI1043; identical to SEQ ID NO: 44339
  CDS (1)..(378)

SEQ ID NO: 68714 - protein, 125 aa, Erwinia carotovora subsp. atroseptica SCRI1043; identical to SEQ ID NO: 44340

SEQ ID NO: 68715 - DNA, 378 bp, Yersinia pseudotuberculosis IP 32953; identical to SEQ ID NO: 44341
  CDS (1)..(378): transl_table=11

SEQ ID NO: 68716 - protein, 125 aa, Yersinia pseudotuberculosis IP 32953; identical to SEQ ID NO: 44342

SEQ ID NO: 68717 - DNA, 381 bp, Methylococcus capsulatus str. Bath; identical to SEQ ID NO: 44343
  CDS (1)..(381): transl_table=11

SEQ ID NO: 68718 - protein, 126 aa, Methylococcus capsulatus str. Bath; identical to SEQ ID NO: 44344

SEQ ID NO: 68719 - DNA, 453 bp, Anaplasma marginale str. St. Maries; identical to SEQ ID NO: 44345
  CDS (1)..(453): transl_table=11

SEQ ID NO: 68720 - protein, 150 aa, Anaplasma marginale str. St. Maries; identical to SEQ ID NO: 44346

SEQ ID NO: 68721 - DNA, 375 bp, Idiomarina loihiensis L2TR; identical to SEQ ID NO: 44347
  CDS (1)..(375): transl_table=11

SEQ ID NO: 68722 - protein, 124 aa, Idiomarina loihiensis L2TR; identical to SEQ ID NO: 44348

SEQ ID NO: 68723 - DNA, 384 bp, Azoarcus sp. EbN1; identical to SEQ ID NO: 44349
  CDS (1)..(384): transl_table=11

SEQ ID NO: 68724 - protein, 127 aa, Azoarcus sp. EbN1; identical to SEQ ID NO: 44350

SEQ ID NO: 68725 - DNA, 405 bp, Ehrlichia ruminantium str. Welgevonden; identical to SEQ ID NO: 44351
  CDS (1)..(405): transl_table=11

SEQ ID NO: 68726 - protein, 134 aa, Ehrlichia ruminantium str. Welgevonden; identical to SEQ ID NO: 44352

SEQ ID NO: 68727 - DNA, 384 bp, Xylella fastidiosa Ann-1; identical to SEQ ID NO: 44353
  CDS (1)..(384)

SEQ ID NO: 68728 - protein, 127 aa, Xylella fastidiosa Ann-1; identical to SEQ ID NO: 44354

SEQ ID NO: 68729 - DNA, 393 bp, Magnetospirillum magnetotacticum MS-1; identical to SEQ ID NO: 44355
  CDS (1)..(393)

SEQ ID NO: 68730 - protein, 130 aa, Magnetospirillum magnetotacticum MS-1; identical to SEQ ID NO: 44356

SEQ ID NO: 68731 - DNA, 393 bp, Magnetospirillum magnetotacticum MS-1; identical to SEQ ID NO: 44357
  CDS (1)..(393)

SEQ ID NO: 68732 - protein, 130 aa, Magnetospirillum magnetotacticum MS-1; identical to SEQ ID NO: 44358

SEQ ID NO: 68733 - DNA, 381 bp, Azotobacter vinelandii; identical to SEQ ID NO: 44359
  CDS (1)..(381)

SEQ ID NO: 68734 - protein, 126 aa, Azotobacter vinelandii; identical to SEQ ID NO: 44360

SEQ ID NO: 68735 - DNA, 384 bp, Desulfitobacterium hafniense DCB-2; identical to SEQ ID NO: 44361
  CDS (1)..(384)

SEQ ID NO: 68736 - protein, 127 aa, Desulfitobacterium hafniense DCB-2; identical to SEQ ID NO: 44362

SEQ ID NO: 68737 - DNA, 384 bp, Methylobacillus flagellatus KT; identical to SEQ ID NO: 44363
  CDS (1)..(384)

SEQ ID NO: 68738 - protein, 127 aa, Methylobacillus flagellatus KT; identical to SEQ ID NO: 44364

SEQ ID NO: 68739 - DNA, 393 bp, Mesorhizobium sp. BNC1; identical to SEQ ID NO: 44365
  CDS (1)..(393)

SEQ ID NO: 68740 - protein, 130 aa, Mesorhizobium sp. BNC1; identical to SEQ ID NO: 44366

SEQ ID NO: 68741 - DNA, 384 bp, Ehrlichia canis str. Jake; identical to SEQ ID NO: 44367
  CDS (1)..(384)

SEQ ID NO: 68742 - protein, 127 aa, Ehrlichia canis str. Jake; identical to SEQ ID NO: 44368

SEQ ID NO: 68743 - DNA, 375 bp, Rubrivivax gelatinosus PM1; identical to SEQ ID NO: 44369
  CDS (1)..(375)

SEQ ID NO: 68744 - protein, 124 aa, Rubrivivax gelatinosus PM1; identical to SEQ ID NO: 44370

SEQ ID NO: 68745 - DNA, 381 bp, Pseudomonas fluorescens PfO-1; identical to SEQ ID NO: 44371
  CDS (1)..(381)

SEQ ID NO: 68746 - protein, 126 aa, Pseudomonas fluorescens PfO-1; identical to SEQ ID NO: 44372

SEQ ID NO: 68747 - DNA, 408 bp, Rhodospirillum rubrum; identical to SEQ ID NO: 44373
  CDS (1)..(408)

SEQ ID NO: 68748 - protein, 135 aa, Rhodospirillum rubrum; identical to SEQ ID NO: 44374

SEQ ID NO: 68749 - DNA, 375 bp, Ralstonia metallidurans CH34; identical to SEQ ID NO: 44375
  CDS (1)..(375)

SEQ ID NO: 68750 - protein, 124 aa, Ralstonia metallidurans CH34; identical to SEQ ID NO: 44376

SEQ ID NO: 68751 - DNA, 375 bp, Burkholderia fungorum LB400; identical to SEQ ID NO: 44377
  CDS (1)..(375)

SEQ ID NO: 68752 - protein, 124 aa, Burkholderia fungorum LB400; identical to SEQ ID NO: 44378

SEQ ID NO: 68753 - DNA, 381 bp, Magnetococcus sp. MC-1; identical to SEQ ID NO: 44379
  CDS (1)..(381)

SEQ ID NO: 68754 - protein, 126 aa, Magnetococcus sp. MC-1; identical to SEQ ID NO: 44380

SEQ ID NO: 68755 - DNA, 399 bp, Novosphingobium aromaticivorans DSM 12444; identical to SEQ ID NO: 44381
  CDS (1)..(399)

SEQ ID NO: 68756 - protein, 132 aa, Novosphingobium aromaticivorans DSM 12444; identical to SEQ ID NO: 44382

SEQ ID NO: 68757 - DNA, 387 bp, Cytophaga hutchinsonii; identical to SEQ ID NO: 44383
  CDS (1)..(387)

SEQ ID NO: 68758 - protein, 128 aa, Cytophaga hutchinsonii; identical to SEQ ID NO: 44384

SEQ ID NO: 68759 - DNA, 372 bp, Microbulbifer degradans 2-40; identical to SEQ ID NO: 44385
  CDS (1)..(372)

SEQ ID NO: 68760 - protein, 123 aa, Microbulbifer degradans 2-40; identical to SEQ ID NO: 44386

SEQ ID NO: 68761 - DNA, 384 bp, Thiobacillus denitrificans ATCC 25259; identical to SEQ ID NO: 44387
  CDS (1)..(384)

SEQ ID NO: 68762 - protein, 127 aa, Thiobacillus denitrificans ATCC 25259; identical to SEQ ID NO: 44388

SEQ ID NO: 68763 - DNA, 384 bp, Dechloromonas aromatica RCB; identical to SEQ ID NO: 44389
  CDS (1)..(384)

SEQ ID NO: 68764 - protein, 127 aa, Dechloromonas aromatica RCB; identical to SEQ ID NO: 44390

SEQ ID NO: 68765 - DNA, 414 bp, Chloroflexus aurantiacus; identical to SEQ ID NO: 44391
  CDS (1)..(414)

SEQ ID NO: 68766 - protein, 137 aa, Chloroflexus aurantiacus; identical to SEQ ID NO: 44392

SEQ ID NO: 68767 - DNA, 396 bp, Polaromonas sp. JS666; identical to SEQ ID NO: 44393
  CDS (1)..(396)

SEQ ID NO: 68768 - protein, 131 aa, Polaromonas sp. JS666; identical to SEQ ID NO: 44394

SEQ ID NO: 68769 - DNA, 903 bp, Oryza sativa; identical to SEQ ID NO: 44395
  CDS (1)..(903)

SEQ ID NO: 68770 - protein, 300 aa, Oryza sativa; identical to SEQ ID NO: 44396

SEQ ID NO: 68771 - DNA, 384 bp, Bdellovibrio bacteriovorus; identical to SEQ ID NO: 44397
  CDS (1)..(384)

SEQ ID NO: 68772 - protein, 127 aa, Bdellovibrio bacteriovorus; identical to SEQ ID NO: 44398

SEQ ID NO: 68773 - DNA, 393 bp, Brucella suis; identical to SEQ ID NO: 44399
  CDS (1)..(393)

SEQ ID NO: 68774 - protein, 130 aa, Brucella suis; identical to SEQ ID NO: 44400

SEQ ID NO: 68775 - DNA, 381 bp, Chromobacterium violaceum; identical to SEQ ID NO: 44401
  CDS (1)..(381): transl_table=11

SEQ ID NO: 68776 - protein, 126 aa, Chromobacterium violaceum; identical to SEQ ID NO: 44402

SEQ ID NO: 68777 - DNA, 387 bp, Deinococcus radiodurans; identical to SEQ ID NO: 44403
  CDS (1)..(387): transl_table=11

SEQ ID NO: 68778 - protein, 128 aa, Deinococcus radiodurans; identical to SEQ ID NO: 44404

SEQ ID NO: 68779 - DNA, 384 bp, Nitrosomonas europaea; identical to SEQ ID NO: 44405
  CDS (1)..(384): transl_table=11

SEQ ID NO: 68780 - protein, 127 aa, Nitrosomonas europaea; identical to SEQ ID NO: 44406

SEQ ID NO: 68781 - DNA, 378 bp, Photorhabdus luminescens; identical to SEQ ID NO: 44407
  CDS (1)..(378): transl_table=11

SEQ ID NO: 68782 - protein, 125 aa, Photorhabdus luminescens; identical to SEQ ID NO: 44408

SEQ ID NO: 68783 - DNA, 384 bp, Photobacterium profundum; identical to SEQ ID NO: 44409
  CDS (1)..(384): transl_table=11

SEQ ID NO: 68784 - protein, 127 aa, Photobacterium profundum; identical to SEQ ID NO: 44410

SEQ ID NO: 68785 - DNA, 381 bp, Pseudomonas aeruginosa; identical to SEQ ID NO: 44411
  CDS (1)..(381): transl_table=11

SEQ ID NO: 68786 - protein, 126 aa, Pseudomonas aeruginosa; identical to SEQ ID NO: 44412

SEQ ID NO: 68787 - DNA, 375 bp, Ralstonia solanacearum; identical to SEQ ID NO: 44413
  CDS (1)..(375): transl_table=11

SEQ ID NO: 68788 - protein, 124 aa, Ralstonia solanacearum; identical to SEQ ID NO: 44414

SEQ ID NO: 68789 - DNA, 393 bp, Rhizobium etli; identical to SEQ ID NO: 44415
  CDS (1)..(393)

SEQ ID NO: 68790 - protein, 130 aa, Rhizobium etli; identical to SEQ ID NO: 44416

SEQ ID NO: 68791 - DNA, 393 bp, Rhizobium loti; identical to SEQ ID NO: 44417
  CDS (1)..(393)

SEQ ID NO: 68792 - protein, 130 aa, Rhizobium loti; identical to SEQ ID NO: 44418

SEQ ID NO: 68793 - DNA, 393 bp, Rhodopseudomonas palustris; identical to SEQ ID NO: 44419
  CDS (1)..(393): transl_table=11

SEQ ID NO: 68794 - protein, 130 aa, Rhodopseudomonas palustris; identical to SEQ ID NO: 44420

SEQ ID NO: 68795 - DNA, 378 bp, Salmonella typhi; identical to SEQ ID NO: 44421
  CDS (1)..(378): transl_table=11

SEQ ID NO: 68796 - protein, 125 aa, Salmonella typhi; identical to SEQ ID NO: 44422

SEQ ID NO: 68797 - DNA, 378 bp, Salmonella typhimurium; identical to SEQ ID NO: 44423
  CDS (1)..(378): transl_table=11

SEQ ID NO: 68798 - protein, 125 aa, Salmonella typhimurium; identical to SEQ ID NO: 44424

SEQ ID NO: 68799 - DNA, 381 bp, Shewanella oneidensis; identical to SEQ ID NO: 44425
  CDS (1)..(381): transl_table=11

SEQ ID NO: 68800 - protein, 126 aa, Shewanella oneidensis; identical to SEQ ID NO: 44426

SEQ ID NO: 68801 - DNA, 381 bp, Vibrio cholerae; identical to SEQ ID NO: 44427
  CDS (1)..(381): transl_table=11

SEQ ID NO: 68802 - protein, 126 aa, Vibrio cholerae; identical to SEQ ID NO: 44428

SEQ ID NO: 68803 - DNA, 381 bp, Vibrio parahaemolyticus; identical to SEQ ID NO: 44429
  CDS (1)..(381)

SEQ ID NO: 68804 - protein, 126 aa, Vibrio parahaemolyticus; identical to SEQ ID NO: 44430

SEQ ID NO: 68805 - DNA, 402 bp, Wolbachia pipientis wMel; identical to SEQ ID NO: 44431
  CDS (1)..(402): transl_table=11

SEQ ID NO: 68806 - protein, 133 aa, Wolbachia pipientis wMel; identical to SEQ ID NO: 44432

SEQ ID NO: 68807 - DNA, 384 bp, Xanthomonas campestris; identical to SEQ ID NO: 44433
  CDS (1)..(384): transl_table=11

SEQ ID NO: 68808 - protein, 127 aa, Xanthomonas campestris; identical to SEQ ID NO: 44434

SEQ ID NO: 68809 - DNA, 384 bp, Xylella fastidiosa; identical to SEQ ID NO: 44435
  CDS (1)..(384): transl_table=11

SEQ ID NO: 68810 - protein, 127 aa, Xylella fastidiosa; identical to SEQ ID NO: 44436

SEQ ID NO: 68811 - DNA, 23 bp, Primer
atgatcaattcgccccgagtgtg

SEQ ID NO: 68812 - DNA, 24 bp, Primer
ttaatgaatgagtgtgggaacggc

SEQ ID NO: 68813 - protein, 78 aa, consensus; identical to SEQ ID NO: 44439
  MISC_FEATURE (1)..(78): consensus for the disclosure of xaa see table XV

SEQ ID NO: 68814 - protein, 112 aa, consensus; identical to SEQ ID NO: 44440
  MISC_FEATURE (1)..(112): consensus for the disclosure of xaa see table XV

SEQ ID NO: 68815 - protein, 114 aa, consensus; identical to SEQ ID NO: 44441
  MISC_FEATURE (1)..(114): consensus for the disclosure of xaa see table XV

SEQ ID NO: 68816 - DNA, 723 bp, Escherichia coli
  CDS (1)..(723)
atgacgccaaccattgaacttatttgtggccatcgctccattcgccatttcactgatgaacccatttccgaagcgcagcgtgaggcgattattaacagcgcccgtgcgacgtccagttccagttttttgcagtgcagtagcattattcgcattaccgacaaagcgttacgtgaagaactggtgacgctgaccggcgggcaaaaacacgtagcgcaagcggcggagttctgggtgttctgtgccgactttaaccgccatttacagatctgtccggatgctcagctcggcctggcggaacaactgttgctcggtgtcgttgatacggcaatgatggcgcagaatgcattaatcgcagcggaatcgctgggattgggcggggtatatatcggcggcctgcgcaataatattgaagcggtgacgaaactgcttaaattaccgcagcatgttctgccgctgtttgggctgtgccttggctggcctgcggataatccggatcttaagccgcgtttaccggcctccattttggtgcatgaaaacagctatcaaccgctggataaaggcgcactggcgcagtatgacgagcaactggcggaatattacctcacccgtggcagcaataatcgccgggatacctggagcgatcatatccgccgaacaatcattaaagaaagccgcccatttattctggattatttgcacaaacagggttgggcgacgcgctaa

SEQ ID NO: 68817 - protein, 240 aa, Escherichia coli [sequence omitted]

SEQ ID NO: 68818 - DNA, 831 bp, Gluconobacter oxydans 621H
  CDS (1)..(831)
atgtcgggcacctcttccgaacggatttccacgctgtggcagacacggtaccgcacgccggcgccgaaaaccctgccggacaacgcggtgctcgacctgctgctgtcgcatcattcggtccgggcctatctgcccgacgccctgcctgaaggcacgctggaagccggtattgccgccgcatcctcggccgctacgtccagcaatcttcaggtctggtccgtcgtagccgttgaaaacccggaaacgcgcgcccgactggcagagctctgcggcaaccagaagcatatcgaggtcgcgcccctgttcctggcctggatcgtcgatctggcccggctggagcggatcgccgagcgggcagggatggggcatgaggcgctcgactatcaggagacgttcctcatggcgacgctcgatacggggattgccgcccagaacgccgtgaccgcgttcgaatccctcggtctgggcacggtctatatcggcggcctacgcaaccatcccgaagaagtctccagtctcctctcccttccgccgcgttcggtcgcggtcgtcgggctctgtgtcggcaaacccgatccggccgcccagaacggctacaaaccgcgtctggggcaggatgttgtcctgcaccgcgagcgttacagcacggaaaacgaagccaaaggcattgcggcctatgaccgcatcgcggatgactaccagaaggaacagggcctgacctcgcgggtctggtcggaaacggtcgccaagcgggtggacagcttcaaaggcctgagcggacggcacgtcatccgcacggtgctgcacaggctcggctttccgctccgctaa

SEQ ID NO: 68819 - protein, 276 aa, Gluconobacter oxydans 621H
MSGTSSERISTLWQTRYRTPAPKTLPDNAVLDLLLSHHSVRAYLPDALPEGTLEAGIAAASSAATSSNLQVWSVVAVENPETRARLAELCGNQKHIEVAPLFLAWIVDLARLERIAERAGMGHEALDYQETFLMATLDTGIAAQNAVTAFESLGLGTVYIGGLRNHPEEVSSLLSLPPRSVAVVGLCVGKPDPAAQNGYKPRLGQDVVLHRERYSTENEAKGIAAYDRIADDYQKEQGLTSRVWSETVAKRVDSFKGLSGRHVIRTVLHRLGFPLR

SEQ ID NO: 68820 - DNA, 780 bp, Aeropyrum pernix K1
  CDS (1)..(780): transl_table=11
gtgaaacgggataggacatcctctttattcctttcctttcctttcaagtttctccggtggtcttcagtggaggataggggttgctgtttctccgttataagtcgtcacagaagtgttagaagcttctctacagagccgattccccaggaggatatcaggaagattcttgaggcggccagacggcacgtgagcccttggaacatacagcctgtccatgtgacagtagtgacggatagtaagctgaagtctcgcctctccgatgccctctggggacaggagcagataaaagaggcgccagtgttttttgtcttcagtgttgattatgcgaaagtgcttgagtctatcaagcttcttggtctagaggccagggagcccgggttaacggagctactccaaggatatatctcggctagtgtcgctctcgcctggtctatagctgtggccgaggatctaggctacgtcgtcaacataattgctgcttatggaaacccgtgcgaggtcgccgatatacttggcctacccagttatgtcgtcccggtagcaggcttgctagttggtaagcctaaaggcgagctgccgcctttaacgccgagggctccagtagaagctcttgctggctggaactcttacggcgatcttgaggataaggtgaaggcgtatatgagcttgggggaaaagtttgttaacaatatgtggcgggtccacaggcacggcggccccgttgatagaatggataatgttataagggagtgcctcaaatcgagagggtttagggtttaa

SEQ ID NO: 68821 - protein, 259 aa, Aeropyrum pernix K1
MKRDRTSSLFLSFPFKFLRWSSVEDRGCCFSVISRHRSVRSFSTEPIPQEDIRKILEAARRHVSPWNIQPVHVTVVTDSKLKSRLSDALWGQEQIKEAPVFFVFSVDYAKVLESIKLLGLEAREPGLTELLQGYISASVALAWSIAVAEDLGYVVNIIAAYGNPCEVADILGLPSYVVPVAGLLVGKPKGELPPLTPRAPVEALAGWNSYGDLEDKVKAYMSLGEKFVNNMWRVHRHGGPVDRMDNVIRECLKSRGFRV

SEQ ID NO: 68822 - DNA, 750 bp, Aeropyrum pernix K1
  CDS (1)..(750): transl_table=11
atggaggctacgggggcttctgaggctgctagggtggtttacgaggtttttgcgaggcataggtctataagaaagtatgttaagaagccgctgccggaggagcatgtgtccctcctactggaggctgctaggagggctcccacagacgctactctacacctctggagcgcagttagggttgttgatgatggtgtgaggaggaggattgccgatgctataggccaggagcacgtctacgaggccggcgagttcttcatcttcctcgccgacttctacaggctgaaaaggctcctggagtaccggggtgaggagctgggcagggttgacagggctctcctcgttttcgcagccatcgacgccggcctggcggctgagaacatggccgtcatggccgaggccctgggctacggcacctgcttcatagggggcgtccagaacgccgccgagctcatcatagaactcctggccctaccggagaagacctaccccctcttcggcctcaccataggctacccagcagaggacccgcccctcaggcccaggctacccccggacctcctattccacacggacaggtacagggaatacaccagcgaggacctagccagagcttacgaggccatggcatcctacagcaggaggagggactggctcaggatactcaaacgctacgtagccaagggaggctacttcgaggccaggagcgaggagatgtggaggctgctcaggaagcagggcttcagcctatag

SEQ ID NO: 68823 - protein, 249 aa, Aeropyrum pernix K1
MEATGASEAARVVYEVFARHRSIRKYVKKPLPEEHVSLLLEAARRAPTDATLHLWSAVRVVDDGVRRRIADAIGQEHVYEAGEFFIFLADFYRLKRLLEYRGEELGRVDRALLVFAAIDAGLAAENMAVMAEALGYGTCFIGGVQNAAELIIELLALPEKTYPLFGLTIGYPAEDPPLRPRLPPDLLFHTDRYREYTSEDLARAYEAMASYSRRRDWLRILKRYVAKGGYFEARSEEMWRLLRKQGFSL

SEQ ID NO: 68824 - DNA, 735 bp, Bacillus halodurans C-125
  CDS (1)..(735): transl_table=11
atgaccaatgaaatgacaacgctcattcagcagcatcgttcgattcggaaatttaccgctgaaccgatttcaaatcaagtgattgatgacattgtaacgtccggtcagtgggcgccgtcatcccatcacgtccaggcgtacagtatcgtagtcgtaaaaaatcaggagtcaaagaacaagctggccgaattaactggcaatcaatcgtatgttgccgagtgccctgtcttttttgtgatttgtgctgatttttatcgtttgaagcaggcaagtgacaagcataaaatgccgtttgaaataaatgaagttgaaaacgtattagtcggagccgtagatgctgcgttggtggcgcaaaacatgctgctagctgctcgctcttacggattagggggagtgatgatcggcggtattcgcaacaatccagatcaagtggctgaacagctggagttgccagaactcgtcatcccgattatgggtctatgcgttggctaccctgaccaacaaccggaacaaaagcctcgcttctcaaaaaacgcagtcgtccatgaggaacgttactcctttaatgaggctgatctcgagcgatatgatgagatgacgaaagcgtactatacgaaacgaacaaatgggaaacgcacagacagttggagtgaaatgatggcgaaacacttctctacccgaaagcgccctcatgtgacgacgtttattaaaaaacaaggaatcgatttaacctga

SEQ ID NO: 68825 - protein, 244 aa, Bacillus halodurans C-125
MTNEMTTLIQQHRSIRKFTAEPISNQVIDDIVTSGQWAPSSHHVQAYSIVVVKNQESKNKLAELTGNQSYVAECPVFFVICADFYRLKQASDKHKMPFEINEVENVLVGAVDAALVAQNMLLAARSYGLGGVMIGGIRNNPDQVAEQLELPELVIPIMGLCVGYPDQQPEQKPRFSKNAVVHEERYSFNEADLERYDEMTKAYYTKRTNGKRTDSWSEMMAKHFSTRKRPHVTTFIKKQGIDLT

SEQ ID NO: 68826 - DNA, 756 bp, Bacillus halodurans C-125
  CDS (1)..(756): transl_table=11
atgaatgaagtgattcaaacgatgatgaaccaccgctcctgtcgccaatacagtgacaaaccagttcccgacgatcatttgcaagcgattcttcacgccgcccaatgggggccgtcgtggattcatggtcagcaagtctcggttatcgtcattcgtgagccaaacgagcgagagttgtttgctgagctcgtaggtggacaggctcacgttgcacaagcaccgatctttctcgtgttttgcgcagattttcaccgtgcggcggtggcggcagaagcccgtgggaaattcttagcggccttggaggatgtagatgcccttatggttggtgcaacagatgttggtattgcactcagcaacgccataacagcagccgaatcgctcggccttggaaccgtaccgattggtggaatccggcgccagcctttgcgcgtaatcgaaacgctccaattgccatcatacgtgatcccgatttctgggctctgtatcggatatccggaggagacagtcgaacaaaagccacgcctcccgttggatgtattcacccatgatggccggtatgagccacttagtcaaaagacacttgctgcttatgacgaactcatatctggtaatacgaaacagcggacaggtggagcgacgactacaacctggtcggatcgcctcatcagcttctatgaacagccctactaccaagagattgtcgccatgctaaaacagcaagggttcacttgtaaaaatgtaaaagaagaaggttga

SEQ ID NO: 68827 - protein, 251 aa, Bacillus halodurans C-125
MNEVIQTMMNHRSCRQYSDKPVPDDHLQAILHAAQWGPSWIHGQQVSVIVIREPNERELFAELVGGQAHVAQAPIFLVFCADFHRAAVAAEARGKFLAALEDVDALMVGATDVGIALSNAITAAESLGLGTVPIGGIRRQPLRVIETLQLPSYVIPISGLCIGYPEETVEQKPRLPLDVFTHDGRYEPLSQKTLAAYDELISGNTKQRTGGATTTTWSDRLISFYEQPYYQEIVAMLKQQGFTCKNVKEEG

SEQ ID NO: 68828 - DNA, 651 bp, Lactococcus lactis subsp. lactis Il1403
  CDS (1)..(651): transl_table=11
ttgataaaagctgcacagtctggagcttcatctaattttctacaagcttattcaatcattgagatagcggataatgatttacgtcgtgaactggctaagatatcaggttcagatgattatgtgaatcaaacaggtgttttttatatatttgtggctgactggtatcgacaagctcagattttacaaacggaaaataaggatgtgaaggctctccagaatatggaagcattgacggttgccattgttgatactacaattgctgcacagaatatggcgatagctgcagaatctatggggcttggaatttgttatattggtgggattcgtaatgatattgataaagtggcagatttactggatttaccagaattgactgttccactttttggtcttacaattgggatgccaaaaacacgaaatgaagttaaaccacgtttaccaagagcaaatattttgtcagtaaatgcttataatcgtgtgacagtgagtgatttacaggcttataatgaacaaacttcagattactatgccaatcggagtcatcatcaaaagtctactgattggacgcaggaaatgagcaattttctgacaaagccacggcgtgaggatgttgccaaatttttgaaaaagcaaggatttacattaaactga

SEQ ID NO: 68829 - protein, 216 aa, Lactococcus lactis subsp. lactis Il1403
MIKAAQSGASSNFLQAYSIIEIADNDLRRELAKISGSDDYVNQTGVFYIFVADWYRQAQILQTENKDVKALQNMEALTVAIVDTTIAAQNMAIAAESMGLGICYIGGIRNDIDKVADLLDLPELTVPLFGLTIGMPKTRNEVKPRLPRANILSVNAYNRVTVSDLQAYNEQTSDYYANRSHHQKSTDWTQEMSNFLTKPRREDVAKFLKKQGFTLN

SEQ ID NO: 68830 - DNA, 729 bp, Lactococcus lactis subsp. lactis Il1403
  CDS (1)..(729): transl_table=11
atgactgaaacaaatgaaacgattgatttaatgatgaatcacacttcggtcagaaattttacagaagaagcaattgagcctaaagatttggaaaaaatcttaaaagctgctcaaatggcatcaacatggaaaaatttccaatcatattctgtgattgttgtagaatcacaagctcaaaaagatgcgatttatgaatttcaaccacaaaaatcaatcaaaaattgtgcagcatatttagtttttgttggcgatttaaatcgtgctcaaaaggcagtcgaattggatcaaggcaatttccaaccgcaaggaattgaaagcttattgattacatcagttgatgccgcaacagctggacaaaatgcgcttcttgcagcagaatctttaggctacaacggggtgatggttggcttaattcgagaccaatcctcagaaatttctaaagtcttgaacttgccagattatacttatcctatttttggcattgcactcggtaaggccgcacgtttgaacaaagtaaaaccacgtcttcctttggaagcaacagcttttaaagaaaaatatgttgagcaaacgtctgaaaccattgaaaaatatgaccaagttcaagaagaatatgctggaaatagacgcttaaacaaatggtctgaacggattgttgaccagtggggccaaccagaaatttcagcttcaacagaaaatttaaaggcgaaaaaattactgtttaattaa

SEQ ID NO: 68831 - protein, 242 aa, Lactococcus lactis subsp. lactis Il1403
MTETNETIDLMMNHTSVRNFTEEAIEPKDLEKILKAAQMASTWKNFQSYSVIVVESQAQKDAIYEFQPQKSIKNCAAYLVFVGDLNRAQKAVELDQGNFQPQGIESLLITSVDAATAGQNALLAAESLGYNGVMVGLIRDQSSEISKVLNLPDYTYPIFGIALGKAARLNKVKPRLPLEATAFKEKYVEQTSETIEKYDQVQEEYAGNRRLNKWSERIVDQWGQPEISASTENLKAKKLLFN

SEQ ID NO: 68832 - DNA, 780 bp, Deinococcus radiodurans R1
  CDS (1)..(780): transl_table=11
atgcacggcacccaaacgcccgaccaagttcgcgccttctacgacgcccaccgcacggtccgcctctaccagacccagcccgacggctcgcccatccgcatgacagcagacgagctcgacgcggtgctgcacgccgctcagcgggcgcccaccgacgccactgcacagctctactcttatattcacctcaccactcctgagctgcgggcgcaggtggccgagctgaccggcaacccccacatcaacatcgcgtccgaggcgtttatcgcctgctccgacacccgccgggtgggcaagattctggaggcggcgggctatgagtcgggcagttggcctgccatcgccgtgcacttcggcatcggggacatcgtgatgtccggtcagaacctgctgaccgccgccgaaatgctcggctatcagggctgctggatcggcggcgtggtgaacaacatggacgccctgatcacgctgctcggcctccccgaaggtgtgctgcccttcgccgccatcactgtgggccgccccgccgaggacgccccgctgcgcccgcgcctgccgcgagaactcgtcgtccacaccggcacctaccgcgacggcacccccgaggaactgcgcgccgccaccgaactcatgaaccccatcgccgagcgccccggcaagcccggcgactgggcgcggctgctcaagatgtacttcggccagggcggcggcatggaagtccgcgaacccggactggtggccgccctcaagcgtcagggcctgcacaacggcgagcagtga

SEQ ID NO: 68833 - protein, 259 aa, Deinococcus radiodurans R1
MHGTQTPDQVRAFYDAHRTVRLYQTQPDGSPIRMTADELDAVLHAAQRAPTDATAQLYSYIHLTTPELRAQVAELTGNPHINIASEAFIACSDTRRVGKILEAAGYESGSWPAIAVHFGIGDIVMSGQNLLTAAEMLGYQGCWIGGVVNNMDALITLLGLPEGVLPFAAITVGRPAEDAPLRPRLPRELVVHTGTYRDGTPEELRAATELMNPIAERPGKPGDWARLLKMYFGQGGGMEVREPGLVAALKRQGLHNGEQ

SEQ ID NO: 68834 - DNA, 741 bp, Clostridium acetobutylicum ATCC 824
  CDS (1)..(741): transl_table=11
atgaataatacaatagatacaatgaaaaatcatagatcaataagacaatatctagataaagaggtgccaaatgatttaatcgatgaaattgttaaaagtgctcaggctatgcctaactcaatcaatggacaacaaacatctgttatagttgtaagagataaaaagaagagagaaaaattagcagaacttgttggtaatcaagaatatgttgcaaaagctccagtattcttagtatttgtgatggatttttatagaacttatcttgcaggtgaaaaaactggtcttaagcaggtaattcatgaagatatagaaggtattcttgcagggtctgtagatgttggaatagctttaggagcttctgttgttgctgccgaatcccttggacttggcacagtgcctattggtggtatcagaaaaaatccagaagaagttatagaaatattaggattacctaaatatacttttccaatggtaggtttagtagttggatatccggctgatgaatcacataaaaaacctagggttccttttgaaagttttaggcataatgagagttatgatataaaagctgttgaagattcaattaatgtttatgacgaacagatgaataaatatctaaaggaaattggaagagctgagaaagaaataaattggagtacttttacttcaacaatttatcaatctgtttattatcctaaagttaaaggcgctattaataaacaaggactaaaaactaaataa

SEQ ID NO: 68835 - protein, 246 aa, Clostridium acetobutylicum ATCC 824
MNNTIDTMKNHRSIRQYLDKEVPNDLIDEIVKSAQAMPNSINGQQTSVIVVRDKKKREKLAELVGNQEYVAKAPVFLVFVMDFYRTYLAGEKTGLKQVIHEDIEGILAGSVDVGIALGASVVAAESLGLGTVPIGGIRKNPEEVIEILGLPKYTFPMVGLVVGYPADESHKKPRVPFESFRHNESYDIKAVEDSINVYDEQMNKYLKEIGRAEKEINWSTFTSTIYQSVYYPKVKGAINKQGLKTK

SEQ ID NO: 68836 - DNA, 714 bp, Streptococcus pneumoniae R6
  CDS (1)..(714): transl_table=11
atgacagaaaccattaaattgatgaaggctcatacttcagtgcgcaggtttaaagagcaagaaattccccaagtagacttaaatgagattttgacagcagcccagatggcatcatcttggaagaatttccaatcctactctgtgattgtggtacgaagtcaagagaagaaagatgccttgtatgaattggtacctcaagaagccattcgccagtctgctgttttccttctctttgtcggagatttgaaccgagcagaaaagggagcccgacttcataccgacaccttccaaccccaaggtgtagaaggtctcttgattagttcggtggatgcggctttggctggacaaaatgccctgctggcagctgaaagtttgggttatggtggtgtgattattggcttggtacggtacaagtcagaagaagtggcagaactctttaacctgcctgactacacctatcctgtctttgggatggcactaggtgttccaaatcaaactcatgatgtgaaaccaagactgccactagataatgtagtctttgaggaagaataccaagaacagtcaactgaggcaatccaagcttatgaccgtgttcaggctgactatgctggggcgcgtgcgaccacaagctggagtcagcgtctagcagaacagtttggtcaagctgaaccaagctcaactagaaaaaatcttgaacagaagaaattattgtag

SEQ ID NO: 68837 - protein, 237 aa, Streptococcus pneumoniae R6
MTETIKLMKAHTSVRRFKEQEIPQVDLNEILTAAQMASSWKNFQSYSVIVVRSQEKKDALYELVPQEAIRQSAVFLLFVGDLNRAEKGARLHTDTFQPQGVEGLLISSVDAALAGQNALLAAESLGYGGVIIGLVRYKSEEVAELFNLPDYTYPVFGMALGVPNQTHDVKPRLPLDNVVFEEEYQEQSTEAIQAYDRVQADYAGARATTSWSQRLAEQFGQAEPSSTRKNLEQKKLL

SEQ ID NO: 68838 - DNA, 738 bp, Listeria monocytogenes EGD-e
  CDS (1)..(738): transl_table=11
atgaatacaaccattcaacaattagttaaacatgtttcagtaagagaatttaaaaatgaaagattatcagatgaaaccaaacaacatttattaacggctgcgagaagtgcatctagttcgcattttgtgcaatctttttctattttagaaatcacagatgaaaaactaagaaaggaactagctgaaattacgaatagtgcttcttatgtaaatcaaacggggaccttttatgtgtttgtaggagatttataccggcaatcaaaacttttacttgagaataatagaactttagatgggttgagaaatatggaatcattactcgtctcggtgatagatgctacaattgcagctcaaaacatggttattgctgctgagtctcttgatttaggaatctgttatatcggtggaataagaaatgatattggaaaagtagctgaattgctaaacttaccaccatttacgatacctgttttcggattaactgtaggcgttccagaatataaaaatcaagtaaaaccacggctattactagaaaatcaagtaggagaaaatcagtatccacatgaacagtttacggatttaaaagcgtatgaggaattgaccaaagattattatgctttacgtgaaaaaaatcagcatcaaacttcatggggagataagaatgtagagttttttgaagaaatacgaagaccagaaatagctagttttttgaaaaaacaagggttcacactggattaa

SEQ ID NO: 68839 - protein, 245 aa, Listeria monocytogenes EGD-e
MNTTIQQLVKHVSVREFKNERLSDETKQHLLTAARSASSSHFVQSFSILEITDEKLRKELAEITNSASYVNQTGTFYVFVGDLYRQSKLLLENNRTLDGLRNMESLLVSVIDATIAAQNMVIAAESLDLGICYIGGIRNDIGKVAELLNLPPFTIPVFGLTVGVPEYKNQVKPRLLLENQVGENQYPHEQFTDLKAYEELTKDYYALREKNQHQTSWGDKNVEFFEEIRRPEIASFLKKQGFTLD

SEQ ID NO: 68840 - DNA, 738 bp, Listeria innocua Clip11262
  CDS (1)..(738): transl_table=11
atgaatacaaccattcaacaattagttaaacatgtttcagtaagagaatttaaaaatgaaagattatcagatgaaaccaaacaacatttattaacagctgcgagaagtgcctctagttcgcattttgtgcaatctttttctattttagaaatcacagatgaaaagctaagaaaggaactagctgaaattacgaatagtgcttcttatgtaaaccaaacggggaccttttatgtgtttgtaggtgatttataccgacaatcaaaacttttactggagaataatcgaactttggatgggttgagaaatatggaatcattactcgtctcggtgatagatgcaacgattgcagctcaaaatatggttattgctgctgagtctcttgatttaggaatttgctatatcggtggaataagaaatgatattgaaaaagtagctgaattgctaaacttaccaccatttacgatacctgttttcggattaactgtaggggttccggtatataaaaatcaagtaaaaccacggctattactagaaaatcaagtaggtgaaaatcagtacccatatgaacaatttacagatttaaaagcgtatgaggaattgaccaaagattattatgctttacgtgaaaaaaatcagcatcaaacttcatggggagacaagaatgtagagttttttgaagaaatacgaagaccagaaatagcgggatttttgaaaaaacaagggtttacactggattaa

SEQ ID NO: 68841 - protein, 245 aa, Listeria innocua Clip11262
MNTTIQQLVKHVSVREFKNERLSDETKQHLLTAARSASSSHFVQSFSILEITDEKLRKELAEITNSASYVNQTGTFYVFVGDLYRQSKLLLENNRTLDGLRNMESLLVSVIDATIAAQNMVIAAESLDLGICYIGGIRNDIEKVAELLNLPPFTIPVFGLTVGVPVYKNQVKPRLLLENQVGENQYPYEQFTDLKAYEELTKDYYALREKNQHQTSWGDKNVEFFEEIRRPEIAGFLKKQGFTLD

SEQ ID NO: 68842 - DNA, 741 bp, Listeria innocua Clip11262
  CDS (1)..(741): transl_table=11
gtgaatcaggcgatagatgccattttaggtcattattcagtacggaactttgaagataaagctttaacagaagaagaattagctttacttattaaaagtgcgcaggccgcatctacatctagttttgttcaagcatactctataatcggaataacagataaaaaaattcgagaacaaatttctgctattgcgggaaatcaaccatatactgtacaaacagggcaattatttatctttgttgctgatctagcgagacaccaagccatcctagaagaacatcaagtagacacagccgcactagaaacttcagaaaaatggcttgtttccattattgatgccgcacttgccgcgcaaaatatggctgttgccgcagaatcgttaggatttggtatttgctttatcggaggaattcgtaatgacgtagggcaaattgccgaaattcttgatttgccaccatatacgatgccgttatttggtttaacaataggccacccgattaaaggcaaagaaaaagccaaacctagattaccgcaagatttggtttatcacgaaaatacttatcaaaaaatgaatccagcaactttagcagaatacgatgaacaaataaaaacttactacgatgaacgaacagcaggaaaacgagtagaaggctggtccgagcagattgcacgcgggcttggaagaaaaagccggttagacttaaaagattttttacaaaagcaacatttaaatcaaaaataa

SEQ ID NO: 68843 - protein, 246 aa, Listeria innocua Clip11262
MNQAIDAILGHYSVRNFEDKALTEEELALLIKSAQAASTSSFVQAYSIIGITDKKIREQISAIAGNQPYTVQTGQLFIFVADLARHQAILEEHQVDTAALETSEKWLVSIIDAALAAQNMAVAAESLGFGICFIGGIRNDVGQIAEILDLPPYTMPLFGLTIGHPIKGKEKAKPRLPQDLVYHENTYQKMNPATLAEYDEQIKTYYDERTAGKRVEGWSEQIARGLGRKSRLDLKDFLQKQHLNQK

SEQ ID NO: 68844 - DNA, 732 bp, Listeria innocua Clip11262
  CDS (1)..(732): transl_table=11
atgaatgacgtattaactttactcagaaatcatcgttcttttcggaaatataaacagggtatcgaaattccggaagaaaaactcgatgctattattcgagcagctcaagcagccccgtcgtggattaatggacagcattattccattattgcgattaaagatcaagatcgtaaaaacaaaatggcagaactttgcgggaatcaaccatacatagctgaatgttcggtatttctttgttttgtagcagatttccaccgcgtaaaagtagcaagtgagctgcacggcaaaagtttccaaattgctagtgaagaagatttgttgatggttgcagcaacggatataggtttgtgtatgcaaaatgctttaacagccgctgagtcgcttgattatgggacaatttgtattggtggtttacggagaaatattacagctacttctgagtttcttgctttaccaaaatatgtcatgccggtcgttgggctttgtatcggggttccggatgtagaagctcctgtaaaacctcgcttgccgaaagaagccgtttattttgaagaaacgtaccaaactgatgttatgcctttacttgaagcttatgaccaagaaatcattcctttttctgagcgggaaggttttgtgtcttataccgaacgtttagcaaaattttatgataagccgtattatccgaatttaacagaacaaataaaagaaagaggctttttaggcggaaaataa

SEQ ID NO: 68845 - protein, 243 aa, Listeria innocua Clip11262
MNDVLTLLRNHRSFRKYKQGIEIPEEKLDAIIRAAQAAPSWINGQHYSIIAIKDQDRKNKMAELCGNQPYIAECSVFLCFVADFHRVKVASELHGKSFQIASEEDLLMVAATDIGLCMQNALTAAESLDYGTICIGGLRRNITATSEFLALPKYVMPVVGLCIGVPDVEAPVKPRLPKEAVYFEETYQTDVMPLLEAYDQEIIPFSEREGFVSYTERLAKFYDKPYYPNLTEQIKERGFLGGK

SEQ ID NO: 68846 - DNA, 717 bp, Pyrobaculum aerophilum str. IM2
  CDS (1)..(717): transl_table=11
atggagtttttcgaggttgtgaatagaaggcgatcggttaggaggtttaagagagtgaaaatcccagaggacgatgtgaagaaaatcatggaggcggggaggctagcgccgacagatgccactcttcacctctggagcgcagtgtggataagagatgatgttaaaaagtcggagatcgccaagttgattggccaaccgcatgtggaagagggatccgacttctttatcttcttagcggatttatacaggctgagggagttgttgaaatacagaggccgtgaaattgttgcgaataaattagcgcttttcgtgtttgcggctgtggacgccgcgctagcggctgagaatatggccctggcggcgaccgctttgggatacggcagttgttttataggcgctgtgcaaaacgccgtatacgatcttgtaagtcttttgaaactccccgatttaacctatcccctatttggactagtaattggcgtgcctgatgaggatcccccgcgccgcccgaggcttccggccgatatgttatttcatcgcgaggagtacagggcgtatcgggaggatgagttaaaagcggcgtatgaaattatgggcagagtcaccaggtcgggggattggctgagaatactagaacgctacgccgctagagacggatattttgataaacgcagtgatttaatgatatctgtaatgaaaaggctgggatttatgtaa

SEQ ID NO: 68847 - protein, 238 aa, Pyrobaculum aerophilum str. IM2
MEFFEVVNRRRSVRRFKRVKIPEDDVKKIMEAGRLAPTDATLHLWSAVWIRDDVKKSEIAKLIGQPHVEEGSDFFIFLADLYRLRELLKYRGREIVANKLALFVFAAVDAALAAENMALAATALGYGSCFIGAVQNAVYDLVSLLKLPDLTYPLFGLVIGVPDEDPPRRPRLPADMLFHREEYRAYREDELKAAYEIMGRVTRSGDWLRILERYAARDGYFDKRSDLMISVMKRLGFM

SEQ ID NO: 68848 - DNA, 819 bp, Corynebacterium glutamicum ATCC 13032
  CDS (1)..(819): transl_table=11
atgccgtcaccaggagaacttttagccgcccgctacggacaacctgcaacctggacgccaccgcagtggaatgagacgcttgatgtcattcaccagcatcgatcagttcgcaggtggttggataaaccggttgatgatgacaccatccgcaccattatttccgccgcacaatcggctggaacctcttccaataagcaggtcatttctgtcatcgtggttaaagatcctgagctgaggaaaggcctcgcggggatcactcgccagatgtttccgcaccttgagcaggttcccgcggtgctgatttggttgattgattattcccgaatcagtgcggtggcagccagagaagatctcccaacaggggctcttgattatctcgatgaggccgcgttggggttcctcgacgccggaatcgcagctcaaaacgctgcaattgctgcggagtcacttggattgggaacgctctatttgggttcggtgcgcaacgatgcggaagccgtgcagaaattgcttggccttccacctgagatcgtgcctgtcgtgggcttggaaattgggcatgcggatccgtctgaacctgccggaattaaacctcgcctgccacaagaagccattgttcactgggatacctacaccgagaaaaacctcgaacttatcgattcctacgaccgcgccctcgacacttactattctcgctacggccagcaccagctctggtcgaagcagacggcgcatagggcggcgtcgaaaagcattacaaaaaccaacaggcagttccttaggcgcgtgtttgagcgcgccgggtttgggctgagataa

SEQ ID NO: 68849 - protein, 272 aa, Corynebacterium glutamicum ATCC 13032
MPSPGELLAARYGQPATWTPPQWNETLDVIHQHRSVRRWLDKPVDDDTIRTIISAAQSAGTSSNKQVISVIVVKDPELRKGLAGITRQMFPHLEQVPAVLIWLIDYSRISAVAAREDLPTGALDYLDEAALGFLDAGIAAQNAAIAAESLGLGTLYLGSVRNDAEAVQKLLGLPPEIVPVVGLEIGHADPSEPAGIKPRLPQEAIVHWDTYTEKNLELIDSYDRALDTYYSRYGQHQLWSKQTAHRAASKSITKTNRQFLRRVFERAGFGLR

SEQ ID NO: 68850 - DNA, 777 bp, Streptomyces coelicolor A3(2)
  CDS (1)..(777)
atgaacatcatctggaacgagcagatcgaagcgctgctcgcgcaccgctcagtgcgcgcgttcaccgacgagccactgcccgacggcgctctggagacggtggtggcggccgcccagtcggcgtccacgtcgtcgaacctccatcagtggagtctcgtggccgtctcggacccggagacgaaggccgaactcgcaaggctgacacacggcgcggagttcaccgggttcgatttcgtcgcccaggcccccagcgtgctgctgtggatagcggacatgtcgcgcagccacgcgatcagtgtcgagcagggcggcaagcccgtcgtcaccgactacgtcgacgccttcctgatggcgtcggtcgacgcggccctggccgcccagaatggtcttgtggcggcagaggcgatcggcctgggaggcgtgtacctgggctcgctgcgcaaccacgccaaggagctctccgacctgatcggacttcccgcgtacgcctacgtcgtgttcggcatggccgtcggtaccccggacccgcaccgccccagtgcggtgcatccccgtccggcacaggacgtcgtgctgcatcgcgagcgctaccggacacggccggtcgaggagtggatcgaggactacgagaccgcgttcaaggccttccgcgccgagtacggactgcgtgacaagacatggagccactccgtcgcggtgagtacgggcctggactacatggatgggcgtgagaacctgcgccgtacgctggaggagcgcggctacctgctgcgctga

SEQ ID NO: 68851 - protein, 258 aa, Streptomyces coelicolor A3(2)
MNIIWNEQIEALLAHRSVRAFTDEPLPDGALETVVAAAQSASTSSNLHQWSLVAVSDPETKAELARLTHGAEFTGFDFVAQAPSVLLWIADMSRSHAISVEQGGKPVVTDYVDAFLMASVDAALAAQNGLVAAEAIGLGGVYLGSLRNHAKELSDLIGLPAYAYVVFGMAVGTPDPHRPSAVHPRPAQDVVLHRERYRTRPVEEWIEDYETAFKAFRAEYGLRDKTWSHSVAVSTGLDYMDGRENLRRTLEERGYLLR

SEQ ID NO: 68852 - DNA, 756 bp, Staphylococcus aureus subsp. aureus MW2
  CDS (1)..(756): transl_table=11
gtgtcagaacatgtatataatcttgtgaaaaagcatcattctgttagaaaatttaagaataaacctttaagtgaagacgttgttaagaaattggtagaagctggacaaagcgcttcgacgtcaagtttcctgcaagcatactcaattattggtatcgacgatgagaagattaaagaaaatttacgagaagtttctggacaaccttatgttgtagaaaatggctatttattcgtctttgttattgattattatcgtcatcatttagttgatcaacatgctgaaactgatatggaaaatgcatatggttcaacggaaggtttgctagtaggtgcaatcgatgcagcattagttgccgaaaatattgcggtaactgctgaagatatggggtatggcattgtctttttaggatcattaagaaatgatgttgaacgagttcgagaaattttagacttacctgactatgtcttcccggtatttggtatggcagtaggggaacccgcagatgacgaaaatggtgcagccaagccacgcttaccatttgaccatgtcttccatcataataagtatcatgctgataaggaaacacagtatgcacaaatggcagattacgaccagacaatcagcgagtactataatcaacgtacaaacgggaatcgcaaagaaacatggtcgcagcaaattgagatgttcctaggaaacaaagcaagattagatatgttagaacaattgcaaaaatcaggcttaatacagcgatag

SEQ ID NO: 68853 - protein, 251 aa, Staphylococcus aureus subsp. aureus MW2
MSEHVYNLVKKHHSVRKFKNKPLSEDVVKKLVEAGQSASTSSFLQAYSIIGIDDEKIKENLREVSGQPYVVENGYLFVFVIDYYRHHLVDQHAETDMENAYGSTEGLLVGAIDAALVAENIAVTAEDMGYGIVFLGSLRNDVERVREILDLPDYVFPVFGMAVGEPADDENGAAKPRLPFDHVFHHNKYHADKETQYAQMADYDQTISEYYNQRTNGNRKETWSQQIEMFLGNKARLDMLEQLQKSGLIQR

SEQ ID NO: 68854 - DNA, 735 bp, Bacillus anthracis str. A2012
  CDS (1)..(735): transl_table=11
atgaatgaaatgatacataaaatggagcaacacgtttcagttcgtaaatataaagaagagtccattccgaaagatgtagtagaaagaatggtgcaagctgggcagcatgctgcgtcctctcattttgtacaggcctattctgttatatatgtaaccgatcaagacttaaaggctaaactagcagagttgtctggaaatcgacatgtgaaagattgcgcagcattctttgtttgttgtgcagatttaaaacgacttgaaatggcatgtgaaaaacatggtacagagataaagcatgaaggagtagaagactttatcgtagcaacggtagatgcttcactttttgcgcaaaacttagcgttagcagcagaatcgttaggatacggtatttgttatattggtggtattcgtaataatccgagagaagtgagcgaattgcttcatttaccggataaagtatatcctgtattcggaatgacagtcggtgtaccaaatgaagatcatggagtaaaaccacgcttaccagtagcagcaatccttcatgaaaatgaatatgatgaaaagaaatatgatgaattactaaacgaatacgatgaaacgatgagcgcgtattataaaggaagatcatcaaacaagaaaagcgtaacatggacggaatcaatgagttcatttatgtctaaagaaaaaagaatgcacatgaaagagtttttaaatgagagaggattaaataagaaatga

SEQ ID NO: 68855 - protein, 244 aa, Bacillus anthracis str. A2012
MNEMIHKMEQHVSVRKYKEESIPKDVVERMVQAGQHAASSHFVQAYSVIYVTDQDLKAKLAELSGNRHVKDCAAFFVCCADLKRLEMACEKHGTEIKHEGVEDFIVATVDASLFAQNLALAAESLGYGICYIGGIRNNPREVSELLHLPDKVYPVFGMTVGVPNEDHGVKPRLPVAAILHENEYDEKKYDELLNEYDETMSAYYKGRSSNKKSVTWTESMSSFMSKEKRMHMKEFLNERGLNKK

SEQ ID NO: 68856 - DNA, 750 bp, Oceanobacillus iheyensis HTE831
  CDS (1)..(750): transl_table=11
atgaataaaattattgaaacacttaaaaatcaccgatcaattagaaaatttacgaatcaacctctaaccgattatcaaataaaggaaattatagaatcagctcaatgtgcatctacatcgagtaatgtcatggcatatacaattatcggtgttaccgataccacattaaagcaagatctgtatgaaatctctggacataatcatgtaaaaacaagtgcacatttattactattttgtgcagatttacatcgaatacatcaattagaagataatcccgatgaaaatcctgattacctcaataatttggaaagcaccgagcaatttatggtatctgttattgatgctaccctagcttcacaaaatgcagcaatagctgctgaatcaatgggattgggaatttgttatttaggtagtttacgtaataacatacgtaaatttaatgatttattgcatttacctcaacatgttatcccgttatttggtttagcaattggacaccctgatcatcaacccgatatcaaaccgcgcttaccaatggaaactatctatcatgagaatacatataaaccatttgaggatcaaaaaagttacatacaaaaatatgatgaaactgtatcggattattatgcaagccgttcttcaaataataaaattgatacctggtccaatcaaatgaaaagaaaattcgcaattccaacacgtatggatgttagttcttttgttcaggaaaaacagttgaatagaaaataa

SEQ ID NO: 68857 - protein, 249 aa, Oceanobacillus iheyensis HTE831
MNKIIETLKNHRSIRKFTNQPLTDYQIKEIIESAQCASTSSNVMAYTIIGVTDTTLKQDLYEISGHNHVKTSAHLLLFCADLHRIHQLEDNPDENPDYLNNLESTEQFMVSVIDATLASQNAAIAAESMGLGICYLGSLRNNIRKFNDLLHLPQHVIPLFGLAIGHPDHQPDIKPRLPMETIYHENTYKPFEDQKSYIQKYDETVSDYYASRSSNNKIDTWSNQMKRKFAIPTRMDVSSFVQEKQLNRK

SEQ ID NO: 68858 - DNA, 708 bp, Shigella flexneri 2a str. 301
  CDS (1)..(708): transl_table=11
atgtgtatctaccttaacttaatgattttgataaaaatcattaggggattcatcagtgcgcagtgtgaggcgattattaacagcgcccgtgcgacgtccagttccagttttttgcagtgtagtagcattattcgcattaccgacaaagcattacgtgaagaactggtgacgctgaccggcgggcaaaaacacgtagcgcaagcggcggagttctgggtgttctgtgccgactttaaccgccatttacagatctgtccggatgctcagctcggcctggcggaacaactgttgctcggtgtcgttgatacggcaatgatggcgcagaatgcattaaccgcagcggaatcgctgggattgggcggggtatatatcggcggcctgcgcaataatattgaagcggtgacgaaactgctgaaattaccgcagcatgttctgccgctgtttgggctgtgccttggctggcctgcggataatccggatctcaagccgcgtttaccggcctccattttggtgcatgaaaacagctatcaaccgctggataaagacgcactggcgcagtatgacgagcaactggcggaatattacctcacccgtggcagcaataatcgctgggatacctggagcgatcatatccgccgaacaatcattaaagaaagccgcccatttattctggattatttgcacaaacagggttgggcgacgcgctaa

SEQ ID NO: 68859 - protein, 235 aa, Shigella flexneri 2a str. 301
MCIYLNLMILIKIIRGFISAQCEAIINSARATSSSSFLQCSSIIRITDKALREELVTLTGGQKHVAQAAEFWVFCADFNRHLQICPDAQLGLAEQLLLGVVDTAMMAQNALTAAESLGLGGVYIGGLRNNIEAVTKLLKLPQHVLPLFGLCLGWPADNPDLKPRLPASILVHENSYQPLDKDALAQYDEQLAEYYLTRGSNNRWDTWSDHIRRTIIKESRPFILDYLHKQGWATR

SEQ ID NO: 68860 - DNA, 828 bp, Corynebacterium efficiens YS-314
  CDS (1)..(828): transl_table=11
atgaccggcagagacaacccgcgggaacttctcaacgcgaggtatggaaccgagatcgactgggaaccgggggagcggaatgacaccctcgacgtgatcctcagccaccggtcggtgcgcagatggctcgatgaaactgtcagcgaggagcagatccggaccatcgtggcggccgcgcagtccgcgccgagttcctccaacaagcagaccgtttccgtggtggcggtgcaggatgcggggatcaagaaggaactgcaggtcgtcggacggcagatgttcaaccacatcgagaccgcaccggtggtgctgatctggtgcatcgatcattccatcgcgcggctgcttgcggagcgcgacggcaaggaactcggtgccctggagtatttcgacgaggctggcctgggtttcctggatgccggcatcatggcgcagaacgcggcgatcgcggcggagtcgatgggcctgggcacggtctatctggggtcgatgcgcaatgacatggagcgcgtccaggaacttctccacctgcccacacacgtcgtgccggtggtcggcctggccatcggccaccccgatcccaccgagcgcgccggtatccaaccccgcctgccgcaggaggcggtcctgcactgggacgtttacggggcgccgcgcccggagcttgtcgacgcctatgacaccgccctgaacacgtactattcccggtatggccagcaccagctgtggtcacaccagtttgtctcccgcctcggcgcggagatcatcattaaaaccagtcgtcggctcgttcgtcgcgtgctagaaaaagctggctttggcctgcgatag

SEQ ID NO: 68861 - protein, 275 aa, Corynebacterium efficiens YS-314
MTGRDNPRELLNARYGTEIDWEPGERNDTLDVILSHRSVRRWLDETVSEEQIRTIVAAAQSAPSSSNKQTVSVVAVQDAGIKKELQVVGRQMFNHIETAPVVLIWCIDHSIARLLAERDGKELGALEYFDEAGLGFLDAGIMAQNAAIAAESMGLGTVYLGSMRNDMERVQELLHLPTHVVPVVGLAIGHPDPTERAGIQPRLPQEAVLHWDVYGAPRPELVDAYDTALNTYYSRYGQHQLWSHQFVSRLGAEIIIKTSRRLVRRVLEKAGFGLR

SEQ ID NO: 68862 - DNA, 825 bp, Pseudomonas putida KT2440
  CDS (1)..(825): transl_table=11
atgagccttcaagacgaagcactcaaagcctggcaagcccgttatggcgagccagctaacttacctgctgccgacaccgtgatcgcgcagatgttgcagcatcgatcagtacgtgcctacagcgatcttcctgtggatgagcagatgctgagctgggcgatcgcggcggcccagtcagcctcgacttcctcgaacctgcaagcttggagcgtgctcgccgtgcgggatcgcgagcgtctcgcgaggcttgcccgactgtccggtaaccagcgccatgtcgagcaggcaccgctgttcctggtctggctcgtggactggtcacgcctacgccgactagccagaacccttcaggcaccgactgcaggtatcgactatttagaaagctacaccgtcggtgttgtagatgcagctctggccgctcagaacgccgcactagctttcgaggcccaaggactgggaatcgtttacatcggcggaatgcgcaaccacccggaagcgatgtccgaggagcttggcctgccaaacgacactttcgctgtatttggcatgtgcgtcggtcatcccgatccggcacagcccgccgagatcaagccacgcctggcgcaatcagtggtgcttcaccgtgagcgctatgaggccaccgaggcagaggcggtttcagttgctgcctatgaccgaaggatgagcgacttccaacatcgtcaacaacgcgaaaaccgttcctggtccagccaggccgtggaacgtgtaaaaggagcggattcactgagcggaagacaccgcttgcgagatgcattaaacaccctaggtttcggcctgcgctga

SEQ ID NO: 68863 - protein, 274 aa, Pseudomonas putida KT2440
MSLQDEALKAWQARYGEPANLPAADTVIAQMLQHRSVRAYSDLPVDEQMLSWAIAAAQSASTSSNLQAWSVLAVRDRERLARLARLSGNQRHVEQAPLFLVWLVDWSRLRRLARTLQAPTAGIDYLESYTVGVVDAALAAQNAALAFEAQGLGIVYIGGMRNHPEAMSEELGLPNDTFAVFGMCVGHPDPAQPAEIKPRLAQSVVLHRERYEATEAEAVSVAAYDRRMSDFQHRQQRENRSWSSQAVERVKGADSLSGRHRLRDALNTLGFGLR

SEQ ID NO: 68864 - DNA, 729 bp, Mycoplasma penetrans HF-2
  CDS (1)..(729): transl_table=4
atgcaagtaatagaaaatattttaaaaagaagattagaaagaaattataaaaacacagctattgaacaagaaaaaattgattatttaatcaaggttattaacagttcacctacaagtactaattctcaagatttttctgcaataatagtagaagataaagaattaagacaaaaaatctcaatgggattagaaacacaatctcacattgtaaatgcaccattgtttattattttttgtgcagacaacaatagacttaatcatgttgctttaaaagaaaacaaagaaatcagaacagataatttaaataactttttaacagcatctggagatgcttttatagcagcttcttttgcatataatgcagcattacaattaggtttaggtgcttgttatattgggatggtaagagcaagtttagaagcaatcaaagaaactttaaatttagaagggaacattgttcctataattggtttaacaattggatatattgaatcacaaaatgagatcaaacctaaaattaatcatgtttataaacaaaaatataatatcaatcaattaaaacaagaagttgatgtatatgataaagatatgcttacatactatgattcaagaaatgcaaatgcaaagaattctacttgatcacaaacttgtttaaatccatttattaatggaacagaaaaagcagcgccagttgatgctttcatcaaaaaaacttgagggttaaaataa

SEQ ID NO: 68865 - protein, 242 aa, Mycoplasma penetrans HF-2
MQVIENILKRRLERNYKNTAIEQEKIDYLIKVINSSPTSTNSQDFSAIIVEDKELRQKISMGLETQSHIVNAPLFIIFCADNNRLNHVALKENKEIRTDNLNNFLTASGDAFIAASFAYNAALQLGLGACYIGMVRASLEAIKETLNLEGNIVPIIGLTIGYIESQNEIKPKINHVYKQKYNINQLKQEVDVYDKDMLTYYDSRNANAKNSTWSQTCLNPFINGTEKAAPVDAFIKKTWGLK

SEQ ID NO: 68866 - DNA, 765 bp, Staphylococcus epidermidis ATCC 12228
  CDS (1)..(765): transl_table=11
gtgggtatagtgtcagattatgtttatgagttgatgaaacaacatcattcagttagaaaatttaagaatcaaccacttggttctgaaacggtagaaaaattagtagaggcgggacagagtgcttctacatccagttatcttcaaacttattctattattggtgttgaagatccaagcattaaagcgcgtttaaaggaagtgtcaggtcagccttatgttttagataatggttatttatttgtatttgttttagattattatcgtcatcatttagtagatgaagttgcggcgtcaaatatggagacatcatatggttctgcagaaggactattagtaggtacaatagatgttgcattagttgcgcaaaacatggcagttgctgccgaagatatggggtatggaattgtttatttagggtcattgcgtaatgatgttgcgcgagtgcgtgaaattttaaatttacctgattatacgtttccgttatttggtatggcagtaggtgaaccttctgatgaagaaaatgggtcacctaaaccgcgcttgccatttaaacatatttttcataaagaccagtatgatgcaaatcagcatcaacaacgtaaagaattggaagcatacgaccaagtagtgagtgaatattataaagaacgtactaacggtgtgcgtacagaaaattggtcacaacaaatagaaacatttctaggacgtaaaacacgtttagatatgttagatgaattgaaaaaagcaggatttattaaaagataa

SEQ ID NO: 68867 - protein, 254 aa, Staphylococcus epidermidis ATCC 12228
MGIVSDYVYELMKQHHSVRKFKNQPLGSETVEKLVEAGQSASTSSYLQTYSIIGVEDPSIKARLKEVSGQPYVLDNGYLFVFVLDYYRHHLVDEVAASNMETSYGSAEGLLVGTIDVALVAQNMAVAAEDMGYGIVYLGSLRNDVARVREILNLPDYTFPLFGMAVGEPSDEENGSPKPRLPFKHIFHKDQYDANQHQQRKELEAYDQVVSEYYKERTNGVRTENWSQQIETFLGRKTRLDMLDELKKAGFIKR

SEQ ID NO: 68868 - DNA, 753 bp, Lactobacillus plantarum WCFS1
  CDS (1)..(753): transl_table=11
gtgacaaagagtgtgagtgaaaccttacaggaccatcgaacgcggcgacaatttaccactgaaccaattagtgatgcgcaattcgcgcaaatcatcacaacggcacaacaaatgccgactagccaatatttacaggcatacagtttgattgagatcactcagcctgcactacggcaacaattggccacgattacgatgatgccaacggttggtgaaaacggccgtttattagttgtggttgcggaccaacaccgcaacgtcaagctagcaccgggcgcaacgacgcgtcgggcactgagtgaatttgaccgctttgctggtagtattgaagatgccacgctgattacagcggcgatggtgatggtcgctgaaagcatgggtcttggtagcgttgtacttggatcaattaacaacgacacgcaggcggtgattgacgcactacacttgccggacttgacgttacccgtctttgggttgcagttagggcacccagcggatgttcctgaaaagaaacctcgattagggttgcccgctgtgttgtttcaagatacctatgctgagcctgcgagttatcaggcggagttggaccggtttgatggcgttttgaatcagtattatcaacatcggagtagtcacgcccgtacggaacacttagcgcacatgacgcaggaagcgacccactcagcggccaaacggcgagagtttttgacaatcgctaggcagcagggctttttgccggaattagaccaataa

SEQ ID NO: 68869 - protein, 250 aa, Lactobacillus plantarum WCFS1
MTKSVSETLQDHRTRRQFTTEPISDAQFAQIITTAQQMPTSQYLQAYSLIEITQPALRQQLATITMMPTVGENGRLLVVVADQHRNVKLAPGATTRRALSEFDRFAGSIEDATLITAAMVMVAESMGLGSVVLGSINNDTQAVIDALHLPDLTLPVFGLQLGHPADVPEKKPRLGLPAVLFQDTYAEPASYQAELDRFDGVLNQYYQHRSSHARTEHLAHMTQEATHSAAKRREFLTIARQQGFLPELDQ

SEQ ID NO: 68870 - DNA, 723 bp, Vibrio parahaemolyticus RIMD 2210633
  CDS (1)..(723): transl_table=11
atgaacagtacgatccaaaccattcttggccaccgttccattcgtaaatttacctcacagcctatcgataaagagcaactggaaaccatccttcaagcgggtcttgccgcatcctcatccagtatgttgcaggtagtatcaattgttagagtcacggacatagagaagagatcacaactagcgaaatttgcagggaatcaagcatacgttgaaagcgcggcagagttcttggtgttctgtatcgactaccagcgtcacgccagtattaatcctgatgttcaagccgatttcacagagttaatgttaataggcgccgtagactcaggaatcatggctcaaaactgcttactggcagcagaatcgatgggcttgggaggcgtatacattggcggtttaagaaataatgctcagcaagtggatgagctactggggctaccccagaataccgccatcctatttggtatgtgtttgggccacccagatcaaaacccagaagttaaacctcgcctacctgcgcacgtggtggtgcacgagaaccagtaccaagatctcaacttagatgacattcaagcatacgaccaaacgatgcagaactactatgcaaaccgctcaagcaatcaaaaacaaagtacgtggtcacaagaagttacgagcaagttagcaggtgagtctcgtccgcatattcttccgtatttgaatgggaaggggttagcaaagaagtga

SEQ ID NO: 68871 - protein, 240 aa, Vibrio parahaemolyticus RIMD 2210633
MNSTIQTILGHRSIRKFTSQPIDKEQLETILQAGLAASSSSMLQVVSIVRVTDIEKRSQLAKFAGNQAYVESAAEFLVFCIDYQRHASINPDVQADFTELMLIGAVDSGIMAQNCLLAAESMGLGGVYIGGLRNNAQQVDELLGLPQNTAILFGMCLGHPDQNPEVKPRLPAHVVVHENQYQDLNLDDIQAYDQTMQNYYANRSSNQKQSTWSQEVTSKLAGESRPHILPYLNGKGLAKK

SEQ ID NO: 68872 - DNA, 738 bp, Bacteroides thetaiotaomicron VPI-5482
  CDS (1)..(738): transl_table=11
atgtttgaaaccgtaaagaacagaagaacaatccggaaataccagcaaaaagatattgctcctgatttgttaaatgatttgctcgaaacctctttccgcgcttctacgatgggagggatgcaactttatagtgttatagtgactcgcgatgcagaaatgaaagagaaactttctcctgctcatttcaatcagccgatggtaaaaggggcacctgtcgtgcttactttttgtgccgatttccgccgtttcagcaagtggtgtgaacagagaaacgctgttcccggctacgataatttaatgtcttttatgaatgcgtctatggataccttgttggttgcgcaaaccttctgcacgttagctgaagaggcaggcttgggtatctgttatctgggaacgactacttataatccgcaaatgatcatcgatacacttcaactgccgaaactggtattccctattacgacgatcacagtcggctatccggacggtactccggcccaggtggaccgcttgcctctcgaagctgccgtgcatcaggaagtttaccatgattatactccggaagacatcgatcgcttgtacgagtataaagaatcactgccggaaaataaacagtttatagaagaaaataagaaagaaactctggcacaagtatttacggatgtacgttatacaaagaaagacaatgaatttatgtctgagaacttgttgaaagtgcttcgtcaacaaggattctaa

SEQ ID NO: 68873 - protein, 245 aa, Bacteroides thetaiotaomicron VPI-5482
MFETVKNRRTIRKYQQKDIAPDLLNDLLETSFRASTMGGMQLYSVIVTRDAEMKEKLSPAHFNQPMVKGAPVVLTFCADFRRFSKWCEQRNAVPGYDNLMSFMNASMDTLLVAQTFCTLAEEAGLGICYLGTTTYNPQMIIDTLQLPKLVFPITTITVGYPDGTPAQVDRLPLEAAVHQEVYHDYTPEDIDRLYEYKESLPENKQFIEENKKETLAQVFTDVRYTKKDNEFMSENLLKVLRQQGF

SEQ ID NO: 68874 - DNA, 735 bp, Enterococcus faecalis V583
  CDS (1)..(735): transl_table=11
atgaatcaaacaatcgaacaattactaagtcaccgttccgttcgtcattttaaaaagcaagcgttaacggacaagcagaaacaacagttaattactgcagctcaagcaggatcaagctccaattttttacaagcttatacaattatagaaatcaaagatcctgagctacgcagagaattgggacgtttagcgaattgtgaagactatgtcgttaacactggtgtgttctatgtttttgttgctgatttgtatcgtcatgcaacgattttgtcaaaagaggggcaatcattggaacccttaaagacaccagaatcattattagtagctgccgttgatacaacgattgctgcgcaaaacatggccattgcggctgaatctatggatttagggatttgttatattggcggcattcgaaatgacttagacacagtagccaaacgcttatctttgcctgaattaactgtaccacttttcggattaacaatcggtgtaccagaaacgttaaatggtgtaaaaccacggatgccttttgaaaatattttaagtgaaaatcactaccaatcagacaaattgacagatatgcacacatatgatgaattattaaaagattattatgccagccgctcaagtaacgcccaaacagcggattggtcacagaaatctttgtcctatttttcttataatcgtcgcccagaagtaaaaattttcttgcaaaaacaaggatttgatgtctaa

SEQ ID NO: 68875 - protein, 244 aa, Enterococcus faecalis V583
MNQTIEQLLSHRSVRHFKKQALTDKQKQQLITAAQAGSSSNFLQAYTIIEIKDPELRRELGRLANCEDYVVNTGVFYVFVADLYRHATILSKEGQSLEPLKTPESLLVAAVDTTIAAQNMAIAAESMDLGICYIGGIRNDLDTVAKRLSLPELTVPLFGLTIGVPETLNGVKPRMPFENILSENHYQSDKLTDMHTYDELLKDYYASRSSNAQTADWSQKSLSYFSYNRRPEVKIFLQKQGFDV

SEQ ID NO: 68876 - DNA, 735 bp, Bacillus cereus ATCC 14579
  CDS (1)..(735): transl_table=11
atgaatgagatcatacataagatggagcaacatgtttcagttcgtaaatataaagaagaatcaattccgaaagatgtagtagaaaagatggtgcacgctgcgcaacatgcagcttcatcacattttgtacaggcttattctgttatatatgtaacagatcaagacctaaagattaaactagcagagctatccggaaatcgtcacgtgaaagactgtgcagcattctttgtttgttgtgcagatttaaaacgacttgaaattgcatgtgaaaaacatagtacagagataaagtatgagggagtagaagactttatcgttgcgacggtagatgcttcactttttgcgcaaaacttagcactagcagcagaatcgttaggatacggtatttgttatattggtggtattcgtaataatccgagagaagtgagtgaactgcttcatttacctgataaagtatatcctgtattcggaatgacagtcggcgtaccagatgaagatcatggagtgaaaccacgtttaccggtagcagcagttcttcatgaaaatggatatgatgaacaaaaatatgatgaattactaaacgaatatgatgaaacgatgaacgcgtattataaagaaagatcatcaaacaagaaaaacgtaacatggacggaatcaatgagttcgtttatgtctaaagaaaaaagaatgcatatgaaagagttcttaagtgaaaaaggattaaataagaagtga

SEQ ID NO: 68877 - protein, 244 aa, Bacillus cereus ATCC 14579
MNEIIHKMEQHVSVRKYKEESIPKDVVEKMVHAAQHAASSHFVQAYSVIYVTDQDLKIKLAELSGNRHVKDCAAFFVCCADLKRLEIACEKHSTEIKYEGVEDFIVATVDASLFAQNLALAAESLGYGICYIGGIRNNPREVSELLHLPDKVYPVFGMTVGVPDEDHGVKPRLPVAAVLHENGYDEQKYDELLNEYDETMNAYYKERSSNKKNVTWTESMSSFMSKEKRMHMKEFLSEKGLNKK

SEQ ID NO: 68878 - DNA, 723 bp, Shigella flexneri 2a str. 2457T
  CDS (1)..(723): transl_table=11
atgacgccaaccattgaacttatttgtggccatcgctccattcgccatttcactgatgaacccatttccgaagcgcagtgtgaggcgattattaacagcgcccgtgcgacgtccagttccagttttttgcagtgtagtagcattattcgcattaccgacaaagcattacgtgaagaactggtgacgctgaccggcgggcaaaaacacgtagcgcaagcggcggagttctgggtgttctgtgccgactttaaccgccatttacagatctgtccggatgctcagctcggcctggcggaacaactgttgctcggtgtcgttgatacggcaatgatggcgcagaatgcattaaccgcagcggaatcgctgggattgggcggggtatatatcggcggcctgcgcaataatattgaagcggtgacgaaactgctgaaattaccgcagcatgttctgccgctgtttgggctgtgccttggctggcctgcggataatccggatctcaagccgcgtttaccggcctccattttggtgcatgaaaacagctatcaaccgctggataaagacgcactggcgcagtatgacgagcaactggcggaatattacctcacccgtggcagcaataatcgctgggatacctggagcgatcatatccgccgaacaatcattaaagaaagccgcccatttattctggattatttgcacaaacagggttgggcgacgcgctaa

SEQ ID NO: 68879 - protein, 240 aa, Shigella flexneri 2a str. 2457T
MTPTIELICGHRSIRHFTDEPISEAQCEAIINSARATSSSSFLQCSSIIRITDKALREELVTLTGGQKHVAQAAEFWVFCADFNRHLQICPDAQLGLAEQLLLGVVDTAMMAQNALTAAESLGLGGVYIGGLRNNIEAVTKLLKLPQHVLPLFGLCLGWPADNPDLKPRLPASILVHENSYQPLDKDALAQYDEQLAEYYLTRGSNNRWDTWSDHIRRTIIKESRPFILDYLHKQGWATR

SEQ ID NO: 68880 - DNA, 858 bp, Bordetella parapertussis 12822
  CDS (1)..(858): transl_table=11
atgaagcggcccgtcccgcacccgtccacggggcgcctgcacgaacacctggaccggcgctacggcggcgcggccgcgccgccgctgacgcttgcccatgcggcgggctcggatatgctgtccctgctgttgccgcatcgcagcgtgcgcgcctacgccgacacaccgctggacgatgccgtgctcacggcgctcacggcggccgcccaatccgccgccacgtcgtccaacctgcaggcatggagcctggtggccgttaccgacccggcgcgcaaggccaggctggccgaattggcggggtcccagccgcacgtcgtccaatgcccgctgtttctcgtctggctcgccgacctgtcgcgcctggcgcgcgtggcggccggccggaacgccccggccgcggcactgccttttcttgagctctacacgctcgccctggtcgacgcggcgctggcggcgcagaacgcggtcgtcgccgccgaagcgctcggcctgggcacggtgttcatcggcggcctgcgcaatcggccggaacgggtcagcgccgaactcggtctgcccgcgcagtgctttgccgccttcggcctgtgcgtgggcaaccccgatccgtcgcggccagcatccatcaaaccccgcctgccgccgccggctgtcctgcaccgggaccagtacgccaccagttcggaagccgatctgctcgaacggtacgacgaacggctcgcggcattccaggccgcccaggggctgcccgcgccgggctggacgccgcaggtcgcgcgccgcgtcgccggggcgcgcagcctggccggacgggaccggctcaggcaggccctgggcaatctcggcttccagctggaatga

SEQ ID NO: 68881 - protein, 285 aa, Bordetella parapertussis 12822
MKRPVPHPSTGRLHEHLDRRYGGAAAPPLTLAHAAGSDMLSLLLPHRSVRAYADTPLDDAVLTALTAAAQSAATSSNLQAWSLVAVTDPARKARLAELAGSQPHVVQCPLFLVWLADLSRLARVAAGRNAPAAALPFLELYTLALVDAALAAQNAVVAAEALGLGTVFIGGLRNRPERVSAELGLPAQCFAAFGLCVGNPDPSRPASIKPRLPPPAVLHRDQYATSSEADLLERYDERLAAFQAAQGLPAPGWTPQVARRVAGARSLAGRDRLRQALGNLGFQLE

SEQ ID NO: 68882 - DNA, 858 bp, Bordetella bronchiseptica RB50
  CDS (1)..(858): transl_table=11
atgaagcggcccgtcccgcacccgtccacggggcgcctgcacgaacacctggaccggcgctacggcggcgcggccgcgccgccgctgacgcttgcccatgcggcgggctcggatatgctgtccctgctgttgtcgcatcgcagcgtgcgcgcctacgccgacacaccgctggacgatgccgtgctcacggcgctcacggcggccgcccaatccgccgccacgtcgtccaacctgcaggcatggagcctggtggccgttaccgacccggcgcgcaaggccaggctggccgaattggcggggtcccagccgcacgtcgtccaatgcccgctgtttctcgtctggctcgccgacctgtcgcgcctggcgcgcgtggcggccggccggaacgccccggccgcggcactgccttttcttgagctctacacgctcgccctggtcgacgcggcgctggcggcgcagaacgcggtcgtcgccgccgaagcgctcggcctgggcacggtgttcatcggcggcctgcgcaatcggccggaacgggtcagcgccgaactcggtctgcccgcgcagtgctttgccgccttcggcctgtgcgtgggctaccccgatccgtcgcggccagcatccatcaaaccccgcctgccgccgccggctgtcctgcaccgggaccagtacgccaccggttcggaagccgatctgctcgaacggtacgacgaacggctcgcggcattccaggccgcccaggggctgcccgcgccgggctggacgccgcaggtcgcgcgccgcgtcgccggggcgcgcagcctggccggacgggaccggctcaggcaggccctgggcaatctcggcttccagctggaatga

SEQ ID NO: 68883 - protein, 285 aa, Bordetella bronchiseptica RB50
MKRPVPHPSTGRLHEHLDRRYGGAAAPPLTLAHAAGSDMLSLLLSHRSVRAYADTPLDDAVLTALTAAAQSAATSSNLQAWSLVAVTDPARKARLAELAGSQPHVVQCPLFLVWLADLSRLARVAAGRNAPAAALPFLELYTLALVDAALAAQNAVVAAEALGLGTVFIGGLRNRPERVSAELGLPAQCFAAFGLCVGYPDPSRPASIKPRLPPPAVLHRDQYATGSEADLLERYDERLAAFQAAQGLPAPGWTPQVARRVAGARSLAGRDRLRQALGNLGFQLE

SEQ ID NO: 68884 - DNA, 741 bp, Chromobacterium violaceum ATCC 12472
  CDS (1)..(741): transl_table=11
atgaacgaaaccttgcagttgatgcattcccatcgcagcgtgcgcagctaccaggacaaacctgtcgcgccggaactgctggacgccgtgctggacgccgcctggaaaggccccacctcgatcaacggccagcagatctcgctggtggtggtgcaggacccggaacgccgcaagcgcatcgccgaaatcgccggcggccagccgtggatcgcgcaggcgccggtcttcgtcgccgtggtgatggatttccacaagacccgcctgggcgtggaaatggccggcgagaaacaggtgatacacgacagcgtcgaagccttcgccgtcggatcggtggatgccggcatcgcgctgggcaatatgatcaccgccgcgcacgccgccggcctgggcgtggtgccgatcggcggcatccgccgcgatccgcaggcgatgatagacctgctggaactgccggaactgacctttccgctggttggcctggtgatcggccacgttcaggatgacgccgatctcaagccccgcctgccgcgcgcgagcttcatccaccgcgaaagctatcaggccgcggagctggccggccacatcgccgcctacgacgacacgctgcgccgccactggcaggacatcggccgcgccgacggcgaaccatggaccgccaacaccgcccgctactaccgccaggtttatttccccaaggtcgcgcccgtcgcgcgcgcccagggttttggcttcgaccagtaa

SEQ ID NO: 68885 - protein, 246 aa, Chromobacterium violaceum ATCC 12472
MNETLQLMHSHRSVRSYQDKPVAPELLDAVLDAAWKGPTSINGQQISLVVVQDPERRKRIAEIAGGQPWIAQAPVFVAVVMDFHKTRLGVEMAGEKQVIHDSVEAFAVGSVDAGIALGNMITAAHAAGLGVVPIGGIRRDPQAMIDLLELPELTFPLVGLVIGHVQDDADLKPRLPRASFIHRESYQAAELAGHIAAYDDTLRRHWQDIGRADGEPWTANTARYYRQVYFPKVAPVARAQGFGFDQ

SEQ ID NO: 68886 - DNA, 765 bp, Corynebacterium diphtheriae NCTC 13129
  CDS (1)..(765): transl_table=11
atgaaggcaagcatgaacgagacgattcgcacccagcttaaccaccgcactatccgtgagttcagcaccgagcaagtatcggaggagatcatggagcagctgtttgcggtggcggggcggactgccacctcgttgggaatgcaaagcaccagcattatccgtgtaactgacccccagttgcgggtacgcttagccgaaatcggcgcccaggaatatgttggccgtgcccccatctacctgctgtttattgtcgattgccaccgcaacgcaggcatcctccaagagctaggcgcggaccctgccggtgctgcgacagcccgcaactttgtccaggggttcaccgatgcctgcctcacggcacaaaacgtgtgcatcgctgccgaatcgatgggcttaggtgtgaacttcctcggcaacgtccacaacgatgctgcggctgtgatcgaactgctgcaactacctgagctcactttcccagttgtgggcatgacactgggctggcctaatcaagagccgcaacttaaaccacgtatggccaccccattgcgcacaatggaaaatggttaccatgcgcccgactcgtggctggaagcgcttagtgactacgaccaagagatgaccacctactacgatcttcgggatgccaaccggcgcgtagatagtttcacccgtcaggtgctcgcaaaaaatcctgctgccggagccgactccgataaacgcaatcacaccttcgcgatcgcccgcgaccaagggtttaacctctag

SEQ ID NO: 68887 - protein, 254 aa, Corynebacterium diphtheriae NCTC 13129
MKASMNETIRTQLNHRTIREFSTEQVSEEIMEQLFAVAGRTATSLGMQSTSIIRVTDPQLRVRLAEIGAQEYVGRAPIYLLFIVDCHRNAGILQELGADPAGAATARNFVQGFTDACLTAQNVCIAAESMGLGVNFLGNVHNDAAAVIELLQLPELTFPVVGMTLGWPNQEPQLKPRMATPLRTMENGYHAPDSWLEALSDYDQEMTTYYDLRDANRRVDSFTRQVLAKNPAAGADSDKRNHTFAIARDQGFNL

SEQ ID NO: 68888 - DNA, 759 bp, Lactobacillus johnsonii NCC 533
  CDS (1)..(759): transl_table=11
atgatacataacaaaactattgatgcacaattaaatcaccgttcaattcgagaatttaaagatacaactttaaataaagaacaattagaaactttatactcagtttttgcacaaaccccaactagtatgttcatgcaaaatgctagcttgatacatattattgatcctgaggagaagaaaaaaattagagaattatgtaatcaaaaatatgttggtgcagaaggtgatttattcatctttgtagttgatttatatcgtaatcaacaaattagaaaacaacttggcaaggatgatggtcgtgtgcatactactgatatctttttccaagcaatggaagataccttacttgcctaccaaaatgttgctaatgccgtagaaagtatggatttaggctacgtaccccttggaacagttaatgatcatccacttgaaatgcttaagacgcttgatttacctaaattgactttcccagtattagggatgcaagttggcgtgcctgatcaaaagccacaattaaaaccacgtttaccattaaaattcacttgttttgaaggaaaatatgataaggacttcaatgtaaaagaattacgtgactatgacaaagtagttactacttactatgatttacgtgattcaaatcgtcgtattgattcatttactaaacaaatcactggcgctaagctagataatcataaaactgatcgtgacgaattacctgaagaactgcataaacaagagctttgcttagactggaagtaa

SEQ ID NO: 68889 - protein, 252 aa, Lactobacillus johnsonii NCC 533
MIHNKTIDAQLNHRSIREFKDTTLNKEQLETLYSVFAQTPTSMFMQNASLIHIIDPEEKKKIRELCNQKYVGAEGDLFIFVVDLYRNQQIRKQLGKDDGRVHTTDIFFQAMEDTLLAYQNVANAVESMDLGYVPLGTVNDHPLEMLKTLDLPKLTFPVLGMQVGVPDQKPQLKPRLPLKFTCFEGKYDKDFNVKELRDYDKVVTTYYDLRDSNRRIDSFTKQITGAKLDNHKTDRDELPEELHKQELCLDWK

SEQ ID NO: 68890 - DNA, 858 bp, Aspergillus nidulans FGSC A4
  CDS (1)..(858)
atggacactcctaccccgccagcaacaccaaaagacctcagcggtctaattgaacgccggtatcaggacggtcaatccttacatatctccaatcaatccgtcccacaaacgatctcaacaattctcgagcaccggtcaatccgcgcattcctgcctacgccacttccacccgggacactcgaaacacttattgctgccggccaaagtgcttccaccttctcaatgctgcaaacctggtccgtcgtcgcaatccatgacccgcagcacaaagacgccgtcgcgcgagtctccggaaaccaagacttcatacgacaagcgccgctattcttgatcttctgtgcagatctacaccgtcatgcaaacgtaatagacaagtacagaacggccggaaagccgctcgagaagatcgatatgctgatagcaggtgtcgttgacgcctcaatcgcggccgaaaatgtcgccatcgcagctgagtcgcttggcctgggaatctgtatggtgggcggagtcagaaataacgctgagagcttggtcgaactacttcatctccccgagaagacatttggaattgtcgggttggctgttgggtatgcggacccgacagcgcatgaggatatcaagccgcggctgccgatgagggagatactccattatgaaacctgggatagcaaccaacagcggcaggacgagaatgtggcgatgtttgatgacgtgctgagcaagcactacgcacttcattcgatgcttggtcggaaaccatggagtagatttgctgccgagtggaatgctgatgggagaatggacgggagggatcgtatgaggggcttgttggagcggcaggggtttggtctgaattag

SEQ ID NO: 68891 - protein, 285 aa, Aspergillus nidulans FGSC A4
MDTPTPPATPKDLSGLIERRYQDGQSLHISNQSVPQTISTILEHRSIRAFLPTPLPPGTLETLIAAGQSASTFSMLQTWSVVAIHDPQHKDAVARVSGNQDFIRQAPLFLIFCADLHRHANVIDKYRTAGKPLEKIDMLIAGVVDASIAAENVAIAAESLGLGICMVGGVRNNAESLVELLHLPEKTFGIVGLAVGYADPTAHEDIKPRLPMREILHYETWDSNQQRQDENVAMFDDVLSKHYALHSMLGRKPWSRFAAEWNADGRMDGRDRMRGLLERQGFGLN

SEQ ID NO: 68892 - DNA, 921 bp, Thermus thermophilus HB27
  CDS (1)..(921): transl_table=11
gtggaactcctagacgtcctggcgagaaggcggagcgtgcgtcgcttcaagcccgtgcccatccccgaggaggacctggaaaagctcctcttcgccctccagcgggcccccaccgacgcgagcgcccagctctactcggcgatccgggtgcgggacccaaggcttagggacgaggtggcccggctctccggggaccaggagcacatcaggcaggcggcggagttcttcctcttcctcgcagatgtccaccgcctggagcggctcctcgcccaccgggggcagaggatggccttctggcccaggaccgccctccacttcgccatcctggacgcggggatcgccgcctcgtacctcgccctcaccgccgaggccctgggctacggggtctgcttcatcggtggggtcttgaacggggtggaggccctcacggacctccttgggcttcccccgggggtcctccccgtggtggggctcgccgtgggggtgcccgacgaggaggggcccccgaggcccaggcttccccggaggctcgtggtccacgaggaccgctaccgcccctacgccgcggaggacctggaggaggcctaccgggccatggccccctacagccgggtgggggactggaaccgggtccttaggcgctacttcgccgaggggggcacgatggaggccagggagaagccttacgggaaggtcctttcccggcaggggtttgacccggacctgccccaaggggcccccttctactccctgggggccttgctggaggaggccttggcggaggcccggggagtgctcttccgcaagggggaggtctggctggaggaggaggccagggccttccggggggaggggaggccgggggaggccctcctcatggcgttgcggaaggcgcggggggaggttccggactggccatga

SEQ ID NO: 68893 - protein, 306 aa, Thermus thermophilus HB27
MELLDVLARRRSVRRFKPVPIPEEDLEKLLFALQRAPTDASAQLYSAIRVRDPRLRDEVARLSGDQEHIRQAAEFFLFLADVHRLERLLAHRGQRMAFWPRTALHFAILDAGIAASYLALTAEALGYGVCFIGGVLNGVEALTDLLGLPPGVLPVVGLAVGVPDEEGPPRPRLPRRLVVHEDRYRPYAAEDLEEAYRAMAPYSRVGDWNRVLRRYFAEGGTMEAREKPYGKVLSRQGFDPDLPQGAPFYSLGALLEEALAEARGVLFRKGEVWLEEEARAFRGEGRPGEALLMALRKARGEVPDWP

SEQ ID NO: 68894 - DNA, 768 bp, Mycoplasma mobile 163K
  CDS (1)..(768): transl_table=4
atgttttatatattagtctacaaaaggagaaatatgattgaaaatttaataagtagaaaaagttcaagagcttttaaagatgaaaaaatttcagaaaaagatttaaaaactttaattgatgtaatgaatacttctgcaacatcttcgaatgctcatcaatcttcggtaattgttgttactgaaatgaatactaagaaaaaaatttatgaaatattaggatctaatccaacacaaacacacatttataaaaatagtgctttatttgtttttgttgctgattttaatagaactttaatttcttctaaaatacataaaattagctataagcagaataatttaaatgatttattgacagcttttggtgatgcatatattcaagccactagattagaaagtgcagcacttgaattagattttggaacttgttatattggcggaattagaaatagtgcagaatctattttacaaattaaaaaacttttaaatataagtggaaaagctatcccaattttggcaattacacttggaaaagaagaaattaaaaatggacttaaacctaaattaaatcgtgtttatttagaaaagtatgatgtttcagttcttgaaaaagaaattaaagcttatgataaagttttaaataatttttgaacaaaattgaatatgagtggcgattattcttcttcaacaataaaaacttatagcaatgaagtaaataatgaaacttgaaaagaaacaatagataaaatttgaacaaaagaaattatctaa

SEQ ID NO: 68895 - protein, 255 aa, Mycoplasma mobile 163K
MFYILVYKRRNMIENLISRKSSRAFKDEKISEKDLKTLIDVMNTSATSSNAHQSSVIVVTEMNTKKKIYEILGSNPTQTHIYKNSALFVFVADFNRTLISSKIHKISYKQNNLNDLLTAFGDAYIQATRLESAALELDFGTCYIGGIRNSAESILQIKKLLNISGKAIPILAITLGKEEIKNGLKPKLNRVYLEKYDVSVLEKEIKAYDKVLNNFWTKLNMSGDYSSSTIKTYSNEVNNETWKETIDKIWTKEII

SEQ ID NO: 68896 - DNA, 741 bp, Erwinia carotovora subsp. atroseptica SCRI1043
  CDS (1)..(741)
atgaataaaacgactgaactgtttacgtcacaccgcagcgaacgtagctaccttgataaacctattcccgatgacgtgctggatgccattattcaatccgcacatttggcgccgacgtccgtgaactctcagcaagtttcgctcatcgtcacccgcgacccagaacgcaaggcacgcattgccgaactggctggtggacaaccgtggattgccaaagcacccgtgttcatcaccgtagtgctagatatgcacaaaacgcagctcgggattgctatgagcggcaaacagcagcacgcgcatgaaagtcttgaaagcctgatcgctggcacaacggacgtcggcatagcactcggcacgctgatggccgctgcacgctcatttgggctgggcatcgtcccgattggcggcatccgtcgcgaaccacaggagttgatcgattttctgcaactccctgaactgacgttccccgttgcaggcgtcgccatcggctacgtcgataccccagcacaccagaaaccgcgcctgccgctgaattcattccgccatgatgaaacctatcatcaggacgttctgcctgcggcgattgagcaatataaccacacgctggtgacacactggcagcaaactggccgcgcagacggcgacaactggggtgataacaccgccagctactatcaacacatctacttcccgaaagtcttgcccgcgatccttcaacagggatttaaactggacaaataa

SEQ ID NO: 68897 - protein, 246 aa, Erwinia carotovora subsp. atroseptica SCRI1043
MNKTTELFTSHRSERSYLDKPIPDDVLDAIIQSAHLAPTSVNSQQVSLIVTRDPERKARIAELAGGQPWIAKAPVFITVVLDMHKTQLGIAMSGKQQHAHESLESLIAGTTDVGIALGTLMAAARSFGLGIVPIGGIRREPQELIDFLQLPELTFPVAGVAIGYVDTPAHQKPRLPLNSFRHDETYHQDVLPAAIEQYNHTLVTHWQQTGRADGDNWGDNTASYYQHIYFPKVLPAILQQGFKLDK

SEQ ID NO: 68898 - DNA, 720 bp, Erwinia carotovora subsp. atroseptica SCRI1043
  CDS (1)..(720)
atgataccaactattgatttgctacaacgccaccgttccattcgtgcgtttacgtctcaagctgtgacagatgagcaacgccacgccatcattgcctccgcacaaagcgcgtccagctccagctttttacaatgcagttcgattattcgtattaccgatcctgccgtacgtgaaacgctcgttcactataccggcgaacaagcctatgtggcacaggcggcagagttttgggtcttttgtgccgattttcaccggcatgtggagattttcccacaagcggaaactgggctggcggagcaattgctgattggttgtgtcgacaccgctatcatggcgcagaatgcgctggttgccgctgagtcgctggggttgggcggggtatttatcggcggcatccgcaatcggattgctgatgtgacgcagttactgcaattgccgacgctggtgataccgctgtttggcctgtgtctgggtcacccagacgccgaacctcaactgaaaccgcgtatgccaaccgccatgatgctgcatgaaaatgtctatcagccgctcgaccgcgatgtgttggcacaatacgatcagcaaatggtggagtattatctgcagcgtaccggtagccgccgtgaaagctggagtgagcatgttgaactgacgctgaaaaaagagttacgtccattcatgctggactacttacatcaacaaggatgggcgatacgctag

SEQ ID NO: 68899 - protein, 239 aa, Erwinia carotovora subsp. atroseptica SCRI1043
MIPTIDLLQRHRSIRAFTSQAVTDEQRHAIIASAQSASSSSFLQCSSIIRITDPAVRETLVHYTGEQAYVAQAAEFWVFCADFHRHVEIFPQAETGLAEQLLIGCVDTAIMAQNALVAAESLGLGGVFIGGIRNRIADVTQLLQLPTLVIPLFGLCLGHPDAEPQLKPRMPTAMMLHENVYQPLDRDVLAQYDQQMVEYYLQRTGSRRESWSEHVELTLKKELRPFMLDYLHQQGWAIR

SEQ ID NO: 68900 - DNA, 783 bp, Mannheimia succiniciproducens MBEL55E
  CDS (1)..(783): transl_table=11
gtgtttttcagcattattgcgattggtgtaatatatcaaacagcttatcaggaggtgattatgtcagagaagaattttatcgaaactctattatcccatcgttctattcgtcagtttaaatcacagcaaatagcgccggatattattgagcaattagtcgatgtggcacgttttgcgtccagttccaaccatttgcaatgtatttcaattgttcgggttatgcagccgcaactgcgtcatgaattaatgctttgtgcatcagggcaggcttatgttgaaagtgcggcggaattttgggtattttgtgcggattttaataaacacaaacaaatttgcccggaggcgcaattggattatacggaagtcatgttaatcggtgcggtggatgccggtattatggcgcaaaatgtgttggccgccgctgaaaacctcgggttaggcggtgtttatatcggttctatccgcaatcaaatcgaaaaagtcggcgagctgttgaatttgcctgaatatgtcgtgccgttgtttggaatgtgtttaggttatccggatcagaatccgccgttaaaaccccgtttaccgcaggaactgatgttttttgaaaatcaatatcggccgttggataaagagatgttgaatgattatgacaaagaagtggcggagtattataaaaaacgcagccaagcggatatggattggtctcgtaatgtggtgaaaaccttaggtaaacccgttcgtccgcaggtattgggttatttgcaaaaacagggttttgtgaaaaagtag

SEQ ID NO: 68901 - protein, 260 aa, Mannheimia succiniciproducens MBEL55E
MFFSIIAIGVIYQTAYQEVIMSEKNFIETLLSHRSIRQFKSQQIAPDIIEQLVDVARFASSSNHLQCISIVRVMQPQLRHELMLCASGQAYVESAAEFWVFCADFNKHKQICPEAQLDYTEVMLIGAVDAGIMAQNVLAAAENLGLGGVYIGSIRNQIEKVGELLNLPEYVVPLFGMCLGYPDQNPPLKPRLPQELMFFENQYRPLDKEMLNDYDKEVAEYYKKRSQADMDWSRNVVKTLGKPVRPQVLGYLQKQGFVKK

SEQ ID NO: 68902 - DNA, 738 bp, Bacillus licheniformis ATCC 14580
  CDS (1)..(738): transl_table=11
atgaatgaagtattgaaaacattgaaagaccatagatcaatccgcagctatacagatgagcccgtgagccctgaacagctggacgacattattcaagccgttcaagccgcgccgaattccattaacggccagcaggtcaccgtgattacggttcaggatgaggaacggaaaaagaaaattgccgaactggccggcggacaggtctggatcgagcaggcccctgttttccttttgttctgcgcggacttcaaccgtgcgaaaatcgcccttgagaaaaacggcgaaacgcttgcgatcacagacggaatggaatccgtgcttgtcggagctgtcgacgcaggcatcgccctcgggacggccacagcagccgctgaatcgatgggacttggcactgtgccgatcggcgcggtccgcggccgtgcagaagagttgatcaaactgctcaatattcctgaatacgtcttccctgtcgcaggacttgtcgtcggccatccggcggaccgctccgccaaaaagccgcgcctcccggaacaagcggtaaggcacagcgaaacgtatcaaccggatttaaaaccgctgatcgacgcgtacgatgaagaaatatccgaatacatgacaaaacggactaacggacaggaaacaagaaactggtctcagggcatatccgcttattacaataaagtgtactatcctcacatccgtgaaatgcttgagaaacaaggatttaaactcgaatag

SEQ ID NO: 68903 - protein, 245 aa, Bacillus licheniformis ATCC 14580
MNEVLKTLKDHRSIRSYTDEPVSPEQLDDIIQAVQAAPNSINGQQVTVITVQDEERKKKIAELAGGQVWIEQAPVFLLFCADFNRAKIALEKNGETLAITDGMESVLVGAVDAGIALGTATAAAESMGLGTVPIGAVRGRAEELIKLLNIPEYVFPVAGLVVGHPADRSAKKPRLPEQAVRHSETYQPDLKPLIDAYDEEISEYMTKRTNGQETRNWSQGISAYYNKVYYPHIREMLEKQGFKLE

SEQ ID NO: 68904 - DNA, 744 bp, Bacteroides fragilis YCH46
  CDS (1)..(744): transl_table=11
atgatggatacagttaagaacagaaggacaatccgcaaataccagcaaaaagatattacgccggatttgttaaatgatttgcttgaaacttcatttcgcgcttctacgatgggtggaatgcagctttatagtgtggttgtcacccgtgatgccgagaaaaaagaaatactttctccggctcattttaatcagccgatggtaaaggaggctccggttgtattgacattttgcgcggattttcgtcgtttttgcaaatattgtcaggaaaggaatgcggagccgggatatggtaatttaatgtcctttttgaatgccgctatggatactttattggttgcacagactttctgtacgcttgccgaggaagccggattgggtatttgctatttgggtactactacctataatcctcaaatgatcatcgatgctttgcacttgcccgagttggtgtttcccattactacagtgactgtgggatatccggcggaatctccgaaacaggtagaccgtctgccgatagagggcattatacatgaagagagctatcacgattataccgccgaagatataaaccggttatatgcttataaggaatctttgcctgagaacaagttatttatagaagagaatcagaaagagactctggcccaagtattcacggatgtccgctatacaaagaaggataatgaatttatgtctgagaatctgttgaaggtacttcgccggcagggctttatggattaa

SEQ ID NO: 68905 - protein, 247 aa, Bacteroides fragilis YCH46
MMDTVKNRRTIRKYQQKDITPDLLNDLLETSFRASTMGGMQLYSVVVTRDAEKKEILSPAHFNQPMVKEAPVVLTFCADFRRFCKYCQERNAEPGYGNLMSFLNAAMDTLLVAQTFCTLAEEAGLGICYLGTTTYNPQMIIDALHLPELVFPITTVTVGYPAESPKQVDRLPIEGIIHEESYHDYTAEDINRLYAYKESLPENKLFIEENQKETLAQVFTDVRYTKKDNEFMSENLLKVLRRQGFMD

SEQ ID NO: 68906 - DNA, 822 bp, Methylococcus capsulatus str. Bath
  CDS (1)..(822): transl_table=11
atgagctcgatcccaacgctactcgcttcacgttacggcaggcatgaacccgtgccggccatcgccgcgaacgctgtcctggaacacctgctttcccaccgatcggtccgcgcctacaccgccgagcccttggcgcctggcacgctggaagccctggtcgctgcggctcaatccgccgccagttcgtccaacctccagctctggagcgtggtcgcggtcgaagacggcgcgcggcgcgcccgcctcgccgagcttgccggcaaccagacccacatcgtccaggcgccgttgttcctggtctggctggccgaccatgcccgtctgcggcggatcgccgcccggcgcggcatcgccgccgagggactggactatctggagatgtacaccatggccttggtcgacgccgccctggcggcgcagaacgccgtggtcgccgcggaatcgctggggctgggcacggtctacatcggcgcgatgcgcaaccacccggaacgggtggcggcggaactcggcctgcctcggggggttttcgccgtcttcggcctgtgcgtcggccaccccgacccggccgccctccccgctatcaagccgcgtctgccccagaacgcggtgctgcaccgggaaacctatgccctggaaagccaggacgaggcggtggagcgttacaacgccacaatgtcggagttctatgccgaacagaacatggcggtcgggggtgactggtcgaaacactccgcctcgcgcatctccggtcccgccaagctgtccggccgcgaccggctcaaggcggctctgaacgccctcggcttcgaactgcgctga

SEQ ID NO: 68907 - protein, 273 aa, Methylococcus capsulatus str. Bath
MSSIPTLLASRYGRHEPVPAIAANAVLEHLLSHRSVRAYTAEPLAPGTLEALVAAAQSAASSSNLQLWSVVAVEDGARRARLAELAGNQTHIVQAPLFLVWLADHARLRRIAARRGIAAEGLDYLEMYTMALVDAALAAQNAVVAAESLGLGTVYIGAMRNHPERVAAELGLPRGVFAVFGLCVGHPDPAALPAIKPRLPQNAVLHRETYALESQDEAVERYNATMSEFYAEQNMAVGGDWSKHSASRISGPAKLSGRDRLKAALNALGFELR

SEQ ID NO: 68908 - DNA, 837 bp, Nocardia farcinica IFM 10152
  CDS (1)..(837): transl_table=11
atggccgccatgacgcagatcgccccctctccggccgagaccgtgcgcacccggtaccgggacgcgcaggtgcccgagcccgccgtgtggaacgccacactggcggtgctgcacgagcaccgttcggtgcgccgctacctgcccgacccggtgtccgacgacacgctgcggctgctgatctcggccgcgcagtcggcgccgacctcgtccaacctgcaggtgtggagtgtggtcgcggtccgcgaccccgatcgcaaggctcggctggcggccctggccggtgaccaggcgcacgtggtgcgggcgccgctgctgctggtgtggacggccgatttcgcgcggttgcgccagctcgccgccgaccacgacgccccgctggccggagccgactatctcgagtccagctacgtcggcttcatcgacgcggcattggcggcgcagaacgcggtggtggccgccgaatccctcggcctcggcacggtctacatcggggcgttgcgcaatcatccggaggcggtcgcgaccgaactccagctcccgccaggggttttcgcgaccttcggcctggtggtcggccatcccgacccggccgagcgcgcccaggtcaagccgcgcctgccacagcaggcggtactgcaccgggaaacctaccggctccccgagcagcgctcgcacgtcgccacctacgagcgccgcatcgccgagttctacggtgagcaggatctcgcgcactcctggaccgagcgggtgctggcccgtctcgcctccgcccgcagcctcgccggccgcgaccgcctccgcaccgccctgcacaaccagggcttccccctgcggtga

SEQ ID NO: 68909 - protein, 278 aa, Nocardia farcinica IFM 10152
MAAMTQIAPSPAETVRTRYRDAQVPEPAVWNATLAVLHEHRSVRRYLPDPVSDDTLRLLISAAQSAPTSSNLQVWSVVAVRDPDRKARLAALAGDQAHVVRAPLLLVWTADFARLRQLAADHDAPLAGADYLESSYVGFIDAALAAQNAVVAAESLGLGTVYIGALRNHPEAVATELQLPPGVFATFGLVVGHPDPAERAQVKPRLPQQAVLHRETYRLPEQRSHVATYERRIAEFYGEQDLAHSWTERVLARLASARSLAGRDRLRTALHNQGFPLR

SEQ ID NO: 68910 - DNA, 732 bp, Photobacterium profundum SS9
  CDS (1)..(732): transl_table=11
atgtccatgaatcaaacgatcgacactattctgcaacaccgttctattcgtcagtttaccgatcaagctattgatgcagaactactatcgtctctactcgattgtgcaatagcagcatcgacatcgagcttcatacaatgtgtcagtattattcgtgttactcaatctgatacgcgtcaaaaattagcacacttagcgggtggtcaaccttatgttgagactgcagcagagtttcttgttttttgtgcagattttaatcgccaccaacaaattcacccagaagcgcagttaggttttacagagcaaacgcttattggtgctgttgatgccgctcttatggctcaaaattgtttaatagctgcagaatctatggggttaggcggcgtgtatattggtggacttcgtaataacccagaagcagtggctgatgttttagcactgcctcagcatgtgattccactttttgggttatgcttgggttacccgtctcaaaatccggaaattaaaccgcgtttaccgcaatcgattatcgtgcatcaagagcagtatcaacaggtgcttaatcagcctgaattacaaaattacgatgaagaagtgcgtgaatattacagaacccgtactggtggaaataaagaaatgtcttggtcagaacaaattactgatgccttaaataaagaggctcgaccttttatgaaaggctttattaatagtaaaggctttagtacaaagtga

SEQ ID NO: 68911 - protein, 243 aa, Photobacterium profundum SS9
MSMNQTIDTILQHRSIRQFTDQAIDAELLSSLLDCAIAASTSSFIQCVSIIRVTQSDTRQKLAHLAGGQPYVETAAEFLVFCADFNRHQQIHPEAQLGFTEQTLIGAVDAALMAQNCLIAAESMGLGGVYIGGLRNNPEAVADVLALPQHVIPLFGLCLGYPSQNPEIKPRLPQSIIVHQEQYQQVLNQPELQNYDEEVREYYRTRTGGNKEMSWSEQITDALNKEARPFMKGFINSKGFSTK

SEQ ID NO: 68912 - DNA, 747 bp, Streptococcus thermophilus LMG 18311
  CDS (1)..(747): transl_table=11
atgaacgaaactattaagacacaactcaatcaccgcagtattcgtcagtttaaacctgtggctttggcacaagaagaggttaacctcctggttgatgttgccagacatgcaccaacaagtaattttagacaggcttattcgattatcagtattactgatgaaaaattgaaggaacaaattgcagaaattgccaaccaaccctatattcctaatgctgggcacctctttgtatttgttgtagaccaaagacgtaataccttgattgcagaagctaagggagccaaggctttggtacaaggtagtcctgaacgctttatttcagctttttcagatgctatgattgctgcgcaaaatatggtggtagctgctgagagtttaggtatgggaactgtttatttgggcagtattttaaatgataatgctaaactttcagagctcctcaaacttccaaagtatgtctatccagcagttggtttagcagttggttggccagaccaggaaccgcagcttaaacctcgtttgccacgtcatgtcatccatatggaaaattactataaagatttggaaaatcccttggcggagctaaaagactacgacgctgaagtccatgagtattatgatcttcgcgatctcaataacagagttgatgaatttacgactcaaattgccaagaccatggacaaatccgttgccaatcgtgctaacaccttgaaggatctacaaaagcagggatttttcatcgactaa

SEQ ID NO: 68913 - protein, 248 aa, Streptococcus thermophilus LMG 18311
MNETIKTQLNHRSIRQFKPVALAQEEVNLLVDVARHAPTSNFRQAYSIISITDEKLKEQIAEIANQPYIPNAGHLFVFVVDQRRNTLIAEAKGAKALVQGSPERFISAFSDAMIAAQNMVVAAESLGMGTVYLGSILNDNAKLSELLKLPKYVYPAVGLAVGWPDQEPQLKPRLPRHVIHMENYYKDLENPLAELKDYDAEVHEYYDLRDLNNRVDEFTTQIAKTMDKSVANRANTLKDLQKQGFFID

SEQ ID NO: 68914 - DNA, 921 bp, Thermus thermophilus HB8
  CDS (1)..(921): transl_table=11
gtggaactcctagacgtcctggcgagaaggcggagcgtacgccgcttcaagccccttccccttcccgaggaggacctggaaaagctcctcttcgccctccagcgggcccccaccgacgcgagcgcccagctctactcggcgatccgggtacgggatccaaggcttagggacgaggtggcccggctctccggggaccaggagcacatcaggcaggcggcggagttcttcctcttcctcgcagacgtccaccgcctggagcggctcctcgcccaccgggggcagaggatggccttctggcccaggaccgccctccacttcgccatcctggacgcggggatcgccgcctcgtacctcgccctcaccgccgaggccttaggctacggggtctgcttcatcggcggggtcttgaacggggtggagaccctcacggacctcctcgggcttcccccgggggtcctccccgtggtggggcttgccgttggggtgcccgacgaggagggccccccgaggcccaggcttccccggaggctcgtggtccacgaggaccgctaccgcccctacgccgcggaggacctggaggaggcctaccgggccatggccccctacagccgggtgggggactggaaccgggtccttaggcgctacttcgccgaggggggcacgatggaggccagggagaagccttacgggaaggtcctttcccggcaggggtttgacccggacctgcccaaaggggcccccttctactccctgggggccttgctggaggaggccttggcggaggcccggggggtgctcttccgcaagggggaggtctggctggaggaggaggcccgggccttccggggggaggggaggccgggggaggccctcctcatggcgttgcggaaggcgcggggggaggttccggactggccatga

SEQ ID NO: 68915 - protein, 306 aa, Thermus thermophilus HB8
MELLDVLARRRSVRRFKPLPLPEEDLEKLLFALQRAPTDASAQLYSAIRVRDPRLRDEVARLSGDQEHIRQAAEFFLFLADVHRLERLLAHRGQRMAFWPRTALHFAILDAGIAASYLALTAEALGYGVCFIGGVLNGVETLTDLLGLPPGVLPVVGLAVGVPDEEGPPRPRLPRRLVVHEDRYRPYAAEDLEEAYRAMAPYSRVGDWNRVLRRYFAEGGTMEAREKPYGKVLSRQGFDPDLPKGAPFYSLGALLEEALAEARGVLFRKGEVWLEEEARAFRGEGRPGEALLMALRKARGEVPDWP

SEQ ID NO: 68916 - DNA, 750 bp, Geobacillus kaustophilus HTA426
  CDS (1)..(750): transl_table=11
atgaaccaagtcatcgaaacgattctccagcaccgttcgatccgccggtttgaaaacaggccgctcacggatgaacaaatccgcacgatcgtcgaatgcgcccaggcggcatcgacttcaagctatgttcaagcgtactcgatcatcggggtgaaagatccggagaaaaaacggaagctcgccgagctggcgggaaatcaatcctatgtcgagcataacggccatttctttgtcttttgcgctgattttcaccgccatgagctcattggcgagctagaaggaaaagacgtgcttccatcgcttgagagtacggaaaagtttatggttgcgctgattgacacggcgcttgcggcgcaaaacgccgccattgccgcggagtcgatggggcttggcatctgctacattggcgggctgcgcaacaacctgccggaagtatgccaactgcttaacataccgaaacgggtcattccgctgttcgggcttgccgtcggctatcctgcgcaaacgccggatccaaagccgcggctgccgtttgaacacgtttatcatgaggacgaatacaaccaagaccgcgcccgattcctcgaacaattgcaacgctacaacgaaacggtttcggcgtattatgagcagcggacaaacggccgccgccgcgacacatggaccgggcagatggccgatacgctcagccgccaagtccggatgtacatgaaggagtttgtggaagggaaagggttcaatttacggtag

SEQ ID NO: 68917 - protein, 249 aa, Geobacillus kaustophilus HTA426
MNQVIETILQHRSIRRFENRPLTDEQIRTIVECAQAASTSSYVQAYSIIGVKDPEKKRKLAELAGNQSYVEHNGHFFVFCADFHRHELIGELEGKDVLPSLESTEKFMVALIDTALAAQNAAIAAESMGLGICYIGGLRNNLPEVCQLLNIPKRVIPLFGLAVGYPAQTPDPKPRLPFEHVYHEDEYNQDRARFLEQLQRYNETVSAYYEQRTNGRRRDTWTGQMADTLSRQVRMYMKEFVEGKGFNLR

SEQ ID NO: 68918 - DNA, 744 bp, Leuconostoc mesenteroides subsp. mesenteroides ATCC 8293
  CDS (1)..(744)
atgtctaacccaaccttagatgtgcttaatcaacatatgtccatacgttcctttacagatgaaatggtctctgatcaacaggtttcagaaattattcgtgcggcaactgctgggcctaatatgaataattaccaaccagtaacttttatagaaattacatcacaagatataaaagctgatattaccactaaggtaggcatgaaatatattgaaactgcggcaagatactttgttgtaacagttgactacaataaagatttaataggcttaaacaatgagcagcgccgccaggcagaagagaacatacagagctatgcattacttgaaggtggtattgtgagtgccggcattgctcttggacgggctcaagtcgctgctgaatcgctgggattaggtagtgtgaccatggctggtgcattaggggcctttgaaatttacgaagagcatctcaacttgccacgctatgtgaaagcagtgatgggcttttcaattggtcatccggcggataatcctggtattaagccaaaacttggtgaaagcggatttttgatgaaagatcgctataatcaagtacagctagaagagtcagtttccgcgtataataaagtgatggttgaatattatgcgaatcgaggtattgaacgttcttggacagaaaacaatgcccgaatgttaactcgtgaacgaaaaacaacaccattattgacgcagtatgctaaagataaaggatttaacctaaaataa

SEQ ID NO: 68919 - protein, 247 aa, Leuconostoc mesenteroides subsp. mesenteroides ATCC 8293
MSNPTLDVLNQHMSIRSFTDEMVSDQQVSEIIRAATAGPNMNNYQPVTFIEITSQDIKADITTKVGMKYIETAARYFVVTVDYNKDLIGLNNEQRRQAEENIQSYALLEGGIVSAGIALGRAQVAAESLGLGSVTMAGALGAFEIYEEHLNLPRYVKAVMGFSIGHPADNPGIKPKLGESGFLMKDRYNQVQLEESVSAYNKVMVEYYANRGIERSWTENNARMLTRERKTTPLLTQYAKDKGFNLK

SEQ ID NO: 68920 - DNA, 822 bp, Azotobacter vinelandii
  CDS (1)..(822)
atgtccgaagcccccaccgacctcctgcaacaacgctatggctcagaagccagtcccgccgtgatcgataatcctatcatcactgccctgctcgcccaccgcagcgtccgtgcctacctcgaccggccattgccggcaggaacactggagaccctgctggctgcagcccaatcggccgcgacctcctccaatctgcaggcgtggagcctgctggccgtcgccgatcccgaacgcaaggcccgcctggccgctctcgccggtaatcaagcgcatatcctccaagcgccgctgctgctggtctggctggcggacttctcccgcatccgtcgccaagcggacctacaaggcgcggagctggaagcggtggattacctggacagtttcctggtcgccagtctcgacgctgccctggccgcacagaacgccgcggtcgccgccgaatccttgggtctgggaaccgtttatatcggagccttgcgcaaccgactttccgaggtcattgaagaactgcgcctaccacctctggtgtatccggtcttcggcctctgcgttggctaccccgaccccgtccacccggcggccatcaagccgcgcttgccacaggaactggtgttgcaccgggaaacctacagggtatcgcccacggaagccggctcggtcgagggctacgaccgcatcctcgcggatttctacaggcaacagggcctccctagcgccaactggagcagccaggcgatagagcggctgaagaaagtggaaaccctgaatggccgggaacagatcggccaacgcctaagaaagcagcagttcgaactgctgtga

SEQ ID NO: 68921 - protein, 273 aa, Azotobacter vinelandii
MSEAPTDLLQQRYGSEASPAVIDNPIITALLAHRSVRAYLDRPLPAGTLETLLAAAQSAATSSNLQAWSLLAVADPERKARLAALAGNQAHILQAPLLLVWLADFSRIRRQADLQGAELEAVDYLDSFLVASLDAALAAQNAAVAAESLGLGTVYIGALRNRLSEVIEELRLPPLVYPVFGLCVGYPDPVHPAAIKPRLPQELVLHRETYRVSPTEAGSVEGYDRILADFYRQQGLPSANWSSQAIERLKKVETLNGREQIGQRLRKQQFELL

SEQ ID NO: 68922 - DNA, 879 bp, Nostoc punctiforme PCC 73102
  CDS (1)..(879)
atgcctttacagatggaattggtgttagtaataaaatatcggaaaatttgggagttgattatgactaatcctatagaactactgcgatcgcgctacggtgaaattcccttcaatcccgaagaatggaatgattctctgacggcactattatctcatcgttccatccggtcttatctatccgatcctttaccagagggaactctggagttgttaattgcagccgcccaatctgcatctacttcctctaatttacaaacctggagtgtggtagcagttgaagatccagaatgcaaagaagaattatctaaattagcgggaaaccaagcacatattaagcaggttcctttattcttggtttggttggcagacttggcacgtctaagttacgttgctgacagtcgcggcatatctcatgatgcgctggaatacttggaaatgtttgtgatggcaacaatcgatgcaactttggcggcgcaaaatgcagcagttgcagctgagtcactcggtttaggaacagtgtatatcggtggaatcaggaaccacccgcaagaggtagcagagatattgaatttgccctcctctgtgtatgctgtatttgggctgtgtgtaggctatccaaatcctgaagtagaagcagcgattaagccacgattgccacaatcagcagtgttgcaccgcgaaacttataaattgtcagagcaagaagaagcgatcgctcactacaacgacatcatcaaagaattctatactgaacaaaagatgaatgtccctggtgattggtcagaacactcagcccaaaggatcgcaactgttgagtcattgagaggacgcgatcgcttgcgggaagttctcaatcatcttggcttcaagctactgtaa

SEQ ID NO: 68923 - protein, 292 aa, Nostoc punctiforme PCC 73102
MPLQMELVLVIKYRKIWELIMTNPIELLRSRYGEIPFNPEEWNDSLTALLSHRSIRSYLSDPLPEGTLELLIAAAQSASTSSNLQTWSVVAVEDPECKEELSKLAGNQAHIKQVPLFLVWLADLARLSYVADSRGISHDALEYLEMFVMATIDATLAAQNAAVAAESLGLGTVYIGGIRNHPQEVAEILNLPSSVYAVFGLCVGYPNPEVEAAIKPRLPQSAVLHRETYKLSEQEEAIAHYNDIIKEFYTEQKMNVPGDWSEHSAQRIATVESLRGRDRLREVLNHLGFKLL

SEQ ID NO: 68924 - DNA, 765 bp, Bifidobacterium longum DJO10A
  CDS (1)..(765)
atggttaccaacgcaacaatcgaggctcttctgggccgccgctccatccgtaagttcaaggacgaggccatcgacgacgatacccgcgccacgctcgaaaccgtcgcccagcatgccgcgtccagccagttccttaacgactggtccgccatccgcatcaccgatccggccatcaaagccaagctcgccgagttcggccatcagccgtatattgccactgcgccgctgctgtacgtgttcgtcatcgacgagcaccgcaacgcgcgcatcgccgaacgcaagggcatcgatcccgcttccgacgaattccatctcaagtacagttatcgctttacccaagctcagaacgacgcagtgctggccctgcacgccatggagaccgccgcctattcgctgggactgggctacgtgattctcggctctctgctcaacaacatccccggccttatcgacgtgctgaatctgccggaatacacgtatccggtgctgggtctggccatcggcaagcctgatcagaacccgaccgtcaagccgcgcatgccgcgcacgatgcagttcttcgagaacacctacccggctgacgccgatggagtactcgaccagctgcccgccttcgacgaagaagttcaccggtactacgatctgcgccaagccgaccgtccggtggacgccttcagcgatcaggtcgtcacaatcagtcggcaggatgtcagccatcagacgctgctcgacaaggccgccgctcagggcttccgtctggattag

SEQ ID NO: 68925 - protein, 254 aa, Bifidobacterium longum DJO10A
MVTNATIEALLGRRSIRKFKDEAIDDDTRATLETVAQHAASSQFLNDWSAIRITDPAIKAKLAEFGHQPYIATAPLLYVFVIDEHRNARIAERKGIDPASDEFHLKYSYRFTQAQNDAVLALHAMETAAYSLGLGYVILGSLLNNIPGLIDVLNLPEYTYPVLGLAIGKPDQNPTVKPRMPRTMQFFENTYPADADGVLDQLPAFDEEVHRYYDLRQADRPVDAFSDQVVTISRQDVSHQTLLDKAAAQGFRLD

SEQ ID NO: 68926 - DNA, 759 bp, Pseudomonas syringae pv. syringae B728a
  CDS (1)..(759)
atgccctggaacgagacgatcgatcagttgctcgaccatcgcagcgtccgtgctttcattgatcagccactgcctgacggcaccatcgagaccctggtcgccgcggcgcagtccgcctccacctcttcaaacctgcagttctggagcgttgtcgctgttcaggacagcgatcggaaagcgcgcctctcggcactggcaggaaaccaggcctacatcgggcaggcgcctctgttctttgtatggcttgccgacctgtctagggtcacccgcgttgctgagcagcagggtgtagagctcgaagcagtgccttacttggagagcctgttgctcggtacgattgacgccgccttagccgctcagaacgccgtggttgctctggagtctctgggacttgggagcgtgtacatcggcgccatccgaaacgacattgaaggcgtggccaaggagcttggtctgcctccgcaggtctatccagttttcggtctctgcgtaggatatccatctaccgagcgaccagctcaggtaaaaccacggctcccccaaggtgcagtgcttcaccgcgagacctactcggtagcggcagatgtggaagcggtggctgtatacgatgagcgcctgggcgccttctaccagcgtgagggcatgacggcttccggctggtcggagcaagtggtcaatcggcttcgcagtgtctcgagcctgcatgggcgagaggagctggttgaggagctgaagcggatggggtttgggctgcgctga

SEQ ID NO: 68927 - protein, 252 aa, Pseudomonas syringae pv. syringae B728a
MPWNETIDQLLDHRSVRAFIDQPLPDGTIETLVAAAQSASTSSNLQFWSVVAVQDSDRKARLSALAGNQAYIGQAPLFFVWLADLSRVTRVAEQQGVELEAVPYLESLLLGTIDAALAAQNAVVALESLGLGSVYIGAIRNDIEGVAKELGLPPQVYPVFGLCVGYPSTERPAQVKPRLPQGAVLHRETYSVAADVEAVAVYDERLGAFYQREGMTASGWSEQVVNRLRSVSSLHGREELVEELKRMGFGLR

SEQ ID NO: 68928 - DNA, 750 bp, Actinobacillus pleuropneumoniae serovar 1 str. 4074
  CDS (1)..(750)
atgtcggacgtttattttatcggaggcaatatgatgagcaaaccaaccttagaaacgatactttcgcatcgttctattcgtaaatttaccgaacaacctatctcggaagatctattccaaaccttaatccaagccgggcaacaagcctcaacctccaatcatttgcaatgcgtgagcgtgattcgtgtcaaagatcaaaccatacgccaagcattgcgtgaggtatcgggtatggcatatgttaccgaatgtgcggagttcctagttttttgcattgattttcataaacataagcagcttgtgccggattcgcaattggattgggcggaagtcagcgtaatcggtgcggtggataccggaatttttgcccaaaatgttttgctggctgcggaatcggtcggcttaggcggagtatatatcggggcattacgtaatgatgtggcgaaagtggcggaagtattagggttaccgcaatattgtgtgccgttagtaggaatgtgtttgggttatccggcacaggatcccgcactaaaaccgcgtttgcctataagtttggtctgttacgaagatcaatatcagccgttggatcaaacggaacttacaaaatataacgaaattttgaccgcttattatcaggcgagaaccggtgaaggacagcagtggcaagcggcgattgacaaaaccttaaataaagcggtgcgtccgcatatgttaccgtttttccaacaacaaggattgttgaagcgatga

SEQ ID NO: 68929 - protein, 249 aa, Actinobacillus pleuropneumoniae serovar 1 str. 4074
MSDVYFIGGNMMSKPTLETILSHRSIRKFTEQPISEDLFQTLIQAGQQASTSNHLQCVSVIRVKDQTIRQALREVSGMAYVTECAEFLVFCIDFHKHKQLVPDSQLDWAEVSVIGAVDTGIFAQNVLLAAESVGLGGVYIGALRNDVAKVAEVLGLPQYCVPLVGMCLGYPAQDPALKPRLPISLVCYEDQYQPLDQTELTKYNEILTAYYQARTGEGQQWQAAIDKTLNKAVRPHMLPFFQQQGLLKR

SEQ ID NO: 68930 - DNA, 822 bp, Anabaena variabilis ATCC 29413
  CDS (1)..(822)
atgactaatcctgtggaagttttgcgatcgcgctacggtgaaattccttttgattacaatattccctggaatgactctatcggaacaatattatctcaccgttcagtccggtcttatttacctgatcctttaccaccaggaattatcgagttattagtagctgcggctcaatctgcgcctacttccgcaaacttgcaaagctggagtgtggtagcggttgaagacgaagaacgcaaacaagaactatatcgtttttccaataatcaagcccatgtcaaacaagctccggtattcttagtatggttagccgatttaggtcgtttggctcaaattgctgatagtcgtggactagctcatgttgcgttggaatacactgaacttttggtaaaagccatagttgatgcttccgtagcagcgcaaaatgtgactgtagttgctgaatccttgggtttaggaacagtatacataggtgcaattcgcaaccatacccaagaagtcgccaccttattgaacttaccgcctttcgtcttccccgtatttggacagtgtttaggctttcctaatcctgaagtccaaccagcagtaaaaccacgtttaccccagcaggctatattgcatcgagagacttataaattagcagaacaagaagatgcgatcgctcgttacaacgatattatgaaacagttctacaccgaacaaaacatgaacgtcgccggtgattggtcagaacattccgccgagagaatcgccactctagattatctcaaaggttgcaagaatttgcgtgagactctcaataacttcggcttcaagttattgtaa

SEQ ID NO: 68931 - protein, 273 aa, Anabaena variabilis ATCC 29413
MTNPVEVLRSRYGEIPFDYNIPWNDSIGTILSHRSVRSYLPDPLPPGIIELLVAAAQSAPTSANLQSWSVVAVEDEERKQELYRFSNNQAHVKQAPVFLVWLADLGRLAQIADSRGLAHVALEYTELLVKAIVDASVAAQNVTVVAESLGLGTVYIGAIRNHTQEVATLLNLPPFVFPVFGQCLGFPNPEVQPAVKPRLPQQAILHRETYKLAEQEDAIARYNDIMKQFYTEQNMNVAGDWSEHSAERIATLDYLKGCKNLRETLNNFGFKLL

SEQ ID NO: 68932 - DNA, 822 bp, Anabaena variabilis ATCC 29413
  CDS (1)..(822)
atgaccaatcctactgagttattacatcgtcgttacggcgtagacgcattcaatgcagatatttcttggaacgagacattatcaactttactgtctcaccgttcgattcgttcttaccttagtgattccctaccatcaaacactctagaaactttggtagcagcagcccaatctgcatcgacttcctcaaatctccagacatggagtgtagttgctgtccaagatgcacaacgtaaggagaagttatcgcagttagcgaataaccaagcgcatattcgccagtgtcctttatttctggtgtggttagcagatttggcaagactaacatacgttgctgagagtcaaggattatcccatgatgctttagattatctagaaatgtttctgatggcggctatagatgcgacattggcggcacaaaatgccgttgttgctgccgaatctctgggtttgggaacagtttatataggtgcattgcgtaaccgtccagaagaagtggcagaggttttaaatttaccgcctcatgtctttgcagtttttgggttgtgcgtcggttacgcagattcatctgtaaatgtggaagttaaaccgcgtttacctcaagcagcagtattgcatcgggagacttatcaattggagaaacaagaccaggaaattgctctttacaaccaaatcatgaaagcattctacaattcccaacagatgaatgttgctggtgattggtcggaacactcagctaaacgagtagcgtttgctgaatctttatcaggacgcgatcgcttgcaggaagctttgaaaaatttaggttttaagttgcgctaa

SEQ ID NO: 68933 - protein, 273 aa, Anabaena variabilis ATCC 29413
MTNPTELLHRRYGVDAFNADISWNETLSTLLSHRSIRSYLSDSLPSNTLETLVAAAQSASTSSNLQTWSVVAVQDAQRKEKLSQLANNQAHIRQCPLFLVWLADLARLTYVAESQGLSHDALDYLEMFLMAAIDATLAAQNAVVAAESLGLGTVYIGALRNRPEEVAEVLNLPPHVFAVFGLCVGYADSSVNVEVKPRLPQAAVLHRETYQLEKQDQEIALYNQIMKAFYNSQQMNVAGDWSEHSAKRVAFAESLSGRDRLQEALKNLGFKLR

SEQ ID NO: 68934 - DNA, 747 bp, Exiguobacterium sp. 255-15
  CDS (1)..(747)
atgaatgaaacaatcgaacatttacttaaccaccggtctatccgtaaattcaagcctcatcaattagatcaagagacagtcgaaacgctcgtccgttcggcccagtctgcctctacgtcttcttatcagcaggcctatgccatcatcggcgtggaggacgaagcactgaaacgacaattggtcgatgtagcgagcggtcaatcttacgtcgctgagaacagttactttttcgttttttgtatcgattatcataaacacatcctggcagcgaaaatcgcatccggttccgtggaccggacggtcgaaacgacggaagccttgattgtcggtgcggtcgatgccggtttagccgcccaaaatctagtcattgcagcggaatcgttaggatacggcaccgtctatatcggttcattacgaaatgacgctgccaaagtgagtgaactgttgggcttgccggatcatgtcgttccgttatttggagtcgcagtcggtattcccgaccaacagccggggaaaaaaccccgccttccgatggatgcggtcttccaccggaatacgtatactaatgacgacacgatgcgtgaattgttgtcgcaatatgaagaagaaacgtctacgtattatggagaacgaacagatggacgccggacggaaggatgggtctatcagatggctgcttcgatgagggagccgaaacggacatatatgcatgactttttacaggaaaaacacttagcccgagattga

SEQ ID NO: 68935 - protein, 248 aa, Exiguobacterium sp. 255-15
MNETIEHLLNHRSIRKFKPHQLDQETVETLVRSAQSASTSSYQQAYAIIGVEDEALKRQLVDVASGQSYVAENSYFFVFCIDYHKHILAAKIASGSVDRTVETTEALIVGAVDAGLAAQNLVIAAESLGYGTVYIGSLRNDAAKVSELLGLPDHVVPLFGVAVGIPDQQPGKKPRLPMDAVFHRNTYTNDDTMRELLSQYEEETSTYYGERTDGRRTEGWVYQMAASMREPKRTYMHDFLQEKHLARD

SEQ ID NO: 68936 - DNA, 732 bp, Listeria monocytogenes str. 1/2a F6854
  CDS (1)..(732): transl_table=11
atgaatgacgtattaactttgctaagaaatcatcgctcttttcgtaaatataaaaaaggggtcgagattccggaagaaaaactagatgcgattatccgagcagctcaagcggccccgtcgtggattaacggtcaacactattccattattgcgattaaagaccaagaacgtaaaaataaaatggccgaactttgcggaaatcaaccttacatagcagaatgttctgtttttctttgtttcgtggcagattttcaccgcgtaaaagtagcgagtgacatgcatggtaaaagtttccaaattgctggggaagaagatttactgatggttgcggcaacagacatcgggctttgtatgcaaaatgctttaactgctgctgaatcgcttggttacgggacgatttgtattggaggcttgcgacgaaatattgcggcaacagctgaatttctgaatttaccagaatttgtcatgcccgttgtcggactttgtattggtgttccggatgtcgaagcgcctgtaaaacctcgtttgccaaaagaagcagtttattttgaagagacgtaccaaacagatgtcatgcctttactagaagcatatgaccaagagattattccgttttcagagcgagaaggctttgtttcttataccgaacggttagccaaattttatgacagaccttattacccaaatttaaccgaacaaataaaagaaagaggttttttaggcgggaaataa

SEQ ID NO: 68937 - protein, 243 aa, Listeria monocytogenes str. 1/2a F6854
MNDVLTLLRNHRSFRKYKKGVEIPEEKLDAIIRAAQAAPSWINGQHYSIIAIKDQERKNKMAELCGNQPYIAECSVFLCFVADFHRVKVASDMHGKSFQIAGEEDLLMVAATDIGLCMQNALTAAESLGYGTICIGGLRRNIAATAEFLNLPEFVMPVVGLCIGVPDVEAPVKPRLPKEAVYFEETYQTDVMPLLEAYDQEIIPFSEREGFVSYTERLAKFYDRPYYPNLTEQIKERGFLGGK

SEQ ID NO: 68938 - DNA, 735 bp, Bacillus cereus G9241
  CDS (1)..(735): transl_table=11
atgaatgagatgatacataaaatggagcaacacgtttcagttcgtaaatataaagaagaatctattccgaaaggtgtagtagaaagaatggtgcaagctgcgcagcatgctgcttcctcgcattttgtacaggcttattctgttatatatgtaacagatcaagacctaaaggttaaactagcagagctatccggaaatcgtcacgtgaaagactgtgcagcattctttgtttgttgtgcggatttaaaacgacttgaaatggcatgtgaaaaacatggtaccgagataaagcatgaaggagtagaagattttatcgttgcgacagtagatgcttcactttttgcgcaaaacttagcgctagcagcagaatcgttaggatacggtatttgttacattggtggtattcgtaataacccaagagaagtgagtgaattgcttcatttaccagataaagtatatcctgtattcggaatgacagtcggtgtaccagatgaagatcatggagtgaaaccacgtttaccagtaacagctatccttcatgaaaatggatatgatgaaaagaaatatgatgaattattaaacgaatacgacgaaacgatgagcgcgtattataaagaaagatcatcaaatcaaaaaaacgtaacatggacggaatcaatgagttcatttatgtctaaagaaaaaagaatgcatatgaaagagtttttaagtgaaaaaggatttaataagaagtga

SEQ ID NO: 68939 - protein, 244 aa, Bacillus cereus G9241
MNEMIHKMEQHVSVRKYKEESIPKGVVERMVQAAQHAASSHFVQAYSVIYVTDQDLKVKLAELSGNRHVKDCAAFFVCCADLKRLEMACEKHGTEIKHEGVEDFIVATVDASLFAQNLALAAESLGYGICYIGGIRNNPREVSELLHLPDKVYPVFGMTVGVPDEDHGVKPRLPVTAILHENGYDEKKYDELLNEYDETMSAYYKERSSNQKNVTWTESMSSFMSKEKRMHMKEFLSEKGFNKK

SEQ ID NO: 68940 - DNA, 738 bp, Oenococcus oeni PSU-1
  CDS (1)..(738)
atgaatgaccttttaaaagtgattcacaaccgtgcttcgattcgtaaatttaccggtgaacatattccggaatccgatatggaacagattatgtcggcagcgcagtcagtgccgagtattaataattatcagccagtgacctatgttgaaattacggatcaatcagtcaaagatcaggccgccgatttggttaatatgccctatgtcgccagttcggatcgtttttttgtgattcttgccgattatcataaattgctggttggttttgaaggaaaagaacgcgaaatagcccaaactaatttaagtgcctataacatagccgaaggggcagctttgtctgccggcgtttcggcctatgcggctatcatagcagccgaatctttaggctacggtggtgttacaatggccggaccggttagagcctttcaaatttatgaaaactatttggatttaccagaaatgactaaagttgttttcacattggccttgggagttcctgacggacacccgggagttaaaccaaaactgcctttgtcaactttttggcaaaaagattcttatgatacgaatgtaatcgatcaagggattgctgattataacaaaacgatgcgtagttattacgagagcagaaatatcgatgagaattggacggaacataacaaaaaagctttaacgaaggctaaggatacgactgctttgaccgaatatgccaagagaaaaggtttcaatctaaaataa

SEQ ID NO: 68941 - protein, 245 aa, Oenococcus oeni PSU-1
MNDLLKVIHNRASIRKFTGEHIPESDMEQIMSAAQSVPSINNYQPVTYVEITDQSVKDQAADLVNMPYVASSDRFFVILADYHKLLVGFEGKEREIAQTNLSAYNIAEGAALSAGVSAYAAIIAAESLGYGGVTMAGPVRAFQIYENYLDLPEMTKVVFTLALGVPDGHPGVKPKLPLSTFWQKDSYDTNVIDQGIADYNKTMRSYYESRNIDENWTEHNKKALTKAKDTTALTEYAKRKGFNLK

SEQ ID NO: 68942 - DNA, 738 bp, Pediococcus pentosaceus ATCC 25745
  CDS (1)..(738)
atgcgagatacaattattttaatgcaacatcatacatccgtgcgtaactttatgccggaaccacttcctgaaagtgtaaaaaatcaattagtttcggccgctcaaagtggttcatcttcgaactttattcaagcaacttctattattgaagtgactgatcttaaaactcgtgaaaaaatcgccaaaatttccaatagtgatgcatacgtaaaacaaagtggggccttttttgtttttatagcagatttatatcgacaagctaatatcctaaagcaagcccaattaccattagacgggattcaaaatatggaatctcttctagtaggagttgttgatacggccattgcaggtgagaacatggcgattgctgctgagtccctagacttaggaatctgttttattggtggaatccgaaatgaaatggatagcattaaggaactacttggtttacctaaatatacagtgtcactttttggaatgactgtgggtattccagttcaaaaaaatgaaattaagccacgtctacctaaaaagaatatttcttttaaaaaccgatatgaaccatcggttgcagtaaatctggatagttataatcaacaaactcgtgtgtattatgctaatcgttcaactgctccccaaaatacggattggtctcataaaatgcttcatttttttgccgaacccaaaagaccagcagttgctgaatttcttaaaaaacaaggattttcactggaataa

SEQ ID NO: 68943 - protein, 245 aa, Pediococcus pentosaceus ATCC 25745
MRDTIILMQHHTSVRNFMPEPLPESVKNQLVSAAQSGSSSNFIQATSIIEVTDLKTREKIAKISNSDAYVKQSGAFFVFIADLYRQANILKQAQLPLDGIQNMESLLVGVVDTAIAGENMAIAAESLDLGICFIGGIRNEMDSIKELLGLPKYTVSLFGMTVGIPVQKNEIKPRLPKKNISFKNRYEPSVAVNLDSYNQQTRVYYANRSTAPQNTDWSHKMLHFFAEPKRPAVAEFLKKQGFSLE

SEQ ID NO: 68944 - DNA, 714 bp, Streptococcus suis 89/1591
  CDS (1)..(714)
atgaatgaaaccatagacttgatgctgaatcatacttccgtccgtcgttttacggaggagcctattgaggcggaacatttgcaagctattatttcagctgggcgagctgcgtctagctggaagaatttccagtcttattccatcattgtggtgcagttggaggagaaaaaacaggcactctatgatttggtgccccagccagctattttacaggctcaggccattctggtttttgtgggcgaccataatcgtgccagcaaggcggctcaactccatggttcagactttgatgccaaaggaacagagaatcccctgatttcttcagttgatgcgagcctagcagggcaaaatgcccttttagcagctgaaagcctaggttacggtggcgtctttatcggtatgattcgccataaggccatggcaatagcagagctgttcaacttgccagattatacctatccaattttctgtattgccttgggtcgaccagcccaaaaccatcctgttaaaccacgtttggcaagtgaaaccattgtctttcaggaagaatatgtggagcaaggcgtggaagtaatccaagcctacgaccaagttcagacagcctatgcaggtgcccgtcagacagaaacttggtctgagcgaatggttgcccagtttggtcaggctgaacaaccagaaacaaagtctatcttagaaaagaataaattattgtaa

SEQ ID NO: 68945 - protein, 237 aa, Streptococcus suis 89/1591
MNETIDLMLNHTSVRRFTEEPIEAEHLQAIISAGRAASSWKNFQSYSIIVVQLEEKKQALYDLVPQPAILQAQAILVFVGDHNRASKAAQLHGSDFDAKGTENPLISSVDASLAGQNALLAAESLGYGGVFIGMIRHKAMAIAELFNLPDYTYPIFCIALGRPAQNHPVKPRLASETIVFQEEYVEQGVEVIQAYDQVQTAYAGARQTETWSERMVAQFGQAEQPETKSILEKNKLL

SEQ ID NO: 68946 - DNA, 765 bp, Lactobacillus crispatus
  CDS (1)..(765): transl_table=11
atgaaaatgatacataacgaaacaatcgacacgcaattaaatcaccgttctattagaaaatttaaggatcaaactttgactaaagaacaactggaaactttgtattctgtctttggtcaaactccaaccagcatgtttatgcaaaatgctagcttactgcacgttaccgatcctgaagaaaagaagaaaattcaaaagttatgtaaccaaaaatatgttggtgcagaaggcgatttgtttatttttatcgttgacttgtaccgtaaccaacaaattagaaagcaacttgacaaagacgacggccgtgttcacacaactgatatctttttccaagcaatagaagatacgctgcttgcttttcaaaatgtcgctaatgcggtagaaagtatgggcttaggctatgtgccacttggtacggttaacgatcatccgttggatttgcttaagacgcttgatttgcctgagttgacttttccagtgttgaggatgcaagtcggtatgccagatcaaaagccacaattaaaaccacgattaccacttaagttcacttgttttgaaggtagttataagaaagactttgatgtgaaagaccttaaagactatgatgatatagttacgacatattatgacttacgtgattctaaccgtcgcattgattcattcactaagcagattacaggtaaaaaacttgatctgcatgaaactgatcgtgatcaattgccagaagaattgcacaagcaaggattgtgcttagattggaaataa

SEQ ID NO: 68947 - protein, 254 aa, Lactobacillus crispatus
MKMIHNETIDTQLNHRSIRKFKDQTLTKEQLETLYSVFGQTPTSMFMQNASLLHVTDPEEKKKIQKLCNQKYVGAEGDLFIFIVDLYRNQQIRKQLDKDDGRVHTTDIFFQAIEDTLLAFQNVANAVESMGLGYVPLGTVNDHPLDLLKTLDLPELTFPVLRMQVGMPDQKPQLKPRLPLKFTCFEGSYKKDFDVKDLKDYDDIVTTYYDLRDSNRRIDSFTKQITGKKLDLHETDRDQLPEELHKQGLCLDWK

SEQ ID NO: 68948 - DNA, 711 bp, Agrobacterium sp
  CDS (1)..(711): transl_table=11
atgacaagccacacttcgacaagtgccgctgcacacgacgactgcagcgttgcaagcgccttcgaccggcgctacggcgccccgactttcaatcaaataccgtccgccgacgaactggtgtcggattgcatcgcactgatgttgaagcaccgctcggtcaggcgctacacgcaggatcccctccccgcaggcacgctggaaatcctgatggcagcgggtcagtccgccgcaacatcgtcaaacatgcagaccgtttccgttatcgcggtgacggatcccgagatgaaggcccgtttggcgcgaacatgcgcggggcaagacttcatcgcgaacgccccgttgcttttgtgtttcgtcacggaccttgctcgccccgcccggatcgccaccaccatcggcgccgaccttttcgcgcttccgatgatcgataccttcctggcatcgatcagcgattgctccatcttcgcgcaaaacgtggttctggccgcggaatcccttggcatgggcacatgctatgtcgggagtttgcgcaatcgggccgatcttgtctcaaaggaactgaacgttccgagcggctccgcagtgctcttcggtctttgcatcggctacgaacacccggagcgcatcacgaacgttcggccgaggttcccccagaaaggggtcagaacaagagcagtccgaaatcgtacgctaaggccgaacggagcgtga

SEQ ID NO: 68949 - protein, 236 aa, Agrobacterium sp
MTSHTSTSAAAHDDCSVASAFDRRYGAPTFNQIPSADELVSDCIALMLKHRSVRRYTQDPLPAGTLEILMAAGQSAATSSNMQTVSVIAVTDPEMKARLARTCAGQDFIANAPLLLCFVTDLARPARIATTIGADLFALPMIDTFLASISDCSIFAQNVVLAAESLGMGTCYVGSLRNRADLVSKELNVPSGSAVLFGLCIGYEHPERITNVRPRFPQKGVRTRAVRNRTLRPNGA

SEQ ID NO: 68950 - DNA, 732 bp, Pseudomonas sp
  CDS (1)..(732): transl_table=11
atggtaaaagaattattacgtaaccactcttcagttcgtatttatgatggaaatccgatttcaaaggaaattattgaagaattaattgctactgctcaaatggcggctacatcacattttgtacaagcttatagtgttatttgggtaactgatgaggagaaaaaagaaaaattagggatgctctctggtaatccccgtcaatatgaaacttctggcggcgcctttgtcttctgtgtagatttcaaacgtcttcaatcagcaggcaaattagaaggtgtagacattgtcgctgattccgcagaaaatgtacttgttggagtagctgatgtatcattattcgcgcaaaactttgtggttgctgcagaatctatgggatatggaatttgttacatcggaggagtgcgtaataagcctgaagaaataagcgaactatttaatctacctgaatacgttttccctctattcggcttaacaattggggttcccgcacgtcgtaatgaagtaaaacctcgtttacctgttgccgcggtattacatgaaaatgaatacaatacagaaaaatatgaggaacttttaccagcttataacgacacaatggaagcatactataataatcgctcatccaatcgaaaaattgataactggacaaagcaaatggcagattttttaattgaacaacgccgtccccatatcaaagatttcttagcgaaaaagggttttaattggaaataa

SEQ ID NO: 68951 - protein, 243 aa, Pseudomonas sp
MVKELLRNHSSVRIYDGNPISKEIIEELIATAQMAATSHFVQAYSVIWVTDEEKKEKLGMLSGNPRQYETSGGAFVFCVDFKRLQSAGKLEGVDIVADSAENVLVGVADVSLFAQNFVVAAESMGYGICYIGGVRNKPEEISELFNLPEYVFPLFGLTIGVPARRNEVKPRLPVAAVLHENEYNTEKYEELLPAYNDTMEAYYNNRSSNRKIDNWTKQMADFLIEQRRPHIKDFLAKKGFNWK

SEQ ID NO: 68952 - DNA, 750 bp, Bacillus subtilis
  CDS (1)..(750): transl_table=11
atgaataacacaatcgaaaccattttgaatcatcggtcaatccggtcttttactgatcagcttttgacagctgaagaaattgatacattagtgaaaagtgcgcaggctgcgtctacatccagctatgtgcaggcatattcgattatcggggtttctgatcctgagaaaaaacgtgagctgtccgtgcttgctgggaatcagccttacgttgagaagaacggacacttttttgtattttgtgcggatttgtaccgccatcaacaactggctgaggaaaaaggtgaacatatttctgagctgctcgagaatacagaaatgtttatggttagcttgattgatgcggcgctggcagcgcaaaatatgagcattgccgctgaatccatggggcttggcatttgctatatcggcggcattcggaatgaattggacaaggtgacagaggtgctgcaaacgcctgaccatgtgctcccgcttttcggactggcagtaggccatcctgcgaacctttccggcaaaaaaccgagattgccaaagcaggccgtttatcatgaaaatacgtataatgtgaacacagacgatttccgtcatactatgaatacgtatgacaaaaccatttctgattactatagagaaagaacaaacgggaagcgggaagaaacgtggtccgatcaaatactgaactttatgaagcaaaagccgcgtacgtatttaaatgactacgtgaaagaaaagggctttaataaaaactaa

SEQ ID NO: 68953 - protein, 249 aa, Bacillus subtilis
MNNTIETILNHRSIRSFTDQLLTAEEIDTLVKSAQAASTSSYVQAYSIIGVSDPEKKRELSVLAGNQPYVEKNGHFFVFCADLYRHQQLAEEKGEHISELLENTEMFMVSLIDAALAAQNMSIAAESMGLGICYIGGIRNELDKVTEVLQTPDHVLPLFGLAVGHPANLSGKKPRLPKQAVYHENTYNVNTDDFRHTMNTYDKTISDYYRERTNGKREETWSDQILNFMKQKPRTYLNDYVKEKGFNKN

SEQ ID NO: 68954 - DNA, 723 bp, Salmonella typhimurium
  CDS (1)..(723): transl_table=11
atgagtccgaccattgaacttctttgtggccatcgttctattcgccatttcaccgatgaacccgtgactgacgcgcagcgagaggccattattgccgccgcgcgcagcacgtccagttccagttttttacagtgcagctctattatccgtattaccgatcgggcgctgcgtgaggcgttagtgcccctgacgggcgggcaaaagcatgtggcgcaggccgctgagttctgggtattttgcgccgattttaatcgtcatttgcagatctgtcctgacgcgcagctggggcttgccgaacaactgttgctcggtgtcgtcgatacggcgatgatggggcaaaacgcgctgacggcggcggaatcactggggttaggcggcgtgtatatcggcggcatccgtaacaatattgagtctgttaccgaactattaaaattgccgaagcatgtattgccgctctttggcctgtgtttgggatggcctgcggataatccggatctgaaaccgcgcctgcctgccgagcttgtggttcatgagaaccagtatcaaccgcttgatgaaaagctgctggcgcgctatgacgagcagttggctgagtattatctgacccgcggcagtaatacgcgacgcgatacctggagcgatcatatccgtcgcaccctgattaaagaaaatcgcccatttatccttgaatatttgcataaacagggctgggcgacgcgctaa

SEQ ID NO: 68955 - protein, 240 aa, Salmonella typhimurium
MSPTIELLCGHRSIRHFTDEPVTDAQREAIIAAARSTSSSSFLQCSSIIRITDRALREALVPLTGGQKHVAQAAEFWVFCADFNRHLQICPDAQLGLAEQLLLGVVDTAMMGQNALTAAESLGLGGVYIGGIRNNIESVTELLKLPKHVLPLFGLCLGWPADNPDLKPRLPAELVVHENQYQPLDEKLLARYDEQLAEYYLTRGSNTRRDTWSDHIRRTLIKENRPFILEYLHKQGWATR

SEQ ID NO: 68956 - DNA, 750 bp, Bacillus subtilis
  CDS (1)..(750): transl_table=11
atgaatgaagtgattaaatctttaacagaccaccgctcgattcgcagctacacagatgagcctgtagctcaggagcaattggaccaaatcattgaagcggtgcaatcagccccttcttctatcaacggacagcaagtgactgtgatcacagtccaggataaagagcgcaaaaagaaaatctccgagctggcaggcggccagccatggatcgatcaagctcctgttttcctgctgttctgcgcagattttaaccgggccaaaattgcgcttgaagatctgcatgatttcaaaatggaaatcacaaatggattggaatctgttcttgtcggcgcagtagacgctggtattgccctcggcacagcaacagcagcggctgagtcactcggacttggcacagttccgatcggtgcagttcgcggaaaccctcaagagctgatcgaactgcttgagcttccgaaatacgtgttccctttatccggccttgtcattgggcatcctgccgaccgttcagcgaaaaaaccgcgcttgccgcaggaagctgtcaatcatcaggaaacttatttgaatcaggatgagctgacgtctcacattcaggcatacgacgaacagatgtctgaatacatgaataaacggacaaacggaaaagaaacaagaaactggtcacagagcatcgcttcctactatgagcgcctgtactatccgcacatccgtgaaatgcttgaaaaacaaggatttaaagttgaaaaataa

SEQ ID NO: 68957 - protein, 249 aa, Bacillus subtilis
MNEVIKSLTDHRSIRSYTDEPVAQEQLDQIIEAVQSAPSSINGQQVTVITVQDKERKKKISELAGGQPWIDQAPVFLLFCADFNRAKIALEDLHDFKMEITNGLESVLVGAVDAGIALGTATAAAESLGLGTVPIGAVRGNPQELIELLELPKYVFPLSGLVIGHPADRSAKKPRLPQEAVNHQETYLNQDELTSHIQAYDEQMSEYMNKRTNGKETRNWSQSIASYYERLYYPHIREMLEKQGFKVEK

SEQ ID NO: 68958 - DNA, 25 bp, Primer
atgacgccaaccattgaacttattt

SEQ ID NO: 68959 - DNA, 21 bp, Primer
ttagcgcgtcgcccaaccctg

SEQ ID NO: 68960 - protein, 259 aa, consensus
  MISC_FEATURE (1)..(259): consensus for the disclosure of xaa see table XV
HXSXRXXXXXXXXXXXXXXXXXXXXXXXXXXXXXXXXXXQXXSXXXXXDXXXXXXXXXXXXXXXXXXXXXXXXXXXXXXXXXDXXRXXXXXXXXXXXXXXXXXXXXXXXXXXXXXXDXXXXXXXXXXAAEXXGXGXXXXGXXXXXXXXXXXXXXXLXLPXXXXXXXGXXXGXPXXXXXXXXKPRLPXXXXXXXXXYXXXXXXXXXXXXXYXXXXXXXXXXXXXXXXXXXWXXXXXXXXXXXXXXXXXXXXXXXXXXXXG

SEQ ID NO: 68961 - protein, 84 aa, consensus
  MISC_FEATURE (1)..(84): consensus for the disclosure of xaa see table XV
XXRXXXXXXXXXXXXXXXXXXXXXXXXXXXXXXXXXXXXXXXXXXXXXXXXXXXXXXXXXXXXXXXXXXXXXXXXXXXXXDXXX

SEQ ID NO: 68962 - protein, 80 aa, consensus
  MISC_FEATURE (1)..(80): consensus for the disclosure of xaa see table XV
XXXXXXXXXXXXXXXXXXGXXXXXXXXXXXXXXXXXXXXXXXPXXXXXXXXXXXGXXXXXXXXXXXXXXXXXXXXXXXXY

SEQ ID NO: 68963 - DNA, 1644 bp, Escherichia coli; identical to SEQ ID NO: 34379
  CDS (1)..(1644)

SEQ ID NO: 68964 - protein, 547 aa, Escherichia coli; identical to SEQ ID NO: 34380

SEQ ID NO: 68965 - DNA, 1833 bp, Idiomarina loihiensis L2TR; identical to SEQ ID NO: 34381
  CDS (1)..(1833)

SEQ ID NO: 68966 - protein, 610 aa, Idiomarina loihiensis L2TR; identical to SEQ ID NO: 34382

SEQ ID NO: 68967 - DNA, 1971 bp, Silicibacter pomeroyi DSS-3; identical to SEQ ID NO: 34383
  CDS (1)..(1971)

SEQ ID NO: 68968 - protein, 656 aa, Silicibacter pomeroyi DSS-3; identical to SEQ ID NO: 34384

SEQ ID NO: 68969 - DNA, 1830 bp, Francisella tularensis subsp. tularensis; identical to SEQ ID NO: 34385
  CDS (1)..(1830)

SEQ ID NO: 68970 - protein, 609 aa, Francisella tularensis subsp. tularensis; identical to SEQ ID NO: 34386

SEQ ID NO: 68971 - DNA, 1782 bp, Synechococcus elongatus PCC 6301; identical to SEQ ID NO: 34387
  CDS (1)..(1782)

SEQ ID NO: 68972 - protein, 593 aa, Synechococcus elongatus PCC 6301; identical to SEQ ID NO: 34388

SEQ ID NO: 68973 - DNA, 1842 bp, Mesorhizobium loti MAFF303099; identical to SEQ ID NO: 34389
  CDS (1)..(1842): transl_table=11

SEQ ID NO: 68974 - protein, 613 aa, Mesorhizobium loti MAFF303099; identical to SEQ ID NO: 34390

SEQ ID NO: 68975 - DNA, 1743 bp, Pyrococcus abyssi GE5; identical to SEQ ID NO: 34391
  CDS (1)..(1743): transl_table=11

SEQ ID NO: 68976 - protein, 580 aa, Pyrococcus abyssi GE5; identical to SEQ ID NO: 34392

SEQ ID NO: 68977 - DNA, 1656 bp, Helicobacter pylori 26695; identical to SEQ ID NO: 34393
  CDS (1)..(1656): transl_table=11

SEQ ID NO: 68978 - protein, 551 aa, Helicobacter pylori 26695; identical to SEQ ID NO: 34394

SEQ ID NO: 68979 - DNA, 1665 bp, Aquifex aeolicus VF5; identical to SEQ ID NO: 34395
  CDS (1)..(1665): transl_table=11

SEQ ID NO: 68980 - protein, 554 aa, Aquifex aeolicus VF5; identical to SEQ ID NO: 34396

SEQ ID NO: 68981 - DNA, 1656 bp, Helicobacter pylori J99; identical to SEQ ID NO: 34397
  CDS (1)..(1656): transl_table=11

SEQ ID NO: 68982 - protein, 551 aa, Helicobacter pylori J99; identical to SEQ ID NO: 34398

SEQ ID NO: 68983 - DNA, 1833 bp, Vibrio cholerae O1 biovar eltor str. N16961; identical to SEQ ID NO: 34399
  CDS (1)..(1833): transl_table=11

SEQ ID NO: 68984 - protein, 610 aa, Vibrio cholerae O1 biovar eltor str. N16961; identical to SEQ ID NO: 34400

SEQ ID NO: 68985 - DNA, 1860 bp, Vibrio cholerae O1 biovar eltor str. N16961; identical to SEQ ID NO: 34401
  CDS (1)..(1860): transl_table=11

SEQ ID NO: 68986 - protein, 619 aa, Vibrio cholerae O1 biovar eltor str. N16961; identical to SEQ ID NO: 34402

SEQ ID NO: 68987 - DNA, 1806 bp, Bacillus halodurans C-125; identical to SEQ ID NO: 34403
  CDS (1)..(1806): transl_table=11

SEQ ID NO: 68988 - protein, 601 aa, Bacillus halodurans C-125; identical to SEQ ID NO: 34404

SEQ ID NO: 68989 - DNA, 1650 bp, Pseudomonas aeruginosa PAO1; identical to SEQ ID NO: 34405
  CDS (1)..(1650): transl_table=11

SEQ ID NO: 68990 - protein, 549 aa, Pseudomonas aeruginosa PAO1; identical to SEQ ID NO: 34406

SEQ ID NO: 68991 - DNA, 1695 bp, Campylobacter jejuni subsp. jejuni NCTC 11168; identical to SEQ ID NO: 34407
  CDS (1)..(1695): transl_table=11

SEQ ID NO: 68992 - protein, 564 aa, Campylobacter jejuni subsp. jejuni NCTC 11168; identical to SEQ ID NO: 34408

SEQ ID NO: 68993 - DNA, 1632 bp, Campylobacter jejuni subsp. jejuni NCTC 11168; identical to SEQ ID NO: 34409
  CDS (1)..(1632): transl_table=11

SEQ ID NO: 68994 - protein, 543 aa, Campylobacter jejuni subsp. jejuni NCTC 11168; identical to SEQ ID NO: 34410

SEQ ID NO: 68995 - DNA, 1809 bp, Deinococcus radiodurans R1; identical to SEQ ID NO: 34411
  CDS (1)..(1809): transl_table=11

SEQ ID NO: 68996 - protein, 602 aa, Deinococcus radiodurans R1; identical to SEQ ID NO: 34412

SEQ ID NO: 68997 - DNA, 1752 bp, Deinococcus radiodurans R1; identical to SEQ ID NO: 34413
  CDS (1)..(1752): transl_table=11

SEQ ID NO: 68998 - protein, 583 aa, Deinococcus radiodurans R1; identical to SEQ ID NO: 34414

SEQ ID NO: 68999 - DNA, 1722 bp, Escherichia coli O157:H7; identical to SEQ ID NO: 34415
  CDS (1)..(1722): transl_table=11

SEQ ID NO: 69000 - protein, 573 aa, Escherichia coli O157:H7; identical to SEQ ID NO: 34416

SEQ ID NO: 69001 - DNA, 1740 bp, Clostridium acetobutylicum ATCC 824; identical to SEQ ID NO: 34417
  CDS (1)..(1740): transl_table=11

SEQ ID NO: 69002 - protein, 579 aa, Clostridium acetobutylicum ATCC 824; identical to SEQ ID NO: 34418

SEQ ID NO: 69003 - DNA, 2121 bp, Clostridium acetobutylicum ATCC 824; identical to SEQ ID NO: 34419
  CDS (1)..(2121): transl_table=11

SEQ ID NO: 69004 - protein, 706 aa, Clostridium acetobutylicum ATCC 824; identical to SEQ ID NO: 34420

SEQ ID NO: 69005 - DNA, 1761 bp, Streptococcus pneumoniae R6; identical to SEQ ID NO: 34421
  CDS (1)..(1761): transl_table=11

SEQ ID NO: 69006 - protein, 586 aa, Streptococcus pneumoniae R6; identical to SEQ ID NO: 34422

SEQ ID NO: 69007 - DNA, 1923 bp, Sinorhizobium meliloti 1021; identical to SEQ ID NO: 34423
  CDS (1)..(1923): transl_table=11

SEQ ID NO: 69008 - protein, 640 aa, Sinorhizobium meliloti 1021; identical to SEQ ID NO: 34424

SEQ ID NO: 69009 - DNA, 1815 bp, Sinorhizobium meliloti 1021; identical to SEQ ID NO: 34425
  CDS (1)..(1815): transl_table=11

SEQ ID NO: 69010 - protein, 604 aa, Sinorhizobium meliloti 1021; identical to SEQ ID NO: 34426

SEQ ID NO: 69011 - DNA, 2022 bp, Bacillus subtilis subsp. subtilis str. 168; identical to SEQ ID NO: 34427
  CDS (1)..(2022): transl_table=11

SEQ ID NO: 69012 - protein, 673 aa, Bacillus subtilis subsp. subtilis str. 168; identical to SEQ ID NO: 34428

SEQ ID NO: 69013 - DNA, 1815 bp, Bacillus subtilis subsp. subtilis str. 168; identical to SEQ ID NO: 34429
  CDS (1)..(1815): transl_table=11

SEQ ID NO: 69014 - protein, 604 aa, Bacillus subtilis subsp. subtilis str. 168; identical to SEQ ID NO: 34430

SEQ ID NO: 69015 - DNA, 1824 bp, Sinorhizobium meliloti 1021; identical to SEQ ID NO: 34431
  CDS (1)..(1824): transl_table=11

SEQ ID NO: 69016 - protein, 607 aa, Sinorhizobium meliloti 1021; identical to SEQ ID NO: 34432

SEQ ID NO: 69017 - DNA, 1782 bp, Synechocystis sp. PCC 6803; identical to SEQ ID NO: 34433
  CDS (1)..(1782): transl_table=11

SEQ ID NO: 69018 - protein, 593 aa, Synechocystis sp. PCC 6803; identical to SEQ ID NO: 34434

SEQ ID NO: 69019 - DNA, 1833 bp, Synechocystis sp. PCC 6803; identical to SEQ ID NO: 34435
  CDS (1)..(1833): transl_table=11

SEQ ID NO: 69020 - protein, 610 aa, Synechocystis sp. PCC 6803; identical to SEQ ID NO: 34436

SEQ ID NO: 69021 - DNA, 2202 bp, Synechocystis sp. PCC 6803; identical to SEQ ID NO: 34437
  CDS (1)..(2202): transl_table=11

SEQ ID NO: 69022 - protein, 733 aa, Synechocystis sp. PCC 6803; identical to SEQ ID NO: 34438

SEQ ID NO: 69023 - DNA, 1722 bp, Salmonella typhimurium LT2; identical to SEQ ID NO: 34439
  CDS (1)..(1722): transl_table=11

SEQ ID NO: 69024 - protein, 573 aa, Salmonella typhimurium LT2; identical to SEQ ID NO: 34440

SEQ ID NO: 69025 - DNA, 3798 bp, Caenorhabditis elegans; identical to SEQ ID NO: 34441
  CDS (1)..(3798)

SEQ ID NO: 69026 - protein, 1265 aa, Caenorhabditis elegans; identical to SEQ ID NO: 34442

SEQ ID NO: 69027 - DNA, 1902 bp, Caenorhabditis elegans; identical to SEQ ID NO: 34443
  CDS (1)..(1902)

SEQ ID NO: 69028 - protein, 633 aa, Caenorhabditis elegans; identical to SEQ ID NO: 34444

SEQ ID NO: 69029 - DNA, 1668 bp, Ralstonia solanacearum GMI1000; identical to SEQ ID NO: 34445
  CDS (1)..(1668): transl_table=11

SEQ ID NO: 69030 - protein, 555 aa, Ralstonia solanacearum GMI1000; identical to SEQ ID NO: 34446

SEQ ID NO: 69031 - DNA, 1731 bp, Clostridium perfringens str. 13; identical to SEQ ID NO: 34447
  CDS (1)..(1731): transl_table=11

SEQ ID NO: 69032 - protein, 576 aa, Clostridium perfringens str. 13; identical to SEQ ID NO: 34448

SEQ ID NO: 69033 - DNA, 1782 bp, Clostridium perfringens str. 13; identical to SEQ ID NO: 34449
  CDS (1)..(1782): transl_table=11

SEQ ID NO: 69034 - protein, 593 aa, Clostridium perfringens str. 13; identical to SEQ ID NO: 34450

SEQ ID NO: 69035 - DNA, 1746 bp, Pyrococcus furiosus DSM 3638; identical to SEQ ID NO: 34451
  CDS (1)..(1746): transl_table=11

SEQ ID NO: 69036 - protein, 581 aa, Pyrococcus furiosus DSM 3638; identical to SEQ ID NO: 34452

SEQ ID NO: 69037 - DNA, 1737 bp, Pyrococcus furiosus DSM 3638; identical to SEQ ID NO: 34453
  CDS (1)..(1737): transl_table=11

SEQ ID NO: 69038 - protein, 578 aa, Pyrococcus furiosus DSM 3638; identical to SEQ ID NO: 34454

SEQ ID NO: 69039 - DNA, 1752 bp, Streptomyces coelicolor A3(2); identical to SEQ ID NO: 34455
  CDS (1)..(1752)

SEQ ID NO: 69040 - protein, 583 aa, Streptomyces coelicolor A3(2); identical to SEQ ID NO: 34456

SEQ ID NO: 69041 - DNA, 1962 bp, Chlorobium tepidum TLS; identical to SEQ ID NO: 34457
  CDS (1)..(1962): transl_table=11

SEQ ID NO: 69042 - protein, 653 aa, Chlorobium tepidum TLS; identical to SEQ ID NO: 34458

SEQ ID NO: 69043 - DNA, 1803 bp, Yersinia pestis KIM; identical to SEQ ID NO: 34459
  CDS (1)..(1803): transl_table=11

SEQ ID NO: 69044 - protein, 600 aa, Yersinia pestis KIM; identical to SEQ ID NO: 34460

SEQ ID NO: 69045 - DNA, 1815 bp, Thermosynechococcus elongatus BP-1; identical to SEQ ID NO: 34461
  CDS (1)..(1815): transl_table=11

SEQ ID NO: 69046 - protein, 604 aa, Thermosynechococcus elongatus BP-1; identical to SEQ ID NO: 34462

SEQ ID NO: 69047 - DNA, 1737 bp, Thermosynechococcus elongatus BP-1; identical to SEQ ID NO: 34463
  CDS (1)..(1737): transl_table=11

SEQ ID NO: 69048 - protein, 578 aa, Thermosynechococcus elongatus BP-1; identical to SEQ ID NO: 34464

SEQ ID NO: 69049 - DNA, 1629 bp, Thermosynechococcus elongatus BP-1; identical to SEQ ID NO: 34465
  CDS (1)..(1629): transl_table=11

SEQ ID NO: 69050 - protein, 542 aa, Thermosynechococcus elongatus BP-1; identical to SEQ ID NO: 34466

SEQ ID NO: 69051 - DNA, 1770 bp, Oceanobacillus iheyensis HTE831; identical to SEQ ID NO: 34467
  CDS (1)..(1770): transl_table=11

SEQ ID NO: 69052 - protein, 589 aa, Oceanobacillus iheyensis HTE831; identical to SEQ ID NO: 34468

SEQ ID NO: 69053 - DNA, 1749 bp, Oceanobacillus iheyensis HTE831; identical to SEQ ID NO: 34469
  CDS (1)..(1749): transl_table=11

SEQ ID NO: 69054 - protein, 582 aa, Oceanobacillus iheyensis HTE831; identical to SEQ ID NO: 34470

SEQ ID NO: 69055 - DNA, 1800 bp, Brucella suis 1330; identical to SEQ ID NO: 34471
  CDS (1)..(1800): transl_table=11

SEQ ID NO: 69056 - protein, 599 aa, Brucella suis 1330; identical to SEQ ID NO: 34472

SEQ ID NO: 69057 - DNA, 1830 bp, Shewanella oneidensis MR-1; identical to SEQ ID NO: 34473
  CDS (1)..(1830): transl_table=11

SEQ ID NO: 69058 - protein, 609 aa, Shewanella oneidensis MR-1; identical to SEQ ID NO: 34474

SEQ ID NO: 69059 - DNA, 1788 bp, Shewanella oneidensis MR-1; identical to SEQ ID NO: 34475
  CDS (1)..(1788): transl_table=11

SEQ ID NO: 69060 - protein, 595 aa, Shewanella oneidensis MR-1; identical to SEQ ID NO: 34476

SEQ ID NO: 69061 - DNA, 1773 bp, Streptococcus mutans UA159; identical to SEQ ID NO: 34477
  CDS (1)..(1773): transl_table=11

SEQ ID NO: 69062 - protein, 590 aa, Streptococcus mutans UA159; identical to SEQ ID NO: 34478

SEQ ID NO: 69063 - DNA, 1740 bp, Streptococcus agalactiae NEM316; identical to SEQ ID NO: 34479
  CDS (1)..(1740): transl_table=11

SEQ ID NO: 69064 - protein, 579 aa, Streptococcus agalactiae NEM316; identical to SEQ ID NO: 34480

SEQ ID NO: 69065 - DNA, 1833 bp, Pseudomonas putida KT2440; identical to SEQ ID NO: 34481
  CDS (1)..(1833): transl_table=11

SEQ ID NO: 69066 - protein, 610 aa, Pseudomonas putida KT2440; identical to SEQ ID NO: 34482

SEQ ID NO: 69067 - DNA, 1764 bp, Pseudomonas putida KT2440; identical to SEQ ID NO: 34483
  CDS (1)..(1764): transl_table=11

SEQ ID NO: 69068 - protein, 587 aa, Pseudomonas putida KT2440; identical to SEQ ID NO: 34484

SEQ ID NO: 69069 - DNA, 1659 bp, Pseudomonas putida KT2440; identical to SEQ ID NO: 34485
  CDS (1)..(1659): transl_table=11

SEQ ID NO: 69070 - protein, 552 aa, Pseudomonas putida KT2440; identical to SEQ ID NO: 34486

SEQ ID NO: 69071 - DNA, 1896 bp, Escherichia coli CFT073; identical to SEQ ID NO: 34487
  CDS (1)..(1896): transl_table=11

SEQ ID NO: 69072 - protein, 631 aa, Escherichia coli CFT073; identical to SEQ ID NO: 34488

SEQ ID NO: 69073 - DNA, 1794 bp, Mycoplasma penetrans HF-2; identical to SEQ ID NO: 34489
  CDS (1)..(1794): transl_table=4

SEQ ID NO: 69074 - protein, 597 aa, Mycoplasma penetrans HF-2; identical to SEQ ID NO: 34490

SEQ ID NO: 69075 - DNA, 1776 bp, Vibrio vulnificus CMCP6; identical to SEQ ID NO: 34491
  CDS (1)..(1776): transl_table=11

SEQ ID NO: 69076 - protein, 591 aa, Vibrio vulnificus CMCP6; identical to SEQ ID NO: 34492

SEQ ID NO: 69077 - DNA, 1800 bp, Vibrio vulnificus CMCP6; identical to SEQ ID NO: 34493
  CDS (1)..(1800): transl_table=11

SEQ ID NO: 69078 - protein, 599 aa, Vibrio vulnificus CMCP6; identical to SEQ ID NO: 34494

SEQ ID NO: 69079 - DNA, 1659 bp, Vibrio vulnificus CMCP6; identical to SEQ ID NO: 34495
  CDS (1)..(1659): transl_table=11

SEQ ID NO: 69080 - protein, 552 aa, Vibrio vulnificus CMCP6; identical to SEQ ID NO: 34496

SEQ ID NO: 69081 - DNA, 1761 bp, Vibrio vulnificus CMCP6; identical to SEQ ID NO: 34497
  CDS (1)..(1761): transl_table=11

SEQ ID NO: 69082 - protein, 586 aa, Vibrio vulnificus CMCP6; identical to SEQ ID NO: 34498

SEQ ID NO: 69083 - DNA, 1743 bp, Clostridium tetani E88; identical to SEQ ID NO: 34499
  CDS (1)..(1743): transl_table=11

SEQ ID NO: 69084 - protein, 580 aa, Clostridium tetani E88; identical to SEQ ID NO: 34500

SEQ ID NO: 69085 - DNA, 1890 bp, Lactobacillus plantarum WCFS1; identical to SEQ ID NO: 34501
  CDS (1)..(1890): transl_table=11

SEQ ID NO: 69086 - protein, 629 aa, Lactobacillus plantarum WCFS1; identical to SEQ ID NO: 34502

SEQ ID NO: 69087 - DNA, 1764 bp, Lactobacillus plantarum WCFS1; identical to SEQ ID NO: 34503
  CDS (1)..(1764): transl_table=11

SEQ ID NO: 69088 - protein, 587 aa, Lactobacillus plantarum WCFS1; identical to SEQ ID NO: 34504

SEQ ID NO: 69089 - DNA, 1788 bp, Lactobacillus plantarum WCFS1; identical to SEQ ID NO: 34505
  CDS (1)..(1788): transl_table=11

SEQ ID NO: 69090 - protein, 595 aa, Lactobacillus plantarum WCFS1; identical to SEQ ID NO: 34506

SEQ ID NO: 69091 - DNA, 1827 bp, Pseudomonas syringae pv. tomato str. DC3000; identical to SEQ ID NO: 34507
  CDS (1)..(1827): transl_table=11

SEQ ID NO: 69092 - protein, 608 aa, Pseudomonas syringae pv. tomato str. DC3000; identical to SEQ ID NO: 34508

SEQ ID NO: 69093 - DNA, 1770 bp, Pseudomonas syringae pv. tomato str. DC3000; identical to SEQ ID NO: 34509
  CDS (1)..(1770): transl_table=11

SEQ ID NO: 69094 - protein, 589 aa, Pseudomonas syringae pv. tomato str. DC3000; identical to SEQ ID NO: 34510

SEQ ID NO: 69095 - DNA, 1665 bp, Pseudomonas syringae pv. tomato str. DC3000; identical to SEQ ID NO: 34511
  CDS (1)..(1665): transl_table=11

SEQ ID NO: 69096 - protein, 554 aa, Pseudomonas syringae pv. tomato str. DC3000; identical to SEQ ID NO: 34512

SEQ ID NO: 69097 - DNA, 1833 bp, Pseudomonas syringae pv. tomato str. DC3000; identical to SEQ ID NO: 34513
  CDS (1)..(1833): transl_table=11

SEQ ID NO: 69098 - protein, 610 aa, Pseudomonas syringae pv. tomato str. DC3000; identical to SEQ ID NO: 34514

SEQ ID NO: 69099 - DNA, 1851 bp, Vibrio parahaemolyticus RIMD 2210633; identical to SEQ ID NO: 34515
  CDS (1)..(1851): transl_table=11

SEQ ID NO: 69100 - protein, 616 aa, Vibrio parahaemolyticus RIMD 2210633; identical to SEQ ID NO: 34516

SEQ ID NO: 69101 - DNA, 1644 bp, Salmonella enterica subsp. enterica serovar Typhi Ty2; identical to SEQ ID NO: 34517
  CDS (1)..(1644): transl_table=11

SEQ ID NO: 69102 - protein, 547 aa, Salmonella enterica subsp. enterica serovar Typhi Ty2; identical to SEQ ID NO: 34518

SEQ ID NO: 69103 - DNA, 1731 bp, Bacteroides thetaiotaomicron VPI-5482; identical to SEQ ID NO: 34519
  CDS (1)..(1731): transl_table=11

SEQ ID NO: 69104 - protein, 576 aa, Bacteroides thetaiotaomicron VPI-5482; identical to SEQ ID NO: 34520

SEQ ID NO: 69105 - DNA, 1767 bp, Enterococcus faecalis V583; identical to SEQ ID NO: 34521
  CDS (1)..(1767): transl_table=11

SEQ ID NO: 69106 - protein, 588 aa, Enterococcus faecalis V583; identical to SEQ ID NO: 34522

SEQ ID NO: 69107 - DNA, 1869 bp, Enterococcus faecalis V583; identical to SEQ ID NO: 34523
  CDS (1)..(1869): transl_table=11

SEQ ID NO: 69108 - protein, 622 aa, Enterococcus faecalis V583; identical to SEQ ID NO: 34524

SEQ ID NO: 69109 - DNA, 1782 bp, Streptomyces avermitilis MA-4680; identical to SEQ ID NO: 34525
  CDS (1)..(1782)

SEQ ID NO: 69110 - protein, 593 aa, Streptomyces avermitilis MA-4680; identical to SEQ ID NO: 34526

SEQ ID NO: 69111 - DNA, 1767 bp, Streptomyces avermitilis MA-4680; identical to SEQ ID NO: 34527
  CDS (1)..(1767)

SEQ ID NO: 69112 - protein, 588 aa, Streptomyces avermitilis MA-4680; identical to SEQ ID NO: 34528

SEQ ID NO: 69113 - DNA, 1626 bp, Bacillus cereus ATCC 14579; identical to SEQ ID NO: 34529
  CDS (1)..(1626): transl_table=11

SEQ ID NO: 69114 - protein, 541 aa, Bacillus cereus ATCC 14579; identical to SEQ ID NO: 34530

SEQ ID NO: 69115 - DNA, 1680 bp, Bacillus cereus ATCC 14579; identical to SEQ ID NO: 34531
  CDS (1)..(1680): transl_table=11

SEQ ID NO: 69116 - protein, 559 aa, Bacillus cereus ATCC 14579; identical to SEQ ID NO: 34532

SEQ ID NO: 69117 - DNA, 1797 bp, Bacillus cereus ATCC 14579; identical to SEQ ID NO: 34533
  CDS (1)..(1797): transl_table=11

SEQ ID NO: 69118 - protein, 598 aa, Bacillus cereus ATCC 14579; identical to SEQ ID NO: 34534

SEQ ID NO: 69119 - DNA, 1782 bp, Shigella flexneri 2a str. 2457T; identical to SEQ ID NO: 34535
  CDS (1)..(1782): transl_table=11

SEQ ID NO: 69120 - protein, 593 aa, Shigella flexneri 2a str. 2457T; identical to SEQ ID NO: 34536

SEQ ID NO: 69121 - DNA, 1749 bp, Nitrosomonas europaea ATCC 19718; identical to SEQ ID NO: 34537
  CDS (1)..(1749): transl_table=11

SEQ ID NO: 69122 - protein, 582 aa, Nitrosomonas europaea ATCC 19718; identical to SEQ ID NO: 34538

SEQ ID NO: 69123 - DNA, 2094 bp, Enterococcus faecalis; identical to SEQ ID NO: 34539
  CDS (1)..(2094): transl_table=11

SEQ ID NO: 69124 - protein, 697 aa, Enterococcus faecalis; identical to SEQ ID NO: 34540

SEQ ID NO: 69125 - DNA, 1644 bp, Rhodopirellula baltica SH 1; identical to SEQ ID NO: 34541
  CDS (1)..(1644): transl_table=11

SEQ ID NO: 69126 - protein, 547 aa, Rhodopirellula baltica SH 1; identical to SEQ ID NO: 34542

SEQ ID NO: 69127 - DNA, 1752 bp, Candidatus Blochmannia floridanus; identical to SEQ ID NO: 34543
  CDS (1)..(1752): transl_table=11

SEQ ID NO: 69128 - protein, 583 aa, Candidatus Blochmannia floridanus; identical to SEQ ID NO: 34544

SEQ ID NO: 69129 - DNA, 1803 bp, Prochlorococcus marinus str. MIT 9313; identical to SEQ ID NO: 34545
  CDS (1)..(1803): transl_table=11

SEQ ID NO: 69130 - protein, 600 aa, Prochlorococcus marinus str. MIT 9313; identical to SEQ ID NO: 34546

SEQ ID NO: 69131 - DNA, 1797 bp, Prochlorococcus marinus str. MIT 9313; identical to SEQ ID NO: 34547
  CDS (1)..(1797): transl_table=11

SEQ ID NO: 69132 - protein, 598 aa, Prochlorococcus marinus str. MIT 9313; identical to SEQ ID NO: 34548

SEQ ID NO: 69133 - DNA, 1779 bp, Synechococcus sp. WH 8102; identical to SEQ ID NO: 34549
  CDS (1)..(1779): transl_table=11

SEQ ID NO: 69134 - protein, 592 aa, Synechococcus sp. WH 8102; identical to SEQ ID NO: 34550

SEQ ID NO: 69135 - DNA, 1863 bp, Chromobacterium violaceum ATCC 12472; identical to SEQ ID NO: 34551
  CDS (1)..(1863): transl_table=11

SEQ ID NO: 69136 - protein, 620 aa, Chromobacterium violaceum ATCC 12472; identical to SEQ ID NO: 34552

SEQ ID NO: 69137 - DNA, 1707 bp, Porphyromonas gingivalis W83; identical to SEQ ID NO: 34553
  CDS (1)..(1707): transl_table=11

SEQ ID NO: 69138 - protein, 568 aa, Porphyromonas gingivalis W83; identical to SEQ ID NO: 34554

SEQ ID NO: 69139 - DNA, 1692 bp, Wolinella succinogenes DSM 1740; identical to SEQ ID NO: 34555
  CDS (1)..(1692): transl_table=11

SEQ ID NO: 69140 - protein, 563 aa, Wolinella succinogenes DSM 1740; identical to SEQ ID NO: 34556

SEQ ID NO: 69141 - DNA, 1707 bp, Wolinella succinogenes DSM 1740; identical to SEQ ID NO: 34557
  CDS (1)..(1707): transl_table=11

SEQ ID NO: 69142 - protein, 568 aa, Wolinella succinogenes DSM 1740; identical to SEQ ID NO: 34558

SEQ ID NO: 69143 - DNA, 1752 bp, Gloeobacter violaceus PCC 7421; identical to SEQ ID NO: 34559
  CDS (1)..(1752): transl_table=11

SEQ ID NO: 69144 - protein, 583 aa, Gloeobacter violaceus PCC 7421; identical to SEQ ID NO: 34560

SEQ ID NO: 69145 - DNA, 1767 bp, Gloeobacter violaceus PCC 7421; identical to SEQ ID NO: 34561
  CDS (1)..(1767): transl_table=11

SEQ ID NO: 69146 - protein, 588 aa, Gloeobacter violaceus PCC 7421; identical to SEQ ID NO: 34562

SEQ ID NO: 69147 - DNA, 1803 bp, Photorhabdus luminescens subsp. laumondii TTO1; identical to SEQ ID NO: 34563
  CDS (1)..(1803): transl_table=11

SEQ ID NO: 69148 - protein, 600 aa, Photorhabdus luminescens subsp. laumondii TTO1; identical to SEQ ID NO: 34564

SEQ ID NO: 69149 - DNA, 1677 bp, Photorhabdus luminescens subsp. laumondii TTO1; identical to SEQ ID NO: 34565
  CDS (1)..(1677): transl_table=11

SEQ ID NO: 69150 - protein, 558 aa, Photorhabdus luminescens subsp. laumondii TTO1; identical to SEQ ID NO: 34566

SEQ ID NO: 69151 - DNA, 1785 bp, Photorhabdus luminescens subsp. laumondii TTO1; identical to SEQ ID NO: 34567
  CDS (1)..(1785): transl_table=11

SEQ ID NO: 69152 - protein, 594 aa, Photorhabdus luminescens subsp. laumondii TTO1; identical to SEQ ID NO: 34568

SEQ ID NO: 69153 - DNA, 1839 bp, Vibrio vulnificus YJ016; identical to SEQ ID NO: 34569
  CDS (1)..(1839): transl_table=11

SEQ ID NO: 69154 - protein, 612 aa, Vibrio vulnificus YJ016; identical to SEQ ID NO: 34570

SEQ ID NO: 69155 - DNA, 1800 bp, Vibrio vulnificus YJ016; identical to SEQ ID NO: 34571
  CDS (1)..(1800): transl_table=11

SEQ ID NO: 69156 - protein, 599 aa, Vibrio vulnificus YJ016; identical to SEQ ID NO: 34572

SEQ ID NO: 69157 - DNA, 1776 bp, Vibrio vulnificus YJ016; identical to SEQ ID NO: 34573
  CDS (1)..(1776): transl_table=11

SEQ ID NO: 69158 - protein, 591 aa, Vibrio vulnificus YJ016; identical to SEQ ID NO: 34574

SEQ ID NO: 69159 - DNA, 1890 bp, Vibrio vulnificus YJ016; identical to SEQ ID NO: 34575
  CDS (1)..(1890): transl_table=11

SEQ ID NO: 69160 - protein, 629 aa, Vibrio vulnificus YJ016; identical to SEQ ID NO: 34576

SEQ ID NO: 69161 - DNA, 1716 bp, Geobacter sulfurreducens PCA; identical to SEQ ID NO: 34577
  CDS (1)..(1716): transl_table=11

SEQ ID NO: 69162 - protein, 571 aa, Geobacter sulfurreducens PCA; identical to SEQ ID NO: 34578

SEQ ID NO: 69163 - DNA, 1569 bp, Lactobacillus johnsonii NCC 533; identical to SEQ ID NO: 34579
  CDS (1)..(1569): transl_table=11

SEQ ID NO: 69164 - protein, 522 aa, Lactobacillus johnsonii NCC 533; identical to SEQ ID NO: 34580

SEQ ID NO: 69165 - DNA, 1812 bp, Treponema denticola ATCC 35405; identical to SEQ ID NO: 34581
  CDS (1)..(1812): transl_table=11

SEQ ID NO: 69166 - protein, 603 aa, Treponema denticola ATCC 35405; identical to SEQ ID NO: 34582

SEQ ID NO: 69167 - DNA, 1743 bp, Treponema denticola ATCC 35405; identical to SEQ ID NO: 34583
  CDS (1)..(1743): transl_table=11

SEQ ID NO: 69168 - protein, 580 aa, Treponema denticola ATCC 35405; identical to SEQ ID NO: 34584

SEQ ID NO: 69169 - DNA, 1668 bp, Treponema denticola ATCC 35405; identical to SEQ ID NO: 34585
  CDS (1)..(1668): transl_table=11

SEQ ID NO: 69170 - protein, 555 aa, Treponema denticola ATCC 35405; identical to SEQ ID NO: 34586

SEQ ID NO: 69171 - DNA, 1746 bp, Treponema denticola ATCC 35405; identical to SEQ ID NO: 34587
  CDS (1)..(1746): transl_table=11

SEQ ID NO: 69172 - protein, 581 aa, Treponema denticola ATCC 35405; identical to SEQ ID NO: 34588

SEQ ID NO: 69173 - DNA, 2001 bp, Bacillus cereus ATCC 10987; identical to SEQ ID NO: 34589
  CDS (1)..(2001): transl_table=11

SEQ ID NO: 69174 - protein, 666 aa, Bacillus cereus ATCC 10987; identical to SEQ ID NO: 34590

SEQ ID NO: 69175 - DNA, 1755 bp, Bacillus cereus ATCC 10987; identical to SEQ ID NO: 34591
  CDS (1)..(1755): transl_table=11

SEQ ID NO: 69176 - protein, 584 aa, Bacillus cereus ATCC 10987; identical to SEQ ID NO: 34592

SEQ ID NO: 69177 - DNA, 1797 bp, Bacillus cereus ATCC 10987; identical to SEQ ID NO: 34593
  CDS (1)..(1797): transl_table=11

SEQ ID NO: 69178 - protein, 598 aa, Bacillus cereus ATCC 10987; identical to SEQ ID NO: 34594

SEQ ID NO: 69179 - DNA, 1896 bp, Leptospira interrogans serovar Copenhageni str. Fiocruz L1-130; identical to SEQ ID NO: 34595
  CDS (1)..(1896): transl_table=11

SEQ ID NO: 69180 - protein, 631 aa, Leptospira interrogans serovar Copenhageni str. Fiocruz L1-130; identical to SEQ ID NO: 34596

SEQ ID NO: 69181 - DNA, 1806 bp, Desulfovibrio vulgaris subsp. vulgaris str. Hildenborough; identical to SEQ ID NO: 34597
  CDS (1)..(1806): transl_table=11

SEQ ID NO: 69182 - protein, 601 aa, Desulfovibrio vulgaris subsp. vulgaris str. Hildenborough; identical to SEQ ID NO: 34598

SEQ ID NO: 69183 - DNA, 1896 bp, Mycoplasma mobile 163K; identical to SEQ ID NO: 34599
  CDS (1)..(1896): transl_table=4

SEQ ID NO: 69184 - protein, 631 aa, Mycoplasma mobile 163K; identical to SEQ ID NO: 34600

SEQ ID NO: 69185 - DNA, 1791 bp, Bartonella henselae str. Houston-1; identical to SEQ ID NO: 34601
  CDS (1)..(1791): transl_table=11

SEQ ID NO: 69186 - protein, 596 aa, Bartonella henselae str. Houston-1; identical to SEQ ID NO: 34602

SEQ ID NO: 69187 - DNA, 1797 bp, Bacillus thuringiensis serovar konkukian str. 97-27; identical to SEQ ID NO: 34603
  CDS (1)..(1797): transl_table=11

SEQ ID NO: 69188 - protein, 598 aa, Bacillus thuringiensis serovar konkukian str. 97-27; identical to SEQ ID NO: 34604

SEQ ID NO: 69189 - DNA, 1785 bp, Staphylococcus aureus subsp. aureus MRSA252; identical to SEQ ID NO: 34605
  CDS (1)..(1785): transl_table=11

SEQ ID NO: 69190 - protein, 594 aa, Staphylococcus aureus subsp. aureus MRSA252; identical to SEQ ID NO: 34606

SEQ ID NO: 69191 - DNA, 1785 bp, Staphylococcus aureus subsp. aureus MSSA476; identical to SEQ ID NO: 34607
  CDS (1)..(1785): transl_table=11

SEQ ID NO: 69192 - protein, 594 aa, Staphylococcus aureus subsp. aureus MSSA476; identical to SEQ ID NO: 34608

SEQ ID NO: 69193 - DNA, 1851 bp, Acinetobacter sp. ADP1; identical to SEQ ID NO: 34609
  CDS (1)..(1851): transl_table=11

SEQ ID NO: 69194 - protein, 616 aa, Acinetobacter sp. ADP1; identical to SEQ ID NO: 34610

SEQ ID NO: 69195 - DNA, 1647 bp, Erwinia carotovora subsp. atroseptica SCRI1043; identical to SEQ ID NO: 34611
  CDS (1)..(1647)

SEQ ID NO: 69196 - protein, 548 aa, Erwinia carotovora subsp. atroseptica SCRI1043; identical to SEQ ID NO: 34612

SEQ ID NO: 69197 - DNA, 1665 bp, Erwinia carotovora subsp. atroseptica SCRI1043; identical to SEQ ID NO: 34613
  CDS (1)..(1665)

SEQ ID NO: 69198 - protein, 554 aa, Erwinia carotovora subsp. atroseptica SCRI1043; identical to SEQ ID NO: 34614

SEQ ID NO: 69199 - DNA, 1785 bp, Erwinia carotovora subsp. atroseptica SCRI1043; identical to SEQ ID NO: 34615
  CDS (1)..(1785)

SEQ ID NO: 69200 - protein, 594 aa, Erwinia carotovora subsp. atroseptica SCRI1043; identical to SEQ ID NO: 34616

SEQ ID NO: 69201 - DNA, 1893 bp, Symbiobacterium thermophilum IAM 14863; identical to SEQ ID NO: 34617
  CDS (1)..(1893): transl_table=11

SEQ ID NO: 69202 - protein, 630 aa, Symbiobacterium thermophilum IAM 14863; identical to SEQ ID NO: 34618

SEQ ID NO: 69203 - DNA, 1863 bp, Symbiobacterium thermophilum IAM 14863; identical to SEQ ID NO: 34619
  CDS (1)..(1863): transl_table=11

SEQ ID NO: 69204 - protein, 620 aa, Symbiobacterium thermophilum IAM 14863; identical to SEQ ID NO: 34620

SEQ ID NO: 69205 - DNA, 1800 bp, Symbiobacterium thermophilum IAM 14863; identical to SEQ ID NO: 34621
  CDS (1)..(1800): transl_table=11

SEQ ID NO: 69206 - protein, 599 aa, Symbiobacterium thermophilum IAM 14863; identical to SEQ ID NO: 34622

SEQ ID NO: 69207 - DNA, 2001 bp, Bacillus cereus ZK; identical to SEQ ID NO: 34623
  CDS (1)..(2001): transl_table=11

SEQ ID NO: 69208 - protein, 666 aa, Bacillus cereus ZK; identical to SEQ ID NO: 34624

SEQ ID NO: 69209 - DNA, 1725 bp, Bacillus cereus ZK; identical to SEQ ID NO: 34625
  CDS (1)..(1725): transl_table=11

SEQ ID NO: 69210 - protein, 574 aa, Bacillus cereus ZK; identical to SEQ ID NO: 34626

SEQ ID NO: 69211 - DNA, 1851 bp, Agrobacterium tumefaciens; identical to SEQ ID NO: 34627
  CDS (1)..(1851): transl_table=11

SEQ ID NO: 69212 - protein, 616 aa, Agrobacterium tumefaciens; identical to SEQ ID NO: 34628

SEQ ID NO: 69213 - DNA, 1860 bp, Mannheimia succiniciproducens MBEL55E; identical to SEQ ID NO: 34629
  CDS (1)..(1860): transl_table=11

SEQ ID NO: 69214 - protein, 619 aa, Mannheimia succiniciproducens MBEL55E; identical to SEQ ID NO: 34630

SEQ ID NO: 69215 - DNA, 1680 bp, Mannheimia succiniciproducens MBEL55E; identical to SEQ ID NO: 34631
  CDS (1)..(1680): transl_table=11

SEQ ID NO: 69216 - protein, 559 aa, Mannheimia succiniciproducens MBEL55E; identical to SEQ ID NO: 34632

SEQ ID NO: 69217 - DNA, 2019 bp, Bacillus licheniformis DSM 13; identical to SEQ ID NO: 34633
  CDS (1)..(2019): transl_table=11

SEQ ID NO: 69218 - protein, 672 aa, Bacillus licheniformis DSM 13; identical to SEQ ID NO: 34634

SEQ ID NO: 69219 - DNA, 1836 bp, Bacteroides fragilis YCH46; identical to SEQ ID NO: 34635
  CDS (1)..(1836): transl_table=11

SEQ ID NO: 69220 - protein, 611 aa, Bacteroides fragilis YCH46; identical to SEQ ID NO: 34636

SEQ ID NO: 69221 - DNA, 1746 bp, Burkholderia pseudomallei K96243; identical to SEQ ID NO: 34637
  CDS (1)..(1746): transl_table=11

SEQ ID NO: 69222 - protein, 581 aa, Burkholderia pseudomallei K96243; identical to SEQ ID NO: 34638

SEQ ID NO: 69223 - DNA, 1854 bp, Nocardia farcinica IFM 10152; identical to SEQ ID NO: 34639
  CDS (1)..(1854): transl_table=11

SEQ ID NO: 69224 - protein, 617 aa, Nocardia farcinica IFM 10152; identical to SEQ ID NO: 34640

SEQ ID NO: 69225 - DNA, 1812 bp, Nocardia farcinica IFM 10152; identical to SEQ ID NO: 34641
  CDS (1)..(1812): transl_table=11

SEQ ID NO: 69226 - protein, 603 aa, Nocardia farcinica IFM 10152; identical to SEQ ID NO: 34642

SEQ ID NO: 69227 - DNA, 1713 bp, Photobacterium profundum SS9; identical to SEQ ID NO: 34643
  CDS (1)..(1713): transl_table=11

SEQ ID NO: 69228 - protein, 570 aa, Photobacterium profundum SS9; identical to SEQ ID NO: 34644

SEQ ID NO: 69229 - DNA, 2067 bp, Photobacterium profundum SS9; identical to SEQ ID NO: 34645
  CDS (1)..(2067): transl_table=11

SEQ ID NO: 69230 - protein, 688 aa, Photobacterium profundum SS9; identical to SEQ ID NO: 34646

SEQ ID NO: 69231 - DNA, 1854 bp, Photobacterium profundum SS9; identical to SEQ ID NO: 34647
  CDS (1)..(1854): transl_table=11

SEQ ID NO: 69232 - protein, 617 aa, Photobacterium profundum SS9; identical to SEQ ID NO: 34648

SEQ ID NO: 69233 - DNA, 1746 bp, Lactobacillus gasseri; identical to SEQ ID NO: 34649
  CDS (1)..(1746)

SEQ ID NO: 69234 - protein, 581 aa, Lactobacillus gasseri; identical to SEQ ID NO: 34650

SEQ ID NO: 69235 - DNA, 1515 bp, Lactobacillus gasseri; identical to SEQ ID NO: 34651
  CDS (1)..(1515)

SEQ ID NO: 69236 - protein, 504 aa, Lactobacillus gasseri; identical to SEQ ID NO: 34652

SEQ ID NO: 69237 - DNA, 1788 bp, Azotobacter vinelandii; identical to SEQ ID NO: 34653
  CDS (1)..(1788)

SEQ ID NO: 69238 - protein, 595 aa, Azotobacter vinelandii; identical to SEQ ID NO: 34654

SEQ ID NO: 69239 - DNA, 1662 bp, Azotobacter vinelandii; identical to SEQ ID NO: 34655
  CDS (1)..(1662)

SEQ ID NO: 69240 - protein, 553 aa, Azotobacter vinelandii; identical to SEQ ID NO: 34656

SEQ ID NO: 69241 - DNA, 1863 bp, Desulfitobacterium hafniense DCB-2; identical to SEQ ID NO: 34657
  CDS (1)..(1863)

SEQ ID NO: 69242 - protein, 620 aa, Desulfitobacterium hafniense DCB-2; identical to SEQ ID NO: 34658

SEQ ID NO: 69243 - DNA, 1809 bp, Nostoc punctiforme PCC 73102; identical to SEQ ID NO: 34659
  CDS (1)..(1809)

SEQ ID NO: 69244 - protein, 602 aa, Nostoc punctiforme PCC 73102; identical to SEQ ID NO: 34660

SEQ ID NO: 69245 - DNA, 1656 bp, Nostoc punctiforme PCC 73102; identical to SEQ ID NO: 34661
  CDS (1)..(1656)

SEQ ID NO: 69246 - protein, 551 aa, Nostoc punctiforme PCC 73102; identical to SEQ ID NO: 34662

SEQ ID NO: 69247 - DNA, 1677 bp, Pseudomonas syringae pv. syringae B728a; identical to SEQ ID NO: 34663
  CDS (1)..(1677)

SEQ ID NO: 69248 - protein, 558 aa, Pseudomonas syringae pv. syringae B728a; identical to SEQ ID NO: 34664

SEQ ID NO: 69249 - DNA, 1770 bp, Pseudomonas syringae pv. syringae B728a; identical to SEQ ID NO: 34665
  CDS (1)..(1770)

SEQ ID NO: 69250 - protein, 589 aa, Pseudomonas syringae pv. syringae B728a; identical to SEQ ID NO: 34666

SEQ ID NO: 69251 - DNA, 1833 bp, Pseudomonas syringae pv. syringae B728a; identical to SEQ ID NO: 34667
  CDS (1)..(1833)

SEQ ID NO: 69252 - protein, 610 aa, Pseudomonas syringae pv. syringae B728a; identical to SEQ ID NO: 34668

SEQ ID NO: 69253 - DNA, 1827 bp, Pseudomonas syringae pv. syringae B728a; identical to SEQ ID NO: 34669
  CDS (1)..(1827)

SEQ ID NO: 69254 - protein, 608 aa, Pseudomonas syringae pv. syringae B728a; identical to SEQ ID NO: 34670

SEQ ID NO: 69255 - DNA, 1845 bp, Actinobacillus pleuropneumoniae serovar 1 str. 4074; identical to SEQ ID NO: 34671
  CDS (1)..(1845)

SEQ ID NO: 69256 - protein, 614 aa, Actinobacillus pleuropneumoniae serovar 1 str. 4074; identical to SEQ ID NO: 34672

SEQ ID NO: 69257 - DNA, 1764 bp, Haemophilus influenzae R2846; identical to SEQ ID NO: 34673
  CDS (1)..(1764)

SEQ ID NO: 69258 - protein, 587 aa, Haemophilus influenzae R2846; identical to SEQ ID NO: 34674

SEQ ID NO: 69259 - DNA, 1845 bp, Haemophilus influenzae R2846; identical to SEQ ID NO: 34675
  CDS (1)..(1845)

SEQ ID NO: 69260 - protein, 614 aa, Haemophilus influenzae R2846; identical to SEQ ID NO: 34676

SEQ ID NO: 69261 - DNA, 1764 bp, Haemophilus influenzae R2866; identical to SEQ ID NO: 34677
  CDS (1)..(1764)

SEQ ID NO: 69262 - protein, 587 aa, Haemophilus influenzae R2866; identical to SEQ ID NO: 34678

SEQ ID NO: 69263 - DNA, 1809 bp, Anabaena variabilis ATCC 29413; identical to SEQ ID NO: 34679
  CDS (1)..(1809)

SEQ ID NO: 69264 - protein, 602 aa, Anabaena variabilis ATCC 29413; identical to SEQ ID NO: 34680

SEQ ID NO: 69265 - DNA, 1776 bp, Synechococcus elongatus PCC 7942; identical to SEQ ID NO: 34681
  CDS (1)..(1776)

SEQ ID NO: 69266 - protein, 591 aa, Synechococcus elongatus PCC 7942; identical to SEQ ID NO: 34682

SEQ ID NO: 69267 - DNA, 2307 bp, Ralstonia eutropha JMP134; identical to SEQ ID NO: 34683
  CDS (1)..(2307)

SEQ ID NO: 69268 - protein, 768 aa, Ralstonia eutropha JMP134; identical to SEQ ID NO: 34684

SEQ ID NO: 69269 - DNA, 2070 bp, Exiguobacterium sp. 255-15; identical to SEQ ID NO: 34685
  CDS (1)..(2070)

SEQ ID NO: 69270 - protein, 689 aa, Exiguobacterium sp. 255-15; identical to SEQ ID NO: 34686

SEQ ID NO: 69271 - DNA, 1842 bp, Methylobacillus flagellatus KT; identical to SEQ ID NO: 34687
  CDS (1)..(1842)

SEQ ID NO: 69272 - protein, 613 aa, Methylobacillus flagellatus KT; identical to SEQ ID NO: 34688

SEQ ID NO: 69273 - DNA, 1746 bp, Dechloromonas aromatica RCB; identical to SEQ ID NO: 34689
  CDS (1)..(1746)

SEQ ID NO: 69274 - protein, 581 aa, Dechloromonas aromatica RCB; identical to SEQ ID NO: 34690

SEQ ID NO: 69275 - DNA, 1704 bp, Rhodobacter sphaeroides 2.4.1; identical to SEQ ID NO: 34691
  CDS (1)..(1704)

SEQ ID NO: 69276 - protein, 567 aa, Rhodobacter sphaeroides 2.4.1; identical to SEQ ID NO: 34692

SEQ ID NO: 69277 - DNA, 1662 bp, Burkholderia cepacia R18194; identical to SEQ ID NO: 34693
  CDS (1)..(1662)

SEQ ID NO: 69278 - protein, 553 aa, Burkholderia cepacia R18194; identical to SEQ ID NO: 34694

SEQ ID NO: 69279 - DNA, 1740 bp, Burkholderia cepacia R1808; identical to SEQ ID NO: 34695
  CDS (1)..(1740)

SEQ ID NO: 69280 - protein, 579 aa, Burkholderia cepacia R1808; identical to SEQ ID NO: 34696

SEQ ID NO: 69281 - DNA, 2001 bp, Bacillus cereus G9241; identical to SEQ ID NO: 34697
  CDS (1)..(2001): transl_table=11

SEQ ID NO: 69282 - protein, 666 aa, Bacillus cereus G9241; identical to SEQ ID NO: 34698

SEQ ID NO: 69283 - DNA, 1725 bp, Bacillus cereus G9241; identical to SEQ ID NO: 34699
  CDS (1)..(1725): transl_table=11

SEQ ID NO: 69284 - protein, 574 aa, Bacillus cereus G9241; identical to SEQ ID NO: 34700

SEQ ID NO: 69285 - DNA, 1761 bp, Bacillus cereus G9241; identical to SEQ ID NO: 34701
  CDS (1)..(1761): m means a or c, k means g or t/u

SEQ ID NO: 69286 - protein, 586 aa, Bacillus cereus G9241; identical to SEQ ID NO: 34702
  misc_feature (37)..(37): Xaa can be Arg or Ser
  misc_feature (221)..(221): Xaa can be Asn or Lys

SEQ ID NO: 69287 - DNA, 1755 bp, Bacillus cereus G9241; identical to SEQ ID NO: 34703
  CDS (1)..(1755): transl_table=11

SEQ ID NO: 69288 - protein, 584 aa, Bacillus cereus G9241; identical to SEQ ID NO: 34704

SEQ ID NO: 69289 - DNA, 1833 bp, Pseudomonas fluorescens PfO-1; identical to SEQ ID NO: 34705
  CDS (1)..(1833)

SEQ ID NO: 69290 - protein, 610 aa, Pseudomonas fluorescens PfO-1; identical to SEQ ID NO: 34706

SEQ ID NO: 69291 - DNA, 1794 bp, Pseudomonas fluorescens PfO-1; identical to SEQ ID NO: 34707
  CDS (1)..(1794)

SEQ ID NO: 69292 - protein, 597 aa, Pseudomonas fluorescens PfO-1; identical to SEQ ID NO: 34708

SEQ ID NO: 69293 - DNA, 1818 bp, Pseudomonas fluorescens PfO-1; identical to SEQ ID NO: 34709
  CDS (1)..(1818)

SEQ ID NO: 69294 - protein, 605 aa, Pseudomonas fluorescens PfO-1; identical to SEQ ID NO: 34710

SEQ ID NO: 69295 - DNA, 1659 bp, Pseudomonas fluorescens PfO-1; identical to SEQ ID NO: 34711
  CDS (1)..(1659)

SEQ ID NO: 69296 - protein, 552 aa, Pseudomonas fluorescens PfO-1; identical to SEQ ID NO: 34712

SEQ ID NO: 69297 - DNA, 1674 bp, Rhodospirillum rubrum; identical to SEQ ID NO: 34713
  CDS (1)..(1674)

SEQ ID NO: 69298 - protein, 557 aa, Rhodospirillum rubrum; identical to SEQ ID NO: 34714

SEQ ID NO: 69299 - DNA, 1719 bp, Rhodospirillum rubrum; identical to SEQ ID NO: 34715
  CDS (1)..(1719)

SEQ ID NO: 69300 - protein, 572 aa, Rhodospirillum rubrum; identical to SEQ ID NO: 34716

SEQ ID NO: 69301 - DNA, 2265 bp, Ralstonia metallidurans CH34; identical to SEQ ID NO: 34717
  CDS (1)..(2265)

SEQ ID NO: 69302 - protein, 754 aa, Ralstonia metallidurans CH34; identical to SEQ ID NO: 34718

SEQ ID NO: 69303 - DNA, 1695 bp, Burkholderia fungorum LB400; identical to SEQ ID NO: 34719
  CDS (1)..(1695)

SEQ ID NO: 69304 - protein, 564 aa, Burkholderia fungorum LB400; identical to SEQ ID NO: 34720

SEQ ID NO: 69305 - DNA, 1767 bp, Burkholderia fungorum LB400; identical to SEQ ID NO: 34721
  CDS (1)..(1767)

SEQ ID NO: 69306 - protein, 588 aa, Burkholderia fungorum LB400; identical to SEQ ID NO: 34722

SEQ ID NO: 69307 - DNA, 1764 bp, Enterococcus faecium; identical to SEQ ID NO: 34723
  CDS (1)..(1764)

SEQ ID NO: 69308 - protein, 587 aa, Enterococcus faecium; identical to SEQ ID NO: 34724

SEQ ID NO: 69309 - DNA, 1893 bp, Enterococcus faecium; identical to SEQ ID NO: 34725
  CDS (1)..(1893)

SEQ ID NO: 69310 - protein, 630 aa, Enterococcus faecium; identical to SEQ ID NO: 34726

SEQ ID NO: 69311 - DNA, 1812 bp, Magnetococcus sp. MC-1; identical to SEQ ID NO: 34727
  CDS (1)..(1812)

SEQ ID NO: 69312 - protein, 603 aa, Magnetococcus sp. MC-1; identical to SEQ ID NO: 34728

SEQ ID NO: 69313 - DNA, 1716 bp, Geobacter metallireducens GS-15; identical to SEQ ID NO: 34729
  CDS (1)..(1716)

SEQ ID NO: 69314 - protein, 571 aa, Geobacter metallireducens GS-15; identical to SEQ ID NO: 34730

SEQ ID NO: 69315 - DNA, 1809 bp, Geobacter metallireducens GS-15; identical to SEQ ID NO: 34731
  CDS (1)..(1809)

SEQ ID NO: 69316 - protein, 602 aa, Geobacter metallireducens GS-15; identical to SEQ ID NO: 34732

SEQ ID NO: 69317 - DNA, 1812 bp, Novosphingobium aromaticivorans DSM 12444; identical to SEQ ID NO: 34733
  CDS (1)..(1812)

SEQ ID NO: 69318 - protein, 603 aa, Novosphingobium aromaticivorans DSM 12444; identical to SEQ ID NO: 34734

SEQ ID NO: 69319 - DNA, 1689 bp, Microbulbifer degradans 2-40; identical to SEQ ID NO: 34735
  CDS (1)..(1689)

SEQ ID NO: 69320 - protein, 562 aa, Microbulbifer degradans 2-40; identical to SEQ ID NO: 34736

SEQ ID NO: 69321 - DNA, 2031 bp, Trichodesmium erythraeum IMS101; identical to SEQ ID NO: 34737
  CDS (1)..(2031)

SEQ ID NO: 69322 - protein, 676 aa, Trichodesmium erythraeum IMS101; identical to SEQ ID NO: 34738

SEQ ID NO: 69323 - DNA, 1833 bp, Trichodesmium erythraeum IMS101; identical to SEQ ID NO: 34739
  CDS (1)..(1833)

SEQ ID NO: 69324 - protein, 610 aa, Trichodesmium erythraeum IMS101; identical to SEQ ID NO: 34740

SEQ ID NO: 69325 - DNA, 1791 bp, Trichodesmium erythraeum IMS101; identical to SEQ ID NO: 34741
  CDS (1)..(1791)

SEQ ID NO: 69326 - protein, 596 aa, Trichodesmium erythraeum IMS101; identical to SEQ ID NO: 34742

SEQ ID NO: 69327 - DNA, 1665 bp, Streptococcus suis 89/1591; identical to SEQ ID NO: 34743
  CDS (1)..(1665)

SEQ ID NO: 69328 - protein, 554 aa, Streptococcus suis 89/1591; identical to SEQ ID NO: 34744

SEQ ID NO: 69329 - DNA, 1740 bp, Thiobacillus denitrificans ATCC 25259; identical to SEQ ID NO: 34745
  CDS (1)..(1740)

SEQ ID NO: 69330 - protein, 579 aa, Thiobacillus denitrificans ATCC 25259; identical to SEQ ID NO: 34746

SEQ ID NO: 69331 - DNA, 1767 bp, Thiobacillus denitrificans ATCC 25259; identical to SEQ ID NO: 34747
  CDS (1)..(1767)

SEQ ID NO: 69332 - protein, 588 aa, Thiobacillus denitrificans ATCC 25259; identical to SEQ ID NO: 34748

SEQ ID NO: 69333 - DNA, 1791 bp, Pseudomonas aeruginosa UCBPP-PA14; identical to SEQ ID NO: 34749
  CDS (1)..(1791)

SEQ ID NO: 69334 - protein, 596 aa, Pseudomonas aeruginosa UCBPP-PA14; identical to SEQ ID NO: 34750

SEQ ID NO: 69335 - DNA, 1749 bp, Exiguobacterium sp. 255-15; identical to SEQ ID NO: 34751
  CDS (1)..(1749)

SEQ ID NO: 69336 - protein, 582 aa, Exiguobacterium sp. 255-15; identical to SEQ ID NO: 34752

SEQ ID NO: 69337 - DNA, 1872 bp, Chloroflexus aurantiacus; identical to SEQ ID NO: 34753
  CDS (1)..(1872)

SEQ ID NO: 69338 - protein, 623 aa, Chloroflexus aurantiacus; identical to SEQ ID NO: 34754

SEQ ID NO: 69339 - DNA, 1860 bp, Chloroflexus aurantiacus; identical to SEQ ID NO: 34755
  CDS (1)..(1860)

SEQ ID NO: 69340 - protein, 619 aa, Chloroflexus aurantiacus; identical to SEQ ID NO: 34756

SEQ ID NO: 69341 - DNA, 1749 bp, Xylella fastidiosa Dixon; identical to SEQ ID NO: 34757
  CDS (1)..(1749)

SEQ ID NO: 69342 - protein, 582 aa, Xylella fastidiosa Dixon; identical to SEQ ID NO: 34758

SEQ ID NO: 69343 - DNA, 1752 bp, Bacillus brevis; identical to SEQ ID NO: 34759
  CDS (1)..(1752): transl_table=11

SEQ ID NO: 69344 - protein, 583 aa, Bacillus brevis; identical to SEQ ID NO: 34760

SEQ ID NO: 69345 - DNA, 1722 bp, Shigella flexneri; identical to SEQ ID NO: 34761
  CDS (1)..(1722): transl_table=11

SEQ ID NO: 69346 - protein, 573 aa, Shigella flexneri; identical to SEQ ID NO: 34762

SEQ ID NO: 69347 - DNA, 1695 bp, Campylobacter jejuni; identical to SEQ ID NO: 34763
  CDS (1)..(1695): transl_table=11

SEQ ID NO: 69348 - protein, 564 aa, Campylobacter jejuni; identical to SEQ ID NO: 34764

SEQ ID NO: 69349 - DNA, 1785 bp, Thermoanaerobacter thermosulfurogenes; identical to SEQ ID NO: 34765
  CDS (1)..(1785): transl_table=11

SEQ ID NO: 69350 - protein, 594 aa, Thermoanaerobacter thermosulfurogenes; identical to SEQ ID NO: 34766

SEQ ID NO: 69351 - DNA, 2160 bp, Lactobacillus sakei; identical to SEQ ID NO: 34767
  CDS (1)..(2160): transl_table=11

SEQ ID NO: 69352 - protein, 719 aa, Lactobacillus sakei; identical to SEQ ID NO: 34768

SEQ ID NO: 69353 - DNA, 1647 bp, Pseudomonas aeruginosa; identical to SEQ ID NO: 34769
  CDS (1)..(1647): transl_table=11

SEQ ID NO: 69354 - protein, 548 aa, Pseudomonas aeruginosa; identical to SEQ ID NO: 34770

SEQ ID NO: 69355 - DNA, 1815 bp, Streptomyces verticillus; identical to SEQ ID NO: 34771
  CDS (1)..(1815): transl_table=11

SEQ ID NO: 69356 - protein, 604 aa, Streptomyces verticillus; identical to SEQ ID NO: 34772

SEQ ID NO: 69357 - DNA, 1776 bp, Streptomyces glaucescens; identical to SEQ ID NO: 34773
  CDS (1)..(1776): transl_table=11

SEQ ID NO: 69358 - protein, 591 aa, Streptomyces glaucescens; identical to SEQ ID NO: 34774

SEQ ID NO: 69359 - DNA, 1851 bp, Haloarcula marismortui ATCC 43049; identical to SEQ ID NO: 34775
  CDS (1)..(1851): transl_table=11

SEQ ID NO: 69360 - protein, 616 aa, Haloarcula marismortui ATCC 43049; identical to SEQ ID NO: 34776

SEQ ID NO: 69361 - DNA, 1752 bp, uncultured bacterium 582; identical to SEQ ID NO: 34777
  CDS (1)..(1752): transl_table=11

SEQ ID NO: 69362 - protein, 583 aa, uncultured bacterium 582; identical to SEQ ID NO: 34778

SEQ ID NO: 69363 - DNA, 1824 bp, uncultured bacterium 580; identical to SEQ ID NO: 34779
  CDS (1)..(1824): transl_table=11

SEQ ID NO: 69364 - protein, 607 aa, uncultured bacterium 580; identical to SEQ ID NO: 34780

SEQ ID NO: 69365 - DNA, 2172 bp, Lactobacillus sakei; identical to SEQ ID NO: 34781
  CDS (1)..(2172): transl_table=11

SEQ ID NO: 69366 - protein, 723 aa, Lactobacillus sakei; identical to SEQ ID NO: 34782

SEQ ID NO: 69367 - DNA, 1767 bp, Pseudomonas aeruginosa; identical to SEQ ID NO: 34783
  CDS (1)..(1767): transl_table=11

SEQ ID NO: 69368 - protein, 588 aa, Pseudomonas aeruginosa; identical to SEQ ID NO: 34784

SEQ ID NO: 69369 - DNA, 1695 bp, Campylobacter jejuni; identical to SEQ ID NO: 34785
  CDS (1)..(1695): transl_table=11

SEQ ID NO: 69370 - protein, 564 aa, Campylobacter jejuni; identical to SEQ ID NO: 34786

SEQ ID NO: 69371 - DNA, 1653 bp, Pseudomonas aeruginosa; identical to SEQ ID NO: 34787
  CDS (1)..(1653): transl_table=11

SEQ ID NO: 69372 - protein, 550 aa, Pseudomonas aeruginosa; identical to SEQ ID NO: 34788

SEQ ID NO: 69373 - DNA, 2094 bp, Dictyostelium discoideum; identical to SEQ ID NO: 34789
  CDS (1)..(2094)

SEQ ID NO: 69374 - protein, 697 aa, Dictyostelium discoideum; identical to SEQ ID NO: 34790

SEQ ID NO: 69375 - DNA, 1860 bp, Vibrio cholerae non; identical to SEQ ID NO: 34791
  CDS (1)..(1860): transl_table=11

SEQ ID NO: 69376 - protein, 619 aa, Vibrio cholerae non; identical to SEQ ID NO: 34792

SEQ ID NO: 69377 - DNA, 1803 bp, Yersinia enterocolitica; identical to SEQ ID NO: 34793
  CDS (1)..(1803): transl_table=11

SEQ ID NO: 69378 - protein, 600 aa, Yersinia enterocolitica; identical to SEQ ID NO: 34794

SEQ ID NO: 69379 - DNA, 1767 bp, Proteus mirabilis; identical to SEQ ID NO: 34795
  CDS (1)..(1767): transl_table=11

SEQ ID NO: 69380 - protein, 588 aa, Proteus mirabilis; identical to SEQ ID NO: 34796

SEQ ID NO: 69381 - DNA, 1722 bp, Escherichia coli; identical to SEQ ID NO: 34797
  CDS (1)..(1722): transl_table=11

SEQ ID NO: 69382 - protein, 573 aa, Escherichia coli; identical to SEQ ID NO: 34798

SEQ ID NO: 69383 - DNA, 1728 bp, Bacillus subtilis; identical to SEQ ID NO: 34799
  CDS (1)..(1728): transl_table=11

SEQ ID NO: 69384 - protein, 575 aa, Bacillus subtilis; identical to SEQ ID NO: 34800

SEQ ID NO: 69385 - DNA, 2148 bp, Lactococcus lactis; identical to SEQ ID NO: 34801
  CDS (1)..(2148): transl_table=11

SEQ ID NO: 69386 - protein, 715 aa, Lactococcus lactis; identical to SEQ ID NO: 34802

SEQ ID NO: 69387 - DNA, 1773 bp, Lactococcus lactis; identical to SEQ ID NO: 34803
  CDS (1)..(1773)

SEQ ID NO: 69388 - protein, 590 aa, Lactococcus lactis; identical to SEQ ID NO: 34804

SEQ ID NO: 69389 - DNA, 1764 bp, Haemophilus influenzae; identical to SEQ ID NO: 34805
  CDS (1)..(1764): transl_table=11

SEQ ID NO: 69390 - protein, 587 aa, Haemophilus influenzae; identical to SEQ ID NO: 34806

SEQ ID NO: 69391 - DNA, 1749 bp, Pasteurella multocida; identical to SEQ ID NO: 34807
  CDS (1)..(1749): transl_table=11

SEQ ID NO: 69392 - protein, 582 aa, Pasteurella multocida; identical to SEQ ID NO: 34808

SEQ ID NO: 69393 - DNA, 1779 bp, Ralstonia solanacearum; identical to SEQ ID NO: 34809
  CDS (1)..(1779): transl_table=11

SEQ ID NO: 69394 - protein, 592 aa, Ralstonia solanacearum; identical to SEQ ID NO: 34810

SEQ ID NO: 69395 - DNA, 1770 bp, Xanthomonas axonopodis; identical to SEQ ID NO: 34811
  CDS (1)..(1770): transl_table=11

SEQ ID NO: 69396 - protein, 589 aa, Xanthomonas axonopodis; identical to SEQ ID NO: 34812

SEQ ID NO: 69397 - DNA, 1770 bp, Xanthomonas campestris; identical to SEQ ID NO: 34813
  CDS (1)..(1770): transl_table=11

SEQ ID NO: 69398 - protein, 589 aa, Xanthomonas campestris; identical to SEQ ID NO: 34814

SEQ ID NO: 69399 - DNA, 1770 bp, Xylella fastidiosa; identical to SEQ ID NO: 34815
  CDS (1)..(1770): transl_table=11

SEQ ID NO: 69400 - protein, 589 aa, Xylella fastidiosa; identical to SEQ ID NO: 34816

SEQ ID NO: 69401 - DNA, 1701 bp, Pseudomonas syringae; identical to SEQ ID NO: 34817
  CDS (1)..(1701): transl_table=11

SEQ ID NO: 69402 - protein, 566 aa, Pseudomonas syringae; identical to SEQ ID NO: 34818

SEQ ID NO: 69403 - DNA, 1755 bp, Streptomyces coelicolor; identical to SEQ ID NO: 34819
  CDS (1)..(1755): transl_table=11

SEQ ID NO: 69404 - protein, 584 aa, Streptomyces coelicolor; identical to SEQ ID NO: 34820

SEQ ID NO: 69405 - DNA, 1815 bp, Bacillus subtilis; identical to SEQ ID NO: 34821
  CDS (1)..(1815): transl_table=11

SEQ ID NO: 69406 - protein, 604 aa, Bacillus subtilis; identical to SEQ ID NO: 34822

SEQ ID NO: 69407 - DNA, 1728 bp, Bacillus subtilis; identical to SEQ ID NO: 34823
  CDS (1)..(1728): transl_table=11

SEQ ID NO: 69408 - protein, 575 aa, Bacillus subtilis; identical to SEQ ID NO: 34824

SEQ ID NO: 69409 - DNA, 23 bp, Primer
atggaacttcttgtacttgtctg

SEQ ID NO: 69410 - DNA, 21 bp, Primer
ttatgccgtccgggcaacggc

SEQ ID NO: 69411 - protein, 231 aa, consensus; identical to SEQ ID NO: 34827
  MISC_FEATURE (1)..(231): consensus for the disclosure of xaa see table XV

SEQ ID NO: 69412 - protein, 65 aa, consensus; identical to SEQ ID NO: 34828
  MISC_FEATURE (1)..(65): consensus for the disclosure of xaa see table XV

SEQ ID NO: 69413 - protein, 78 aa, consensus; identical to SEQ ID NO: 34829
  MISC_FEATURE (1)..(78): consensus for the disclosure of xaa see table XV

SEQ ID NO: 69414 - DNA, 1509 bp, Escherichia coli
  CDS (1)..(1509)
atgactgaaaaaaaatatatcgttgcgctcgaccagggcaccaccagctcccgcgcggtcgtaatggatcacgatgccaatatcattagcgtgtcgcagcgcgaatttgagcaaatctacccaaaaccaggttgggtagaacacgacccaatggaaatctgggccacccaaagctccacgctggtagaagtgctggcgaaagccgatatcagttccgatcaaattgcagctatcggtattacgaaccagcgtgaaaccactattgtctgggaaaaagaaaccggcaagcctatctataacgccattgtctggcagtgccgtcgtaccgcagaaatctgcgagcatttaaaacgtgacggtttagaagattatatccgcagcaataccggtctggtgattgacccgtacttttctggcaccaaagtgaagtggatcctcgaccatgtggaaggctctcgcgagcgtgcacgtcgtggtgaattgctgtttggtacggttgatacgtggcttatctggaaaatgactcagggccgtgtccatgtgaccgattacaccaacgcctctcgtaccatgttgttcaacatccataccctggactgggacgacaaaatgctggaagtgctggatattccgcgcgagatgctgccagaagtgcgtcgttcttccgaagtatacggtcagactaacattggcggcaaaggcggcacgcgtattccaatctccgggatcgccggtgaccagcaggccgcgctgtttggtcagttgtgcgtgaaagaagggatggcgaagaacacctatggcactggctgctttatgctgatgaacactggcgagaaagcggtgaaatcagaaaacggcctgctgaccaccatcgcctgcggcccgactggcgaagtgaactatgcgttggaaggtgcggtgtttatggcaggcgcatccattcagtggctgcgcgatgaaatgaagttgattaacgacgcctacgattccgaatatttcgccaccaaagtgcaaaacaccaatggtgtgtatgtggttccggcatttaccgggctgggtgcgccgtactgggacccgtatgcgcgcggggcgattttcggtctgactcgtggggtgaacgctaaccacattatacgcgcgacgctggagtctattgcttatcagacgcgtgacgtgctggaagcgatgcaggccgactctggtatccgtctgcacgccctgcgcgtggatggtggcgcagtagcaaacaatttcctgatgcagttccagtccgatattctcggcacccgcgttgagcgcccggaagtgcgcgaagtcaccgcattgggtgcggcctatctcgcaggcctggcggttggcttctggcagaacctcgacgagctgcaagagaaagcggtgattgagcgcgagttccgtccaggcatcgaaaccactgagcgtaattaccgttacgcaggctggaaaaaagcggttaaacgcgcgatggcgtgggaagaacacgacgaataa

SEQ ID NO: 69415 - protein, 502 aa, Escherichia coli
MTEKKYIVALDQGTTSSRAVVMDHDANIISVSQREFEQIYPKPGWVEHDPMEIWATQSSTLVEVLAKADISSDQIAAIGITNQRETTIVWEKETGKPIYNAIVWQCRRTAEICEHLKRDGLEDYIRSNTGLVIDPYFSGTKVKWILDHVEGSRERARRGELLFGTVDTWLIWKMTQGRVHVTDYTNASRTMLFNIHTLDWDDKMLEVLDIPREMLPEVRRSSEVYGQTNIGGKGGTRIPISGIAGDQQAALFGQLCVKEGMAKNTYGTGCFMLMNTGEKAVKSENGLLTTIACGPTGEVNYALEGAVFMAGASIQWLRDEMKLINDAYDSEYFATKVQNTNGVYVVPAFTGLGAPYWDPYARGAIFGLTRGVNANHIIRATLESIAYQTRDVLEAMQADSGIRLHALRVDGGAVANNFLMQFQSDILGTRVERPEVREVTALGAAYLAGLAVGFWQNLDELQEKAVIEREFRPGIETTERNYRYAGWKKAVKRAMAWEEHDE

SEQ ID NO: 69416 - DNA, 2409 bp, Cryptococcus neoformans var. neoformans JEC21
  CDS (46)..(2325)
tcagatttagaaatcttccactgctcacagcctcctttttcattaatgtctcgccccatagacctttctatgtcctcggtcaagaacccctcgccccttgcggcaggcggtaccggtggctttacccctgtcttcgaggcttctcctgccaattctcccgcaggttctcgtcgaccttctatctcacagcccacagctcgtcgcccttcagaagtctcgatttctcgtaggccttctgtaaatcaccaatacagtagctacgtctcgcaatatcctcaacaagggtctctttcccgacgatcatctatggcttccggcccgcgacctatccggcggggcgaatattctggacctgtcacgccgtctgtcctatctcgagctggttcgcctaccttgcccctcggtaacgaattcactcaagctccaaggtcatactatgagggtgcttcaggctacactcctttgggcggaacgcgggagttgcgtaatgggcaatttattggtagtctggattgtggtactacctctacgcgattcatcattttcgataagcgagcaaagattatcgcagagcatcaaaccgaattcgaacagattctccctcatgcaggttggcatgagcatgaccccgacgcgctagttgaagcgatgaacgaatgtatcatcaaagctgttgaaaagctcgaatggatgggctggtccagaaatagcatcaagggtattggtattaccaatcaacgagagacgactgtctgctggtcacgttctactggcaagcctctgtgtaatgctatcgtttgggatgatgcgcgaactatcaatgtggttcgtgagatggaaaagaagctcgacgaggagggcctggaaattgatgacgaggaggaggacgagatcaatcaaaagtctaaaattgtgccagacgaagttgagatgggaactggtacgcatgaggcagccttcggggagaaaggtgatgtcgtagatggtgataccagtatgactggcaaaattggaaaagcgatggagggtctcggcttgtcaggccgaggtaaagatggaaaggcgaaaaagtacagaaagggcaaggaaggtctggtggacgttaccggtattcctctctctacttacttttctgccatcaaacttcgatggatgttggatcatcaaaaggccgtccgaatcgcccatgaagctgatgatctgatgttcggtactgttgatacttggcttgtctataatttgaccggtgccaacaatggcggtctccatattattgacgttaccaatgcctctcgaacactccttatctctcttaaaacacttcgatggcacgctcctctccttcgcttcttcggccttcgagcttcgatccttccaaagatcgtgtcttcagccgaagtgtacggcaatatttctgattcacttggcctaccgctttccggtgttccaattgccggtattgttggtgaccaacaggccgcgctcgtcggcaacaaatgtttgatgaagggccaggccaagtgcacttatggtaccggtgctttcgtcttattcaacacgggcgaagacattgtgagaagcaactacggtctcatttctaccgtagcctttcaagcaggtgcggacagtaagcctgtatatgcattggaaggttctattgccgtggctggatcggccataaaatggctacgagaccaaatgacccttattgaagaatctgccgaaatggatatcctcgccggatcagtgtcggacactggaggtgtctattttgttaccgccttctctggccttcttgcgccgtattgggatcgtgaagcttctggcactatcattggtcttactggatacacaacttctgcccacattgcgcgggccacccttgaggctgtgtgtttccaaactcgcgcggttttagatgtcatcgagaaagagagtggtagcaggctcgacacactcaaggttgatggtggtgtgaccaactcagacttggctatgcaattgcaggctaacatcggtggcttcaacgttgcacgaccttcgatgcgcgagtctactgcgcttggttccgctttgctggccgctcatgctcttggtctgtttggttgggatctgacccgtccagaaactctcagtgaggtgaacaccgctggtgtccatacattcgagcccgagttggaggagaaagccagactgaagaagatcaagggatggaataaggctgttgatagggccaagaaatggcatgacatcgacgatgaggacgacgaagaagaagaatacgaaaacgaagccggatacgctaagatcatcgggtcggcttaagggagtgttcaagcaatggtgtgcaatagaattcggggggaacacgatagaaacttgcttgcctagactgacatttgtaacaca

SEQ ID NO: 69417 - protein, 759 aa, Cryptococcus neoformans var. neoformans JEC21
MSRPIDLSMSSVKNPSPLAAGGTGGFTPVFEASPANSPAGSRRPSISQPTARRPSEVSISRRPSVNHQYSSYVSQYPQQGSLSRRSSMASGPRPIRRGEYSGPVTPSVLSRAGSPTLPLGNEFTQAPRSYYEGASGYTPLGGTRELRNGQFIGSLDCGTTSTRFIIFDKRAKIIAEHQTEFEQILPHAGWHEHDPDALVEAMNECIIKAVEKLEWMGWSRNSIKGIGITNQRETTVCWSRSTGKPLCNAIVWDDARTINVVREMEKKLDEEGLEIDDEEEDEINQKSKIVPDEVEMGTGTHEAAFGEKGDVVDGDTSMTGKIGKAMEGLGLSGRGKDGKAKKYRKGKEGLVDVTGIPLSTYFSAIKLRWMLDHQKAVRIAHEADDLMFGTVDTWLVYNLTGANNGGLHIIDVTNASRTLLISLKTLRWHAPLLRFFGLRASILPKIVSSAEVYGNISDSLGLPLSGVPIAGIVGDQQAALVGNKCLMKGQAKCTYGTGAFVLFNTGEDIVRSNYGLISTVAFQAGADSKPVYALEGSIAVAGSAIKWLRDQMTLIEESAEMDILAGSVSDTGGVYFVTAFSGLLAPYWDREASGTIIGLTGYTTSAHIARATLEAVCFQTRAVLDVIEKESGSRLDTLKVDGGVTNSDLAMQLQANIGGFNVARPSMRESTALGSALLAAHALGLFGWDLTRPETLSEVNTAGVHTFEPELEEKARLKKIKGWNKAVDRAKKWHDIDDEDDEEEEYENEAGYAKIIGSA

SEQ ID NO: 69418 - DNA, 1494 bp, Thermococcus kodakaraensis
  CDS (1)..(1494)
atggaaaagttcgttctttctcttgacgagggtacaacttccgccagggcaataatcttcgacagggagagcaacatccacggaataggccagtatgagttcccccagcactatccaaggccgggatgggtcgagcacaatcccgaggagatatgggacgcccagctcagggcgataaaagatgccatccagagcgctagaatagagccgaatcagatagcggcgataggagttaccaaccagcgcgagacgacgcttgtatgggacaaagatggtaagccgctctacaacgcaatagtctggcagtgcagaagaacggctgaaatggttgaggagataaagcgtgagtacgggacgatgataaaggagaagaccggcctcgtccccgatgcctacttttctgcctcgaagctcaagtggctccttgacaacgttccaggtttaagggagaaggccgagaaaggcgaggtgatgttcggaacggtcgataccttcctcatctaccgccttacaggagagcacgttacggactattccaatgcctcaaggacgatgctcttcaacattaagaagctcgactgggacgatgagctccttgagctcttcgacattcctgagagcgttttacctgaggtcagggagtctagtgaagtttacggctacacaaagaaggagcttctcggggctgagattcccgtaagcggcgatgcaggtgaccagcaggcggccctcttcggacaggcggcgttcgaggcgggaatggtgaaggccacctatggtacggggagctttatcctcgtgaacacggacaagatggtgctctattcggacaacctgctcacgacgatagcatggggcctaaatggaagggtcagctacgccctcgaggggagcattttcgtaactggagcggcagtccagtggctcagagacggaataaaaatcataaagcatgcctctgagacagaggaactcgccacaaagcttgagagcaacgaaggcgtttatttcgttcccgccttcgttggtctaggggctccctactgggatcagtttgccaggggcattataatcggcataacgcgcggcacgggcagggagcatctcgcgagggcgacgcttgaggcgatagcataccttaccagggatgttgttgacgagatggaaaagctcgtccagatcaaggagctccgcgtcgatggtggcgccaccgcaaacgactttctcatgcagttccaggcggacatcttgaacagaaaggtgataaggcccgtcgtgaaggagacaacggctcttggcgccgcttacctcgcggggcttgccgttgattattgggcggacacgagagaaatagccgagctgtggaaggctgaaagaattttcgagccgaagatggatgagaaaactagggagagactctacaaaggctggaaagaagcagtaaagagggctatggggtgggcaaaggtcgttgatagtgcaaaatcaaattga

SEQ ID NO: 69419 - protein, 497 aa, Thermococcus kodakaraensis
MEKFVLSLDEGTTSARAIIFDRESNIHGIGQYEFPQHYPRPGWVEHNPEEIWDAQLRAIKDAIQSARIEPNQIAAIGVTNQRETTLVWDKDGKPLYNAIVWQCRRTAEMVEEIKREYGTMIKEKTGLVPDAYFSASKLKWLLDNVPGLREKAEKGEVMFGTVDTFLIYRLTGEHVTDYSNASRTMLFNIKKLDWDDELLELFDIPESVLPEVRESSEVYGYTKKELLGAEIPVSGDAGDQQAALFGQAAFEAGMVKATYGTGSFILVNTDKMVLYSDNLLTTIAWGLNGRVSYALEGSIFVTGAAVQWLRDGIKIIKHASETEELATKLESNEGVYFVPAFVGLGAPYWDQFARGIIIGITRGTGREHLARATLEAIAYLTRDVVDEMEKLVQIKELRVDGGATANDFLMQFQADILNRKVIRPVVKETTALGAAYLAGLAVDYWADTREIAELWKAERIFEPKMDEKTRERLYKGWKEAVKRAMGWAKVVDSAKSN

SEQ ID NO: 69420 - DNA, 1593 bp, Staphylococcus aureus subsp. aureus COL
  CDS (97)..(1593)
atgtttgattcatggattatgctattttttcgccaaaatttaacagattttgtacaatgggttagcgattattttttaataaaggagatactactaatggaaaaatatattttatctatagaccaaggaacaacaagctcaagagcgattttattcaatcaaaaaggggaaattgcaggggtagcacaacgtgagtttaagcaatattttccacaatcaggttgggttgaacatgatgcaaatgaaatttggacatctgtgttagctgtaatgacggaagtaattaatgaaaatgatgttagagctgatcaaattgcaggtatcggtattacaaaccaacgtgaaacaacggttgtttgggacaaacatactggccgcccaatttatcacgcaattgtttggcaatcacgtcaaacacaatcaatttgttcagaattaaaacaacaaggatatgaacaaacatttagagataagacaggattacttttagatccgtattttgcaggtacaaaagttaaatggattctagacaatgttgaaggtgcacgagaaaaagcagaaaatggcgatctattatttggaacgattgatacttggttagtatggaaattatcaggaaaagctgcgcatattactgattattcaaatgcgagtcgtacattaatgtttaatatccatgatttagaatgggacgatgagttattagaactacttacagtacctaaaaatatgttgccagaagttaaagcttcgagtgaagtatatggtaagacaattgattaccacttctatggtcaagaagtaccaatcgctggagtagctggtgatcaacaagcagcattatttggacaagcttgcttcgaacgtggtgacgtgaaaaacacatatggaactggtggcttcatgttaatgaatacaggtgacaaagcggttaaatctgaaagtggtttattaacaacaattgcttatggtattgatggaaaagtaaattatgcgcttgaaggttccatctttgtttcgggttcagcaatccaatggttacgtgatggattaagaatgattaattcagcaccacaatcagaaagttatgcgacacgagttgactctactgagggtgtttatgttgttccagcttttgtaggtttaggaacaccatattgggattctgaagcacgtggtgcgattttcggtttaacacgtggaactgaaaaagagcactttatccgtgcaactttagaatcactatgttaccaaactcgtgacgttatggaagcaatgtcaaaagactctggtattgatgtccaaagtttacgtgtcgatggtggtgcagttaaaaataactttattatgcagttccaagcagacattgttaatacttctgttgaaagacctgaaattcaagaaactacagctttaggtgctgcatttttggcaggtttagcagttggattctgggagagtaaagatgatatcgctaaaaactggaaattagaagaaaaattcgatccgaaaatggatgaaggcgaaagagaaaaattatatagaggttggaaaaaagctgttgaagcaacacaagtttttaaaacagaatag

SEQ ID NO: 69421 - protein, 498 aa, Staphylococcus aureus subsp. aureus COL
MEKYILSIDQGTTSSRAILFNQKGEIAGVAQREFKQYFPQSGWVEHDANEIWTSVLAVMTEVINENDVRADQIAGIGITNQRETTVVWDKHTGRPIYHAIVWQSRQTQSICSELKQQGYEQTFRDKTGLLLDPYFAGTKVKWILDNVEGAREKAENGDLLFGTIDTWLVWKLSGKAAHITDYSNASRTLMFNIHDLEWDDELLELLTVPKNMLPEVKASSEVYGKTIDYHFYGQEVPIAGVAGDQQAALFGQACFERGDVKNTYGTGGFMLMNTGDKAVKSESGLLTTIAYGIDGKVNYALEGSIFVSGSAIQWLRDGLRMINSAPQSESYATRVDSTEGVYVVPAFVGLGTPYWDSEARGAIFGLTRGTEKEHFIRATLESLCYQTRDVMEAMSKDSGIDVQSLRVDGGAVKNNFIMQFQADIVNTSVERPEIQETTALGAAFLAGLAVGFWESKDDIAKNWKLEEKFDPKMDEGEREKLYRGWKKAVEATQVFKTE

SEQ ID NO: 69422 - DNA, 1539 bp, Gluconobacter oxydans 621H
  CDS (1)..(1539)
atgagcaagaaagactgcatcctcgccattgatcagggcacgacctcgacccgcagcattgtcttcggaaaagatgcgcaggctctggccatttcccgccgcgagttcccgcagcattatcccgagctgggctgggttgagcacgatgtcgaggacatctggcgtgatgtgctcgccaccgcgcgcgagacgatcgaggaggtcggagggccggagcgcattgcggctctgggcattaccaaccagcgcgaaaccatcgtgatctgggaccgcgagacgggccgcgccatccatcgcgcgctcgtctggcaggaccgccgcacggcgcatgaatgcaacctcctgcgccagcagggcaaggaagccatggtccgtgaaaagacgggcctgctgctggatccctatttctcggcaagcaagatcgcctggctgctcgatcatgtccccgatgcccgtcgccgcgcggaagcgggcgaactggcggctggcacgatcgacagcttcctgctgtggcgtctgaccggcggcaagcgccatgcgacggacatcaccaatgcctgccgcacctcgctcttcaacatccacacgcaggaatgggacgaggagcttctgaagctcttcaatgtgccgcgcgcccttctgccggaagtctgcgacaacagcagcgatttcggtgagacggaagccaagctgttcggcgagaagatcgccatcggcggcatggcgggcgaccagcacgccgctgtcatcgggcaggcgtgcttccacgagggtatggccaaggcgacttacggcacgggctgcttcatgctgctcaacaccggcgagaagccgatcatgtccaacaaccgcctgctgaccacgatcgcctatcgcatcggcggcaagactttctacgcgctggaaggttccatcttcgtggcgggcgccggcatcaagtggctgcgtgacgggctgaagctgatcacgcatgcttcccagaccgacgatatggcgacccgcatcccggacagccatggcgtctacatggtgccggctttcgttggtcttggcgcccctcactgggacccggattcacgtggtctgatctgtggcctgacgcttggttccacgcaggcgcatatcgcgcgtgccatgctggaatccgtagcttaccagacctatgacctgatccgcgccatgcgtgaggacggggccatgcggaccagcatcctgcgcatcgacggaggcatggccgtcaatgactggttcgcccagttcctgtcctccatgctcaaggctgaggtcgagcgtccggtcaatatcgagaccacggcccttggcgccgccttcctggcgggtttgcaggtcggactgtggaagagcctggatgaagtcacggccacctggaagcaggagcgtgttttcgcaccgaagatggacccggcacagcgccggatcatgatcgatggctggcacgatgccgttcgccgcacgctgacacccagtgcgccggttgcgcattccagcgtggaaacgacagccagtcaggcggcttga

SEQ ID NO: 69423 - protein, 512 aa, Gluconobacter oxydans 621H
MSKKDCILAIDQGTTSTRSIVFGKDAQALAISRREFPQHYPELGWVEHDVEDIWRDVLATARETIEEVGGPERIAALGITNQRETIVIWDRETGRAIHRALVWQDRRTAHECNLLRQQGKEAMVREKTGLLLDPYFSASKIAWLLDHVPDARRRAEAGELAAGTIDSFLLWRLTGGKRHATDITNACRTSLFNIHTQEWDEELLKLFNVPRALLPEVCDNSSDFGETEAKLFGEKIAIGGMAGDQHAAVIGQACFHEGMAKATYGTGCFMLLNTGEKPIMSNNRLLTTIAYRIGGKTFYALEGSIFVAGAGIKWLRDGLKLITHASQTDDMATRIPDSHGVYMVPAFVGLGAPHWDPDSRGLICGLTLGSTQAHIARAMLESVAYQTYDLIRAMREDGAMRTSILRIDGGMAVNDWFAQFLSSMLKAEVERPVNIETTALGAAFLAGLQVGLWKSLDEVTATWKQERVFAPKMDPAQRRIMIDGWHDAVRRTLTPSAPVAHSSVETTASQAA

SEQ ID NO: 69424 - DNA, 1503 bp, Lactobacillus acidophilus NCFM
  CDS (1)..(1503)
atgaaagaaaaatacattttatcaattgatgaaggaacaacttcaactagagcaattatttttgatcataatggtaatgaaattgtctcagctcaaaaagaaatcacccaatactttccagaacctggctgggttgaacatgatgctaatgaaatttggatggccgtgcaaactacaatagctaatgcctttattcaatcaggtatttggccaggccagattgcagcaattggcattacgaaccagcgtgaaactgctgtggtttgggataaagataccggtaaaccaatttatcatgcaattgtctggcagtcacgtcaaacaactgatttagccgaaaaactgaaaaaagatggctacagcaacttaattagagaaaaaacaggtttgattgttgatccatatttcagtgcaactaaaattcgctggattcttgatcatgttccaggtgcacaagaaaaagcagaacaaggtaaattattatttggtacgattgatagctggcttgtttggaaattaactgatggtcaaaagcatgtaacggattatactaatgcttctagaaccatgttgtttaatattcataccttaaagtgggataaagaaattttgaatttgctcaatatcccagaaaaaatgttgccggaagttcgctcaaattcagaggtttatggaacaactgcatcatatatgttctttggtggagaagtgtcaatcgctggtatggcaggtgaccaacaagctgcattatttggtcaacttgctttaaagccaggtatggtgaaaaacacttatgggacaggtgcatttattgtgatgaatacaggcgataagccgacaacttctaacaataatttgcttactacgattggttatggcataaatggcaagattacttatgcgctggaaggctcaatattcgtagcaggtagtgcgattcaatggctgcgcgattcaatgaagctaatcaagaatgctcctgattctgaaaaggccgcatatgaatcaacttcagagaatgaagtctatgttgtacctgcatttacgggacttggtgcgccatattgggatgcggaagcacgtggtgcaatttttggtgttacacgtggaactactgacaaagatatgattaaagcaacgcttcaatcacttgcatatcagacgagagacgtagttgatacaatgcaaaaagactctggtattgatattccagctcttcgcgttgatggtggtgcaagtaacaataactatttgatgcaattccaagcagatattttaggtaaaaagattgaacgtaccaaggtgcttgaaacaactagtatgggtgccgcatttttagctggccttgctgtaggatactggaagaacattgatgaattgaagcacgtctttaccattggtcaggctttcgaacctaagatgggcgacctagaacgaaagaaattatacgatggctggcaacgtgcgattaaggctacacgagtttttgcacatggtgagtaa

SEQ ID NO: 69425 - protein, 500 aa, Lactobacillus acidophilus NCFM
MKEKYILSIDEGTTSTRAIIFDHNGNEIVSAQKEITQYFPEPGWVEHDANEIWMAVQTTIANAFIQSGIWPGQIAAIGITNQRETAVVWDKDTGKPIYHAIVWQSRQTTDLAEKLKKDGYSNLIREKTGLIVDPYFSATKIRWILDHVPGAQEKAEQGKLLFGTIDSWLVWKLTDGQKHVTDYTNASRTMLFNIHTLKWDKEILNLLNIPEKMLPEVRSNSEVYGTTASYMFFGGEVSIAGMAGDQQAALFGQLALKPGMVKNTYGTGAFIVMNTGDKPTTSNNNLLTTIGYGINGKITYALEGSIFVAGSAIQWLRDSMKLIKNAPDSEKAAYESTSENEVYVVPAFTGLGAPYWDAEARGAIFGVTRGTTDKDMIKATLQSLAYQTRDVVDTMQKDSGIDIPALRVDGGASNNNYLMQFQADILGKKIERTKVLETTSMGAAFLAGLAVGYWKNIDELKHVFTIGQAFEPKMGDLERKKLYDGWQRAIKATRVFAHGE

SEQ ID NO: 69426 - DNA, 1650 bp, Mus musculus
  CDS (1)..(1650)
atggcagaggctccaaaagcggttttggggccgttggtaggggcagtggaccaaggtaccagctcaacacgttttttggttttcaatccccaaacagctgaattactttgtcatcatcaagtggaaatagcccaggagttcccaaaagaaggatgggtagagcaagacccaaaggcaatcctgcagtctgtgtacgagtgtatagagaaagcatgtgagaaactcggacagcagagcattgatatttccaacataaaagctatcggtgtcaccaaccagcgggaaactacgatagtctgggacaagttcactggagaacctctctacaatgctgtggtgtggcttgacctaaggacccagtctactgtggagaatctcagcaaaagtatttcagtaagcaataactttgtcaagaacaagacaggccttccaatcagcacttattttagtgccgtgaaacttcactggctcattgaaaatgtgagaaaagtgcaaaaggctattgaagatggcagagctatttttgggacggttgattcgtggcttatctggtgtatgactggaggtatcaacggaggtgtccactgtacagatgtaagtaatgccagcaggaccatgcttttcaacattcactctttgcaatgggatgaagagctctgcgacttttttggaattccaatgaccatccttccccgaatccggagttcttctgagatctatggcctagtgaaaagtggcgtgttggaaggtgtgccaatatctggatgtctgggagaccagtctgctgctttggtgggacaactgtgtcttcaggacggacaagctaaaagcacatatggaacaggctgtttcttactatgtaacacaggccagaagtgtgtaaactctgaacatggccttctgaccacagtggcttaccagcttggcagacaggagcctgtctattatgccctggaaggttccgtagccatagccggtgctgttgttagctggataaaaaacaatcttcaaattattcagtcttcatcggaaattgaaaaacttgctgaagtagcagggacttcttatggttgttacttcgtcccagccttttcaggcttatacgctccatattgggacccaagtgcgagagggatcatctgcgggctcacccagttcaccaataagttccatattgcctttgctgcgttagaagctgtttgcttccaaacgcgggagattttggatgccatgaacagtgattgtggaatcccgctgacgcatttgcaggtagatggaggaatgaccgcaaacagagttctcatgcaactgcaggcggacattctgtgtattccggtgatgaaacctttcatgccagaaacaactgcactgggagtcgcaatggcagcgggagcggcagaaggagttagcgtgtggagtctggatcctaaggatttgtcaagtgtccagatggagaagtttgaaccccagatcaatgtcgaggaaagtgaaggtcgttacgccacatggaagaaagctgtgctgaagtcaatgggttgggttttgactcagtctcctgatggtcgcgaccctagtattttcagcagcctgacgctgggcttttatgtagtgagtagtatggtgatattaattggagcaaggtacatgtaa

SEQ ID NO: 69427 - protein, 549 aa, Mus musculus
MAEAPKAVLGPLVGAVDQGTSSTRFLVFNPQTAELLCHHQVEIAQEFPKEGWVEQDPKAILQSVYECIEKACEKLGQQSIDISNIKAIGVTNQRETTIVWDKFTGEPLYNAVVWLDLRTQSTVENLSKSISVSNNFVKNKTGLPISTYFSAVKLHWLIENVRKVQKAIEDGRAIFGTVDSWLIWCMTGGINGGVHCTDVSNASRTMLFNIHSLQWDEELCDFFGIPMTILPRIRSSSEIYGLVKSGVLEGVPISGCLGDQSAALVGQLCLQDGQAKSTYGTGCFLLCNTGQKCVNSEHGLLTTVAYQLGRQEPVYYALEGSVAIAGAVVSWIKNNLQIIQSSSEIEKLAEVAGTSYGCYFVPAFSGLYAPYWDPSARGIICGLTQFTNKFHIAFAALEAVCFQTREILDAMNSDCGIPLTHLQVDGGMTANRVLMQLQADILCIPVMKPFMPETTALGVAMAAGAAEGVSVWSLDPKDLSSVQMEKFEPQINVEESEGRYATWKKAVLKSMGWVLTQSPDGRDPSIFSSLTLGFYVVSSMVILIGARYM

SEQ ID NO: 69428 - DNA, 1503 bp, Agrobacterium rhizogenes
  CDS (1)..(1503): transl_table=11
atgaccggctatgttctggcgatcgaccaggggacgacgtcctcacgagccatcgtttacggccctgatgcccagccgatcgcgatcgatcaaaaagagatatcccagtcgtttccgaagtcgggttgggtcgagcacaacgccactgaaatctgggaatctgtccttcagacctcccgtaacgctcttgcgcgggccggcatagaggcgcgcgacgtcgcggcgatcggcataaccaatcagcgcgaaacatgcctcgtctgggagcggtcgacgggcaagccgatccatccagcgatcgtctggcaagaccggcggacctacggcgcctgcgaggtccttcgcgcagacggctttggccccctgatacaggaaaaaaccggtcttctgctcgatccctatttttccgccacgaaaatcgcctggatcctcgacaatgtcgagggcgcgcggcgcgcggccgagaacggccaactgctgtgcggcaccatcgacacctatctcacctggatgctcaccggcggcgccgtgcatgcgacggacgccaccaacgcgtcgcgcacctcgctgttcgacattcgtgagaattgctgggacgacgaattgctaggcgccttcagagtgccgcgggctcttttgcctgaggtcaaggattgtgctgacgatttcggtcagacgatcgccgcccatttcggcgctcaaattccgatccgggcgctcgccggcgaccagcaggccgccctgcttggtcaggcctgcctgaagcccggaatgctcaaatcgacttacggcacgggctgcttcgtcgttctgaataccggcgataagattgtccggtcgtccaaccgcctgctgtcgaccatcggctatcgcctcaatggcaaaacgacctacgcgcttgagggttcgatcttcatggcaggggccgcggttcaatggctgcgagactccctgaagctcatcaaggaggccgacgagacgggccgtcttgcgcatctggccgacgaacaggaagacgtctatctggtgccggcattcaccgggctcggtgcaccgcactggaattcgcaggctcgtggcgcgattttcggcctgacgagagggacggggatcgcggaactttcgcgggcgacgctggaatccgtctgctaccagacgcgcgatctccttgaggccatggcctgcgattacccgatggaggtcaggggcgcgacccttcgcgtcgacggcggcctgtcgggcagcgattgggccatgcaggcgctggccgattgcctgggcagcgtcatcgagcgatcgcaaagccaggaagcgaccgcttacggcgttgcggcacttgcgggcgctgagagcggcgtctggcccgatcttcagacctttgccgcgaactggaaggcaaagcgcagcttcacccccaacctcaacactgacgagcgggcgcgacgctatcggaaatggcgcgccgccgttgcaagcacgctttcctatgcggcaacggcgtga

SEQ ID NO: 69429 - protein, 500 aa, Agrobacterium rhizogenes
MTGYVLAIDQGTTSSRAIVYGPDAQPIAIDQKEISQSFPKSGWVEHNATEIWESVLQTSRNALARAGIEARDVAAIGITNQRETCLVWERSTGKPIHPAIVWQDRRTYGACEVLRADGFGPLIQEKTGLLLDPYFSATKIAWILDNVEGARRAAENGQLLCGTIDTYLTWMLTGGAVHATDATNASRTSLFDIRENCWDDELLGAFRVPRALLPEVKDCADDFGQTIAAHFGAQIPIRALAGDQQAALLGQACLKPGMLKSTYGTGCFVVLNTGDKIVRSSNRLLSTIGYRLNGKTTYALEGSIFMAGAAVQWLRDSLKLIKEADETGRLAHLADEQEDVYLVPAFTGLGAPHWNSQARGAIFGLTRGTGIAELSRATLESVCYQTRDLLEAMACDYPMEVRGATLRVDGGLSGSDWAMQALADCLGSVIERSQSQEATAYGVAALAGAESGVWPDLQTFAANWKAKRSFTPNLNTDERARRYRKWRAAVASTLSYAATA

SEQ ID NO: 69430 - DNA, 1482 bp, Archaeoglobus fulgidus DSM 4304
  CDS (1)..(1482): transl_table=11
gtggatagaggaggtgatttagtgcattttctcggcatcgatgcgggaacgacaggagtgactgtgggagtttacgatgccgatggaaatctggttgcaaagagctactccgagtttgaaacctactacccccagccgggatgggtcgagcaggatgccgagcactggtggaacagcatcatcgatgcctgcaggcaggcggtgaagattgccaaagcctctgacagcatagcagctatagctgttgcaaatcagagggaaacaatcgtccccgttggcagagacggtgagcctgtaagcagagcgatagtctggcaggacaggaggtgcagggaggaggttgagctgataaaggagagaatcggggaggaaagggttgcaaaaattaccggactaaagccggacccctacttctccctgccgaaaattctctggtggatgaggaacaggcctgaagtcatagagaaaagctggaagctgatgctcgtccacgactacatcgtttacaggctaaccggagaggttgtgacggactactcaaacgcctcaaggacgatgctcctcgacctgaattcgaggaagtggtgcgatgaaatcgctgccgaattcaaccttgacctgtctctgatgcctgatctcgtcaattcgggagaggttgtgggggagatcagggggaacgtggcggagaagcttggcataagttcgaatccggtagtggttgcaggtgggggagaccagcagtgctccgccctcgctcagggtgttgttgaggaggggagcgtgaagtccacgacgggaacggggaccttcatggttgcacctgtggagaaagtcagaggccacggagacatcatatactccgcccacgttctgcccggcatcaatgtgggcgaggtgagcatcttcaccacgggcagcctgctatcgtgggttaagaaagccttctatcacggtgagggctatgatgtgattaacgaggaggctgagaagtcaggagtgggggcgagaggtgtgttcatcctgcccttcttttccggagctggctgtccccactggaatccggaggcgaagggggttatattcggcttaactcttgcccacaacagaggagacattgcgagggctgtgatggaggcagtagctttcgaggtgagaagcaacattgaggtgatggagaataagggaatcagcattgaggagcttcgccttgatggcggagcagcgaacagcaggctttggaaccagatttttgctgacgttaccggcagaaaatgcctcgtttcatctgatgtggaagcgactgcgaggggggcggcaattcttgcagcttccggatctgacagcttcaatggtattgacgacgctcttacaaccttcctacccgatttcacagaggttatgccgtccgaggatgggatgggaaaatacgaggagatttatagcaaatatgtccagattagggatgcatacttgaaaggctga

SEQ ID NO: 69431 - protein, 493 aa, Archaeoglobus fulgidus DSM 4304
MDRGGDLVHFLGIDAGTTGVTVGVYDADGNLVAKSYSEFETYYPQPGWVEQDAEHWWNSIIDACRQAVKIAKASDSIAAIAVANQRETIVPVGRDGEPVSRAIVWQDRRCREEVELIKERIGEERVAKITGLKPDPYFSLPKILWWMRNRPEVIEKSWKLMLVHDYIVYRLTGEVVTDYSNASRTMLLDLNSRKWCDEIAAEFNLDLSLMPDLVNSGEVVGEIRGNVAEKLGISSNPVVVAGGGDQQCSALAQGVVEEGSVKSTTGTGTFMVAPVEKVRGHGDIIYSAHVLPGINVGEVSIFTTGSLLSWVKKAFYHGEGYDVINEEAEKSGVGARGVFILPFFSGAGCPHWNPEAKGVIFGLTLAHNRGDIARAVMEAVAFEVRSNIEVMENKGISIEELRLDGGAANSRLWNQIFADVTGRKCLVSSDVEATARGAAILAASGSDSFNGIDDALTTFLPDFTEVMPSEDGMGKYEEIYSKYVQIRDAYLKG

SEQ ID NO: 69432 - DNA, 1497 bp, Thermoplasma volcanium GSS1
  CDS (1)..(1497): transl_table=11
atggctagaagaccgattgatagtgacgatattttcctcgcacttgatgcgggtactacagacgttaaggcaggagcatatgatcgatcgatgaacctaatcgcttcatgcaaaaggagaataggggtatattatggccaaggcggtgtagttgaacaggatccacatgaaatactcgaagctgctaaatactgcctaaactcaatcttaaggcgcataccgaaaagatacggggaaccaaaggcaatcggtattacaaaccagagggaaagcgtcttggcctgggaacctattgatggaaggccgatcactaaactaataagctggaaggacaaaagaggagcccagttatctcttgatctgaaagagcgttatggtcaagtgataaaggataagacaggcttaataagcgatccctacttttccgccacaaaaataaagtggttggtcgaaaatattaaacggagctctaaccataaaaactacgttattacaacactggattcatggttggtcaaaaatcttaattcgagttcgattaaacctttaacggatcattccaacgcgtctagaactatgcttttcaatatagattcattggaatgggatagcgatcttctcgaaattgtaggtataagtgaagaaatcctgccggaggtaaaacggacaattgagtcagattcatatggaaaagtgaaattgacctacggttcaactacacgtgaagttccaatattatctgttgctggcgaccagcaagcttcgctttttgggaatggctgcctttatccaggtcaagccaaagcaagttatggaactggtgcatttattttggaaaacacgggagttagagtaaaatcggatcgtctattggagacgctattttacacatacaagggcaagaggacatacgctctagaaggaacaatcctttcttctggttcctcaatagattggctagtttccctcgctgggcttaagagcgtgccaagatccatattgagagcggaacaaatcgaaaggagtcatgttttatcagtgccagcattatcaggcttagggtcgccattttattctagcgacataaggggatacatttctgggctatcagaatcaacggatatatatgaagtaataaggtcttttctagaggcgcaggcgtttcttagtacggtgatcattgaagaaatgaggaaacatattaaactattagaaccgctgcacattgatggcggcctatcgaaaagtgacttaatagcagagatgcttgctaatttgcttgatatgaagataatacgcgaaaggaatgttgatgccaccatgaaaggcatagcaatgatgtctatgatcggctattacggtatcgatgaacggaaattaacggtcagtgctggaggcaaagaatttaaccctaatgacaagagggacgaaatagctgaaaaatttaattcttggcgttcattccttctttctgtgatatccaaaaaccaaggttaa

SEQ ID NO: 69433 - protein, 498 aa, Thermoplasma volcanium GSS1
MARRPIDSDDIFLALDAGTTDVKAGAYDRSMNLIASCKRRIGVYYGQGGVVEQDPHEILEAAKYCLNSILRRIPKRYGEPKAIGITNQRESVLAWEPIDGRPITKLISWKDKRGAQLSLDLKERYGQVIKDKTGLISDPYFSATKIKWLVENIKRSSNHKNYVITTLDSWLVKNLNSSSIKPLTDHSNASRTMLFNIDSLEWDSDLLEIVGISEEILPEVKRTIESDSYGKVKLTYGSTTREVPILSVAGDQQASLFGNGCLYPGQAKASYGTGAFILENTGVRVKSDRLLETLFYTYKGKRTYALEGTILSSGSSIDWLVSLAGLKSVPRSILRAEQIERSHVLSVPALSGLGSPFYSSDIRGYISGLSESTDIYEVIRSFLEAQAFLSTVIIEEMRKHIKLLEPLHIDGGLSKSDLIAEMLANLLDMKIIRERNVDATMKGIAMMSMIGYYGIDERKLTVSAGGKEFNPNDKRDEIAEKFNSWRSFLLSVISKNQG

SEQ ID NO: 69434 - DNA, 1569 bp, Arabidopsis thaliana
  CDS (1)..(1569)
atggcaaaagaaaatggatttataggatcaatcgatcaaggaaccaccagcaccagattcatcatttacgaccacgatgctcgtcctgttgcttctcatcaagtcgagttcactcagttctatcccgaagctggatgggtggaacacgatccaatggagatactggaaagtgtgaaagtgtgcattgcaaaggctctcgacaaagccactgccgatggacacaacgtcgacggtggcttgaaggccattgggcttacagatcagagagagactactgttgtttggagcaaatccactggccttcctctccacaaggctattgtctggatggatgctcgtaccagctccatctgcaggagactagagaaagaactctcgggaggaagatcccattttgtggagtcttgcggcttgccaataagcacatacttctctgccatgaagctgctttggctcatggagaatgtggatgatgtcaaagacgctatcaagaaaggggatgccatctttggcactatcgacacatggttgatctggaacatgactggcggtatcaatggcggccttcatgtcactgatgtcaccaatgcttcacggacaatgctcatgaacctcaaaaccttgagctgggaccaggacactttgaagacacttggcataccggctgaaatcttgcccaagattgtcagcaattcagaagtgattggagagatctgcaaaggctggcctattcccggtatcaagattgctggatgtcttggtgatcagcatgctgcgatgttggggcaagcttgcagaaaaggcgaggcgaagagtacttatggcacaggtgctttcattcttctcaacaccggagaagtgccaatcaaatcaggtcatggtcttctgaccacgttggcctacaagctcggtcctcaagcacagacaaactatgcattggagggttcgattgccatagcaggagctgctgttcagtggcttagagacagccttgggataatcaaaagcgcctctgagatcgaagatttggcagcaatggtagattctacaggaggagtgtactttgtgccagcgttcaacggcttgtttgctccttggtggagagaagacgcacgtggtgtgtgcattggaatcacgaggttcaccaacaagtctcacattgctcgggctgtgctggagagcatgtgtttccaggtgaaagacgtccttgactccatgaacaaagatgcaggtgaaaagggttcccttaataacgggaaaggggagttcttgctcagagttgatggtggtgccacagctaacaaccttctgatgcagattcaggctgatctgatgggaagtccggtggtgaggccagtggacatagagacaacagcattaggagcagcctatgcagctggattagctgtgggattctggaaggaagcagacatattcgagtcgggagagaaggcgaagaactccaaagttttcagacccgctatggaagaaggaatcaggaagaagaaagtggcgtcttggtgcaaagcggtggaaagaacatttgatctcgctgacctctctatctaa

SEQ ID NO: 69435 - protein, 522 aa, Arabidopsis thaliana
MAKENGFIGSIDQGTTSTRFIIYDHDARPVASHQVEFTQFYPEAGWVEHDPMEILESVKVCIAKALDKATADGHNVDGGLKAIGLTDQRETTVVWSKSTGLPLHKAIVWMDARTSSICRRLEKELSGGRSHFVESCGLPISTYFSAMKLLWLMENVDDVKDAIKKGDAIFGTIDTWLIWNMTGGINGGLHVTDVTNASRTMLMNLKTLSWDQDTLKTLGIPAEILPKIVSNSEVIGEICKGWPIPGIKIAGCLGDQHAAMLGQACRKGEAKSTYGTGAFILLNTGEVPIKSGHGLLTTLAYKLGPQAQTNYALEGSIAIAGAAVQWLRDSLGIIKSASEIEDLAAMVDSTGGVYFVPAFNGLFAPWWREDARGVCIGITRFTNKSHIARAVLESMCFQVKDVLDSMNKDAGEKGSLNNGKGEFLLRVDGGATANNLLMQIQADLMGSPVVRPVDIETTALGAAYAAGLAVGFWKEADIFESGEKAKNSKVFRPAMEEGIRKKKVASWCKAVERTFDLADLSI

SEQ ID NO: 69436 - DNA, 1449 bp, Thermotoga maritima MSB8
  CDS (1)..(1449): transl_table=11
atgaaatatgttctctctctcgatcaaggtacaacaagctccagagcgatcgttttcgatgaaaaaggaaacgtggtatcgaaagtcaacaaagaattcagacagatctatccaagaccggggtgggtagaacacgatcccgtggagatttgggaatcacagatcgaagtggcaaagaaagctatcgaagaagcagggataaaaccagaagacatcgccgcaataggtatcacaaaccagagggaaacaaccatcgtctgggacaaaaacaccggaaaaccagtttacaacgccatagtctggcagtgtagaagaaccgctcccatctgtgatgagctgaaggaaaaaggatactcagagttcattcgagaaagaactggtcttgtcatcgatgcgtacttttctggaacaaagatcaagtggattctcgacaacgtcgagggagtgagagaaaaggcagagaaaggagaagttctctttggaacagttgacacctggctcatatggaatctcacaggtggaagggttcacgtcacggactattcgaacgcttccagaacgatgatcttcaatatccacaaactcgattgggacgatgaaatcctggaacttctaaacataccgagggcaatgcttccacaggtgatgccgtcgagtcacgtgtacggttacacagcaaaggatatcttcggagtggaaatacctatagctggagacgcaggggatcaacaggcggcactgtttgggcaagcctgcttccagccaggcatgttgaaaaacacttacggaacaggatgtttcctcctcatgaacaccggagaaaaagcctttgaatcgaaatccggtcttctcacaaccatcgcgtggggaataaacgggaaggtttactatgccctcgaaggcagcatattcatcactggcgccgctgtgcaatggctaagggacggtctgaagatcatctcaaacgccgcagaaaccgaagaactcgctacaaaagtgccggacaacggaggagtgttcttcgttcccgccttcgtcggactcggtgctccctactgggacatgtacgctcgaggtttgatcataggcataaccagaggtaccaccagagagcatatagtgagggccgttcttgagtcgatcgcctaccagacaagagacgtggtagaggtcatggaaaaagacagcgatataaaggtggaaaccctccgggtcgatggtggagccgttgtgaacaacttcctgatgcagtttcaggctgacatactcggggttcctgtggagcgccccgttgtaaacgaaacgacggcacttggagctgcttaccttgcagggctcgcagttgggtactggaaagatcaggaagagatagcttctctctggcaactcgacagaagatttgaaccttctatgaattccgaagaaagagagaggctgtattcaaaatga

SEQ ID NO: 69437 - protein, 482 aa, Thermotoga maritima MSB8
MKYVLSLDQGTTSSRAIVFDEKGNVVSKVNKEFRQIYPRPGWVEHDPVEIWESQIEVAKKAIEEAGIKPEDIAAIGITNQRETTIVWDKNTGKPVYNAIVWQCRRTAPICDELKEKGYSEFIRERTGLVIDAYFSGTKIKWILDNVEGVREKAEKGEVLFGTVDTWLIWNLTGGRVHVTDYSNASRTMIFNIHKLDWDDEILELLNIPRAMLPQVMPSSHVYGYTAKDIFGVEIPIAGDAGDQQAALFGQACFQPGMLKNTYGTGCFLLMNTGEKAFESKSGLLTTIAWGINGKVYYALEGSIFITGAAVQWLRDGLKIISNAAETEELATKVPDNGGVFFVPAFVGLGAPYWDMYARGLIIGITRGTTREHIVRAVLESIAYQTRDVVEVMEKDSDIKVETLRVDGGAVVNNFLMQFQADILGVPVERPVVNETTALGAAYLAGLAVGYWKDQEEIASLWQLDRRFEPSMNSEERERLYSK

SEQ ID NO: 69438 - DNA, 1416 bp, Pseudomonas aeruginosa PAO1
  CDS (1)..(1416): transl_table=11
atgcgaatcgccgccctcgaccagggaaccaccagtacccgcgtgctggtcgccagccaggacggcagcgccgatattcagttggcgctgcgtcaccagcaacaccatccgcagtccggctgggtcgagcacgatccgctggaactgctggccaacctgcaacgctgcctggaggccagcggccgggtcgacgccatcggcctcgccaaccagggcgaaagctgcatggcctgggacgcccgcagcggcgagccgttgtcgccgctgatcgtctggcaggacaaccgcaccaccccgcacatcgagcgtctacgcgccagcggcgccgaggcgctggtcctggaacgcagcggcctgccgctcgacgcctatttctcggccagcaagctgggctggatcgtcgagcaccttccggccgctcgcagggctttgaaggcaggccgcctgcgcctgggaaccagcgatgcctggtttctcgaccgcttgtgcggaaccttcgccaccgacgtcaccaccgcctcgcgtaccgcattgatgaacctcgccgagggccgctgggaccccgacctgtgcgccctgttcggcgtgccgatcgagtgcctgccggaaatccgcgataccgtcggccatttcggggtgatcggcaacaccccgctgacggcctcggtggtcgaccagcaggcctcgctctacggtcacggctgccgccagcccggtgatgcgaagatcaccttcggcaccggcgccttcgccctgactctcagcggcgagcggatcatccgctcgccggagacaggcctgctcgccaccatcgcctggcagatcgatggcaaaccggtgtacgccatggacggcggggtctacgacgccagcgccgcggtcgagtgggccgggcgtctcggcctgttcagcgacttctcggaactggccggcttcgaccggccgccggccatcgagcgcggcctggccttcgtcccggccctgtcgggactcgcatgcccgcactgggaccgcagcgccggcgcgatgtggctgggaatggacgccggcacccgccgcgaggacctctgccaggccctgctcgaaggcgtggtgctgcgcagcgccgaggtgatccaggcgatggacggctacctgaaggtcaccgaccgcctgtccatcgacggcggcctggcgcgcagcccctacttcgcccagttcctcgccgacagcctgcaacggcgcatcgtcacccagcgcttcgacgaactcaccgccttcggttgcgccgcccttgccgcacgtggcctcggccacgaactggcggagccgcgcaacactcgcacggagttccagccgcgggtcgacgccggcaccgcccggcgctggcaggtgcgtttcagcgaagcggtggcgcgcacccgcggctggcgctga

SEQ ID NO: 69439 - protein, 471 aa, Pseudomonas aeruginosa PAO1
MRIAALDQGTTSTRVLVASQDGSADIQLALRHQQHHPQSGWVEHDPLELLANLQRCLEASGRVDAIGLANQGESCMAWDARSGEPLSPLIVWQDNRTTPHIERLRASGAEALVLERSGLPLDAYFSASKLGWIVEHLPAARRALKAGRLRLGTSDAWFLDRLCGTFATDVTTASRTALMNLAEGRWDPDLCALFGVPIECLPEIRDTVGHFGVIGNTPLTASVVDQQASLYGHGCRQPGDAKITFGTGAFALTLSGERIIRSPETGLLATIAWQIDGKPVYAMDGGVYDASAAVEWAGRLGLFSDFSELAGFDRPPAIERGLAFVPALSGLACPHWDRSAGAMWLGMDAGTRREDLCQALLEGVVLRSAEVIQAMDGYLKVTDRLSIDGGLARSPYFAQFLADSLQRRIVTQRFDELTAFGCAALAARGLGHELAEPRNTRTEFQPRVDAGTARRWQVRFSEAVARTRGWR

SEQ ID NO: 69440 - DNA, 1551 bp, Xylella fastidiosa 9a5c
  CDS (1)..(1551): transl_table=11
ttgcgctgcaccaagaccacgcaccctgtccgtatcgaaaacactgcactgatgaaaaaaaaatacatactggccattgaccaaggcaccaccagctcccgggccattctgtttgaccaaaaaggccacatcgccgggatggcacagcgggaattcacccagatatttccccaacctggctgggtcgaacacaacccgcgcgacatcatgaccagtgtgtacaccacgatcaccgaactgctcaacaacacccagattgacgtgcgcgccatcgccggaatcggtattaccaaccaacgcgaaacaaccgtcatctgggatcgtcagaccggccaaccgatctacaacgcaatcgtttggcaatcacgccaaaccaaggacatctgcgaccaactcacgaccgccggataccaagatctggttcacgccaaaaccggactcctgatcgacgcctatttttcaggcaccaaggtgaaatggattctagaccatgtcgaaaacgcacatacacaagcaacacgcggagaattggcattcggcaccatcgacacctggatcatctggaacctaaccggcggccaagtccatgtcaccgattacagcaacgcctcacgcaccctgctgtacgacatccacgccctgcgttgggatccagacctgctgacaatgctcgacataccagcggcgatcctgccggacgtccgttcatccagcgacatttacggcctcacccaaaccccgtatttccacggagaacagataccgattgccggaatcgccggtgatcagcaagccgcactcttcggccaagcctgtttcgaacctggcatggccaaaaacacctacggcaccggctgtttcatgctgatgcacaccggcaaaaaagccgtggaatccaaaaatggactactcactacgatcgcttggggcctgaatggagaaatcgagtacgcactagaaggctcgatcttcgtcgctggctctgtggtgcaatggctgcgcgatggattacgcatgttcggcaaagccagcgattcacaagcctacgccgaccgtgtcagcgacaacggcggcgtgtacgttgtaccggccttcgttggcctgggtgcgccctactggcgcagcgatgtccgtggcgcagtgttcggactgacacgcagcaccaccaaggaacacttcatccgtgccgcactagaatcaatggcctaccaaacccgcgacgtcctgagcgcaatgcaggcagatgcaggcatggaactcaaagagctacgcactgacggcgcggcaatcaccaatgacttcatggcccaattccagagcgatatcctcgccgtgccggtgctgcgctcggagatcgccgaaaccacagcactcggtgccgcctacctggctggacttgcaaccggattttggtccagccgcgaagagattacgcaacactgggccatcaatctctgcttcaagccgcagatggacaagcaacaacgcgagcacctatacgcaggctggaaacaggccgtcgcagccaccttaggcttccgtgtggcctga

SEQ ID NO: 69441 - protein, 516 aa, Xylella fastidiosa 9a5c
MRCTKTTHPVRIENTALMKKKYILAIDQGTTSSRAILFDQKGHIAGMAQREFTQIFPQPGWVEHNPRDIMTSVYTTITELLNNTQIDVRAIAGIGITNQRETTVIWDRQTGQPIYNAIVWQSRQTKDICDQLTTAGYQDLVHAKTGLLIDAYFSGTKVKWILDHVENAHTQATRGELAFGTIDTWIIWNLTGGQVHVTDYSNASRTLLYDIHALRWDPDLLTMLDIPAAILPDVRSSSDIYGLTQTPYFHGEQIPIAGIAGDQQAALFGQACFEPGMAKNTYGTGCFMLMHTGKKAVESKNGLLTTIAWGLNGEIEYALEGSIFVAGSVVQWLRDGLRMFGKASDSQAYADRVSDNGGVYVVPAFVGLGAPYWRSDVRGAVFGLTRSTTKEHFIRAALESMAYQTRDVLSAMQADAGMELKELRTDGAAITNDFMAQFQSDILAVPVLRSEIAETTALGAAYLAGLATGFWSSREEITQHWAINLCFKPQMDKQQREHLYAGWKQAVAATLGFRVA

SEQ ID NO: 69442 - DNA, 1524 bp, Agrobacterium tumefaciens str. C58
  CDS (1)..(1524): transl_table=11
ttgcgtctgaaagggagtgacataatgggcggttatattctggcgatcgatcaggggacgacatcgacgaggtcgatggtctttgatcgcgacatgcgggtgatcggtgtcggccagcgagaatttccgcagcatttcccggcctccggctgggtcgagcacgatgccgaagatatctggaaaagcgtgctcgaaaccatccggctggcgcttgccgatgccggcatcgccgcatccgatattgcagcaatcggcatcacaaaccagcgtgaaacaaccgtgctgtgggaccgcaacaccggcgaggccgtgcatcgcgccgtggtctggcaggatcgtcgcgccgcgccggtctgcgaggacctgaagcgccgagggctggagccgctgttttcgaaaaagaccggactgctgctcgatccctatttttccggcaccaagctgaaatggcttctcgatagcgtcagcggccttcgcgaaaaagccgtgaagggagaaatctgcttcggcaccgtcgacagtttcctgatctatcgcctgactggcggccggcgtcatgtgactgacgccactaatgcctcccgtaccttgatctacaacatcgaagacaacgcctgggatgacgaattgctgtctatccttaacattccccgcgccatgctgccggaggtgctggactgcgctgccgatttcggcgtgacggataaggcgcttctcggtgcggaaattccaatcctcggtgtggccggcgatcagcaggccgccgttatcggcaatgcctgcttcgagccgggcatgatgaaatctacctatggcacgggctgctttgcccttctcaataccggcacagaccgggtggcatccaccaaccggttgctaacgacgattgcttaccgcctcgatggcgtgacgacctatgcgcttgaaggttcgatcttcattgccggcgccgccgtgcaatggctgcgtgacgaacttggtttcatctcggttgcgtctgaagtcagcgcgctcgccgaaaaggccgatcccaagcagcgggtttatctcgtgccggcctttaccggccttggcgcgccttattgggatgccgaggcccgcggagcgattttcggcctgacgcgcggtacgggacctgcggaatttgcccgcgcggcgctcgaaagcgttgcctaccagacgttcgatctcctggacgccatgcgcaaggactgggcgggtgacaatggcaagacggtgctgagggtggatggcggcatggtcgcttccgattggaccatgcagcggctggcggatattcttgccgccccggtcgatcgtccggtctttctggaaacgaccattctgggcgcagcctggcttgcggcctcccgcgccggcatctggccggaccgcaaggcctttgccgaccattggcgccgtgaccgccgcttcagccccgacatggaagaaagcgagcggaagaacgcgatcgcgggctggcgtgacagcgttggccgttgcctctcgaaacgggacaattga

SEQ ID NO: 69443 - protein, 507 aa, Agrobacterium tumefaciens str. C58
MRLKGSDIMGGYILAIDQGTTSTRSMVFDRDMRVIGVGQREFPQHFPASGWVEHDAEDIWKSVLETIRLALADAGIAASDIAAIGITNQRETTVLWDRNTGEAVHRAVVWQDRRAAPVCEDLKRRGLEPLFSKKTGLLLDPYFSGTKLKWLLDSVSGLREKAVKGEICFGTVDSFLIYRLTGGRRHVTDATNASRTLIYNIEDNAWDDELLSILNIPRAMLPEVLDCAADFGVTDKALLGAEIPILGVAGDQQAAVIGNACFEPGMMKSTYGTGCFALLNTGTDRVASTNRLLTTIAYRLDGVTTYALEGSIFIAGAAVQWLRDELGFISVASEVSALAEKADPKQRVYLVPAFTGLGAPYWDAEARGAIFGLTRGTGPAEFARAALESVAYQTFDLLDAMRKDWAGDNGKTVLRVDGGMVASDWTMQRLADILAAPVDRPVFLETTILGAAWLAASRAGIWPDRKAFADHWRRDRRFSPDMEESERKNAIAGWRDSVGRCLSKRDN

SEQ ID NO: 69444 - DNA, 1467 bp, Thermoplasma acidophilum DSM 1728
  CDS (1)..(1467): transl_table=11
gtggatgctaatgggcgtatcgtctcatttgcctacagattgaacagacagtattttcctgcgccgggatgggttgaacaggatcccgtgaatctctggcgcaatgtgaggatcacgctgaagaaggccatagaggaatccagaattgatttgactggcattgcttcggctggcgtgacgaaccagcgcgagactgtcctcgtatgggatcgtaagactggccggccgctctacaacgcgattgtatggcaggataaacgaacatccaggaggataaaggatctcgatgaggagacttcaaattcgataatgaaaaccaccgggttgagacctgattcatatttctcggcttcaaagatacagtggctgctggaaaatgtcgagggccttaggaaaaagatggccgatggtgatgtctcattcggaactgtagactcgtggatcatctggaatctgaacggttccgtaaatagaagcatcaccgttacggaccacagcaatgcatccagaaccatgttatatgatatagctaagctgaggtggaatccagatctgctcgacatatttggtggaatatctgaaacttcgctgcctgaggttatgtcgtcaggatctgctgagtacggctacatctcaaaggatacttcagcgatattcgatgggcgggaagtgcccattaccgccgatataggggatcagcagtcggctctctttgggcagggatgtttcaatccaggcgacgtgaaggcaacgtatggaactggaacctttatcctttccaatgcaggaaccgaggttccgcagacctccggaactctgctcagaaccatattctattccatatctggcagggagttgagttatgcgctcgaagggagcatacttgcatctggatcagtgctcagatggcttcagaacagtctccatctattccgatcagccaaggatatagaggatgccgcagaaaagctgaagagcaatgatggagtatactttgtcccggcattctccggccttggttctccatactgggatcaggacgcgagaggactgttcattgggcttactgagagcacgaccgccgatcatctggccagatccgtactggaatctgaagtttatatggccaccgacgtgattatggaaatagaaaaggagatcggaaggaatatagcgaagataaggtgcgatgggggcggatcaagaagcgattttctgatgcagtttcaggccgacattgctaatgcggaggtgctcgtacccgaatcatcggaaactacggccctgggatcagcttacctatccggccttgtatccggcttatggaagagcaaggatgaaatacgcgagctctggaggctcaagaaggtgtataggccagtgatgtcagaagaggaaaggaaaaggaactatgtgggatggaaggatgccgtaaagagatgcatgggatggcatcctaatatataa

SEQ ID NO: 69445 - protein, 488 aa, Thermoplasma acidophilum DSM 1728
MDANGRIVSFAYRLNRQYFPAPGWVEQDPVNLWRNVRITLKKAIEESRIDLTGIASAGVTNQRETVLVWDRKTGRPLYNAIVWQDKRTSRRIKDLDEETSNSIMKTTGLRPDSYFSASKIQWLLENVEGLRKKMADGDVSFGTVDSWIIWNLNGSVNRSITVTDHSNASRTMLYDIAKLRWNPDLLDIFGGISETSLPEVMSSGSAEYGYISKDTSAIFDGREVPITADIGDQQSALFGQGCFNPGDVKATYGTGTFILSNAGTEVPQTSGTLLRTIFYSISGRELSYALEGSILASGSVLRWLQNSLHLFRSAKDIEDAAEKLKSNDGVYFVPAFSGLGSPYWDQDARGLFIGLTESTTADHLARSVLESEVYMATDVIMEIEKEIGRNIAKIRCDGGGSRSDFLMQFQADIANAEVLVPESSETTALGSAYLSGLVSGLWKSKDEIRELWRLKKVYRPVMSEEERKRNYVGWKDAVKRCMGWHPNI

SEQ ID NO: 69446 - DNA, 1491 bp, Caulobacter crescentus CB15
  CDS (1)..(1491): transl_table=11
atggcgcaagacctgatcctggccctggaccagggcaccaccagcacgcgcgccatcctgttcgatcgggcggggacggccctgggcgacgcctcgcgtcctctgcgtcaaagctatccggccgacggctgggtcgagcatgacgccgaggagatctacgccgccgccgtcgctgtgctgcgcgaggtcaccgaggcctccgggcggatggcggacatcgctgcgatcggcgtcaccaaccagcgcgagaccgtggtcgtctgggatcgggctacgggccgtccgatccatccagccatcgtctggcaggatcgccgcaccgctgacgtctgcgcgcgcctcaaggccgaggggcatgagccgagggtgaccgaggttacgggcctgctgctcgacccctatttctcggcgaccaagatcgcctggatcctcgacaagacacccggcgccagggcccgggcggaggccggcgagcttttgtgcggcaccatggactgctgggtgatctggcgactgacgggtggcgccgtgcacgcgaccgacgccaccaacgcttctcgaaccttgctgttcgatatcggcgctcaggcctggtcgagcgagatgctggcgttgttcaatgtgccctcgacgatcctgcccaaggtgctggactgcgtcgacgactatggcgcgacgcaggccgacatcctgggccgcgaggtccccattcggggcgtggcgggcgatcagcaggcggcgctgatggggcagggctgtgtcgctccgggccagatgaaggccacctacggcaccggctgcttcatgctgatcaatacggggactgaccgcgccgtctcgcgggcgcgcctgttgaccaccgtcgcggcgcgggtcggcggcaagacgacctacgcgctggaagggtcgatcttcgttgcaggcgcggcgatccagtggctgggcgaggggctcggaatcacgggcggtccccgcgccgctgaggcgctggcccgggcggccaagccggatcacgcggtggtggtggttcccgcgttcacgggtcttggcgccccctggtgggacgccgaggcgcggggtgggatcttcggtctgacgcgcgatgcaggactacccgagatcgccgccgccaccttcgacgcctgtgcgctgcagagccgcgacctgatcgaggcgatgcgcgccgatgcgcccacggcctttggcgaagcggcgcaactgcggatcgacggcggtatggccaagagcgcctggttctcgcagcggctggccgatctcacggggctctcggtgcgccgcgccagctatcaggagaccacggccctgggggcggcgttgttcgccgccgtcggcgcgggtctctacgggtcgatcgaagaggccgccgaagccagtccagccgccgagaccttagcgccggccatggacgaccatgtgcgggaagccgcctacgcccgttggctcgacgcggtgccgcgcgttcgactttag

SEQ ID NO: 69447 - protein, 496 aa, Caulobacter crescentus CB15
MAQDLILALDQGTTSTRAILFDRAGTALGDASRPLRQSYPADGWVEHDAEEIYAAAVAVLREVTEASGRMADIAAIGVTNQRETVVVWDRATGRPIHPAIVWQDRRTADVCARLKAEGHEPRVTEVTGLLLDPYFSATKIAWILDKTPGARARAEAGELLCGTMDCWVIWRLTGGAVHATDATNASRTLLFDIGAQAWSSEMLALFNVPSTILPKVLDCVDDYGATQADILGREVPIRGVAGDQQAALMGQGCVAPGQMKATYGTGCFMLINTGTDRAVSRARLLTTVAARVGGKTTYALEGSIFVAGAAIQWLGEGLGITGGPRAAEALARAAKPDHAVVVVPAFTGLGAPWWDAEARGGIFGLTRDAGLPEIAAATFDACALQSRDLIEAMRADAPTAFGEAAQLRIDGGMAKSAWFSQRLADLTGLSVRRASYQETTALGAALFAAVGAGLYGSIEEAAEASPAAETLAPAMDDHVREAAYARWLDAVPRVRL

SEQ ID NO: 69448 - DNA, 1509 bp, Salmonella typhimurium LT2
  CDS (1)..(1509): transl_table=11
atgactgaaaaaaaatatatcgttgcgctcgaccagggtaccaccagctcccgcgcggtcgttatggatcatgacgcgaatatcgtcagcgtatcacagcgtgaatttgagcaaatttatcctaagccaggctgggtagaacacgacccgatggaaatttgggcgtcccaaagctcaacgctggtagaagtgctggctaaggccgatatcagttccgatcagattgccgctatcggtatcaccaaccaacgtgaaaccgcgatcgtctgggaacgtgaaaccggcaaaccgatatacaacgctattgtctggcagtgccgtcgtaccgccgatatttgcgaacagcttaaacgcgacggcctggaagattacatccgcgacaataccggtctggtcgtcgacccgtacttctctggcactaaagtgaaatggatccttgaccatgtggaaggttcgcgcgaacgcgcgaagcgtggcgagctgctgttcggtacggtggatacctggcttatctggaagatgacgcagggccgcgtccacgttacggattacaccaacgcctcacgaaccatgctgttcaacatccatgatttggactgggacgataagatgctggacgtgctggatatcccacgcgcgatgctgccccaggtacgtaagtcctccgaagtctacggccagaccaatattggcggtaaaggcggtacacgtattcctatcgccgggattgccggggatcagcaggccgcgttattcggtcaactgtgcgtaaaggaaggaatggcaaagaatacctacggcaccggctgctttatgctgatgaacaccggcgagaaagcggtaaaatcggaaaacggcctgctgatcaccatcgcctgcggcccaagcggcgaagtcaactatgcgctggaaggcgcggtgtttatggcgggagcgtccattcaatggctgcgtgatgaaatgaagctcatcagcgacgcgttcgactccgaatatttcgccacgaaagtgaaagataccaacggtgtctacgtggttccggccttcaccggtctgggcgcgccgtactgggacccgtatgcccgcggcgccatttttggcctgacccgcggcgtgaactctaatcacattatccgcgcgacgctcgaatccatcgcttaccagacccgcgacgtactggaagcgatgcaggccgactccggtatccgcctgcacgctctgcgtgtggacggcggcgcagtggccaacaacttcctgatgcagttccagtcagatattctcggcacgcgggtggaacgcccggaagtgcgcgaagtgaccgcgctgggcgccgcctatctggctggcctggccgtcggttactggcagaacctggacgagctgcaggaaaaagccgtcattgagcgagaattccgccccggcattgaaaccaccgagcgtaactaccgttacagcggctggaagaaagcggttaaacgcgcaatggcgtgggaagagcacgacaagtaa

SEQ ID NO: 69449 - protein, 502 aa, Salmonella typhimurium LT2
MTEKKYIVALDQGTTSSRAVVMDHDANIVSVSQREFEQIYPKPGWVEHDPMEIWASQSSTLVEVLAKADISSDQIAAIGITNQRETAIVWERETGKPIYNAIVWQCRRTADICEQLKRDGLEDYIRDNTGLVVDPYFSGTKVKWILDHVEGSRERAKRGELLFGTVDTWLIWKMTQGRVHVTDYTNASRTMLFNIHDLDWDDKMLDVLDIPRAMLPQVRKSSEVYGQTNIGGKGGTRIPIAGIAGDQQAALFGQLCVKEGMAKNTYGTGCFMLMNTGEKAVKSENGLLITIACGPSGEVNYALEGAVFMAGASIQWLRDEMKLISDAFDSEYFATKVKDTNGVYVVPAFTGLGAPYWDPYARGAIFGLTRGVNSNHIIRATLESIAYQTRDVLEAMQADSGIRLHALRVDGGAVANNFLMQFQSDILGTRVERPEVREVTALGAAYLAGLAVGYWQNLDELQEKAVIEREFRPGIETTERNYRYSGWKKAVKRAMAWEEHDK

SEQ ID NO: 69450 - DNA, 1515 bp, Caenorhabditis elegans
  CDS (1)..(1515)
atggcagacgacagtgaaaacttcgtattaacagttgatattggcaccacaaccatccgatcagtagtttatgactcaaaatgcaaagaacgcggcagttatcaagaaaaggtcaacactatctacacgacgagaaatgatgatgaagtgctagttgaaattgagccggagcaattgtttcttcagtttttgcgtgttatcaagaaagcttatgaaacactcccaccaaatgcacacgttgacgttggtctttgcactcagcgaaactcaattgtcctttggaacaaaaggacactaaaggaagagacacgtataatctgctggaacgataaaagggctaacaacaaatgtcacaacttgaataactcgtttcttttgaaggcaacacaacgcctcaaatttctgggtggcatggtgtcccatcgactgatggtcactattgatagatctgaaaagctgaagctaatgaaggctgatggagatctttgctacggatctctagaaacctggctacttatgcggtcttcaaaatctaatatactttgtgtagaggcttcaaatatttctccttcaggaatgtttgatccctggattggtgcttacaatactttgatcatgaaaatcattgggtttccaacagacatgctttttcctatcgttgattccaatttgaaagacatgaacaaacttcctatcattgatagttctcatattggaaaagaatttaccatatcctcaattattgctgatcaacaggcagcaatgtttggatgcggaacatgggagcgaggcgatgtgaagatcactttaggaactggtacatttgtcaatgttcatacaggaaaagttccctatgcttcaatgtcaggtctatatccactcgttggatggagaatcaacggggagacggatttcattgccgagggaaacgctcatgacacagctgtaattttgcattgggctcagtcgattggactcttcaatgatgtgacggagacttcagacattgctctatcagtgaatgattccaatggagtagtgttcatcccagcattctgtggaattcaaactccaatcaatgatgagacggcgtgttcaggatttatgtgtatccgacctgacactacaaaagtacacatggtccgtgcaattctggagtcaattgctttccgtgtttatcaaatctacgctgctgccgagtcggaggttaacattaacaaaaactctccagtcagaatttgtggaggagtttcgaataacaattttatctgccagtgcattgctgatcttttgggacgtaaagtcgaaagaatgactgattctgatcacgttgctgctcgcggtgttgctcttctgacgggattctccagtggaatatggactaaagaaaaactacgagagcttgttacagttgaagacattttcacacctaattatgaatctagaaaaggtctactaaaaacctttcaaacatggaaaaaggcagttgatcgatgtcttggtttttatcattga

SEQ ID NO: 69451 - protein, 504 aa, Caenorhabditis elegans
MADDSENFVLTVDIGTTTIRSVVYDSKCKERGSYQEKVNTIYTTRNDDEVLVEIEPEQLFLQFLRVIKKAYETLPPNAHVDVGLCTQRNSIVLWNKRTLKEETRIICWNDKRANNKCHNLNNSFLLKATQRLKFLGGMVSHRLMVTIDRSEKLKLMKADGDLCYGSLETWLLMRSSKSNILCVEASNISPSGMFDPWIGAYNTLIMKIIGFPTDMLFPIVDSNLKDMNKLPIIDSSHIGKEFTISSIIADQQAAMFGCGTWERGDVKITLGTGTFVNVHTGKVPYASMSGLYPLVGWRINGETDFIAEGNAHDTAVILHWAQSIGLFNDVTETSDIALSVNDSNGVVFIPAFCGIQTPINDETACSGFMCIRPDTTKVHMVRAILESIAFRVYQIYAAAESEVNINKNSPVRICGGVSNNNFICQCIADLLGRKVERMTDSDHVAARGVALLTGFSSGIWTKEKLRELVTVEDIFTPNYESRKGLLKTFQTWKKAVDRCLGFYH

SEQ ID NO: 69452 - DNA, 1617 bp, Drosophila melanogaster
  CDS (1)..(1617)
atggattctcccacaaccgaaacgacaccgcctccacccacgctatctggtccattcgttggggctattgacgagggaaccacttccgcgcgatttattatatttcgtgcgggcactgacgaaattgtgtgctttcatcagattgaagtggagtctattttccagaaggagggatggtgcgagcaggatcccatggccatagtgaatacggtcaacgagtgcatcaccggtgcctgcaagaaacttgtggccgtgggcgggaaggttgaggaaataatcacgattggaataacaaaccaacgcgagtccacagtcgtatgggatagaaactccggccaaccgctggtgaacgctatcatctggctagacaatcgtaccaccagcacggtggaggagcttttggagactattccgaacaatgccaggaacatcaactacctgcgcccattgtgcggacttcctctgtctccgtacttttcgggcgtgaaactacgctggcttcgagacaacgtgccggttgtcagccaggctatggagaagggcacggccatgtttggcaccatcgacacctggctaatgtataatcttacgggcgggaaggactgtggtgtccacaagacggatgtgaccaacgcttcgcgcactatgctcatgaacatcgagacccttcagtgggatgccaacttgctaaagttctttgggctgcccaagaccattttgccggagatctgctcgagctcagagttctatggcagcattgcgcagggcgttctgcaaggcataggcataacatcggttctgggcgaccagcaagccgctctagtgggtcaacaatgcctggccaaaggtcaggccaaagccacttatggcactggatgttttctgctttataacacaggaccttcaattgtacactcaacgcacggattactaacgactgttggctaccaactaggacggaaggcagtcccattttacgcccttgagggaagcgtgtccattgccggtgcagcattcaactggctgcgcgacaacatgaaccttattcaaaactcggggcagatcgaaaccatggctagcactgtggacaactctcttgacgtatacttcgtaccagctttcaatggactctacgccccctactggaatcaggacgctcgcggtgtcatttgtggactgagtgaagaaacaacaagtgagcacatagtaagagccaccctggaagcagtttgtttccaggtccgtgatattctcgattcgatgcacaaggactgcaagattccactggccaagcttatggtagacgggggcatgactgtgaataatctgttcctgcagcttcaatccgacctagtaggaattcaagtactccgggcgaagatcgcagagacaacagcgctgggagctgcaatggcagcctacaaagccgttgaaaaccgataccaaatggaggctccactctctaaatctggcccccgagaagccataaagccatcgatcagtgccaccgatcgcaacctgcgctaccaaaagtggaaaatggctatcgatcgttcactgaactgggagacttcgacgcttccacagggcgaacgggaggcctttgacggagcgtga

SEQ ID NO: 69453 - protein, 538 aa, Drosophila melanogaster
MDSPTTETTPPPPTLSGPFVGAIDEGTTSARFIIFRAGTDEIVCFHQIEVESIFQKEGWCEQDPMAIVNTVNECITGACKKLVAVGGKVEEIITIGITNQRESTVVWDRNSGQPLVNAIIWLDNRTTSTVEELLETIPNNARNINYLRPLCGLPLSPYFSGVKLRWLRDNVPVVSQAMEKGTAMFGTIDTWLMYNLTGGKDCGVHKTDVTNASRTMLMNIETLQWDANLLKFFGLPKTILPEICSSSEFYGSIAQGVLQGIGITSVLGDQQAALVGQQCLAKGQAKATYGTGCFLLYNTGPSIVHSTHGLLTTVGYQLGRKAVPFYALEGSVSIAGAAFNWLRDNMNLIQNSGQIETMASTVDNSLDVYFVPAFNGLYAPYWNQDARGVICGLSEETTSEHIVRATLEAVCFQVRDILDSMHKDCKIPLAKLMVDGGMTVNNLFLQLQSDLVGIQVLRAKIAETTALGAAMAAYKAVENRYQMEAPLSKSGPREAIKPSISATDRNLRYQKWKMAIDRSLNWETSTLPQGEREAFDGA

SEQ ID NO: 69454 - DNA, 1470 bp, Agrobacterium tumefaciens str. C58
  CDS (1)..(1470): transl_table=11
atgcgcgctattctgtccatcgatcagggcaccaccaattccaaggccatactcgtctcggaaagcggagagttgctcgcgcgcggctcatcgccggtcggcattacctatccgcagcccggctgggtggaacaggacccgaaccgtatctgggcctcggtccgtgaagcgatctccgcctgcctcgcagccgcaccctccgacgtcagcgtcgaagccatcgccatctcaaaccagcgcgaatcggtcacaatctgggacggtgaaaccggcgagccgcttggcccggtgctaagctggcaatgccgccgcaccgcacaggactgcgcagacctgatcgcaaagggacaatcagaacgcgtcatggccctgaccggcctgccgatcgacccgatgtttcccggcgctaagatgcgctggctgctggaacgggcgccgaaaggccgcaagcttcgcctcggcaccatagatagctggctcatccattgcttcaccggcggcaaggttcatgcctgcgacgcctcaaacgcagcccgcagccaggtgctcgatctcaaccggcaggtctggagcgacgagctctgtgacctcttcggcatcgatatcaatgccctgccggacctgcgcgacagcagcggcgacttcggcgtgacatcaggcgttcccggcatcaaggatggcacgccgatcctcgcggccatcggcgacagccacgccgccctcttcggccatggcgctttcaaccccggagacggtaaagtgaccttcggcaccggctcgtcggtcatgacgacgctgccgcatttcatcgcgcctgagcgcggcatcaccacaacggttgcatggcggctcggcggcaaaccgaccttcgcctttgaaggcaatattctcgtttcggcagcctccctgccatggatgacggacattctcggcctgccggatgtcgccgcgctggtggaactcgccgccacggccgaaccggaggggccggggtttgtgccggcctttgtcggccttggcgcgccctattgggataccaacgcgcgcgcgctgttttcgcaaatcaatttcagcaccacccgcgcccagatggcccgggcggtcaccgattccatcgcctttcaggtccacgacgtcttcgccgccatgcgcgcgcagtcgccttccggtttcgggcgcctcttcgtggatggcgggccgagccagaaccgtttcctgatgcaatgcgtcgccgatatgctggaacaccccgtcattcagcgcgatgcgccggaagcctccgccctcggcgctgcctatctcgccggcctggccctcggtgtctggagtgatcttaatgccatcgcagcgttgaatagcaacgggaacaccatcgcgacttcaaccggtgaaagccgtcagcggctcggcatctggcgcgatgcgattgctcgctcgaccttgcccgtaacctcgggtaatggtgaataa

SEQ ID NO: 69455 - protein, 489 aa, Agrobacterium tumefaciens str. C58
MRAILSIDQGTTNSKAILVSESGELLARGSSPVGITYPQPGWVEQDPNRIWASVREAISACLAAAPSDVSVEAIAISNQRESVTIWDGETGEPLGPVLSWQCRRTAQDCADLIAKGQSERVMALTGLPIDPMFPGAKMRWLLERAPKGRKLRLGTIDSWLIHCFTGGKVHACDASNAARSQVLDLNRQVWSDELCDLFGIDINALPDLRDSSGDFGVTSGVPGIKDGTPILAAIGDSHAALFGHGAFNPGDGKVTFGTGSSVMTTLPHFIAPERGITTTVAWRLGGKPTFAFEGNILVSAASLPWMTDILGLPDVAALVELAATAEPEGPGFVPAFVGLGAPYWDTNARALFSQINFSTTRAQMARAVTDSIAFQVHDVFAAMRAQSPSGFGRLFVDGGPSQNRFLMQCVADMLEHPVIQRDAPEASALGAAYLAGLALGVWSDLNAIAALNSNGNTIATSTGESRQRLGIWRDAIARSTLPVTSGNGE

SEQ ID NO: 69456 - DNA, 1791 bp, Drosophila melanogaster
  CDS (1)..(1791)
atgtccaacggtcgttacgggagattcggagcactcatcggcgtcgcctgcgtgagcagcacccactgccgctttctgatatactcaacgaaaaatgccgaggtcctggcctaccatgagctgaagctgcgacagattgtccaccaggcgggctggatggagtacgatccgtcggagatatggaagaacacacaggagtgcatagagaccgcctataagaacctggttatactagagatcaatccacgtgatattattgccatcggtatcgtaaatcagcggggcacctcggtgttatggaatttggagacgggacagccactgcacaatgccatcggatggtcagattgccgtagcactcccatcctaaagaccctgctccataatgtccggcacaatgtggactacgtgaggtatcgcagtggcttgcccctgagcagctgtttcagtgccctaaagatccgttggctaatggatcacgttcctgccgtagccactgccattgaggagaacaagtgcttattcggcaccttggactcctggcttctgtggaacctaaccggcggcgttgagatgggtgtgcactctactgacattaccaatgcccactacacttcccttatgaacgtgtccacagagcagtgggatcctaaactctgccagttctttcgattgcccctgaacatactgccacgcatacgatccaactccgaaatcttcggctatgtgctggagggtcctttgcatggcactcccatagcggccatgatgggtgagcagcccgcaagtttgttgggccaactctgcgtgaaggccgggcaaaatgtctgtaccctggacgacagctgtttcgtgctccttaacacgggcagggagaagctggactctgcaaacggactgataacgggcatagcgcacaagctgggcgaaaaagcggccactaactacacactcgagggagccatttcaaatgccggttccacggttacatggctgcgggataagctacagatcaatactgagattaattccaatgataatgtggtggagtctttgaatacattcatcggcgagaactcgatgatctcgtcctcttgttcctcatccatgctgaatgccgagtgtggactggcagccaagaggtcggagattacgtttgtgccggcatttcatggcatgtacgcaccctactggcgacacgatgccaggggcataatcttgggacttaccagccagactacagcggaaaacattacccaagctgcttacgaggccaccgggttccagatctttgaagtgctacaggcgttcaagcgcgatacacccaactgggaccgatccagcatgcaacccgtgctgacattcggcggtgattacgccgaaaacttgcatttggtgcagttcatagcagatattattggctatatgttggagcgtccacagaccacctcacctgctggattgggcgttatgataaccgcgggcgtgacgatgaaagtggtgtccctggagcacgccgtaaaaatgtacaccccgcccactgatgtcttttcgccaacaactaccaaaaatcgtcgagagctgctctacaagcgctgggcttatgcggtaaagaaatgcctgcactggaacaactacgagacgtacgaggctgatattgagctgtttgctcagcgagaacttgatcccaatttacctgtaaggcgttccgtaccgggcagtatattcctgaccacttcttttgcgatgattatcctggctaactacttaaagtccaatcccctgaaatag

SEQ ID NO: 69457 - protein, 596 aa, Drosophila melanogaster
MSNGRYGRFGALIGVACVSSTHCRFLIYSTKNAEVLAYHELKLRQIVHQAGWMEYDPSEIWKNTQECIETAYKNLVILEINPRDIIAIGIVNQRGTSVLWNLETGQPLHNAIGWSDCRSTPILKTLLHNVRHNVDYVRYRSGLPLSSCFSALKIRWLMDHVPAVATAIEENKCLFGTLDSWLLWNLTGGVEMGVHSTDITNAHYTSLMNVSTEQWDPKLCQFFRLPLNILPRIRSNSEIFGYVLEGPLHGTPIAAMMGEQPASLLGQLCVKAGQNVCTLDDSCFVLLNTGREKLDSANGLITGIAHKLGEKAATNYTLEGAISNAGSTVTWLRDKLQINTEINSNDNVVESLNTFIGENSMISSSCSSSMLNAECGLAAKRSEITFVPAFHGMYAPYWRHDARGIILGLTSQTTAENITQAAYEATGFQIFEVLQAFKRDTPNWDRSSMQPVLTFGGDYAENLHLVQFIADIIGYMLERPQTTSPAGLGVMITAGVTMKVVSLEHAVKMYTPPTDVFSPTTTKNRRELLYKRWAYAVKKCLHWNNYETYEADIELFAQRELDPNLPVRRSVPGSIFLTTSFAMIILANYLKSNPLK

SEQ ID NO: 69458 - DNA, 1440 bp, Streptomyces coelicolor A3(2)
  CDS (1)..(1440)
atgccggacgcggtactcgccgtcgaccagggcacgtccggcaccaaggcgctggtgatctgccccgaacggggcgtcgtcggcaccggattcgccgaggtccggccccgctacctgcccggcggcctggtcgaggtggacccggaggagctgtacggctcggtggtcgacgccgggcaccgggcgctcgccgacgccggcgagccggtcaccgcgctgggcctggccaaccagggcgagacggtgctcgcctgggacccggacaccggccgcccgctcaccgacgcactggtctggcaggaccgcagggcggcatccctctgtgccgaactcggcgaccacgcggacgaactgcgccacctcaccggcctgcccctggacccgtacttcgccgcaccgaaaatggcctggatacgacggcacctcacccgcgagggacaggtcaccacctccgacagctggctggtccaccgcctcaccggcgcccacgtcacggacgccgcgaccgcctcccgcacccagctcctcgacctcgaccgcgtcgagtggtcgccgcgcgccctggagctgtacggcctgaccggcgaacggctcccggccgtcgtggacaacgccgcccacgtcggcacggtgcgggccttcgggcccgaactcccgctcaccggactcgccgtcgaccagcaggccgcgctgctcgcccagcgcgtcaccgaacccggcaccgccaagtgcacctacggcaccggcgccttcctcctcgcccacaccggcggcacaccgcgccggggcgcctcgggcctggccgcctgcgtcgcctggcggctcggcggccgcgccgaccactgcctggacggccaggtgtacaccgccgcctccgccgtacgctggctcaccggcctcggcgtcatcaccggcgccgccgacctcgaccccgtgggcgccacggtgcccgacaccggcggcgtcaccttcgtcccggcactggccgggctggccgccccctggtggcgcggcgacctgcgcggctcgctcaccggcctcggcctggacaccgcccccgggcacctggtgcgcgccctgtgcgagggcctcgccgcccaggtcgccgaactcgccgacgccgccgcggccgacctcggcaccccgctgacggtcctgcgcgtcgacggcggcctcacccgctccgcgctcctcatgcagacccaggccgacctgctgcaacgccccgtcgaggtgtccgcgctgcccgacgccaccgcgctcggcgtcggcaccctcgcccggctcggcgcggaccccgcccgcaccctcgccgaggtgctccccggcgccggacccaccaccgtgtacgagccccgcatcaccaccgacgaggccaccgagcgccgcacccgcttccgcggggcggtcaccgcgctgctcgccgggggccccgcgtga

SEQ ID NO: 69459 - protein, 479 aa, Streptomyces coelicolor A3(2)
MPDAVLAVDQGTSGTKALVICPERGVVGTGFAEVRPRYLPGGLVEVDPEELYGSVVDAGHRALADAGEPVTALGLANQGETVLAWDPDTGRPLTDALVWQDRRAASLCAELGDHADELRHLTGLPLDPYFAAPKMAWIRRHLTREGQVTTSDSWLVHRLTGAHVTDAATASRTQLLDLDRVEWSPRALELYGLTGERLPAVVDNAAHVGTVRAFGPELPLTGLAVDQQAALLAQRVTEPGTAKCTYGTGAFLLAHTGGTPRRGASGLAACVAWRLGGRADHCLDGQVYTAASAVRWLTGLGVITGAADLDPVGATVPDTGGVTFVPALAGLAAPWWRGDLRGSLTGLGLDTAPGHLVRALCEGLAAQVAELADAAAADLGTPLTVLRVDGGLTRSALLMQTQADLLQRPVEVSALPDATALGVGTLARLGADPARTLAEVLPGAGPTTVYEPRITTDEATERRTRFRGAVTALLAGGPA

SEQ ID NO: 69460 - DNA, 1671 bp, Drosophila melanogaster
  CDS (1)..(1671)
atgtcggcgccttcaaaagtagcagctaagccagcaggagcagccaaggattcccagtgtgcggaggagtcgggaccacccgactcacccgctttcatactcgccctggatgttggcaccacctgcgtgcggagcttcgttctggacgaacaatgcgaagtccggggatcggcggtggatgctgtggagctactgaacccgcagccaggctatttcgaaatcgaacccgagagcttgtggcggaaaatcgttggcgttataacgcaggcagtaaaaaatgctcaactgacaccaccggacatcacctgcctgaccatctccacgcagcgctgcacgtttctcacgtgggatcatcgcagtggcgagtactaccacaatttcatcacctggaaggatttgcgcgccgacgagctggttgaccagtggaatgccagctggacgaagagctccatgaactggttctcgtatgccctgttccttctcacccgccagtcacgattcctcgccggcagcgttctccaactgatgaatggccaggtcactccaaggctactcttcgagataatgaacaacaagaagttgaagcaggctctgatgcagaagaaggcgcgcgtggagctgttggactcgtggatcctgcacaagctaagaactggcagcagtcgcgataaggatgtggagcacataaccgatgtgacctcgagtacggcgacgggtttgtacgatccgttcacgctcagctggtcgccgcttataagctggctattcggcatcaattcaaaaatcttgccgcgtgtggtggacaacggctacaagggctttgggcatgtgcatcctactgccttcggtccggattgggccaacacagagatacccattgctgcctctttaagtgaccaaacagcagccatttggggctcgcagtgtttccagaagaacgacgtcaaggtcacaatgggtactggtgcgttccttaatctggtaacaggcgatcgttgccaagctgtcatctctggcatgtatccattggtggcctggcagttcaagaaaccaaccaggcagcagggagctgtctactgcattgagggagcatcccatgactttggcaccgtggtcacttgggcgcaatcgtgcgagctcttcgatagtccagcgaacacctcagatattgcacagtccgttccagatacgaacgatgtgttcttcatgccggccttcagtggcctggggcccccggtgaacgattatcggtcagcaagtggctttattggcctcactccgtccaccaccaaagcccacatggtgcgggctctgctcgagagcatagtatttcgtctggtgcagctgatcgaggccgctgagaaggagacctctcagaagcttcatatgattagggttgatggcggcgtctcccgcaatgacttcgtctgccaattccttgcggatctcagccgactgcgggtggagcgggcggacaatgcggagagcagcatcatgggagccacgttcatggcgggcatcaacctcggaatctggcgcgatgtgaacgatctcaaacgtttccggaaagtggcgcgagtctttgaaccgcgtcccaaggagtacgaaaccattgccaaccggatggacaaatggagccggacgattgcccggtttagtgactggtattag

SEQ ID NO: 69461 - protein, 556 aa, Drosophila melanogaster
MSAPSKVAAKPAGAAKDSQCAEESGPPDSPAFILALDVGTTCVRSFVLDEQCEVRGSAVDAVELLNPQPGYFEIEPESLWRKIVGVITQAVKNAQLTPPDITCLTISTQRCTFLTWDHRSGEYYHNFITWKDLRADELVDQWNASWTKSSMNWFSYALFLLTRQSRFLAGSVLQLMNGQVTPRLLFEIMNNKKLKQALMQKKARVELLDSWILHKLRTGSSRDKDVEHITDVTSSTATGLYDPFTLSWSPLISWLFGINSKILPRVVDNGYKGFGHVHPTAFGPDWANTEIPIAASLSDQTAAIWGSQCFQKNDVKVTMGTGAFLNLVTGDRCQAVISGMYPLVAWQFKKPTRQQGAVYCIEGASHDFGTVVTWAQSCELFDSPANTSDIAQSVPDTNDVFFMPAFSGLGPPVNDYRSASGFIGLTPSTTKAHMVRALLESIVFRLVQLIEAAEKETSQKLHMIRVDGGVSRNDFVCQFLADLSRLRVERADNAESSIMGATFMAGINLGIWRDVNDLKRFRKVARVFEPRPKEYETIANRMDKWSRTIARFSDWY

SEQ ID NO: 69462 - DNA, 1452 bp, Chlorobium tepidum TLS
  CDS (1)..(1452): transl_table=11
atggctattctttccatcgatcagggcacgaccggcaccacctgcatgatctacgaccggacgggcagcgtgctcgcccgcgcgtatcgcgagttgacgcaacactatccgcaggcggggtgggtggagcatgatccggaggagatctggcggacggtggtcgagtgcgtggccgaggtgcggggcgcatattcgggtcacatcgaagctatcggcatcaccaaccagcgcgagaccaccgtggtgtgggatcggcggagcggccagcccgtgcaccgcgccatcgtctggcagtgccggcggacggccaaattgtgcaaccgctaccgcagcgaggaggcggcgatccgcgcgaagacaggactgccggtggacgcctacttcagcgccaccaagattcgctggattctcgacgcgcatcccgaaatcgatccatcaaatctcctcttcggcaccattgacacgtggctcatctggaagctgaccggcggcgaggttcacgcgaccgacctgacgaatgcttcgcgcacgctgttgtttgatatccacgagcggcgctggtcgcccgagctttgcgagttgtttggcgtgccgctctcaatgctaccggaggcgcgtccgtcgatgggcgggttcggctcggtgcgcacgattccggcgctcgatggcgtgctgattgcgggcgtggcgggcgaccagcaggcggcgctttttggccagtgctgctttgcgccggggtcggtcaagaacacctacggcaccggctgcttcatggtgatgaacaccggagaaaagtttgtgagttcgagtcacggcttgttgacgacgctcgcgctcgacggcgctggccggagctgctacgcggtcgaggggtcggtgttcatcggcggcgcggtgatgcagtggctgcgcgacggcttgcagctcatcggcagcgccgccgagtctgagacgattgcccgctcggttgaatcgaatggaggggtctatctcgtgcccgccttcgtcggtctcggcgcaccgcactggaacatggaggcgcggggcacgatcaccggcctgacgcgcggctcgtcgcgggcgcatattgtccgcgcggcgctggagtcgatcgccttccagtcgcacgacgtgtttcgtgcgatggtggccgacatcggcattcagccgcagtcgctcacggtcgatggcggcgcggtgagcaacgagtttctgatgcagctccaggccgacctgctcggcgtgccggtgcaccgtccgcgcaacatcgaatccactgccctcggcgcggcctgccttgcgggtctcgaagccggagtgtggggttccgccgccgaactgcgtgtgctcaacagcgtcgagcgggtcttcactcccgcgatgccggagggcgaacgcgaggcgttgctggcgggctggcaaaaggcgctgcggcagacgctcacatcataa

SEQ ID NO: 69463 - protein, 483 aa, Chlorobium tepidum TLS
MAILSIDQGTTGTTCMIYDRTGSVLARAYRELTQHYPQAGWVEHDPEEIWRTVVECVAEVRGAYSGHIEAIGITNQRETTVVWDRRSGQPVHRAIVWQCRRTAKLCNRYRSEEAAIRAKTGLPVDAYFSATKIRWILDAHPEIDPSNLLFGTIDTWLIWKLTGGEVHATDLTNASRTLLFDIHERRWSPELCELFGVPLSMLPEARPSMGGFGSVRTIPALDGVLIAGVAGDQQAALFGQCCFAPGSVKNTYGTGCFMVMNTGEKFVSSSHGLLTTLALDGAGRSCYAVEGSVFIGGAVMQWLRDGLQLIGSAAESETIARSVESNGGVYLVPAFVGLGAPHWNMEARGTITGLTRGSSRAHIVRAALESIAFQSHDVFRAMVADIGIQPQSLTVDGGAVSNEFLMQLQADLLGVPVHRPRNIESTALGAACLAGLEAGVWGSAAELRVLNSVERVFTPAMPEGEREALLAGWQKALRQTLTS

SEQ ID NO: 69464 - DNA, 1524 bp, Yersinia pestis KIM
  CDS (1)..(1524): transl_table=11
atgacaactgaaaatactactcaaaaaaaatacattgtcgcacttgatcaggggacaaccagctccagggcggtagtactggatcacaatgcaaatatcgtgagtgtttctcagcgtgaattcactcagatttacccaaaggctggctgggttgagcatgacccaatggagatctgggcgacccaaagctctacactgattgaagtcctggccaaagccggtatcaactctgatgaaatcgcgggtatcggtattaccaatcagcgcgaaaccacgattgtttgggataaagtgaccggtaagccggtgtataacgccattgtctggcaatgccgccgtactgcggatatttgcgaaaaactgaaaaaagaagggctggaagagtatatccgccacaacaccggtttggtggtagatccctacttctctggcacaaaagtgaaatggatcctcgataacgtcgagggcgctcgcgagcgcgctgaacgcggtgagttactgtttggtaccgtagacacctggctggtgtggaatatgacgcaaggccgtgtgcacgtcaccgactataccaacgcatcacggaccatgatgtttaacatccgtaccaaggagtgggacgaccgtatgctgaaagcgctgaatattccacgcgccatgctaccggaagttcgcccatcctccgaaatctacggcaaaaccaatatcggtggcaaaggtggcactcgtattccaatcgccgggattgccggtgaccagcaagccgctctgtttggtcagctttgtgtacagccgggcatggcaaaaaatacctacggtacgggttgcttcctgctgatgaacaccggtgaagaagcggttcaatctactcatggcctgttgaccaccattgcctgtggcccacgcggtgaagtgaattatgcactggaaggggctgtatttattggtggtgcctccattcaatggctacgtgatgaattgaagttgataggcgatgccaccgattctgagtatttcgcgaccaaagtgaaaaacagtaatggtgtgtatgtggtaccggccttcaccggtctgggcgctccttactgggacccgtatgcccgtggtgcgattttcggcctgacccgtggtgttaacagcaaccacattatccgtgcaacgctcgaatccatagcttatcagacccgcgatgtcttggatgccatgcaagctgactccggcgcacggctgaaatcactgcgtgttgatggcggtgcagtagctaataacttcctgatgcagttccaggccgatattctgggtacccgtgttgagcgccctgctattcgtgaaagtacagcattgggtgctgcattcctggcaggtctggcgacgggcttctgggatgacctcgatgaggtgaagagtaaagcaagcattgaacgcgaattccgtccagggattgaaaccacagagcgtgatatccgttacaagggctggaaaaaagcagtggcccgcgcccgggattgggaagagcacgacgagtaa

SEQ ID NO: 69465 - protein, 507 aa, Yersinia pestis KIM
MTTENTTQKKYIVALDQGTTSSRAVVLDHNANIVSVSQREFTQIYPKAGWVEHDPMEIWATQSSTLIEVLAKAGINSDEIAGIGITNQRETTIVWDKVTGKPVYNAIVWQCRRTADICEKLKKEGLEEYIRHNTGLVVDPYFSGTKVKWILDNVEGARERAERGELLFGTVDTWLVWNMTQGRVHVTDYTNASRTMMFNIRTKEWDDRMLKALNIPRAMLPEVRPSSEIYGKTNIGGKGGTRIPIAGIAGDQQAALFGQLCVQPGMAKNTYGTGCFLLMNTGEEAVQSTHGLLTTIACGPRGEVNYALEGAVFIGGASIQWLRDELKLIGDATDSEYFATKVKNSNGVYVVPAFTGLGAPYWDPYARGAIFGLTRGVNSNHIIRATLESIAYQTRDVLDAMQADSGARLKSLRVDGGAVANNFLMQFQADILGTRVERPAIRESTALGAAFLAGLATGFWDDLDEVKSKASIEREFRPGIETTERDIRYKGWKKAVARARDWEEHDE

SEQ ID NO: 69466 - DNA, 1506 bp, Plasmodium falciparum 3D7
  CDS (1)..(1506)
atgaatgtcatattaagtatagaccaaagtacacaatcaaccaaagtgtttttctatgatgaagaattaaatattgttcattcgaataatttaaatcatgaacaaaaatgtttgaaacctggttggtatgaacatgatccaatagagattatgaccaacttatataatttaatgaatgaaggaataaaagtgttaaaagataaatatacatctgttataataaaatgtataggtattactaaccaaagagaaactgtaattatatgggatagaataacaggaaaacctttatacaatgctatagtttggctagatacacgtgtagaagaacttgttacggaattttctgcgaaatataataataatgatattcagaaaaaaacaggaacttactttaatacatattttagtgcttttaaaatattgtggttaattcaaaacaatccagaaatcaaacaaaaaattgatgatggtactgcagttataggaaatattaatacatggcttatttttaatttaactaaagggaattgttatacagatgttaccaatgcttcaagaactttattaatggatattaatacattacaatgggatgaaaagatgtgtaaaatatttaatattactaatatgtctgttttacctgaaataaaaagtaattgttctaattttggtttagttaagtcagaacatgttccggactatttaaatattcctattactggatgtattggagatcaacaaagtgcatgcattggtcaagctatcttcgacgaaggtgaagcgaaatgtacatatggtacaggtgtattccttctaattaatacaggagaaaaagttgtatattccacatgcggtttaattactactatatgttataaatttaatgataatgataaacctaaatatgctcttgaaggttcgataggtactgccggatctggagtttcatggcttcttaaaaacaaactaattgatgatccaagtgaagctagcgatattatggaaaaatgtgaaaatacaactggagtcatttttgtaccagctttcagtggattatatgcacccagatggagatctgatgcacgtgcatccatatatggaatgacttttaatacggaaagaagccatattgtaagagcactattagaaggtatagcttttcagttaaatgaaattgtggactccttaacatcggatatgggtattgaaatgttacatgtcttacgatgtgatggaggcatgacaaaaaataaaccttttatgcaatttaactcagatattattaatacaaaaattgaagtttcaaaatataaagaagtaacttctcttggtgctgcagttctagctggattagaagttaaaatatgggacagtctagattctgttaaaagtttattaaggagaagtgacgctgtttttcattctaaaatggatgataaaaaaagaaaaaaaaaaacttccgaatggaataaagctgtcgaaaggacattaatacagttataa

SEQ ID NO: 69467 - protein, 501 aa, Plasmodium falciparum 3D7
MNVILSIDQSTQSTKVFFYDEELNIVHSNNLNHEQKCLKPGWYEHDPIEIMTNLYNLMNEGIKVLKDKYTSVIIKCIGITNQRETVIIWDRITGKPLYNAIVWLDTRVEELVTEFSAKYNNNDIQKKTGTYFNTYFSAFKILWLIQNNPEIKQKIDDGTAVIGNINTWLIFNLTKGNCYTDVTNASRTLLMDINTLQWDEKMCKIFNITNMSVLPEIKSNCSNFGLVKSEHVPDYLNIPITGCIGDQQSACIGQAIFDEGEAKCTYGTGVFLLINTGEKVVYSTCGLITTICYKFNDNDKPKYALEGSIGTAGSGVSWLLKNKLIDDPSEASDIMEKCENTTGVIFVPAFSGLYAPRWRSDARASIYGMTFNTERSHIVRALLEGIAFQLNEIVDSLTSDMGIEMLHVLRCDGGMTKNKPFMQFNSDIINTKIEVSKYKEVTSLGAAVLAGLEVKIWDSLDSVKSLLRRSDAVFHSKMDDKKRKKKTSEWNKAVERTLIQL

SEQ ID NO: 69468 - DNA, 1359 bp, Shigella flexneri 2a str. 301
  CDS (1)..(1359): transl_table=11
atggaaatctgggccacccaaagctccacgctggtagaagtgctggcgaaagccgatatcagttccgatcaaattgcagctatcggtattacgaaccagcgtgaaaccactattgtctgggaaaaagaaaccggcaagcctatctataacgccattgtctggcagtgccgtcgtaccgcagaaatctgcgagcatttaaaacgtgacggtttagaagattatatccgcagcaataccggtctggtgcttgacccgtacttttctggcaccaaagtgaagtggatcctcgaccatgtggaaggctctcacgagcgtgcacgtcgtggtgaattgctgtttggtacggttgatacgtggcttatctggaaaatgactcagggccgtgtccatgtgaccgattacaccaacgcctctcgtaccatgttgttcaacatccataccctggactgggacgacaaaatgctggaagtgctggatattccgcgcgagatgctgccagaagtgcgtcgttcttccgaagtatacggtcagactaacattggcggcaaaggcggcacgcgtattccaatctccgggatcgccggtgaccagcaggccgcgctgtttggtcagttgtgcgtgaaagaagggatggcgaagaacacctatggcactggctgctttatgctgatgaacactggcgagaaagcggtgaaatcagaaaacggcctgctgaccaccatcgcctgcggcccgactggcgaagtgaactatgcgttggaaggtgcggtgtttatggcaggcgcatccattcagtggctgcgcgatgagatgaagttgattaacgacgcctacgattccgaatatttcgccaccaaagtgcaaaacaccaatggtgtgtatgtggttccggcatttaccgggctgggtgcgccgtactgggacccgtatgcgcgcggggcgattttcggtctgactcgtggggtgaacgctaaccacattatacgcgcgacgctggagtctattgcttatcagacgcgtgacgtgctggaagcgatgcaggccgactctggtatccgtctgcacgccctgcgcgtggatggtggcgcagtagcaaacaatttcctgatgcagttccagtccgatattctcggcacccgcgttgagcgcccggaagtgcgcgaagtcaccgcattgggtgcggcctatctcgcaggcctggcggttggcttctggcagaacctcgacgagctgcaagagaaagcggtgattgagcgcgagttccgtccaggcatcgaaaccactgagcgtaattaccgttacgcaggctggaaaaaagcggtcaaacgcgcgatggcgtgggaagaacacgacgagtaa

SEQ ID NO: 69469 - protein, 452 aa, Shigella flexneri 2a str. 301
MEIWATQSSTLVEVLAKADISSDQIAAIGITNQRETTIVWEKETGKPIYNAIVWQCRRTAEICEHLKRDGLEDYIRSNTGLVLDPYFSGTKVKWILDHVEGSHERARRGELLFGTVDTWLIWKMTQGRVHVTDYTNASRTMLFNIHTLDWDDKMLEVLDIPREMLPEVRRSSEVYGQTNIGGKGGTRIPISGIAGDQQAALFGQLCVKEGMAKNTYGTGCFMLMNTGEKAVKSENGLLTTIACGPTGEVNYALEGAVFMAGASIQWLRDEMKLINDAYDSEYFATKVQNTNGVYVVPAFTGLGAPYWDPYARGAIFGLTRGVNANHIIRATLESIAYQTRDVLEAMQADSGIRLHALRVDGGAVANNFLMQFQSDILGTRVERPEVREVTALGAAYLAGLAVGFWQNLDELQEKAVIEREFRPGIETTERNYRYAGWKKAVKRAMAWEEHDE

SEQ ID NO: 69470 - DNA, 1491 bp, Leptospira interrogans serovar Lai str. 56601
  CDS (1)..(1491): transl_table=11
atgagtgattatatcatcggtatagacgccggaactaccgggattcgaattttttgttttaataaatcaggaaacgtaatttccagcgcgtattccgaatttaaccagcattatccgaaacctggttgggtggaacacgatgcggaagaaatctgggccaaaactgaaaagctcatattaaaagcgattcgaaatggaaagttgagtccttctaaagcagtcgcaattggaattacaaatcaaagagaaaccacagtattgtttgataaagataccggaaaacctgtttataatgcgatcgtatggcaatgtagaagaacttctgaaacctgtatggatcttaaatctaaaggattggaatctttttttcgtaaaaaaacgggattggttttagatgcatactttagtggaaccaaaattcaatggattttggaaaatgtaaaaggtgtaaaagccagagcggaaaaaggaaagatattttttggaaccatagatacgtatttactatatcgtttgaccaacggaaaatcgcataagaccgatcatacgaatgcaagtagaactttgatctacaatatcgaaaagaaagaatgggataaggaattaactcaaatattaggaattcctgattctattttaccagagacgcataattctagttcattgttcggaagaacggaaaaggtaaaaggacttcctgacggaattccaatttcctctcttgtgggagatcaacaaggggccttatttggccaactttgcacagagcctggggaagccaagaacacgtatggaaccggatgttttcttctttttaatactggaaataattttcagatttctaagaacaatttacttactaccttaggatgtggaccggaaggaaagactgtttattgtttggaaggatccgtttttataggaggcgctgtcgttcaatttttaagagataatctgaaattttttaaagaatccaaaatttccgaaaagtatgcgtcttcggtaaaaaaagaagacgatgtagtttttattcccgcctttgcagggttaggtgctccttattgggatatgaacgcgaggggtgcaattttaggtctgacaagagatactacagcggaacagatcacaagagctgcgctcaaatcgattgccctccaatcttatgaacttgtagaggcaatggaaaacgatactggttctaaattaaaagttttaaaagtagacgggggtgcgactggaaattcttggttgatgcagtatcaatctgatatattaggaaaacgtgtagttcgtccttccaatgtagataccacggtattaggtgcggcatttttggcgggattagaaaggggattttttccttccgtagtggatctaaaaaagaaactaaaaacgagtaaggaattttctccacagatgaaacaaccccaaagagaaaaagagattcagatttggaaggattctgtccataggatccgaaccaatcaataa

SEQ ID NO: 69471 - protein, 496 aa, Leptospira interrogans serovar Lai str. 56601
MSDYIIGIDAGTTGIRIFCFNKSGNVISSAYSEFNQHYPKPGWVEHDAEEIWAKTEKLILKAIRNGKLSPSKAVAIGITNQRETTVLFDKDTGKPVYNAIVWQCRRTSETCMDLKSKGLESFFRKKTGLVLDAYFSGTKIQWILENVKGVKARAEKGKIFFGTIDTYLLYRLTNGKSHKTDHTNASRTLIYNIEKKEWDKELTQILGIPDSILPETHNSSSLFGRTEKVKGLPDGIPISSLVGDQQGALFGQLCTEPGEAKNTYGTGCFLLFNTGNNFQISKNNLLTTLGCGPEGKTVYCLEGSVFIGGAVVQFLRDNLKFFKESKISEKYASSVKKEDDVVFIPAFAGLGAPYWDMNARGAILGLTRDTTAEQITRAALKSIALQSYELVEAMENDTGSKLKVLKVDGGATGNSWLMQYQSDILGKRVVRPSNVDTTVLGAAFLAGLERGFFPSVVDLKKKLKTSKEFSPQMKQPQREKEIQIWKDSVHRIRTNQ

SEQ ID NO: 69472 - DNA, 1548 bp, Leptospira interrogans serovar Lai str. 56601
  CDS (1)..(1548): transl_table=11
atggctaattcacagggcaaatacgtcctttccatcgacagtgggggaagtggaattcgtgcgtttttattagatcgaaaaggtaatatagtcgaaaggcaatatgaaaaaactcctcctaatattcccgaagcaggtgctttagaacacgatccagaaatcctatggaaggcccttctttctcttttaaaaaagatccaaaaaaatcagcaaattgtaaaagaaattatcgcattaggaatttgtaatcaacgcggctcctttcttctctgggaaaaatccacaggaaagccattaactcctttgatcagttgggcggacgttcgttctcataaaattgcagaagcgatgaatcgaaatctaatctggacaatcatccgtgttgtatctacgtttgtaggaagattgacaaaccatccgatgatgatcgccacttccatgctacgatttacgacagatcacgcaacttgtagattaaaatggattttagacaaaaatccagatctaaaacagagatgcaaaaaaggtgaagttctttttggtacgttagatacttggttcatttataaacttaccggtcaaaaacaacatctcaccgattcgtcaaatgcagttgctacgggaatgtttaatccttttcaattgatctggaaccaaccgattctttcaatattcggaattccttctaatttatttccggaagtaaaagatagcaacggagacttcggtcatactttgccagaatatttaggaggacattcgattccaatcagagcttcgattggagatcaaatggcggctctatttgggcattgttgttttgaaaggggcgaagtaaaaatttctcaaggttccggggcatttgtggatattaacatagggcccaaagcaaaactttccaaacgcggtctttttccaatgatcgcttggagaatagacggcaataccacatatatgttagaaggttatgttgcaaccgctggaaccctcatagattggttaggacaaggaatcggactttccgacactcctaaagttttgaacgaacttgcggcccaatcggaagatacagaaggagtcgtttttattccaactcctacgggagcccgttttccttatttcaatcctcgtgccaaggcatccgtgatcgggctttctctagcatctcatagaagacacgttgcaagagccgtcctagaaggaatttctctcagtctctatgaaattttagaaggaattcaacgagatacaaaagttgaaatcaaagacattaaagtggacggcggtgtatctcagtctgatattcttcttcaatgtctttcagatttttcgaatgtaagagtaaatcgttctcccgaaccagatatgactgcaacaggaacggcgtatcttgctggtttggcagttggcttttggaaaaatttagatgaattgaagaatttacaaaaaggttataaatctttcgaaccgaagatgaacccaacaaaaagggttcaaaaaattcaacgttggaaaaaagcagttaccgcaactctttccatcgaatga

SEQ ID NO: 69473 - protein, 515 aa, Leptospira interrogans serovar Lai str. 56601
MANSQGKYVLSIDSGGSGIRAFLLDRKGNIVERQYEKTPPNIPEAGALEHDPEILWKALLSLLKKIQKNQQIVKEIIALGICNQRGSFLLWEKSTGKPLTPLISWADVRSHKIAEAMNRNLIWTIIRVVSTFVGRLTNHPMMIATSMLRFTTDHATCRLKWILDKNPDLKQRCKKGEVLFGTLDTWFIYKLTGQKQHLTDSSNAVATGMFNPFQLIWNQPILSIFGIPSNLFPEVKDSNGDFGHTLPEYLGGHSIPIRASIGDQMAALFGHCCFERGEVKISQGSGAFVDINIGPKAKLSKRGLFPMIAWRIDGNTTYMLEGYVATAGTLIDWLGQGIGLSDTPKVLNELAAQSEDTEGVVFIPTPTGARFPYFNPRAKASVIGLSLASHRRHVARAVLEGISLSLYEILEGIQRDTKVEIKDIKVDGGVSQSDILLQCLSDFSNVRVNRSPEPDMTATGTAYLAGLAVGFWKNLDELKNLQKGYKSFEPKMNPTKRVQKIQRWKKAVTATLSIE

SEQ ID NO: 69474 - DNA, 1635 bp, Drosophila melanogaster
  CDS (1)..(1635)
atggagtacgatccgtcggagatatggaagaacacacaggagtgcatagagaccgcctataagaacctggttatactagagatcaatccacgtgatattattgccatcggtatcgtaaatcagcggggcacctcggtgttatggaatttggagacgggacagccactgcacaatgccatcggatggtcagattgccgtagcactcccatcctaaagaccctgctccataatgtccggcacaatgtggactacgtgaggtatcgcagtggcttgcccctgagcagctgtttcagtgccctaaagatccgttggctaatggatcacgttcctgccgtagccactgccattgaggagaacaagtgcttattcggcaccttggactcctggcttctgtggaacctaaccggcggcgttgagatgggtgtgcactctactgacattaccaatgcccactacacttcccttatgaacgtgtccacagagcagtgggatcctaaactctgccagttctttcgattgcccctgaacatactgccacgcatacgatccaactccgaaatcttcggctatgtgctggagggtcctttgcatggcactcccatagcggccatgatgggtgagcagcccgcaagtttgttgggccaactctgcgtgaaggccgggcaaaatgtctgtaccctggacgacagctgtttcgtgctccttaacacgggcagggagaagctggactctgcaaacggactgataacgggcatagcgcacaagctgggcgaaaaagcggccactaactacacactcgagggagccatttcaaatgccggttccacggttacatggctgcgggataagctacagatcaatactgagattaattccaatgataatgtggtggagtctttgaatacattcatcggcgagaactcgatgatctcgtcctcttgttcctcatccatgctgaatgccgagtgtggactggcagccaagaggtcggagattacgtttgtgccggcatttcatggcatgtacgcaccctactggcgacacgatgccaggggcataatcttgggacttaccagccagactacagcggaaaacattacccaagctgcttacgaggccaccgggttccagatctttgaagtgctacaggcgttcaagcgcgatacacccaactgggaccgatccagcatgcaacccgtgctgacattcggcggtgattacgccgaaaacttgcatttggtgcagttcatagcagatattattggctatatgttggagcgtccacagaccacctcacctgctggattgggcgttatgataaccgcgggcgtgacgatgaaagtggtgtccctggagcacgccgtaaaaatgtacaccccgcccactgatgtcttttcgccaacaactaccaaaaatcgtcgagagctgctctacaagcgctgggcttatgcggtaaagaaatgcctgcactggaacaactacgagacgtacgaggctgatattgagctgtttgctcagcgagaacttgatcccaatttacctgtaaggcgttccgtaccgggcagtatattcctgaccacttcttttgcgatgattatcctggctaactacttaaagtccaatcccctgaaatag

SEQ ID NO: 69475 - protein, 544 aa, Drosophila melanogaster
MEYDPSEIWKNTQECIETAYKNLVILEINPRDIIAIGIVNQRGTSVLWNLETGQPLHNAIGWSDCRSTPILKTLLHNVRHNVDYVRYRSGLPLSSCFSALKIRWLMDHVPAVATAIEENKCLFGTLDSWLLWNLTGGVEMGVHSTDITNAHYTSLMNVSTEQWDPKLCQFFRLPLNILPRIRSNSEIFGYVLEGPLHGTPIAAMMGEQPASLLGQLCVKAGQNVCTLDDSCFVLLNTGREKLDSANGLITGIAHKLGEKAATNYTLEGAISNAGSTVTWLRDKLQINTEINSNDNVVESLNTFIGENSMISSSCSSSMLNAECGLAAKRSEITFVPAFHGMYAPYWRHDARGIILGLTSQTTAENITQAAYEATGFQIFEVLQAFKRDTPNWDRSSMQPVLTFGGDYAENLHLVQFIADIIGYMLERPQTTSPAGLGVMITAGVTMKVVSLEHAVKMYTPPTDVFSPTTTKNRRELLYKRWAYAVKKCLHWNNYETYEADIELFAQRELDPNLPVRRSVPGSIFLTTSFAMIILANYLKSNPLK

SEQ ID NO: 69476 - DNA, 1620 bp, Drosophila melanogaster
  CDS (1)..(1620)
atgtcggcgccttcaaaagtagcagctaagccagcaggagcagccaaggattcccagtgtgcggaggagtcgggaccacccgactcacccgctttcatactcgccctggatgttggcaccacctgcgtgcggagcttcgttctggacgaacaatgcgaagtccggggatcggcggtggatgctgtggagctactgaacccgcagccaggctatttcgaaatcgaacccgagagcttgtggcggaaaatcgttggcgttataacgcaggcagtaaaaaatgctcaactgacaccaccggacatcacctgcctgaccatctccacgcagcgctgcacgtttctcacgtgggatcatcgcagtggcgagtactaccacaatttcatcacctggaaggatttgcgcgccgacgagctggttgaccagtggaatgccagctggacgaagagctccatgaactggttctcgtatgccctgttccttctcacccgccagtcacgattcctcgccggcagcgttctccaactgatgaatggccaggctctgatgcagaagaaggcgcgcgtggagctgttggactcgtggatcctgcacaagctaagaactggcagcagtcgcgataaggatgtggagcacataaccgatgtgacctcgagtacggcgacgggtttgtacgatccgttcacgctcagctggtcgccgcttataagctggctattcggcatcaattcaaaaatcttgccgcgtgtggtggacaacggctacaagggctttgggcatgtgcatcctactgccttcggtccggattgggccaacacagagatacccattgctgcctctttaagtgaccaaacagcagccatttggggctcgcagtgtttccagaagaacgacgtcaaggtcacaatgggtactggtgcgttccttaatctggtaacaggcgatcgttgccaagctgtcatctctggcatgtatccattggtggcctggcagttcaagaaaccaaccaggcagcagggagctgtctactgcattgagggagcatcccatgactttggcaccgtggtcacttgggcgcaatcgtgcgagctcttcgatagtccagcgaacacctcagatattgcacagtccgttccagatacgaacgatgtgttcttcatgccggccttcagtggcctggggcccccggtgaacgattatcggtcagcaagtggctttattggcctcactccgtccaccaccaaagcccacatggtgcgggctctgctcgagagcatagtatttcgtctggtgcagctgatcgaggccgctgagaaggagacctctcagaagcttcatatgattagggttgatggcggcgtctcccgcaatgacttcgtctgccaattccttgcggatctcagccgactgcgggtggagcgggcggacaatgcggagagcagcatcatgggagccacgttcatggcgggcatcaacctcggaatctggcgcgatgtgaacgatctcaaacgtttccggaaagtggcgcgagtctttgaaccgcgtcccaaggagtacgaaaccattgccaaccggatggacaaatggagccggacgattgcccggtttagtgactggtattag

SEQ ID NO: 69477 - protein, 539 aa, Drosophila melanogaster
MSAPSKVAAKPAGAAKDSQCAEESGPPDSPAFILALDVGTTCVRSFVLDEQCEVRGSAVDAVELLNPQPGYFEIEPESLWRKIVGVITQAVKNAQLTPPDITCLTISTQRCTFLTWDHRSGEYYHNFITWKDLRADELVDQWNASWTKSSMNWFSYALFLLTRQSRFLAGSVLQLMNGQALMQKKARVELLDSWILHKLRTGSSRDKDVEHITDVTSSTATGLYDPFTLSWSPLISWLFGINSKILPRVVDNGYKGFGHVHPTAFGPDWANTEIPIAASLSDQTAAIWGSQCFQKNDVKVTMGTGAFLNLVTGDRCQAVISGMYPLVAWQFKKPTRQQGAVYCIEGASHDFGTVVTWAQSCELFDSPANTSDIAQSVPDTNDVFFMPAFSGLGPPVNDYRSASGFIGLTPSTTKAHMVRALLESIVFRLVQLIEAAEKETSQKLHMIRVDGGVSRNDFVCQFLADLSRLRVERADNAESSIMGATFMAGINLGIWRDVNDLKRFRKVARVFEPRPKEYETIANRMDKWSRTIARFSDWY

SEQ ID NO: 69478 - DNA, 1476 bp, Pseudomonas syringae pv. tomato str. DC3000
  CDS (1)..(1476): transl_table=11
atgaatcaacactctccgctgattctggccatcgatgaaggcaccagcaacgccaaggccgtgctggtcaacgaacaagggcaagtcgtcgctcgtggctcgcggcccttgagtatcagccacccgcaagccggttattcggagcaggacccgctgctgatctggcaggccacgcttgaggccattgcagactgcatgactggtctgcagcgcccgatcagcgcgttggccatcagcaatcagcgcgagtcggtggtggcgtgggaccgggtcagcggggcaccgttgtcgccctgtatcagttggcagtgccgtcgctcgttgccgctgtgcaatgaactgcatgcgcaaggtcacgaggccatgattctggccagaaccggtctggcgctggacccgatgttttccgcaggcaagatgcgctggattctcgaccatctggacgacggtcacgctcgcgcagcggcaggcgaaatctgtctggggacagtcgacagttggctgctctggaaactcagcgcagggcaagcatttgcaaccgattattccaacgcagcacgtactcaactgttcaacctgcagacctgcgactgggacccgcaattgcttgagctgttttcgatccctgctgcagcactggccagcattcaacccagtgccgggctgtttgctcatacggtggcggtcggcgggttggacgccggcattccgattctgtcgatgatcggcgattcgcatgcggcgctgtacgggcagggcggttttgcccctggactggtcaaggcgaccctgggcaccggctcttcgctgatgacgccaatggccgggcctattgcctctcgccacggactgtcgacgacgctggcctggcacgatggcgcagcgtcaacttatgcaatggaaggcaacattgtgcacaccggcgcagcggtgcaatgggctgcgcggctggtggccggcgaatccatagatgccctgagcgaacaggccgcgcaattggccgacaatggcggcgtctactttgtgccggcgctgtccggtctgggcgcgccacattggcaggccgacgcccgagggctgatctgcggccttacggaaggcagttctggcgcacacatcatgcgtgcggctctggagtccatcggctatcagattcgcgacgtcttcgacgccatgcaggccgacatcggcagcccgctcaaggaactttgggtagacggcggggcaacccgcaatcgctggctcatgcaatttcttgccgacctgctgcaacgtccggtcatccgcagcctgtcaccggaagtctcggcactgggcgccgcacacctggcaggcaaagccctcggcctctggaatgacgccgccgacctgcaagtactggaaagacagcgcgaacgcttcgaccccgttcccggcagggatctggagggtgtgtatcaggagtggcagaaggctttggggcgggtggtgtgttga

SEQ ID NO: 69479 - protein, 491 aa, Pseudomonas syringae pv. tomato str. DC3000
MNQHSPLILAIDEGTSNAKAVLVNEQGQVVARGSRPLSISHPQAGYSEQDPLLIWQATLEAIADCMTGLQRPISALAISNQRESVVAWDRVSGAPLSPCISWQCRRSLPLCNELHAQGHEAMILARTGLALDPMFSAGKMRWILDHLDDGHARAAAGEICLGTVDSWLLWKLSAGQAFATDYSNAARTQLFNLQTCDWDPQLLELFSIPAAALASIQPSAGLFAHTVAVGGLDAGIPILSMIGDSHAALYGQGGFAPGLVKATLGTGSSLMTPMAGPIASRHGLSTTLAWHDGAASTYAMEGNIVHTGAAVQWAARLVAGESIDALSEQAAQLADNGGVYFVPALSGLGAPHWQADARGLICGLTEGSSGAHIMRAALESIGYQIRDVFDAMQADIGSPLKELWVDGGATRNRWLMQFLADLLQRPVIRSLSPEVSALGAAHLAGKALGLWNDAADLQVLERQRERFDPVPGRDLEGVYQEWQKALGRVVC

SEQ ID NO: 69480 - DNA, 1506 bp, Synechococcus sp. WH 8102
  CDS (1)..(1506): transl_table=11
atggcagatcagcctctcctgttggcgctggatcaaggcaccagcagttcccgagcagcggtgtttgacgccaagggcgaccttgtggccagtgcgacggcgcccctaccaatccaataccccgccgatggctgggtggaacaacaccccggcgacatctggaacagccaaaggcaggcactgcaggatctgcaccaacagctcgatgaggagcaacgtcgggccgtggtgagctgcggcatcaccaatcaacgcgaaaccacggtgctctggcgtcgcagcagcggcagcccctgcggaccggccctggtctggcaggacggccgtacagcagacatctgccaagcctggaaagcagacggcctcgaatccgcgtggtgccagcgcaccggcttgctgctggatccgtacttcagcgccagcaagatccgttggatgctcgagcatcaccccgaggcggcagccgctgcggcccagggcgatctgtgcttcggcacggtggagtcgtggctgctctggaacctcacgggaggacagcgccacggcagtgacatgagcaatgccagccgcacgctgctgatggatctcgagcagcgctgttggatggatgaattccgcgaacagacgggtcttcctgcgaacgctctaccggagctgttgccctgtcgtggggagttcggccacatcgcagcgaagcttcccttcgccggattgcccatccaggccctcctcggtgatcaacaggccgcgacccttggtcagctctgtctgcagcctggcgaagccaaatgcacctatggcactggggcctttctggtgatcaataccggcgacagcatccgccgctccagcgacggtctactcagcacccttggctggaccgatgccagcggcacacccacctactgcctggagggcagcctgttcaatgcaggaactgtggtgcagtggctgagggacggcttgcagatcatcgagcaggctgatgaggtgaatgccctggcgcaatcggtgccggacagcggcggggtgatgctggtgcccgccttcaccggttgggggaccccccactgggacccccaggcccgcggtgtgctggtggggctcacgcgggacagcaaccgcggccacatcgcccgagccgccctggagggcatcgccctgtcggtggccaccctggtggagctggcgggagaggccctcgggcgtggcctgggggaactggcggtggatgggggggctgccgcctccgatcccttgttgcaggcgcaggcggacagcaccggcctgacggtgcgccgcccccggaacctggaaagcacagcccgcggcatcgctctgtttgccggtgtgcaatgcggcctgatccccgacctgtccgccatcgccgcccaccggcaggacgatgtacagcgcttcgaaccgcagatcaacaccgagcggcgcaggcttcaacgtgaccgctggaatgacgccgtgaaccgcagcctgggctggcatggctga

SEQ ID NO: 69481 - protein, 501 aa, Synechococcus sp. WH 8102
MADQPLLLALDQGTSSSRAAVFDAKGDLVASATAPLPIQYPADGWVEQHPGDIWNSQRQALQDLHQQLDEEQRRAVVSCGITNQRETTVLWRRSSGSPCGPALVWQDGRTADICQAWKADGLESAWCQRTGLLLDPYFSASKIRWMLEHHPEAAAAAAQGDLCFGTVESWLLWNLTGGQRHGSDMSNASRTLLMDLEQRCWMDEFREQTGLPANALPELLPCRGEFGHIAAKLPFAGLPIQALLGDQQAATLGQLCLQPGEAKCTYGTGAFLVINTGDSIRRSSDGLLSTLGWTDASGTPTYCLEGSLFNAGTVVQWLRDGLQIIEQADEVNALAQSVPDSGGVMLVPAFTGWGTPHWDPQARGVLVGLTRDSNRGHIARAALEGIALSVATLVELAGEALGRGLGELAVDGGAAASDPLLQAQADSTGLTVRRPRNLESTARGIALFAGVQCGLIPDLSAIAAHRQDDVQRFEPQINTERRRLQRDRWNDAVNRSLGWHG

SEQ ID NO: 69482 - DNA, 1524 bp, Photorhabdus luminescens subsp. laumondii TTO1
  CDS (1)..(1524): transl_table=11
atgacaacagaaaatatgattgagaaaaagtatattgtcgcccttgatcagggaaccaccagttcccgagcaataattcttgatcacgacgccaatattatctcaatttcccaaagagagtttacgcaaatttatcctaaaccgggttgggtagaacacgatccaatggaaatctgggcaacccaaagctcaacgctggtagaagtattggcgaaagcggatattagttctgatcagattgccggtattggtattaccaaccaacgtgaaacaacgattatttgggaaaaagagaccggtaaacctatctacaatgccatcgtttggcaatgtcgccgtaccgcggacgcgtgtactaaactaaaacaaaaagagggattggaagaatatattcgccagaatacagggctggtagtagacccttatttctccggcaccaaagtaaaatggatcttagataacgtcgcaggtgcccgtgaacgggctgaaaaaggtgagctcctattcggtactgtggatacttggctggtatggaaaatgactcaaggccgagtccacgttaccgatttcacaaacgcctcccgaacgatgctgttcaatattcacaatctggagtgggatcagcatattcttgatgaattacaaatccctcgttccctactgcctagcgttcattcatcttctgagatttatggtcagaccaacatcggcggtaaaggcggcactcggatccctatctcaggtatcgcaggtgatcaacaagctgctctatatggtcaactttgtgtccaaccgggtatggcgaaaaacacctacgggacaggctgtttcctgctgatgaacacgggtacagatgccgtacgctccaatcacggcctactgacaaccattgcctgtggtcctcgcggcgaagtgaactatgcgcttgaaggtgcggttttcgttggtggtgcctctattcagtggttgcgtgatgaactgaaacttattgcagatgcggctgactccgaatattttgccactaaagttaaaaatagtaacggcgtgtatgtggtccctgcttttaccggccttggtgccccctattgggacccctacgcccgagggtcaattttcggcctaacccgcggtaccaacagtaatcacatcattcgtgcgacgctggaatctatcgcctatcagacccgtgatgtactggatgctatgcaagctgatgcaggcacccggctgcaagcactacgggtagatggcggagccgttgccaataacttcctgatgcaattccaatcagatattcttggcacccgggtagaacgccctgtggtgcgtgaaagcacagcattgggcgcagcattcctcgcaggattggcagttggctactggaaagacctggatgaagtgaaaagtaaagccaccattgagaaagaattccgtccgggtattgaaaccaccgagcgtaattacaaatacaatggctggaaaaaagcagttgcccgtgcgcaggattgggaagataaaggctaa

SEQ ID NO: 69483 - protein, 507 aa, Photorhabdus luminescens subsp. laumondii TTO1
MTTENMIEKKYIVALDQGTTSSRAIILDHDANIISISQREFTQIYPKPGWVEHDPMEIWATQSSTLVEVLAKADISSDQIAGIGITNQRETTIIWEKETGKPIYNAIVWQCRRTADACTKLKQKEGLEEYIRQNTGLVVDPYFSGTKVKWILDNVAGARERAEKGELLFGTVDTWLVWKMTQGRVHVTDFTNASRTMLFNIHNLEWDQHILDELQIPRSLLPSVHSSSEIYGQTNIGGKGGTRIPISGIAGDQQAALYGQLCVQPGMAKNTYGTGCFLLMNTGTDAVRSNHGLLTTIACGPRGEVNYALEGAVFVGGASIQWLRDELKLIADAADSEYFATKVKNSNGVYVVPAFTGLGAPYWDPYARGSIFGLTRGTNSNHIIRATLESIAYQTRDVLDAMQADAGTRLQALRVDGGAVANNFLMQFQSDILGTRVERPVVRESTALGAAFLAGLAVGYWKDLDEVKSKATIEKEFRPGIETTERNYKYNGWKKAVARAQDWEDKG

SEQ ID NO: 69484 - DNA, 1521 bp, Corynebacterium diphtheriae NCTC 13129
  CDS (1)..(1521): transl_table=11
atgaatcaaccacagtatgttgctgcgattgaccaaggaacgacgtcgacacgctgcatcattttcgaccacaacggccaacaagtaggcgttggccagtacgaacacgaacaaatcttcccccaaaaaggctgggtagagcacaacccaatggaaatctgggccaacacgcgccaagccgttgggacagcactcgccgaaagcgacgtctcccgtgaagacatcgtagccgtaggcataacaaaccagcgtgaaaccacggtggtctggaacaaaactactggtgaacccatatataacgccattgtgtggcaggacacccgcactaactccatctgctcggagttagcccaaggcgaccctgcccggtggcaaaaacgtaccggtttgctcatcaactcataccccgcgggcccccgactcaagtggatattggacaacgtcgagggtgcccgcgaactagcagagaacggcgatttgctcttcggaaccattgatacgtggttgctgtggaacctgaccggcggtgccgagggtgacaacggccagcctgccgttcacgctaccgacgtaaccaatgcctcccgcaccctactcatggatctggaatccctgcaatgggatgaggaactatgtgccgcgttggatattccaatgcaggtgttgccagagattcgtccttcagttggtaacttcggccaagtacgtgcacgtggatcactagctggtgttccgatccgcgccatcctcggtgaccagcaagccgcaatgttcggacaggcatgcttccggccaggtgatgccaaatgtacatacggcacggggttgttccttctggagaacacaggcaaaaccccgaagcattccgaaaacggtttgctcaccaccgtgtgtttccagctcgaaggcgaaaaaccggtctatgccctcgaaggatccgttgccatggggggctcgctcgtccaatggctacgcgacaaccttcaaatcatcccgaactcgcccgccattgaaaacctcgcacgcgaagtacccgacaacggtggcgtgtacatcgtccccgcattctccggactattcgcaccacgctggcgccccgacgcccgcggggtcatcgtgggcctgacccgctttgccaaccgcaagcacctcgcccgcgcagtactcgaggccaccgcctaccaagtgcgcgaagtgatcgatgccatggtcgcggattccggagtagaactcaccgaaatgcgtgtcgacggcggcatggtcatgaacgaactgctcatgcaattccaagccgacgtcctacgatccgacgtcacgcgccccaagaacatcgagaccacagccaccggcgtagcctacgcagccggcctcggcgtgggctactgggacagcctcgacgtactccgcaacatgaacgaagtggacaaaacctggcacgccaagatggacgccgacaagatcgacgagctccttgccgaatggaacaaagcagtcgaacgcacctacaactgggaaaactaa

SEQ ID NO: 69485 - protein, 506 aa, Corynebacterium diphtheriae NCTC 13129
MNQPQYVAAIDQGTTSTRCIIFDHNGQQVGVGQYEHEQIFPQKGWVEHNPMEIWANTRQAVGTALAESDVSREDIVAVGITNQRETTVVWNKTTGEPIYNAIVWQDTRTNSICSELAQGDPARWQKRTGLLINSYPAGPRLKWILDNVEGARELAENGDLLFGTIDTWLLWNLTGGAEGDNGQPAVHATDVTNASRTLLMDLESLQWDEELCAALDIPMQVLPEIRPSVGNFGQVRARGSLAGVPIRAILGDQQAAMFGQACFRPGDAKCTYGTGLFLLENTGKTPKHSENGLLTTVCFQLEGEKPVYALEGSVAMGGSLVQWLRDNLQIIPNSPAIENLAREVPDNGGVYIVPAFSGLFAPRWRPDARGVIVGLTRFANRKHLARAVLEATAYQVREVIDAMVADSGVELTEMRVDGGMVMNELLMQFQADVLRSDVTRPKNIETTATGVAYAAGLGVGYWDSLDVLRNMNEVDKTWHAKMDADKIDELLAEWNKAVERTYNWEN

SEQ ID NO: 69486 - DNA, 1503 bp, Rhodopseudomonas palustris CGA009
  CDS (1)..(1503): transl_table=11
atgcctttcgtcatggccatcgatcagggcaccacctcgtcgcgggcgattctgtttcgttccgacatttcgatcgcggcctccgcgcagcaggaattcccgcagcatttcccggcgtccggctgggtcgagcacgagcccgaggacatctgggcgacgaccattgctacctgtcgcgctgcgatggacaaggccggcgcgaccgccgccgacatcgccgcgatcggcatcaccaaccagcgcgaaaccgtggtggtgtgggacgcggtgtccggccaggcgatccaccgcgccatcgtctggcaggatcgccgcaccgcggagttctgcacccggctgaaggccgacgggctggagccgatggtcaccgccaagaccgggctgatcatcgatccgtatttctccggcaccaaggtcgcctggctgctcgacaacgtgcccggcgcacgcgctcgcgccgagcgtggcgagctgaaattcggcaccgtcgattgctatctgctgtggcggctgaccggcggcaaggtccacgccaccgacgccaccaatgcgtcgcgcacgctgctgttcaacatccacgacggcgcctgggacgacgagctgctcaagctgctcggcgtgccgcgctcgatgctgccggaggtgaaggattcatcggcgcatttcggcgacagcgtgccggagctgttcggcggctcgatcaccatccgcggcatcgccggcgaccagcaggcggcgaccatcggccaggcctgcttcaccccgggcatgatcaaatcgacctacggcaccggttgcttcgcgctgctcaacaccggcgcgacgccggtgaagtcgaacaacaagctgctgaccacggtcgcctatcagctcgacggcaagcgcacctatgcgctcgagggctcgatcttcgtcgccggcagcgcggtgcaatggctgcgcgacggcctcggcgtcatcaagcacgcctccgagaccgggccgctcgccgataaatcggattcggcgcagagcgtgtatctggtgccggcgttcgtcggcatgggcgcgccgtattggaatccgcgggtccgcggcgcgctgttcggcctgacgcgcaacaccggcccggccgaactcgcccacgccgccctggagagcgtgtgctaccagaccttcgatctgtgggcggcgatgcgggccgactggccggatgccgacgccgccaccaccgtgctccgcgtcgacggcggcatgaccgcctcggactggaccatgcagcgtctcgccgatcttttagacgcgccggtcgatcgcccggtgatccaggaaaccaccgcgctcggcgccgcctacctcgccggcctcagtgcaggcgtcttccccgagccgcaaaaattcgccgacaactggcgcctcgaccaccgcttccgccccgcgatgagcgcagcgacgcgcgagcgtaaattggcgggctggggcagagcggtgaagggattgttggcgacggatgagggggagtag

SEQ ID NO: 69487 - protein, 500 aa, Rhodopseudomonas palustris CGA009
MPFVMAIDQGTTSSRAILFRSDISIAASAQQEFPQHFPASGWVEHEPEDIWATTIATCRAAMDKAGATAADIAAIGITNQRETVVVWDAVSGQAIHRAIVWQDRRTAEFCTRLKADGLEPMVTAKTGLIIDPYFSGTKVAWLLDNVPGARARAERGELKFGTVDCYLLWRLTGGKVHATDATNASRTLLFNIHDGAWDDELLKLLGVPRSMLPEVKDSSAHFGDSVPELFGGSITIRGIAGDQQAATIGQACFTPGMIKSTYGTGCFALLNTGATPVKSNNKLLTTVAYQLDGKRTYALEGSIFVAGSAVQWLRDGLGVIKHASETGPLADKSDSAQSVYLVPAFVGMGAPYWNPRVRGALFGLTRNTGPAELAHAALESVCYQTFDLWAAMRADWPDADAATTVLRVDGGMTASDWTMQRLADLLDAPVDRPVIQETTALGAAYLAGLSAGVFPEPQKFADNWRLDHRFRPAMSAATRERKLAGWGRAVKGLLATDEGE

SEQ ID NO: 69488 - DNA, 1491 bp, Geobacter sulfurreducens PCA
  CDS (1)..(1491): transl_table=11
atgagcttcatcctcgcgcttgaccaggggacgaccagttcccgcgccctggtattcgaccatgacgggaacgtgctcgggctcgcccagaaggagtttcgccagatattcccccaaccgggcctggttgagcacgatgccgaggagatctgggcctcccagctgggggtggtggtggaggccattgcccgggccgggatcaccgccgcggacattgccgccatcggcatcaccaaccagcgggagacgacggtggtctgggatcgccgcaccggccggccgatccaccacgccatcgtctggcaggaccggcgcacggccggcgagtgcgaccggctcagggccaaggggctggagccgaccttccgcaacaggaccgggctggtgctggacccctacttctcgggcaccaagctggcctggctgctcgataacgtgcccggggcacgggccagggccgaggcgggggaactggccttcggtacgatcgattcctggctggtctggaacctgaccggcggcgagcggcacctgaccgatgccagcaacgcctcccggacgctcctgttcaacatccacgacggcgcctgggacccggaactgctggagctgctccggatcccgcccgcgatcctgccccaggtggtggcctccagcgaggtctacggcgagaccgccgcccgcttcctggcggcgcgcatccccatctgcggcatcgcgggggaccagcaggcggcgctgttcggtcagctctgcgaccggcccgggatggtgaagaacacgtacggcaccggctgcttcatgctgatgcagaccggcgagcggccggtgctctcggggcggaacctcctgaccaccgtggcctgccgactgggcaaccggacggagtacgccctggaggggagcgtgttcgtggccggcgcggcggtgcagtggctgcgggacgggctcggcatcatccgcacctcggcggaggtggagacgctggccgcctcggtcccggacaacggcggggtctacctggtgccggcctttgcggggctgggcgctccccattgggacccctacgcccggggcgccctgctgggcatcacccgcggcaccaccgccggccacatcgcccgggccaccttggagagcatcgccttccagacggccgatctcctggaggccatggaggccgatgcggctaccccgctggccgaactgcgggtggacggcggcgccacggccaacaacatgctgatgcagttccaggccgacctcctgggggtgccggtggtgcggccccgggtgcgcgagaccacggccctgggcgctgcctacctggccgggctggcggtgggctactggcgggaccgggccgagatcggccggctctggcaggcggagcacacctttgagccggccatggaccgggacagggcggcggagctgcgctccacctggagcagggccctggaaaggtcccaggggtgggcgcagccatga

SEQ ID NO: 69489 - protein, 496 aa, Geobacter sulfurreducens PCA
MSFILALDQGTTSSRALVFDHDGNVLGLAQKEFRQIFPQPGLVEHDAEEIWASQLGVVVEAIARAGITAADIAAIGITNQRETTVVWDRRTGRPIHHAIVWQDRRTAGECDRLRAKGLEPTFRNRTGLVLDPYFSGTKLAWLLDNVPGARARAEAGELAFGTIDSWLVWNLTGGERHLTDASNASRTLLFNIHDGAWDPELLELLRIPPAILPQVVASSEVYGETAARFLAARIPICGIAGDQQAALFGQLCDRPGMVKNTYGTGCFMLMQTGERPVLSGRNLLTTVACRLGNRTEYALEGSVFVAGAAVQWLRDGLGIIRTSAEVETLAASVPDNGGVYLVPAFAGLGAPHWDPYARGALLGITRGTTAGHIARATLESIAFQTADLLEAMEADAATPLAELRVDGGATANNMLMQFQADLLGVPVVRPRVRETTALGAAYLAGLAVGYWRDRAEIGRLWQAEHTFEPAMDRDRAAELRSTWSRALERSQGWAQP

SEQ ID NO: 69490 - DNA, 1548 bp, Mycobacterium avium subsp. paratuberculosis str. k10
  CDS (1)..(1548): transl_table=11
gtgtcaccgaacaggagagctgtggccgaattcgccgaattcatcgccgccatcgaccagggcaccaccagcacgcgctgcatgatcttcgatcaccagggtgccgaggtggcccgccatcagctcgagcacgagcagatcctgccccgggcgggctgggtcgagcacgacccgatcgagatctgggagcgcacctcctcggtgttgacgtcggtgctcaaccgggccaacctgtccgcggaaaaccttgccgcgctgggcatcacgaatcagcgcgagaccaccctggtatggaaccgcaagaccggccggccctattacaacgcgatcgtctggcaggacacccggaccgaccggatcgcgtcggcgctcgaccgcgacggccgcggccaggtgatccgccgcaaggcgggcctgcccccggcgacctacttctccggggcgaagttgcaatggatcctggacaacgtcgacggggtgcgcgaggcggccgagcgcggcgacgcgttgttcggcactgccgacagctgggtgttgtggcagctcaccggggggccgcggggcggggtgcacgccaccgacgtgaccaacgccagccggaccatgctgatggacttggagacgctggactgggacgacgagctgctgtcgttcttcaccatcccgcgcgccatgctgcccgagatcgggccgtcgtcgtcgccgcggccgttcggggtgacctcggacaccgggccggccggcggccggataccgatcaccgccgtgctgggggatcagcacgcggcgatggtgggccaggtctgcctggccgagggcgaagccaaaaatacctacggcaccgggaatttcctgctgctcaacaccggtgagagcatcgtgcggtccgagcacggattgctcaccaccgtgtgttaccagttcggcgacgccaaacccgtttacgcacttgagggttcgatcgcggtcaccggcgccgccgtgcagtggctgcgcgaccagttgggcatcatcagcggcgccgcgcagagcgaatcgcttgcgcggcaggtcgacgacaacggcggcgtctatttcgtccccgccttttccgggctgttcgcgccctactggcgttcggatgcgcgcggcgcgatcgtcgggctgtcgcggttcaacaccaatgcccacctggcgcgggcgacgctggaggcgatctgctatcagagccgtgacgtggtggacgcgatggcagcggattctggtgtgcgccttgaggttttgaaggtcgacggcggcatcaccggaaacgacctgtgcatgcagatccaggccgatgtgttgggcgtggacgtggtgcggccggtggtggccgagaccaccgcgctgggcgcggcgtacgcggccgggctggcggtggggttctgggccgacccgggcgagctgcgggccaactggcgcgaagacaagcgctggacgccggcctggagcgacgagcagcgcaccgcgggttacgcgggctggcacaaggccgtgcagcggaccctggattgggccgacgtcacgtga

SEQ ID NO: 69491 - protein, 515 aa, Mycobacterium avium subsp. paratuberculosis str. k10
MSPNRRAVAEFAEFIAAIDQGTTSTRCMIFDHQGAEVARHQLEHEQILPRAGWVEHDPIEIWERTSSVLTSVLNRANLSAENLAALGITNQRETTLVWNRKTGRPYYNAIVWQDTRTDRIASALDRDGRGQVIRRKAGLPPATYFSGAKLQWILDNVDGVREAAERGDALFGTADSWVLWQLTGGPRGGVHATDVTNASRTMLMDLETLDWDDELLSFFTIPRAMLPEIGPSSSPRPFGVTSDTGPAGGRIPITAVLGDQHAAMVGQVCLAEGEAKNTYGTGNFLLLNTGESIVRSEHGLLTTVCYQFGDAKPVYALEGSIAVTGAAVQWLRDQLGIISGAAQSESLARQVDDNGGVYFVPAFSGLFAPYWRSDARGAIVGLSRFNTNAHLARATLEAICYQSRDVVDAMAADSGVRLEVLKVDGGITGNDLCMQIQADVLGVDVVRPVVAETTALGAAYAAGLAVGFWADPGELRANWREDKRWTPAWSDEQRTAGYAGWHKAVQRTLDWADVT

SEQ ID NO: 69492 - DNA, 1452 bp, Lactobacillus johnsonii NCC 533
  CDS (1)..(1452): transl_table=11
atgactgaaaaatatattttagcaattgatcaaagcacccaaggaactaaggtacttctaatcaatcatcagaatcaaattttcttcaaggcttccctttcccaccaacagctcattaatgaaaatggctgggtgagtcataatttaaatgaaataaaaaataatctaaaacagctatttaagcagattcttgaaaaagttgattctagacaacttgaagccgtcgctattaccaaccaacgtgaatcggcagctgcctggtctcgaagaactggtgaaccgctttgctatactattgtttggcaagataatcgctcagaacaattaatcaatcaaattacatatccagaattagctagaaaagtaaaaaacaaaactggtttagctctttctccatattttactggagccaaatggggttggatgcttttaaatgaacccagagtgattcaagcacatgctaacaatgacctctgcttaggaacaatagactcttggctagtttatcaactcactaatggcgaatcttttaagactgaagtttctaatgcttgtcgaactgagctaatgaatataaaaactggaacatgggatcaggatttaggtgaaatttttggtattgatctcaatgatcttcctaaaattgttgattcaaatgctaattttggtgaaactaatttatttggtctcattcctcataaaattcctattcttagcgttttaggtgattctcaagctgccttatttgctcatgggtgttttaatcctggtgactttaaagttacgtttggaactggttcttctgtgatgttaaatataggtaataatttaccaaaaaatattaataatcagcttaatacatctcttgcctggtcaattaatggtaaaaaatcttacgttcttgaaggaaatattaattatgcaggagcttgcgttacatggttaaaagacaagctacatttaattcacgatccgtctgatactactatgctggccctaaccgctaatccaaatgatcatactattttaattccggcttttgctggacttggcgctccttattggctccctaatatgaaagctgcatttgttaatatgacagctaccactggtaaaaaagaattagtacgtgccactctaaattcattagtttatcaaatcaatgatattctacaggcatttcatcacttttcttctcaagtgaacagtgaaattcatgctgatggtggaatgatacaaaataaatatttaatgcaatatttaagtaatatcactcaaaaaaatgtaaagattgctgaagtcgctgagttaagtgctctgggaactgcgatgaattcaatgcaacaatttgatgggatgcattattctaaaacttatattcctcgaatggacaaacatgcagcaaataagtattcaagtgaatggtcttcttggataaaaaaattatcataa

SEQ ID NO: 69493 - protein, 483 aa, Lactobacillus johnsonii NCC 533
MTEKYILAIDQSTQGTKVLLINHQNQIFFKASLSHQQLINENGWVSHNLNEIKNNLKQLFKQILEKVDSRQLEAVAITNQRESAAAWSRRTGEPLCYTIVWQDNRSEQLINQITYPELARKVKNKTGLALSPYFTGAKWGWMLLNEPRVIQAHANNDLCLGTIDSWLVYQLTNGESFKTEVSNACRTELMNIKTGTWDQDLGEIFGIDLNDLPKIVDSNANFGETNLFGLIPHKIPILSVLGDSQAALFAHGCFNPGDFKVTFGTGSSVMLNIGNNLPKNINNQLNTSLAWSINGKKSYVLEGNINYAGACVTWLKDKLHLIHDPSDTTMLALTANPNDHTILIPAFAGLGAPYWLPNMKAAFVNMTATTGKKELVRATLNSLVYQINDILQAFHHFSSQVNSEIHADGGMIQNKYLMQYLSNITQKNVKIAEVAELSALGTAMNSMQQFDGMHYSKTYIPRMDKHAANKYSSEWSSWIKKLS

SEQ ID NO: 69494 - DNA, 1488 bp, Bdellovibrio bacteriovorus HD100
  CDS (1)..(1488): transl_table=11
gtgtttatgtcttcttttatcatggccattgaccaagggacaaccagctcaagaacatgcattatcaatcaagccggaggtcttgtcgccgaggctcgtgaggcattcaaacaaatcttcccgaaaccaggctgggttgaacatgatcctgaagatatctggtattccacgcaaaggtccatgcgtctggcgctggaaaaagcaaaaatcaaaggatcgcagattcgcacgattggcatcaccaatcagcgtgaaactgtgatgctttgggacgcgaagtccggaaaagccctgcataacgccattgtctggcagtgtcgccgcacgcaggatctgtgtgaaaagctcaagaaaaacaaaaaagaaaagatcatcaccgccaagacgggtttggtgctggatccttatttctcagccaccaaaattcagtggttgcttaagaatgtcccgaacgcggcaaagaaggccaaagacgggcaggctctggccggcaccgtcgacagcttcttgttgtggaaactgactgcagggcattcacataagacagatgtcagtaatgcctcccgtacgatgttgatgaacatccacaccgggtggtgggatgaggaccttttgaaaatctttggtgtgcctgaagccatcctgccagagatctgtccgtccaattctgattttggtgtgacccaaggtctgggttttatgcccgacggaattccaatcacaggtattgtgggggaccagcaggcggccttgtttgggcagacatgttttgaaaccggagattccaagtgcaccttcggcaccggaagtttcctgcttttaaacaccggcaaaaaagccgtgaaatcgaaaaacaaattgctgaccacgattgcctggaaactaaaaaatcaggagatgacttacgcactggagggtggcgcctttgtctgtggagctgcggttcagtggctgcgcgacggcctggggttgatccagcagtcttcggatgttgaagctctggcaaaaacagtcgacggcactgatggggtggaatttgttcccgccctgacgggactgggggctccgcactggcagccggaagcacgtggcctgatttgcggtcttacccgtggcagcaccaaagcccacattgcgcgcgcgacgttggaagccatggccttgcaaaacgtggatatcctgaacaccatgcaaagagatctgggaaaaaagctgcgcggagtccgtgtcgacggaggtgcggcggccaatgatttgttaatgcagatgcaggcggattactgcggagccaacgtggttcgtccccaaaatcttgaaacgacagctttgggggccgcatttatggcgggtcttggggctggtgtgtggaaagacctgaaagagatcaaacgcgtctggaaagtgaacaaagaattcaaagtaaagatgaccccgaaagcccgcaaagaacgtttgcagcgctgggcacaggcgctggagcgagtgtaa

SEQ ID NO: 69495 - protein, 495 aa, Bdellovibrio bacteriovorus HD100
MFMSSFIMAIDQGTTSSRTCIINQAGGLVAEAREAFKQIFPKPGWVEHDPEDIWYSTQRSMRLALEKAKIKGSQIRTIGITNQRETVMLWDAKSGKALHNAIVWQCRRTQDLCEKLKKNKKEKIITAKTGLVLDPYFSATKIQWLLKNVPNAAKKAKDGQALAGTVDSFLLWKLTAGHSHKTDVSNASRTMLMNIHTGWWDEDLLKIFGVPEAILPEICPSNSDFGVTQGLGFMPDGIPITGIVGDQQAALFGQTCFETGDSKCTFGTGSFLLLNTGKKAVKSKNKLLTTIAWKLKNQEMTYALEGGAFVCGAAVQWLRDGLGLIQQSSDVEALAKTVDGTDGVEFVPALTGLGAPHWQPEARGLICGLTRGSTKAHIARATLEAMALQNVDILNTMQRDLGKKLRGVRVDGGAAANDLLMQMQADYCGANVVRPQNLETTALGAAFMAGLGAGVWKDLKEIKRVWKVNKEFKVKMTPKARKERLQRWAQALERV

SEQ ID NO: 69496 - DNA, 1491 bp, Treponema denticola ATCC 35405
  CDS (1)..(1491): transl_table=11
atgaaaaaatatgttttagcctttgatcagggaactacgagctgcagggcaatcttgttcgataaagacggaaaaaaaattgaaactgcccagcaggagttttctcaaatttttcctaagcagggctgggtcgagcatgatgccatggaaatatggggaaagcaaagcggtgtagcccgcgaagttttggaaagaagcggagtttccacccaagagattgctgcaatcggaattaccaatcagcgtgaaacaaccgttgtttggaacaaaaataccggccgtcccgtttgtaatgctatagtttggcagtgccgcagaaccgccgatatctgcgatgctcttaaagaaaaaggcctatccgattctatcagaaaaaaaaccggcttgataatagacgcttatttttcgggaaccaagataaagtggattttggataatgttcccgaagcaagaactctggccgaaaaaggcgagcttcttttcggaaacatcgacacttggcttatctggaatttgaccagaggtaaggtgcatgtaaccgattatacaaacgcatcccgcaccttgctttttaatattcacaccctgcaatgggataaggagcttttaaaggctatggatatccccgaatctatgctgcccgaagtcaagccttcaagttatgtttacggttataccgaagagcatacattcggaggatctaagattccgattgcgggggctgcaggcgatcagcaggcagccctcttcgggcaagcctgttttgaagaaggctctgcaaaaaacacttatggaaccggctgctttatgttaatgaataccggagataagataatagaatcagaaaacgggcttcttacgactattgccttcggtatagataatagtgtaaaatatgccttggagggaagtagttttatagcgggtgctgcagttcaatggctgagagatgagttaaaacttatctatactgcccacgaaacggaatactatgcagggcttgtaaacgacacaaacggagtttattttgttccggccttttcaggtctgggtgctccctactgggatatgtatgcccgcggtgctcttttgggcttgacaaggggagcgaaaagagagcatattgtacgtgcggtcttggaagccatcgcctatcaaacaaaggatgtcctttatgctatggaaaaggattccaagataaacttaaaatcgcttaaagtagacggcggagcttgtgccaataattttttaatgcagtttcagtcggatattttaaatgtgcccgttttacgcccctacgaaaaagaaacgacggccttgggggctgcctatcttgcaggccttgccgttggcttttggaaagagcagggcgaaataaaacggattcaggatatcgaaagggaatttaggccggacatggaagaagaaaaaagaaagactctctatgccggatggaaaaaggctgtagaacgctcaatgaaatgggcctaa

SEQ ID NO: 69497 - protein, 496 aa, Treponema denticola ATCC 35405
MKKYVLAFDQGTTSCRAILFDKDGKKIETAQQEFSQIFPKQGWVEHDAMEIWGKQSGVAREVLERSGVSTQEIAAIGITNQRETTVVWNKNTGRPVCNAIVWQCRRTADICDALKEKGLSDSIRKKTGLIIDAYFSGTKIKWILDNVPEARTLAEKGELLFGNIDTWLIWNLTRGKVHVTDYTNASRTLLFNIHTLQWDKELLKAMDIPESMLPEVKPSSYVYGYTEEHTFGGSKIPIAGAAGDQQAALFGQACFEEGSAKNTYGTGCFMLMNTGDKIIESENGLLTTIAFGIDNSVKYALEGSSFIAGAAVQWLRDELKLIYTAHETEYYAGLVNDTNGVYFVPAFSGLGAPYWDMYARGALLGLTRGAKREHIVRAVLEAIAYQTKDVLYAMEKDSKINLKSLKVDGGACANNFLMQFQSDILNVPVLRPYEKETTALGAAYLAGLAVGFWKEQGEIKRIQDIEREFRPDMEEEKRKTLYAGWKKAVERSMKWA

SEQ ID NO: 69498 - DNA, 1518 bp, Mycoplasma mycoides subsp. mycoides SC str. PG1
  CDS (1)..(1518): transl_table=4
atgacagatagtaaaaaatacatcttaacactagatgaaggaacaacaagtgcaagagctttaattactgataaacaaggtaatattattgctgttgaacaatcagaatttactcaatactttccaaaagaaggatgagtagaacatgatgctattgaaatttgaaatactcaacgttctgcattagtacaagttttaaataaatctggaattgatccaagccagattgaagcaattggaattactaatcaacgtgaaactgctgttatttgaaataaagaaactggattaccaatttataatgctatagtttgacaagatcaaagaacagctgactattgtcaaacatttgataaagatactttagaaatggtaaaacaaagatctggattaataattaatccatacttttcaggaactaaagtaaaatgaattttagataatgttccaaacgctagacaactagcaaaagaaggaaagctaatgtttggaacaatcaacacatgattaatttatcgtctaacaggtggagaagtatttgtaacagatcatactaacgcacaaagaactttactatacaatattcacacaaatgactgagatgatgaattattaaaattatttgatattccaagaaacattcttcctgaaattaaatcatgtagtgaagtttatggatacacatttaaagggctattttctaaaggcaatgagcaaagaatcaaaattgcatcatcaattggtgatcaacaaagtgctttgtttgggcaattatgcttagaaaaaggtcaagtaaaagtaacttatggaacaggatgctttattttaacaaatactggtgaagaaattgttaaatcaaatcatggtttattaacaacagttgcttattcatttaaagacaaagtatattatgctttagaaggttcagtaatgattgctggagctgctgttcaatgattaagagataatctaagaattgtttataatgctattgaaacagaatgatatgctgatcaagttaaagatgatagaagagtttatgttgttccatcatttactggattaggttctccttattgagattcattctcacgtggtgctatttttggactagatcgtggaactagacgtgaacatattgttagagcaactctagaagctattgtataccaagcaaatgatgttgttgatgcaatgagaaaagatatgaaaaaaccaatcgaaatttttaaagtagatggtggggccgcaaataacaaattcttaatgcaattccaatcaaatatttctcaatctaaagttataaaaccaacaaacgtagaaactactgctatgggagctgcatttatggtaggattagctgttggatattgagaaaatgctgaagaattgaaaaaaacttataaagttcactttgaattaacaccagaactaagtaaaccagaagttgataaattaattaaaggttgaaaagtagctgttcaaagaacatttaaatgagtagaagaaattgaataa

SEQ ID NO: 69499 - protein, 505 aa, Mycoplasma mycoides subsp. mycoides SC str. PG1
MTDSKKYILTLDEGTTSARALITDKQGNIIAVEQSEFTQYFPKEGWVEHDAIEIWNTQRSALVQVLNKSGIDPSQIEAIGITNQRETAVIWNKETGLPIYNAIVWQDQRTADYCQTFDKDTLEMVKQRSGLIINPYFSGTKVKWILDNVPNARQLAKEGKLMFGTINTWLIYRLTGGEVFVTDHTNAQRTLLYNIHTNDWDDELLKLFDIPRNILPEIKSCSEVYGYTFKGLFSKGNEQRIKIASSIGDQQSALFGQLCLEKGQVKVTYGTGCFILTNTGEEIVKSNHGLLTTVAYSFKDKVYYALEGSVMIAGAAVQWLRDNLRIVYNAIETEWYADQVKDDRRVYVVPSFTGLGSPYWDSFSRGAIFGLDRGTRREHIVRATLEAIVYQANDVVDAMRKDMKKPIEIFKVDGGAANNKFLMQFQSNISQSKVIKPTNVETTAMGAAFMVGLAVGYWENAEELKKTYKVHFELTPELSKPEVDKLIKGWKVAVQRTFKWVEEIE

SEQ ID NO: 69500 - DNA, 1593 bp, Homo sapiens
  CDS (1)..(1593)
atggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggatgggtggaacaggaccctaaggaaattctacattctgtctatgagtgtatagagaaaacatgtgagaaacttggacagctcaatattgatatttccaacataaaagctattggtgtcagcaaccagagggaaaccactgtagtctgggacaagataactggagagcctctctacaatgctgtggtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttcttctgagatctatggcctaatgaaaatctctcatagcgtgaaagctggggccttggaaggtgtgccaatatctgggtgtttaggggaccagtctgctgcattggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccagtatattatgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcagttcaccaataaatgccatattgcttttgctgcattagaagctgtttgtttccaaactcgagagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggaggaaagtgaaattcgttattctacatggaagaaagctgtgatgaagtcaatgggttgggttacaactcaatctccagaaagtggtattccataa

SEQ ID NO: 69501 - protein, 530 aa, Homo sapiens
MAASKKAVLGPLVGAVDQGTSSTRFLVFNSKTAELLSHHQVEIKQEFPREGWVEQDPKEILHSVYECIEKTCEKLGQLNIDISNIKAIGVSNQRETTVVWDKITGEPLYNAVVWLDLRTQSTVESLSKRIPGNNNFVKSKTGLPLSTYFSAVKLRWLLDNVRKVQKAVEEKRALFGTIDSWLIWSLTGGVNGGVHCTDVTNASRTMLFNIHSLEWDKQLCEFFGIPMEILPNVRSSSEIYGLMKISHSVKAGALEGVPISGCLGDQSAALVGQMCFQIGQAKNTYGTGCFLLCNTGHKCVFSDHGLLTTVAYKLGRDKPVYYALEGSVAIAGAVIRWLRDNLGIIKTSEEIEKLAKEVGTSYGCYFVPAFSGLYAPYWEPSARGIICGLTQFTNKCHIAFAALEAVCFQTREILDAMNRDCGIPLSHLQVDGGMTSNKILMQLQADILYIPVVKPSMPETTALGAAMAAGAAEGVGVWSLEPEDLSAVTMERFEPQINAEESEIRYSTWKKAVMKSMGWVTTQSPESGIP

SEQ ID NO: 69502 - DNA, 1533 bp, Bacillus cereus ATCC 10987
  CDS (1)..(1533): k means g or t/u, m means a or c
atgaaaaaatatattctttcattagaccaaggaacaactagctcacgtgcaattctgktcaataaaaagggtgaaattgttcattcagctcaaaaagaatttacacaacattttccaaagccaggctgggtagagcataacgcgcaagaaatttggggatctattttagcagttatcgcaacttgcttaagcgaagcagatgtaaaaccagaacaaatcgctggtatcggtattacgaaccaacgtgaaacagcggttgtatgggataaaacaacaggcaaaccaatttataacgcaatcgtatggcaatctcgccaaacagctgaaatttgtgatgagttaaaagaaaaaggttatggcgaaatggttcgcgaaaaaacaggtcttttaattgacgcatatttctctggtacgaaagtaaaatggattttagataacgttgaaggtgcaagagagaaagcggaaaacggcgatctattattcggaacaattgatacatggcttgtatggaaactatctggtggtaaagcgcacgtaacggattactcaaatgcatcacgtacgttaatgtttaacattcacgacttacaatgggatgatgaacttctagacatgttaacagtaccaaagagcatgcttccagaagtacgtccatcatctgaagtgtatggagaaacaattgactatcacttcttcggtcaaaatgtaccgattgccggtgtagctggtgaccaacaagcagcattatttggacaagcttgtttcggtgaaggtatggcgaaaaatacttacggaactggttgcttcatgttaatgaacactggtgaaaaagcagtagcttctgagcatggtctattaacaacaattgcatgggggatagatggtaaagtaaactacgcattagaaggaagtattttcgtagcaggttctgcaattcaatggttacgtgacggaatgcgcatgtttaaagatgcaagtgagagtgaagtatatgcgaatcgcgttgaatcaactgacggtgtatacgttgtaccagcattcgtaggattaggtacaccgtactgggatagtgaagtacgcggtgctatgtttggtgtaacacgcggtacgacgaaagagcatttcattcgtgcaacactagaatctttagcttaccaamcgaaagacgtattatgcgcaatggaagcagattcaggtattgaactgaaaacattacgcgttgatggcggagcagttaaaaataacttcttaatgaagttccaaagtgatattttagatgttcctgtagagcggccggtgatcaatgaaacaacagctttaggtgcagcgtacttagctggtcttgcggttggatattggaaaaaccaagatgaaattaaagaacagtggcatatggacaaacgcttgaaccaacaatggaagcggaaacaagcaaagagctatatgctggatggaaaaaagcaattgaagcaacaaaagctttcaaataatcataaacagtgttataatggtgacaagttaataattcggtag

SEQ ID NO: 69503 - protein, 510 aa, Bacillus cereus ATCC 10987
  misc_feature (20)..(20): Xaa can be Val or Phe
  misc_feature (387)..(387): Xaa can be Thr or Pro
MKKYILSLDQGTTSSRAILXNKKGEIVHSAQKEFTQHFPKPGWVEHNAQEIWGSILAVIATCLSEADVKPEQIAGIGITNQRETAVVWDKTTGKPIYNAIVWQSRQTAEICDELKEKGYGEMVREKTGLLIDAYFSGTKVKWILDNVEGAREKAENGDLLFGTIDTWLVWKLSGGKAHVTDYSNASRTLMFNIHDLQWDDELLDMLTVPKSMLPEVRPSSEVYGETIDYHFFGQNVPIAGVAGDQQAALFGQACFGEGMAKNTYGTGCFMLMNTGEKAVASEHGLLTTIAWGIDGKVNYALEGSIFVAGSAIQWLRDGMRMFKDASESEVYANRVESTDGVYVVPAFVGLGTPYWDSEVRGAMFGVTRGTTKEHFIRATLESLAYQXKDVLCAMEADSGIELKTLRVDGGAVKNNFLMKFQSDILDVPVERPVINETTALGAAYLAGLAVGYWKNQDEIKEQWHMDKRLNQQWKRKQAKSYMLDGKKQLKQQKLSNNHKQCYNGDKLIIR

SEQ ID NO: 69504 - DNA, 1935 bp, Eremothecium gossypii
  CDS (1)..(1935)
atgacgctgaacgtggtgccaaaaggggaaattccgctgattgcggccatcgacgtggggaccacgtcgacccgtgcgatattattcaacaagcagggacaggaggtgtccaagtaccagatcgagtactccacgacggcagccaaggacaaggaggcgtcgtcgccggggtctgcggggtctggtaagggcattattttctctgccgagggtattgccatcgaggcgaacgagtacgtggagatcgaggagctggagcaccaggacgccaccttgcgcttcccccaccccggctgggtggagtgcaagccgatgaacatcttggccaacgtcgtccagtgctttgccgctaccttgatctcgatcaacaaggtgaacgacgagcgtgtggaaaacaatctgcctccatacgtgatcaagtgcattggtgtcaccaacatgcgggagaccacgatcgtgtggtctaagaagaccggcttgccggtagtggactatggtattgtgtggaacgacacacgtaccatggatatcgtgaacacaaaaaaaagcgagaccccccctgaggagcaggagcggttgcgtgcgaagacgggtcttccgccatactccacgtacttctcgtgctccaagttgcgttggttcttggacaacgtccctgaagttctggaagcttacgaaagcggcgacttgatgttcggcaccgtcgacacctggttgatttaccatctcacaggcaaccatgcgtttgtctccgacgtcaccaatgcatccagaaccgggttcatgaacctggacactcttgactacgacgacgaactcctggagtactgggggattgacaggagcaagctcaacatgccaaagattgtcccgtctgcccagtactatggtgacttctgtgtccccgccgtgacaaagaagaagttgacagaggctgcctgggacgtgttgacgtccttcagccagtccggcattccaatccagggctgcttgggtgaccagagctcctctctagtgggccagatggcattcaaggccggctctgccaagtgtacgtacggtaccggctgcttcttggtgtacaacaccggcacaaagaaattgctttcccagcacggtgccttgaccacgttcggtttttggttcccggagttggagggctccgaagccagtaagccacatttcgtcttggaaggttccgtcgccgtcgccggctctgtggtgcagtggctaagagacaacttgagactatttccaagggcggaggacgtcgggccattggccagcagagttccggactgcggcggcgttgttttcgttccggccttcagcggcctattcgctccctactgggacgcagctgcccgtggcaccatattgggcatgtcgcagttcaccacggcctcgcacatcgcgcgtgccgcaatcgagggcgtgtgcttccaagccagagcgatcttgaaggccatgagctccgacgccttcggcgagggcgccaaggaccacgacttcttggaggagatcgtcgacacaggcacgtacgagcactcgcccttgtcggtcttggccgtcgacggcggcatgtccaagtcagacgaggtcatgcagatccaggccgacatcttgggtccctgtgtcaaggtcagacgctcgcccaccgcagagagcaccgcattgggcgccgcaatcgctgcgtgcatggcgtacaaggaccccaacgagcgtgtgtggaaggacctcaacgacgccaaaaaatggatcttctatggcgggttggaaaaagaggaggccctgcgcactccggacaacgtctcctcgaagttgaagatattcgccagccagtccgttgacaccgtccggagaaagaactggaagcgctgggaagcggccatcgaaagaaccaagggttggttacacgacgcagagggcaattaa

SEQ ID NO: 69505 - protein, 644 aa, Eremothecium gossypii
MTLNVVPKGEIPLIAAIDVGTTSTRAILFNKQGQEVSKYQIEYSTTAAKDKEASSPGSAGSGKGIIFSAEGIAIEANEYVEIEELEHQDATLRFPHPGWVECKPMNILANVVQCFAATLISINKVNDERVENNLPPYVIKCIGVTNMRETTIVWSKKTGLPVVDYGIVWNDTRTMDIVNTKKSETPPEEQERLRAKTGLPPYSTYFSCSKLRWFLDNVPEVLEAYESGDLMFGTVDTWLIYHLTGNHAFVSDVTNASRTGFMNLDTLDYDDELLEYWGIDRSKLNMPKIVPSAQYYGDFCVPAVTKKKLTEAAWDVLTSFSQSGIPIQGCLGDQSSSLVGQMAFKAGSAKCTYGTGCFLVYNTGTKKLLSQHGALTTFGFWFPELEGSEASKPHFVLEGSVAVAGSVVQWLRDNLRLFPRAEDVGPLASRVPDCGGVVFVPAFSGLFAPYWDAAARGTILGMSQFTTASHIARAAIEGVCFQARAILKAMSSDAFGEGAKDHDFLEEIVDTGTYEHSPLSVLAVDGGMSKSDEVMQIQADILGPCVKVRRSPTAESTALGAAIAACMAYKDPNERVWKDLNDAKKWIFYGGLEKEEALRTPDNVSSKLKIFASQSVDTVRRKNWKRWEAAIERTKGWLHDAEGN

SEQ ID NO: 69506 - DNA, 1662 bp, Mus musculus
  CDS (1)..(1662)
atggcagccgcgaagaaagcagttctggggccattggtgggagcagtggaccagggtaccagctcgacacgttttttggttttcaattcaaaaacagctgaacttcttagtcatcatcaagtagaaataaaacaggaattcccaagagaaggatgggtagaacaagacccgaaggaaattctgcagtctgtttatgagtgtatagagaaaacgtgtgagaaacttggacagctcaatattgatatttccaacatcaaagccattggtgtcagcaaccagagggaaaccacagtagtctgggacaaggtcaccggagagcctctctataatgccgtggtgtggcttgacctaagaacccagtctactgttgagaaccttagtaaaagaattccaggaaataataactttgtcaagtccaagacaggccttccacttagcacgtatttcagtgcagtgaaacttcgttggctccttgacaacgtgaaaaaggtccaagaggctgttgaagaaaatagagctctttttgggaccattgattcatggcttatttggagtttaacaggaggaatccatgggggtgtccactgtacagatgtaacaaatgcaagcaggacgatgctttttaacattcattctttggaatgggataaagagctctgcgaattttttggaattccaatggaaattcttcccaacgttcggagttcttctgagatctatggcctaatgaaagctggggccttggaaggtgtaccaatatctgggtgtttgggggaccagtctgctgctttggtgggacaaatgtgcttccaggatggacaggccaaaaacacgtatggaacagggtgcttcttattgtgcaacacgggccataagtgtgtattttctgaacatggcctcctgacaaccgtagcatataaacttggcagagacaaacctgtgtattatgcgttggaaggttccgtggctatagctggtgctgtaatccgctggctaagagacaaccttggaattattaagtcctctgaggaaattgaaaaacttgctaaggaagtaggtacttcttatggctgctacttcgttccagcattttcagggttatatgcgccttattgggagcccagtgcaagagggatcatctgtggactcactcagttcaccaataaatgtcatatcgcttttgctgcactagaagctgtttgtttccaaacccgagagattttggatgccatgaatcgcgactgtggaattccactcagtcatttacaggtagatggaggaatgaccagcaataaaattcttatgcagctacaagcagacattctgtatattccagtagtgaaaccctccatgcctgaaacaactgcactaggcgctgccatggcagctggggctgcagagggggttggtgtgtggagtcttgaacctgaggatttgtcagctgtcacaatggagcggtttgaacctcagatcaatgctgaagaaagcgaaatccgttactccacatggaagaaagctgtgatgaagtcaattggttgggttacaactcagtctccagaaagtggtgaccctagtatcttctgtagtctgcctttgggcttttttatagtgagtagcatggtaatgttaatcggagcaaggtacatctcaggtatcccataa

SEQ ID NO: 69507 - protein, 553 aa, Mus musculus
MAAAKKAVLGPLVGAVDQGTSSTRFLVFNSKTAELLSHHQVEIKQEFPREGWVEQDPKEILQSVYECIEKTCEKLGQLNIDISNIKAIGVSNQRETTVVWDKVTGEPLYNAVVWLDLRTQSTVENLSKRIPGNNNFVKSKTGLPLSTYFSAVKLRWLLDNVKKVQEAVEENRALFGTIDSWLIWSLTGGIHGGVHCTDVTNASRTMLFNIHSLEWDKELCEFFGIPMEILPNVRSSSEIYGLMKAGALEGVPISGCLGDQSAALVGQMCFQDGQAKNTYGTGCFLLCNTGHKCVFSEHGLLTTVAYKLGRDKPVYYALEGSVAIAGAVIRWLRDNLGIIKSSEEIEKLAKEVGTSYGCYFVPAFSGLYAPYWEPSARGIICGLTQFTNKCHIAFAALEAVCFQTREILDAMNRDCGIPLSHLQVDGGMTSNKILMQLQADILYIPVVKPSMPETTALGAAMAAGAAEGVGVWSLEPEDLSAVTMERFEPQINAEESEIRYSTWKKAVMKSIGWVTTQSPESGDPSIFCSLPLGFFIVSSMVMLIGARYISGIP

SEQ ID NO: 69508 - DNA, 1560 bp, Anopheles gambiae str. PEST
  CDS (1)..(1560)
atgagcaccaccggcgggatgaagaaattcggcgacctcgtcggctcgatcgacgagggcaccagctcggcccggtttctgctgttccgggcggagacggccgaggtggtgtgcttccaccagaaggagctgcgcctgatctgcccccaggagggttgggtcgagcaggatccgcatgaaatcctgagcgtcgtgtacgagtgcatcgagcgcacgctggagaagctggtcgagctgggcggcaatccgcagaccgacatcgtggcgatcggtgtgacgaaccagcgcgagacgacgatcgtgtgggaccgcacgaccggcgaaccgctgtacaatgcgatcgtttggcaggacatgcgcacgtcctcgacggtggaccagctgctcgagacggtaccgaacaagacgaagaacaaaaactacctcaaaccgctgtgcgggctgccgctgtcgccgtacttctccgccgtcaagctgcgctggctgctcgacaacgtgccgaaggtgaagggggcggtccgcgccggcagctgcctgttcggcacggtcgacacgtggctgatctggaacctgaccggcggtccggacgggggcgcccacgtcacggacgtgtcgaacgcgtcccgcaccatgctgatgaacatcgagacgctcaagtacgacaaggcgctgatgaagttcttcgacgtgccgctggaaatactgcccaccatccggtccagctcggaggtgtacgggctgatcaagtttcggccgctgcagcacatcccgctggccggctgcctgggtgaccagcagtcggcactggtcgggcaggagtgtttgacgcgcggacgggcaaaggcaacgtacgggacgggatgctttctgctgtacaacaccgggacggcggtgatcgactcgtaccacgggctgatctcgaccgtcgcctaccagatgggaccggacgcgctgcccgtgtacgcgctggagggttcggtggcggtggccggtgccgccctcggctggttgcgcgacaacctgaacctgatcgggggtgcctccgagtcggaatcggccgcactggaggtggagaacaatggggacgtgtactttgtgccggcgttcagtgggctgtacgcaccgtactgggatccggaggcgcgcggcgtcatctgcggcatcacggaggacacgcagcgggggcacatcgtgcgggcggcgctggaggcggtctgctttcaggtgcgcgacatactggacgcaatgaacaacgacagcggcacgccgctgcagaagctcaaggtggacggtggcatgacggcgaacgcgaccatgatgcagtggcaggcggacctgatcgggctggacgtgttgaagcccaagtttgtcgagacgacggcactgggtgctgccatggtagcgggccgtgcggttggcaagtgggatatcgagaacgtgagcgtggaaagcgacagtaccgtgtttaagccacaaatcagcgaaaacgagcgggacgtccggtacaagcggtggaagatggccatcgaacgggctgtcggttgggacaagtgtctgtaa

SEQ ID NO: 69509 - protein, 519 aa, Anopheles gambiae str. PEST
MSTTGGMKKFGDLVGSIDEGTSSARFLLFRAETAEVVCFHQKELRLICPQEGWVEQDPHEILSVVYECIERTLEKLVELGGNPQTDIVAIGVTNQRETTIVWDRTTGEPLYNAIVWQDMRTSSTVDQLLETVPNKTKNKNYLKPLCGLPLSPYFSAVKLRWLLDNVPKVKGAVRAGSCLFGTVDTWLIWNLTGGPDGGAHVTDVSNASRTMLMNIETLKYDKALMKFFDVPLEILPTIRSSSEVYGLIKFRPLQHIPLAGCLGDQQSALVGQECLTRGRAKATYGTGCFLLYNTGTAVIDSYHGLISTVAYQMGPDALPVYALEGSVAVAGAALGWLRDNLNLIGGASESESAALEVENNGDVYFVPAFSGLYAPYWDPEARGVICGITEDTQRGHIVRAALEAVCFQVRDILDAMNNDSGTPLQKLKVDGGMTANATMMQWQADLIGLDVLKPKFVETTALGAAMVAGRAVGKWDIENVSVESDSTVFKPQISENERDVRYKRWKMAIERAVGWDKCL

SEQ ID NO: 69510 - DNA, 1668 bp, Anopheles gambiae str. PEST
  CDS (1)..(1668)
atggcctccttggagcgcagcaagttgatcggtgtgatcgatgcgggcaccaacagtgtgcgatttgtgatcttcaaattgcccgagtttgaggagattgcatcgcaccagatccgcattacgcagatagtgccgcgcgatggctggacggagcacaacccggtggaggtgctggaagcggtacggctctgcgcggtcgaagcgtgccatcaggtggaaaagctcggctttctcgtgaaggatatcgctgccatcggtatcacgaaccagcgcgagacgaccgtcgtgtgggacaagaacacgggcgaaccgctttacaatgccatcgtatggaacgatatacgcacggacaaaacggtggaccgggtgttggcccgcctgcccgagcaaaaccataaccacttccgtgcgctgtccgggctgccgatctcgccgtacttctccgccctcaagctaaactggctgaaggacaacgtggtggcggtgcggaaggcgtgccgggagcggcgctgctatgccggcacgatcgacacgtggctggtgtggaatctgaccggtgggccgcagggcggcgcgttcgtgacggacgtaacgaacgcgtcgcgcacgctgctgatgaacatcgagacgctgcactgggatccgctgctgacgaaaacgttctcggtgcatccggacatgctgccggagatacgcagctcgtccgaaatttacggcaaggtgaaggatagcagcgtgctggacggcataccgatcagcgcgatcctgggcaaccagcaggcgagcttggtcgggcagcggtgcttgaaggagggccaggcgaagaacacgtaccgcaagggatgctttctgctgtacaacacgggcactaggtgcgtgcaatccacccacggcctggtgacgacggtggcgtaccagatgggacgaaacgcgccaccgatctacgcgctggaaggttcggtagcggtcgccggcgtggccatgaactggctgcgcgacaacctgaaaatcatcaaggacattaaagactccgaagagatcgctggcagcgtgtcatcgacgggcgatgtctactttgtacctgcattcaccggcctgtacgccccctactggcgaaaggacgcgcgaggcatattttgtggtttgaccagtttcactaccaagcatcatttcgtgcgggccgccttggaggcggtctgcttccagacgcgcgacattatcgaggcgatgaagaaggactgcggcataaaccttaacaagctccacacggacggtatcatggcgagcaacagccttctaatgcagctgcaggcggatctgagcggcattcctgtgttgaggacggaggtgcacgaaccggctgctctcgggacggcgatggccgctgcacaggcgaacggggtggatctgtacaagctggaggcggaaatccgtggctacgcaggtgttcaatcgcaccatgaaacattccttccgaccaccaccgaggaggaacggaacgctcggtacaccaagtggaaaatggcagtgcagcgcagtttgggctgggcagtttcgaagaagagtgaagcaatgacggacgaacgctacagcttgcttgcctcgataccggccggtctgttcctggccacgaccttcctgatgttggttcactcgcaacggcggtga

SEQ ID NO: 69511 - protein, 555 aa, Anopheles gambiae str. PEST
MASLERSKLIGVIDAGTNSVRFVIFKLPEFEEIASHQIRITQIVPRDGWTEHNPVEVLEAVRLCAVEACHQVEKLGFLVKDIAAIGITNQRETTVVWDKNTGEPLYNAIVWNDIRTDKTVDRVLARLPEQNHNHFRALSGLPISPYFSALKLNWLKDNVVAVRKACRERRCYAGTIDTWLVWNLTGGPQGGAFVTDVTNASRTLLMNIETLHWDPLLTKTFSVHPDMLPEIRSSSEIYGKVKDSSVLDGIPISAILGNQQASLVGQRCLKEGQAKNTYRKGCFLLYNTGTRCVQSTHGLVTTVAYQMGRNAPPIYALEGSVAVAGVAMNWLRDNLKIIKDIKDSEEIAGSVSSTGDVYFVPAFTGLYAPYWRKDARGIFCGLTSFTTKHHFVRAALEAVCFQTRDIIEAMKKDCGINLNKLHTDGIMASNSLLMQLQADLSGIPVLRTEVHEPAALGTAMAAAQANGVDLYKLEAEIRGYAGVQSHHETFLPTTTEEERNARYTKWKMAVQRSLGWAVSKKSEAMTDERYSLLASIPAGLFLATTFLMLVHSQRR

SEQ ID NO: 69512 - DNA, 1974 bp, Neurospora crassa
  CDS (1)..(1974)
atgtcgccctcgatgtggacgatgaggtggtcgcaccaggtcatcaatgaacaccatcgacaccacttgaagtcttgttcgaccatcagccgtgtaaacaacgctctcaagtccatcatccaacgaacaagacccggagacacaaacacagacaccccgcacgaggcattaccatctaccccgcttgagcccgttcctacaagaacaacttcagtcaccatgaagttactcaaccttaacgacggcgtcgaggccggcgtcatgtgtgtagaacccaccctcacaaacgatggcatggacgcccgcaacctagcaaaggcccacaagggtcccattgtcacccacctagagcatcttccccgcggcatccacgagacgcccgaggagaggaaaaaccactggttcgtcggctccgtcgaccaaggcaccacctcttcccgcttccttatcttcaacggcgagggcgaccctgttgccagccaccagattgagtttgagaacctctaccccaagtcaggatggcatgagcacgaccccatgactctgctcaactcggtcgaagagtgcattgaaggtgccatgcgtaagtttcaacgactaggcttctccaagaacgacatccgctccatcggcatcaccaaccagcgcgaaaccacgctcgtgtgggaccatgaaaccggcgagcctctctataatgccgtcgtctggtccgatacccgcaccaagtcccttgtccgcgacctcaaggacaaggacggcgccgatgccatcaaggacctttgcggtcttcccctctccacttatcccagcagcgtcaagcttctttggctcattgagaatgttgaggccgtcaagcaggcctacgaagaaggccgtcttgccttcggcactgtcgacacttggctcatctacaagctcaatggcggtgcccaggctgagagtcctgtccacgtaacagacagcaccaacgccagcagaaccatgttcatgaacattcgcactctgcagtatgacgacaagatgctaggattcttcggaattgaccgaaccaaggtgcatttgcccaagatcgtcccttcgtcggaccctgaatgtttcggtcgcattgccagtggtgcgctgtcgggtgtgccgatcgctggttgcttgggcgatcaatccagcgccctggttggccagtgcggcttcaaccccggccaagcaaagaacacctacggcactggctgcttcctgctctacaacgtcggcaccgagcccgtcatctcgcagtacggtcttctgtccactgtcgcctacgactttggccagggccgcgcgcccgtctacgccctcgaaggcagcattgctgtcgccggcgccggcgtcaccttcctccagaacaacctcaacttcattgagaacgctaagcaaatcaacgaccttgccgagtcggtgcccgacaacggaggtgttgtgtttgtcaccgccttcagcggcctgttcgccccttactggatcgatgatgcaaagggaactttgttcggaattactcaacacacccaaaagggacacattgctcgtgccactctcgaggctacttgcttccagaccaaggctatccttgatgccatggagaaagactcgggctgcaagctcaagctcctcgctgtcgatggtggtctctccaactccgacctgaccatgcagacccaggctgacatcagcggtattcccgttgatcgcccggccatgtgcgaaaccaccgctcttggcgctgccattgcggccggcctcgctaccggtgtctggagcgataccaccgagctccaggaagttaaccggaccggccggaaggtctttgagcctaagatttctcgcaagtgtgccgagaagaggttcaagaagtggaaccaggctgttcagatgagccgcggctggctgcaagacaatgacaacgaagacgacgagtgcgacgaggaggtgaagaaggcctaa

SEQ ID NO: 69513 - protein, 657 aa, Neurospora crassa
MSPSMWTMRWSHQVINEHHRHHLKSCSTISRVNNALKSIIQRTRPGDTNTDTPHEALPSTPLEPVPTRTTSVTMKLLNLNDGVEAGVMCVEPTLTNDGMDARNLAKAHKGPIVTHLEHLPRGIHETPEERKNHWFVGSVDQGTTSSRFLIFNGEGDPVASHQIEFENLYPKSGWHEHDPMTLLNSVEECIEGAMRKFQRLGFSKNDIRSIGITNQRETTLVWDHETGEPLYNAVVWSDTRTKSLVRDLKDKDGADAIKDLCGLPLSTYPSSVKLLWLIENVEAVKQAYEEGRLAFGTVDTWLIYKLNGGAQAESPVHVTDSTNASRTMFMNIRTLQYDDKMLGFFGIDRTKVHLPKIVPSSDPECFGRIASGALSGVPIAGCLGDQSSALVGQCGFNPGQAKNTYGTGCFLLYNVGTEPVISQYGLLSTVAYDFGQGRAPVYALEGSIAVAGAGVTFLQNNLNFIENAKQINDLAESVPDNGGVVFVTAFSGLFAPYWIDDAKGTLFGITQHTQKGHIARATLEATCFQTKAILDAMEKDSGCKLKLLAVDGGLSNSDLTMQTQADISGIPVDRPAMCETTALGAAIAAGLATGVWSDTTELQEVNRTGRKVFEPKISRKCAEKRFKKWNQAVQMSRGWLQDNDNEDDECDEEVKKA

SEQ ID NO: 69514 - DNA, 1734 bp, Magnaporthe grisea 70-15
  CDS (1)..(1734)
atggcagcatcagtctcaacctgtggcatcgccacgcccccttcaagaccctcaagagtacccagcactctgggctcaaaaccttcgcgtatgcatgatccagatatcatcatcaacgcactcaaggacgttgtcctaccggctgttgccttgtcggcacagcacgtggagaatgcccaagtcccatcccctgacccggagccagaagacatgtacatcggctcaatagaccagggtaccacgtcttcgcgcttcatcatcttcaaccgtgccggcgagcccgtcgaggcgcaccagattgagtttgagaaccgctatccaaactcgggctggcacgagcatgacccaatggagttgctctccagcgttgaggagtgcatagaagaggccatgatcaagttcaccgcgacgaggccaggtgccaaggttcactcggttggcatcacaaaccagagggaaacgacggtggtctgggatacggagacgggcgagccgctgtacaacgctgtagtgtggcccgacacccgcacctcgcccatcgttcatgaactgcggcaaaagccgggtgcagaggatctgctggacctgtgcggcttgcctctgtcaacctacccgtcctctgtcaagctcatgtggttattgcggaacgtagacaccgtcaaggctgcttatgacgccggccgactcgcctttggcacggttgactcgtggctcatctaccgtctgactggtaaatcggtgcacgtaactgatggttccaacgccagccgcaccatgtttatgaacctgcgcagcatgtcctatgacgaaaagctgctgtcgttcttcgagattgacgccaccaagatccgcctccctgagattgtgccctcggcacaccccactgcctttggaaaatttgcctcgggtcccctcaaggacgtcaggatagcaggctgcctgggcgaccagtccagcgccctggtgggccagcgcgccttcgcctcgggccaggccaagaacacttacggcacgggctgcttcctgctgtataacgtcggcccggagcccgtcatctcaaaggctggcctgctggccacggtagcctacgactttggcgaggagctgggcggccgcgcctacgccctcgagggcagcatcgccgttgccggcagtggcgttaagttcctgtccaacaacctgggcttcgcaccgagcagcggcgagattacggatctggccggcagcgtcgacgacaacggcggcgtggtctttgtgactgctttcagtggcctctttgcgccttactggatcgacgatgccaagggaacactctttggactcacgcagcacacacaaaagggccacatcgcgcgcgcaactctcgaggcgacgtgctaccagaccaaggcgatcctggacgccatggaacgtgacagcgggcgcaagcttgagcgcctggccgtcgacggcggcatgtccaactcggacctgtgcatgcagacccaggccgacgtcggcaacatccccgttgaccggcccgagatgcgcgagaccacggccctgggcgccgccatcgccgccggcttggccacgggcgtatggaagaacatctcagaggtcctcgaggtcggcggccgcaataggtcccagttcctaccgtctcccgatcgcgccaaggctcaaaggatgttcaagaagtgggagcaggccgtcgagatgagtagggggtggttgagggaaggtgaagaataa

SEQ ID NO: 69515 - protein, 577 aa, Magnaporthe grisea 70-15
MAASVSTCGIATPPSRPSRVPSTLGSKPSRMHDPDIIINALKDVVLPAVALSAQHVENAQVPSPDPEPEDMYIGSIDQGTTSSRFIIFNRAGEPVEAHQIEFENRYPNSGWHEHDPMELLSSVEECIEEAMIKFTATRPGAKVHSVGITNQRETTVVWDTETGEPLYNAVVWPDTRTSPIVHELRQKPGAEDLLDLCGLPLSTYPSSVKLMWLLRNVDTVKAAYDAGRLAFGTVDSWLIYRLTGKSVHVTDGSNASRTMFMNLRSMSYDEKLLSFFEIDATKIRLPEIVPSAHPTAFGKFASGPLKDVRIAGCLGDQSSALVGQRAFASGQAKNTYGTGCFLLYNVGPEPVISKAGLLATVAYDFGEELGGRAYALEGSIAVAGSGVKFLSNNLGFAPSSGEITDLAGSVDDNGGVVFVTAFSGLFAPYWIDDAKGTLFGLTQHTQKGHIARATLEATCYQTKAILDAMERDSGRKLERLAVDGGMSNSDLCMQTQADVGNIPVDRPEMRETTALGAAIAAGLATGVWKNISEVLEVGGRNRSQFLPSPDRAKAQRMFKKWEQAVEMSRGWLREGEE

SEQ ID NO: 69516 - DNA, 1551 bp, Gibberella zeae PH-1
  CDS (1)..(1551)
atgcctctcctcaacggaaaagcaaacactgcctttattggtgccattgatcagggcactacaagctcgcgcttcctgatctttgaccccagtggcgatgttgttgccacgcatcagattgagttcaagcagtactatcctcatcctggatggcacgagcatgatcctgaggagcttataagctctgttgaacagtgcattgacggtgccgttgaaacctttgagagccaaggtcactcgagagagcagatcaaggccgttggtatcacaaaccagcgagagacaactgtcgtctgggacaagactactggcaaggccctgcacaacgccattgtctggacagacacacgatcgaaagatctcgtgcgtcgtctcaagcgccgtcttggctccagcgagctgatcggacgatgtggaattcctctctccacatacccatccgtcagcaaactgctctggcttcttgacaacattcccgaagtcaaagatgcgtatgagcgcggtgttttggcgtttggaacggtcgacacatggttgacctacaagctcaacggcgcgactgatcgcgatgtctacgtttctgacccgtcaaatgcgtcacgaaccatgtttatgaatcttgagactctcaagtatgacgaggacattcttgactggttccgcatcgatgattccaagattacgctgccaagaattgtgcgctcttcagacaacaaggcctacggatcactggctggtacatctctcaagggagtcaagatcaccggatgtctgggcgaccagtctgcagctcttgtcggacagaaggcttttacccccggtctcgccaagaacacgtacggcacaggctgcttcttgctatacaatgtgggcacaaagccagtcatttcgtcgcacggcctgttgacaacggtcgcctttgactttggcgagggcaacaccatgtacgccctggaaggcagcatcgcggtggcgggctccagtgtcaagttcctcgtggacaactttggcttcatcgagtcgtcggccaagctcagcgctttggccgagacggtggaggacaatggtgggtgcacctttgttacggcctttagcggcctgtttgcgccgtactggattgacgatgcgcgaggcaccatctttggtatcacgtcgtacacgcagcgcgggcacattgcgagggcgacgctcgaggcgacgtgtttccaaacaaaggccattctcgactcgatggagaaggacagcggacatgccttgaccgagcttgctgtggacggtggcatgtgcaactcggatctcatcatgcagacccagtcagatctcattggaatcccggtcaacagacccggcatgcgtgagacgacagcactgggtgcggccattgcagcgggtttcgccgttggtatctggaagagctttgatgacttgaaggaggtcaacacccaaggccgtaccatcttcaagccgcagattgccgaggaggaggcgacgaagcggtttggacgttggaccaaggccgtcgagatgtccaagggctgggccaacgagtga

SEQ ID NO: 69517 - protein, 516 aa, Gibberella zeae PH-1
MPLLNGKANTAFIGAIDQGTTSSRFLIFDPSGDVVATHQIEFKQYYPHPGWHEHDPEELISSVEQCIDGAVETFESQGHSREQIKAVGITNQRETTVVWDKTTGKALHNAIVWTDTRSKDLVRRLKRRLGSSELIGRCGIPLSTYPSVSKLLWLLDNIPEVKDAYERGVLAFGTVDTWLTYKLNGATDRDVYVSDPSNASRTMFMNLETLKYDEDILDWFRIDDSKITLPRIVRSSDNKAYGSLAGTSLKGVKITGCLGDQSAALVGQKAFTPGLAKNTYGTGCFLLYNVGTKPVISSHGLLTTVAFDFGEGNTMYALEGSIAVAGSSVKFLVDNFGFIESSAKLSALAETVEDNGGCTFVTAFSGLFAPYWIDDARGTIFGITSYTQRGHIARATLEATCFQTKAILDSMEKDSGHALTELAVDGGMCNSDLIMQTQSDLIGIPVNRPGMRETTALGAAIAAGFAVGIWKSFDDLKEVNTQGRTIFKPQIAEEEATKRFGRWTKAVEMSKGWANE

SEQ ID NO: 69518 - DNA, 1539 bp, Apis mellifera
  CDS (1)..(1539)
atgagatacatcggggcgctcgacgtcggtaccaccaacgtacgatttcatatactagatgaagaaggaaacacaattgcttcttcaacggaaaagatccagcttttgtatccaaagccgaattatgtggaaatagatccagatgcgttgtggacaactatagtaagtgtaatgaagaatactctaacagaatcaaaagtgagcttggaatcgatagttggtatcggaatttcgacacaacgaggcagtttcaccacgtggaattcgaaagatggaaggcattatcataattttatcacgtggaaagatctacgtgctgacgatttggtcaaagaatggaattcgtcgataataatgagaatattgaaaataggatcgaagatcttatacactttctccaggaacaaacgattccttggaatgagcgtttttaaattcatgaacacacagatgtcgctaaggttagtgtgggtactgcaacacgtgcctggtttgcaagaggcgatgaacgatggaaatgtcctttttggtggaattgattcttggcttttatataaattcactggaaaacacgtgacagacatttcgagtgcatccgcgactggaatttttgatccatttatcaaatgttggtcaagctcaatgataaatttgcttaaattgccgcacgatatctttccccaagtggtggagacaagtggaaatttcggcagtaccccaaaagatttattcggggtcgaaattccgatattatgttcaacgacagatcaatcggcatcgttgttcggctcgatgtgtatgcaaccgggagatttgaaaatcaccatgggaactggcacgtttttgaacgtgaacacgggtgatatcccgcacgcttctgtcgcaggactttatcctctgatcgcgtggcaaacaggagatgaattagtatacatggcagaaggtgcatggaacgaaactggaggtatcattgagtgggccaaagaaataagtctaatcgaccaagtagcagaaacagcaaatatcgcgaactcggtgaacgattctgatggagtgtatttcgttcctgcattcagtggattacacgcgccgataaatgattacagggcagcggcaggtttcataggcctaaaacctaccacaagaaagaatcatttggttcgagcgttgttagaaagtatagtttttggaatgttactactttatgagacattatgttcagaaacttccttcacttataagagaatacgagttgatggtggagtatccaaaaatgattttatattacaactgctagccgacctaacaggtttagaagtggaacgagcatcaagcacggaaatatctattttaggaataatatttctcactggtttacaatgcggcgtttggaagagcaaggaaaatatattcaagttacgaaaagtagagacaatatttatgccaaacaatgaaaacagagaacgatatcgaccgatagtcgctgaatggaaacgagctctccaaagactcggtaaatggtataccgagattaaataa

SEQ ID NO: 69519 - protein, 512 aa, Apis mellifera
MRYIGALDVGTTNVRFHILDEEGNTIASSTEKIQLLYPKPNYVEIDPDALWTTIVSVMKNTLTESKVSLESIVGIGISTQRGSFTTWNSKDGRHYHNFITWKDLRADDLVKEWNSSIIMRILKIGSKILYTFSRNKRFLGMSVFKFMNTQMSLRLVWVLQHVPGLQEAMNDGNVLFGGIDSWLLYKFTGKHVTDISSASATGIFDPFIKCWSSSMINLLKLPHDIFPQVVETSGNFGSTPKDLFGVEIPILCSTTDQSASLFGSMCMQPGDLKITMGTGTFLNVNTGDIPHASVAGLYPLIAWQTGDELVYMAEGAWNETGGIIEWAKEISLIDQVAETANIANSVNDSDGVYFVPAFSGLHAPINDYRAAAGFIGLKPTTRKNHLVRALLESIVFGMLLLYETLCSETSFTYKRIRVDGGVSKNDFILQLLADLTGLEVERASSTEISILGIIFLTGLQCGVWKSKENIFKLRKVETIFMPNNENRERYRPIVAEWKRALQRLGKWYTEIK

SEQ ID NO: 69520 - DNA, 1647 bp, Apis mellifera
  CDS (1)..(1647)
atgaacaaaaatgagtcgacaagtagatatggacccctcgtcggtgcaatcgacgaagggacaagtagtgctagatttttggtttttgctgcagatacagctgaagtattaacatatcatcaggttccaataacacaaacatgtccaaaagaaggatgggttgaacaagatcctatagaaatattaaaagcagttagagaatgtcttaatcagactatatttaatttacgccagcttaccatagatcccactgatatagttgcagttggtataacaaaccaaagagaaactacagttgtatgggattccattactggagaaccattatataatgctatagtatggatggatatgagaactacttcaattgtagatgatatattaaaaaaaatacgtaatcaaaataaaaactatttaaaaccactttgtggtttaccaattagtccatatttcagtggtttaaaattaaaatggttattagaaaatgtacctcgtgtacgtgaggctctagatttaaaacgatgcatgtttggtacaattgattcatggttaatttggaatttaactggaggtgttcatgccactgatgttacaaatgcttcaagaacaatgttaatgaatatcacaactttaaaatgggatccaacattattatcattttttaatatacctccagaaattttaccagagattcgtagttcatcagaaatatatggttatatacaagatgaagttttatctggtgtaccaatatcaggatgtttaggtgatcaacagtcagcattagtaggacaaatgtgtttacaaaaaggacaagcaaaaagcacttatggcacaggctgttttcttttatataatactggaactgctattgtagattcatctcatggattattgacaacagttgcttatcaattaggaccacaagcagcaccaatatatgctcttgaaggctctgtagctatagctggtgctgttattcaatggctaaaagataatcttggagtattatctgatgtaaaggaatctgaatctcttgttgaacaaattccaactgataatcgtgttacatttgtacctgcatttgctggattatatgctccatattggaggaaagatgcaagaagcgttatatgtggaattactgaagatacaaatagtacacatattataaaggcagctttgcaagctgtttgttttcagacaagagacattttggaagctatgaaagaagacacaggtttaacattatctaaattgttagtagatggtgctatgactactaataatttgttaatgcaaatgcaagcagatatttgtggaattccagttgtgaggcctttaatgtgtgaaactactgcacttggagttgcaattgctgcaggaaatgcagatggtatacgaaaatgggatgtaaaacttgatattgctgtaccaagtgatatctttttaccttcaatatctgagaatgaacgagatatattatattcacaatggaaaatggctattgatcgtagtttaggttgggaaccagtttctaataccaatgataatataaagaatattcacaaagcaactgctccaggtatttttatgataagtacattacttttacttatgattgcaaaatatcattctatgttatga

SEQ ID NO: 69521 - protein, 548 aa, Apis mellifera
MNKNESTSRYGPLVGAIDEGTSSARFLVFAADTAEVLTYHQVPITQTCPKEGWVEQDPIEILKAVRECLNQTIFNLRQLTIDPTDIVAVGITNQRETTVVWDSITGEPLYNAIVWMDMRTTSIVDDILKKIRNQNKNYLKPLCGLPISPYFSGLKLKWLLENVPRVREALDLKRCMFGTIDSWLIWNLTGGVHATDVTNASRTMLMNITTLKWDPTLLSFFNIPPEILPEIRSSSEIYGYIQDEVLSGVPISGCLGDQQSALVGQMCLQKGQAKSTYGTGCFLLYNTGTAIVDSSHGLLTTVAYQLGPQAAPIYALEGSVAIAGAVIQWLKDNLGVLSDVKESESLVEQIPTDNRVTFVPAFAGLYAPYWRKDARSVICGITEDTNSTHIIKAALQAVCFQTRDILEAMKEDTGLTLSKLLVDGAMTTNNLLMQMQADICGIPVVRPLMCETTALGVAIAAGNADGIRKWDVKLDIAVPSDIFLPSISENERDILYSQWKMAIDRSLGWEPVSNTNDNIKNIHKATAPGIFMISTLLLLMIAKYHSML

SEQ ID NO: 69522 - DNA, 1545 bp, Apis mellifera
  CDS (1)..(1545)
atggaagaagagaaggcggaagcagttgcaaagaatggagatccagatgtgaaagaagaaactgaagaagacgaagatggaatgtttgatgaatccagttttccggagctggagcgcacgcaaaccggtcgcaaaacaagtatcttcaagtactattcatttaaagagaaagatataatgccaagttcaataaaaaaaccaggtcctcttattggagtaattgatgttggcacgcgaactgttcgctttgtggtattcaatgcgaagcatgtagctgaagtggcatctcatcaaatcgacatagaacaaataagtccgcaagaaggatggatggaacaggatcccaaagaaattctttttgcggtaaaagcttgcatcaaagatgttatacggaaattagacgtgttaggtttaaaaatggacgaaatagtaacaattggtattacgaatcaaagagaaactactgtagcatgggatgcgatgactggtgaaccattatacaatgcaatagtatggtctgatattagaacgagttcgattgttgatcaaataatagctaaatttccggatcaaagtaagaatcatatcaaacctttatgcggtttgccagtgagtccatatttttcagcattaaaaatacgttggatgaaagataatgtgcccactgttagaaaagcgatgcgagataggcgatgtaaagtgggtacgatggacacttggatcgtttggaatttaacgggtggcaaagacggtggattatatattactgacgtaacaaacgcgtcaaggaccatgttaatgaacatagaaactctttcatgggatcccacgttgtgcagatattttgatattcctatgcaaatgttgccagaaattagaagcagtgctgaaatttatggaaaaattgcaatcggtccattaaagggtatcactatatctggcattttagggaatcagcaatcagctttagttggacaaaattgtttaaagaaaggacaagcaaaaaacacatatagaagtggatgttttttactctgtaatacgggaacaacacgagtatattcttctcatggattagtgacaacggtagcttatcaattaggtccaaaaagttcagctgtttatgcattagaaggttcaattgcagtagcaggtgcagctattaaatggttacgagataatatgaaacttataaaggatgtacatgaaagtgaacatttagcacaaagtgtttttagtactggcgacgtatattttgtgccagcttttacaggattatatgctccatattggagaaaagatgcaagaggaattatttgtggacttactgcatttacaacaaaacagcatataataagagcatcattagaagctgtctgttttcaaactagagatattttagaagctatgtataaagattgtggttttccattaaccaaattaaatacagatggaaaaatgtcaacaaataatcttcttatgcaattgcaagcagatctttgtggtacaccattaggtccacaatgccagatattacagctttag

SEQ ID NO: 69523 - protein, 514 aa, Apis mellifera
MEEEKAEAVAKNGDPDVKEETEEDEDGMFDESSFPELERTQTGRKTSIFKYYSFKEKDIMPSSIKKPGPLIGVIDVGTRTVRFVVFNAKHVAEVASHQIDIEQISPQEGWMEQDPKEILFAVKACIKDVIRKLDVLGLKMDEIVTIGITNQRETTVAWDAMTGEPLYNAIVWSDIRTSSIVDQIIAKFPDQSKNHIKPLCGLPVSPYFSALKIRWMKDNVPTVRKAMRDRRCKVGTMDTWIVWNLTGGKDGGLYITDVTNASRTMLMNIETLSWDPTLCRYFDIPMQMLPEIRSSAEIYGKIAIGPLKGITISGILGNQQSALVGQNCLKKGQAKNTYRSGCFLLCNTGTTRVYSSHGLVTTVAYQLGPKSSAVYALEGSIAVAGAAIKWLRDNMKLIKDVHESEHLAQSVFSTGDVYFVPAFTGLYAPYWRKDARGIICGLTAFTTKQHIIRASLEAVCFQTRDILEAMYKDCGFPLTKLNTDGKMSTNNLLMQLQADLCGTPLGPQCQILQL

SEQ ID NO: 69524 - DNA, 1533 bp, Ustilago maydis 521
  CDS (1)..(1533)
atgccggatctcgtgggttcgattgacgctggcaccaccagcgtccgattcatggtatttgacgaattcgccaaagtgcatgcttcgcaccagatggagttcaaccagtactacccgcatccaggatggcacgagcaggacgcacacgaaatcatcgactgcgtgtacgaatgcatcgacaaggcgctcgccaagctcgaagagggcggcaagtttaaaacatccgatgtcaaggtcatcggtgtcaccaatcagcgagagacgaccgtggtttgggacaagaacaccggcaaggcgttgacacgcgccatcgcctggcccgacgcacgaaccacttccaccatccgaaaactcgaatcccagcatccaaaggggattgatgctgtcaaggaagagaccggattgccgctctcgacctatttcgcttcagtcaaacttcgttggatgctcgacaacctacccgaggtgcgcaaggcgcacgacgacaagcagatgctcttcggcaccgtagacagttggatcgtgtacaatctcaccgacaaacaggtgcacattaccgatgcttccaatgcttcgcgaaccatgttcatggacctgcgcgcacagacgtgggaccagaagctgtgcgatttctttggtatcgacatggacatcctgcccgagatcaagagttcatccgaggtgtacggcaaggtttcgcatggtgcgctcaacggcgtcgagatcgccggtatcgtaggagaccagatggctgcgttggtgggcaacaagtgttttcagcctggtgaggccaagaacacgtacggaacgggtgcgtttctgctctacaatacgggtgaaaaagtggtctcgtccaagaacggtttgctctccaccatcgcatacaaggcaggtccgcatgcaccggtgcactatgccttggaaggctccatcgctgtagctggttcggcagtcaagtgggttcgcgacagccttgggctgatcaaggaggccagcgagatcggcgagctggcaggccaagtccaagacacgggaggtgtctattttgtcacggcattcaacggactcttctgcccgtactgggacgacaccgcggccggcaccgtggtgggcatcactgcctacacggacaaacgacacttctgccgtgccacgctggaatcgacgtgctaccagacaaaagccatcctggacgcaatgtccaaagactcgggagtcgcactcaaggctctccaagtcgatggtggactgactaactcggacgtagccatgcagatccaagctgacatcctgggcatcaacgtggagcgtcccgagatgcgcgaaagtacagcgctcggttcggcgctgcttgccggatcggcggtgggattattcggatgggacatcaacaagccagagacactcagcaaggtcaacacggcgggtaagcaggtgttcgaacccaaaatcgatcaagagaagcgcgccaagctgctacacggctgggagagggccgtggaacgcgccaagggctggaacgagaacgcttga

SEQ ID NO: 69525 - protein, 510 aa, Ustilago maydis 521
MPDLVGSIDAGTTSVRFMVFDEFAKVHASHQMEFNQYYPHPGWHEQDAHEIIDCVYECIDKALAKLEEGGKFKTSDVKVIGVTNQRETTVVWDKNTGKALTRAIAWPDARTTSTIRKLESQHPKGIDAVKEETGLPLSTYFASVKLRWMLDNLPEVRKAHDDKQMLFGTVDSWIVYNLTDKQVHITDASNASRTMFMDLRAQTWDQKLCDFFGIDMDILPEIKSSSEVYGKVSHGALNGVEIAGIVGDQMAALVGNKCFQPGEAKNTYGTGAFLLYNTGEKVVSSKNGLLSTIAYKAGPHAPVHYALEGSIAVAGSAVKWVRDSLGLIKEASEIGELAGQVQDTGGVYFVTAFNGLFCPYWDDTAAGTVVGITAYTDKRHFCRATLESTCYQTKAILDAMSKDSGVALKALQVDGGLTNSDVAMQIQADILGINVERPEMRESTALGSALLAGSAVGLFGWDINKPETLSKVNTAGKQVFEPKIDQEKRAKLLHGWERAVERAKGWNENA

SEQ ID NO: 69526 - DNA, 1827 bp, Aspergillus nidulans FGSC A4
  CDS (1)..(1827)
atggacccagcaaagatttttgttggttctatcgatcagggaaccaccagcacccgatttctaatctttaatcgcgagggagatcctgtcgcatcacatcaagtcgaattcaagcagatatatcctaacccgggatggcacgagcacgatccgctagagcttgtatcttctgtggaaacctgcatcgaagaagctgttaaacaattcgaaatcaacgggtacgaccaacaatctattaaggcggtgggaattaccaatcagcgagagactacagttgtttgggaccatgaaaccggggagccactttataatgcgattgtctggaccgacacccgctcgcaagctgttgttgatgagcttaaaaagaaacccggagcatcgcaacttcaacagatctgcggtctgccgctctcaacctattcctcttcctctaagctcctctggatgcttacaaatgttcccaaggtcaaagaggcatacgaaaaaggcaccttggccttcggaactgttgatgcctggttggtttaccgactgaacggcggaagcgctgccaatgttttcgtctctgattgtacgaacgcctcacgtacaatgttcatgaacctagagacactgggatacgacgacttcttgctggatttctttggcattaagggccgagtacacctgcccaaaattgttccttcttcagatgtcacagcctacggtgcactctccaacggcaggcttgcgggggttcctatcatgggatgcttgggagatcagtcctcagcccttgtagggcaaaaagggttctcccccggcatggccaagaatacatatggcacaggatgcttcctgctgtacaacgtcggggacaaaccagttatctccaagcacggccttctggcgactatagcgtataatttcgatggacgaccagtatatgcgctcgaaggaagcatagcggttggtggatctggaatcaaattccttcagaataatttagagttcttcagggagtctaaggaagttaacgacttggctttaactgtggaagacaacggcgggtgtgttttcgttaccgcgtttagcggactttacgctccgtattggatcgatgatgcaaagggaactatatttgggatcacccaatatacccagaagggccacattgcccgagcaacactggaagcgacctgcttccaaaccaaggcaattctgaatgccatggagaaagacagcggacacgccctattcgagctcgctgttgatggaggaatgagcaactcggatctcgctatgcagatccaagccgacctcatctccatccccgtttaccgccccaagatgcgcgaaacaaccgccctcggcgccgccattgccgcaggcctagctgtcggtctctggcgcaacttcgccgagctccgcgacatcaaccgtgccgggggtacagtcttccgcccgcagacgagtcaggacataagccgcgagcaattttccctctgggaaaaggcagtgagcatgtgtagagggtgggttggcgataaatcgcacgcaacggagcacagagacactgaggggaagcctactcagaaggtggatctgagtaacggtcataagggggttgttgacgcggcttctgccactgcccctagcaacattgtgtcaccattgttgtcggcgaaaatgaatggggatttggtgctatcaaagggcacgccgtggattaatatctcgggggatttggaggatgctgatgatcaggacttgtttctggagttgaggaagttagagattttacagaggctgaagaggttgggtaaggttaaggttacctacttttga

SEQ ID NO: 69527 - protein, 608 aa, Aspergillus nidulans FGSC A4
MDPAKIFVGSIDQGTTSTRFLIFNREGDPVASHQVEFKQIYPNPGWHEHDPLELVSSVETCIEEAVKQFEINGYDQQSIKAVGITNQRETTVVWDHETGEPLYNAIVWTDTRSQAVVDELKKKPGASQLQQICGLPLSTYSSSSKLLWMLTNVPKVKEAYEKGTLAFGTVDAWLVYRLNGGSAANVFVSDCTNASRTMFMNLETLGYDDFLLDFFGIKGRVHLPKIVPSSDVTAYGALSNGRLAGVPIMGCLGDQSSALVGQKGFSPGMAKNTYGTGCFLLYNVGDKPVISKHGLLATIAYNFDGRPVYALEGSIAVGGSGIKFLQNNLEFFRESKEVNDLALTVEDNGGCVFVTAFSGLYAPYWIDDAKGTIFGITQYTQKGHIARATLEATCFQTKAILNAMEKDSGHALFELAVDGGMSNSDLAMQIQADLISIPVYRPKMRETTALGAAIAAGLAVGLWRNFAELRDINRAGGTVFRPQTSQDISREQFSLWEKAVSMCRGWVGDKSHATEHRDTEGKPTQKVDLSNGHKGVVDAASATAPSNIVSPLLSAKMNGDLVLSKGTPWINISGDLEDADDQDLFLELRKLEILQRLKRLGKVKVTYF

SEQ ID NO: 69528 - DNA, 1704 bp, Aspergillus nidulans FGSC A4
  CDS (1)..(1704)
atgcgcaagaacccttttgacatgtctgagctcgacgccgaaatcgaggccaacgaagagcagcaacaccaagtccgcatccatgcccgccaatcaattgacggcgaacggtcgttgttgcaggatgaggagcgtcggcaagacgacttgaaggatcgtttcattggtgccattgaccagggtactacgagtacgcggttcattattttcgactgcgtgggcaaccccgttgccaaataccaggcggaataccgccaactccacgagcattcaggatggcacgaacaagatccgtatgagatggtagattccgtctacacgtgtattgaagaggccatgaaaacattcctcgcccttggtcattctaagtcagatattgaagcaatcggtctcactagccaacgtgagacagtcctctgctgggattgggaaactggtgaacctctatgtccctcgattgcttggcccgatacccgaacaaaagcccttgttcgagaattgaaagcacaaaaaggcgccgatgaactgaagaacatttgcggtctgccactatccacatatccttcgtctgtctcattggtctggctactccgcaacaacgaggccgtgaaacaggcgtacgaggaaggacgacttgcttttggcactgtcgattcatggctcatctacaacctgaacggtggtctagagggtcgccaccacgtaacggatgtgaccaatgcctctagaaccatgttgatgaacctcgagacgctcgattatgataaacgacttctggacttctttgggttagaccccaagaagatccggctgcccaagattcttccatcctctgaccctgaggggttcggatatgtacggtcaggccccttagaaggagttccgatcactagcgaccttggagatcagtctgcggcgcttgttggccactgtgcgtttactccgggcatggcgaagaatacctatggtactggatgcttcctcctgtacaacgttggcgagaaaccggttatttcgaagcatggcctgctcggtactgtcggatttcaattaggaaagaaccggaagcccgtgtatgcacttgaaggaagtgtggccgtcgctggtagtggtgtttcattcctcatgaacaatatgggctttttccgagactcacgtaaagtgagtgacttggcggcaatggttccagacaacggagggtgtgtcttcgtcacagccttcagtggtctctttgcgccatactggattgatgacgccaagggaacaatttttggaatcacgcaacatacccaacgtggtcacatcgcacgtgcgactatggaggccgcctgcttccaaaccaaagcgattctcgatgccatggagatggacagtgggcactccctctctcagctcgccgtcgacggaggaatgagcaactcggatatctgcatgcagacccaagcagacatcattcaaattcccgtcgaacgaccggccatgcatgagacgacagcgctgggcgcagcaatcgccgccggcttcgccatcgatatctggaaggaatttgatgaacttaaaaacatgaaccgcgccaaccgaacctcattcacccccgcaatctcccgcgaacaaagccagaagatgtataaacagtggacgaaagccgtcgaaatgtctcgcggttgggtggataccaaggagatgggaggtgaggacgactag

SEQ ID NO: 69529 - protein, 567 aa, Aspergillus nidulans FGSC A4
MRKNPFDMSELDAEIEANEEQQHQVRIHARQSIDGERSLLQDEERRQDDLKDRFIGAIDQGTTSTRFIIFDCVGNPVAKYQAEYRQLHEHSGWHEQDPYEMVDSVYTCIEEAMKTFLALGHSKSDIEAIGLTSQRETVLCWDWETGEPLCPSIAWPDTRTKALVRELKAQKGADELKNICGLPLSTYPSSVSLVWLLRNNEAVKQAYEEGRLAFGTVDSWLIYNLNGGLEGRHHVTDVTNASRTMLMNLETLDYDKRLLDFFGLDPKKIRLPKILPSSDPEGFGYVRSGPLEGVPITSDLGDQSAALVGHCAFTPGMAKNTYGTGCFLLYNVGEKPVISKHGLLGTVGFQLGKNRKPVYALEGSVAVAGSGVSFLMNNMGFFRDSRKVSDLAAMVPDNGGCVFVTAFSGLFAPYWIDDAKGTIFGITQHTQRGHIARATMEAACFQTKAILDAMEMDSGHSLSQLAVDGGMSNSDICMQTQADIIQIPVERPAMHETTALGAAIAAGFAIDIWKEFDELKNMNRANRTSFTPAISREQSQKMYKQWTKAVEMSRGWVDTKEMGGEDD

SEQ ID NO: 69530 - DNA, 1581 bp, Gallus gallus
  CDS (1)..(1581): n means a or g or c or t/u
atggccgcgtcggaccgcatggtgcgnaggccgctggtgggctccatcgatcagggtaccagttccagccgttttctggtatttaatgcaaaaacagcagagctcctgagtcaccatcaagttgagatacagcagaaattccctaaggaaggatgggtggaacaagatccaaaggaaatcttaaggtcagtccatgaatgtgtggaaagaacctgtgagaaactgcagcaactgaacatagacatcactaacataaaagccattggagttagcaaccagagggaaacaacagtggtttgggacaagacgaccggagaacctctttataatgctattgtgtggcttgacctaagaactcagtcaacagttgaaaggcttcttaagagaattccaggaaataacaaatccttttttaagtttaggactggtcttccacttagcacctactttagtgcagtgaaacttcggtggcttttggataatgtggaagagatcaggcaagcagttgatgatggaagagcaatgtttggaactattgattcatggctcatatggtgtttgacaggtgggaagaatggaggtgttcactgtacagatgtaactaatgccagtagaacgatgttgttcaacattcattccttggattgggatcctgagctctgccaattctttgatattcctatggaaatacttccaaaagtacgaagctcatctgagatttatggcctgatgaaatctggagctttgacaggtgtgccaatttctgggtgcttgggtgaccagtctgctgctcttgttgggcagatgtgcttccaagatggacaggcaaaaaacacgtatgggacaggatgtttcttgctgtgcaatacaggccagaagtctgtgttttctgaccacggtcttctaaccacgatagcttacaaactgggcagagacaaacctgtttgttatgcattagaaggatctgttgcaatagctggtgctgttgttcgttggctgagggacaatctaggtattgttaaaacttcacaggaagttgaaaaactggctgcagaagcgggaacttcttatggctgctactttgtgccagcattttcaggactgtatgcaccttactgggaacccagtgcaaggggtattatttgtggccttacccagtttacaaacaaaaaccacattgcctttgctgcactagaagcagtctgcttccaaacacgagagattttagatgcaatgaacaaggactgcgggataccattaagtcagttgcaagtagatggaggaatgaccaataacaaagttctcatgcaactccaatcagacatcctctgtattccagtagtgaagccatcaatgcctgaaacaacagctctaggagctgctatggcagcaggagctgcagaaggagttggaatttggagtctgaatcctggagatttgacagcagtgacgtgtgaacgatttgaaccacagatcaacccagaggaaagtgaatatcgctatgccagatggaagaaagctgtgatgaaatctatgggctgggaaacatctgaagctccttcaaatggtacagataaatga

SEQ ID NO: 69531 - protein, 526 aa, Gallus gallus
MAASDRMVRRPLVGSIDQGTSSSRFLVFNAKTAELLSHHQVEIQQKFPKEGWVEQDPKEILRSVHECVERTCEKLQQLNIDITNIKAIGVSNQRETTVVWDKTTGEPLYNAIVWLDLRTQSTVERLLKRIPGNNKSFFKFRTGLPLSTYFSAVKLRWLLDNVEEIRQAVDDGRAMFGTIDSWLIWCLTGGKNGGVHCTDVTNASRTMLFNIHSLDWDPELCQFFDIPMEILPKVRSSSEIYGLMKSGALTGVPISGCLGDQSAALVGQMCFQDGQAKNTYGTGCFLLCNTGQKSVFSDHGLLTTIAYKLGRDKPVCYALEGSVAIAGAVVRWLRDNLGIVKTSQEVEKLAAEAGTSYGCYFVPAFSGLYAPYWEPSARGIICGLTQFTNKNHIAFAALEAVCFQTREILDAMNKDCGIPLSQLQVDGGMTNNKVLMQLQSDILCIPVVKPSMPETTALGAAMAAGAAEGVGIWSLNPGDLTAVTCERFEPQINPEESEYRYARWKKAVMKSMGWETSEAPSNGTDK

SEQ ID NO: 69532 - DNA, 2019 bp, Candida glabrata CBS138
  CDS (1)..(2019)
atgatttccgttaacgacggtaatatccagatggataaagacggtaacatccctctgatcgcttctattgacgtgggtactacatcttcccgtgtcattttcttcaacaaacagggtcaagaagtcgctaagcaccaaatcgaatactctacatctgcctctactcagaaatatgctgtacatggttcacgtagacagtccatcaaggaccaaaccaagatggctaacccagaaaaggacaaaccagtgttcacaagtgaaggtattgccatcaaggaaaacgagtacttgaccatcgaagaattccacggtgctaatgaaggaccaactttgaaattccctaaaccaggctgggtcgaatgtaacccaatgaatgtcttggttaacgttgttcagtgtctaggtactacttacgagctgctcgataacttgaacaacgaccgtgcccaaaacaacctgccgctatacagagtcgactgtgtcggtgtagctaatatgagagaaactactattgtttggtctaagaagaccggtatgccaattgtggattacggtattgtctggaatgacacccgtactctagacttggttaagagaaagaagaaagaaactgaaaaggagaagagattacgtatgaaggacaagaccggtttgtctgttttctctacatacttctcttgttcaaaacttgtatggcttttggagaacgaaccagaggtcaagaaggcttatgaagctggcgacttgatgttcggtactgttgatacttggctgatttaccatttgaccgctagcaacgcttttgtctctgatgtaactaatgcaagcagaactggtttcatgaacttggataccagagattatgacgatgaattagttgaattctggggtattgacagaaataagatcaacttcccaaagatcgtgtcatctgctgaatactacggtgacttgagcattccaaagttgtttaagtctcaagtcccaggacatatttgggaattgttattgaaatacaccgaaggtgaatttcaagtaccaattcaaggctgtctaggtgaccaaagtgcctcattggtaggccagatggcttttaaacctggtgccgccaaatgtacctatggtacgggttgtttcttactatacaacactggctgcaagaaattgatttctaagcatggtgctttgacaactttctcttactggttcccatacttggaagaaaaggaaaacccagagtatggtgccccacactttgccttggaaggttccgtcgctgtcgctggtgccgttgtgcaatggttacgtgacaacttgcgtttaattccaaaggctgaagatgttggaccaattgccaattctgttccagactctggtggtgttgtttttgttccagcattcagtggtctattcgcaccatactgggatccagaggctagaggtaccatcatgggtatgtctcaatacacaaccgcttctcacattgctagagcagctgttgaagctgtttgtttccaagcccgtgccattctattggctatgagtaacgatgccatgggtgaagccgagaaggatagtacttttaagactgagatcagcgaagagggttcatatcaaaagtctttactatctacattggctgttgatggtggtatgtcccgttcagatgaagtcatgcaaatccaagctgacatcttgggtccatgtgtcaaagttagaagatctccaactgctgagtgtactgctttaggtgctgcagttgccgctaacatggcctacgaaagaccacaagaccgtgtcctatggagagatcttcaagacgctaagaactggattttctatgaaggtatgactaaatccgaatatcaagctaaggagactaagcaaaacttgaagattttcagaagccaatctactgatgaagacagacacaagcactggattcaatgggaagctgctgttaagagaagcaaaggctggctaaaggatgttgaaggtgaacatcctgtagtagcatga

SEQ ID NO: 69533 - protein, 672 aa, Candida glabrata CBS138
MISVNDGNIQMDKDGNIPLIASIDVGTTSSRVIFFNKQGQEVAKHQIEYSTSASTQKYAVHGSRRQSIKDQTKMANPEKDKPVFTSEGIAIKENEYLTIEEFHGANEGPTLKFPKPGWVECNPMNVLVNVVQCLGTTYELLDNLNNDRAQNNLPLYRVDCVGVANMRETTIVWSKKTGMPIVDYGIVWNDTRTLDLVKRKKKETEKEKRLRMKDKTGLSVFSTYFSCSKLVWLLENEPEVKKAYEAGDLMFGTVDTWLIYHLTASNAFVSDVTNASRTGFMNLDTRDYDDELVEFWGIDRNKINFPKIVSSAEYYGDLSIPKLFKSQVPGHIWELLLKYTEGEFQVPIQGCLGDQSASLVGQMAFKPGAAKCTYGTGCFLLYNTGCKKLISKHGALTTFSYWFPYLEEKENPEYGAPHFALEGSVAVAGAVVQWLRDNLRLIPKAEDVGPIANSVPDSGGVVFVPAFSGLFAPYWDPEARGTIMGMSQYTTASHIARAAVEAVCFQARAILLAMSNDAMGEAEKDSTFKTEISEEGSYQKSLLSTLAVDGGMSRSDEVMQIQADILGPCVKVRRSPTAECTALGAAVAANMAYERPQDRVLWRDLQDAKNWIFYEGMTKSEYQAKETKQNLKIFRSQSTDEDRHKHWIQWEAAVKRSKGWLKDVEGEHPVVA

SEQ ID NO: 69534 - DNA, 1986 bp, Kluyveromyces lactis NRRL Y-1140
  CDS (1)..(1986)
atgactgagaaagagttagttattaagtccgatacagaaaaagaggtggttccgttagttgctgctattgatgtcggtaccacatcttcacgtgtgattcttttcaacagattgggacaagaaatttccaagcatcagatcgagtacagtactagtgcttctcattccgcatattctgcaagcggtgaacgaagattggaagagaataagaccaatggttccagtaacgaacaaaccatcttcagcgcggaaggtattgctattgaggccacggagtatcttgagatcgaggatctagaaaaagatgtagaacctacgttaaggttcccaaaaccgggatgggtcgaatgtaaaccaatgaacattttggaaaacgtggttcaatgtttcgcagcaaacttgattacaatggatcgcgtaaacggcgatagagtctctaatggtctaccgccttatcgcatcaagtgcataggtattgctaacatgagagaaacaactttagtatggtcaaagaagaccgggaaacctttaatcgattacggtattgtatggaacgatgttagaaccacagagatagttcaaaagaaaaaagatgagacaccagaagagtaccaagaacatttaagggaattaactggattaccattgttctctacatatttctcctgttccaaacttcgctggttattagataatatccctgaagttaccaaagcttacgaagaaaatgatttggtcttcggcactgtcgacacctggttgattgccaatttgacccacaacaatgttttagttaccgatgtcactaatgcttgcaggacagggttcatgaatttaaatactaaggattacgacgatgaattgctcgattattggaacatcgacaaggcaaagattcatttgccaaagattgtttcaagttctgagtactacggtaattttgtagttccagaatgtaccaagaaatctttgacgtccacagcatgggatcttctatcagcattttcgcaaagagttcctccagtgccaatacaaggttgtcttggtgaccaaagcgcatctttggtgggtcagcttgcattcaaaccaggctctgccaaatgtacttacggtacaggttgtttccttttgtataacacaggaactactaaattgatatcaaagcacggtgcgctaacaacatttgcatactggttcccacagttagaaaatgaagaaaacgattatggtaaaccacattatgccttagaaggttcagttgctgttgctggtgccgtagttcagtggctaagagacaacttaagattgattccaagagctgaagatgttggacctctagcatcagctgtaccaaattccggtggtgttgtgtttgtaccggctttcagtggtttatttgcgccatactgggatcctgatgctcgtgcaactattatgggaatgtcacaatacacaacagcttctcacatcgctcgagctgctgtcgagggtgtctgcttccaagcgagggctattttaaaagccatgagttctgatgctttcggctcagaagataaggactttttagaagaagttgttgatgaaacttacgagaaaactttactttcgactttagctgttgacggtggtatgtctagatcagatgaagtgatgcaaattcaagctgatatcctaggcccctgtgtcaaggtaagaagatctccaacttcagaatgtactgctttaggtgctgcaattgccgctgctatggctttcaaaacagatgaagaacgtattttatggaagaatctaaaggacgtcaaaaaatgggtattctatggaggggtagagaaaggcgagaaagctcccccaagtaccaccaatgacacggatctgaaggtctttataagcaagtcttcggacaaaagtagaagaaaaggttggaagatgtgggagactgcaattgagaaatctaaaggatggatgaatgaaattcaattgtcataa

SEQ ID NO: 69535 - protein, 661 aa, Kluyveromyces lactis NRRL Y-1140
MTEKELVIKSDTEKEVVPLVAAIDVGTTSSRVILFNRLGQEISKHQIEYSTSASHSAYSASGERRLEENKTNGSSNEQTIFSAEGIAIEATEYLEIEDLEKDVEPTLRFPKPGWVECKPMNILENVVQCFAANLITMDRVNGDRVSNGLPPYRIKCIGIANMRETTLVWSKKTGKPLIDYGIVWNDVRTTEIVQKKKDETPEEYQEHLRELTGLPLFSTYFSCSKLRWLLDNIPEVTKAYEENDLVFGTVDTWLIANLTHNNVLVTDVTNACRTGFMNLNTKDYDDELLDYWNIDKAKIHLPKIVSSSEYYGNFVVPECTKKSLTSTAWDLLSAFSQRVPPVPIQGCLGDQSASLVGQLAFKPGSAKCTYGTGCFLLYNTGTTKLISKHGALTTFAYWFPQLENEENDYGKPHYALEGSVAVAGAVVQWLRDNLRLIPRAEDVGPLASAVPNSGGVVFVPAFSGLFAPYWDPDARATIMGMSQYTTASHIARAAVEGVCFQARAILKAMSSDAFGSEDKDFLEEVVDETYEKTLLSTLAVDGGMSRSDEVMQIQADILGPCVKVRRSPTSECTALGAAIAAAMAFKTDEERILWKNLKDVKKWVFYGGVEKGEKAPPSTTNDTDLKVFISKSSDKSRRKGWKMWETAIEKSKGWMNEIQLS

SEQ ID NO: 69536 - DNA, 1893 bp, Debaryomyces hansenii CBS767
  CDS (1)..(1893)
atgccacgtcgtcaaagtaatgctccatcgcagccagttgttgctacgattgatattggtacaacttcagcaagagctattttgtttaatcaaggaggtgttgaagtagccaaacatcaaatcgaatactccaccacggcatcggaagctccagcggagtcggagaataaggaacagtttagaagaagatcgtcgcttatgagacacaatgcgcctattttcactgctgaaggtattgccatttctataacagacgatgtcgaaatcgaaaataattctgcaagtgttggtcctacgttgagatttccacagcccggatgggttgagtgtatgccagttcatattttggcgaatgctgttcagtgtttgatagcttgtttgattacgttgagaaaaatcaatcagaatccggagttgaaaatcaagtataaggtcaaggctattggtattgctaacatgagagaaacaacgattgtgtggtctcgtaaaaccggtaagcctttgagtaatggtatcacatggactgatacaagaactgcagaaattgtgcagcacttggaaaggacaattgacgatgaaagaaaagaagaattaaagcaaaagaccgggttgccattatccacctatttttctgccgccaaattgcgttggttaatagataatgacgataccataaaggaggaatacgagaagggtgatggtaacttaatgtttggtacggttgatacgtggttgatttatcacttaaccaaggaaagatcctttgtatccgacgttaccaatgcatctagaacttattttatggacttagaaacaagagattatgacgatgatttattagatttttggggtattgatcctacgagggtagcgttaccaaagattgtatctagttcggaattctacggatcatttgcggctccaaatttatctaacttaggtttccacaataagatcactccagaagcatacgaaatattgaaaactattaccggcattcccatttgtgggtgtcttggtgaccagtcagcttcattagttggccaattagcatttaagcctggttctgctaaatgtacttatggtactggttgtttcttgttgtataataccggtaatcgtaagttaatctctgaacatggcacagtaacaacgataggcttttggttccctaacttaaaggacgaggacgccaatccacattatgcattagaaggttcaattgctgttgcaggttcaattattcaatggttaagagataatttgaagttgatagaacacgcgagagatgttggacctttggcctcccaagttgataatgcaggtggagttgtatttatcccagctttctcaggtttatatgctccatactgggatggtggcgctagaggtacaatttttggtatgacacaatatacctcttcatctcatatagcaagagctgcattagaaggtgtctgttatcaagttagggctatcttgagagccatggctaatgatgcgggcgcaagtgaagattttttggaagaagcgttaaataggcaaaatgagaaaaagccattatctgcattatctgttgatggtggtatgtcaaaggctgatgaggtgttgcaaattcaagcggacattttaggaccatgtgtaactgtcaaaagggcaaatatatctgaatgtacagcattgggtgcagcgattgcagccggcttatcattcaaagatgaagaagaaagagtttggaaagatttcgatgatatttatgaaaagattaatggaacggatgatgagaagaataatttcaaagcgaaattgcctgattccgatagaagaaagtattggaagaggtgggagaaagcaatcgatagagctaaaggttggttagatgaagataattag

SEQ ID NO: 69537 - protein, 630 aa, Debaryomyces hansenii CBS767
MPRRQSNAPSQPVVATIDIGTTSARAILFNQGGVEVAKHQIEYSTTASEAPAESENKEQFRRRSSLMRHNAPIFTAEGIAISITDDVEIENNSASVGPTLRFPQPGWVECMPVHILANAVQCLIACLITLRKINQNPELKIKYKVKAIGIANMRETTIVWSRKTGKPLSNGITWTDTRTAEIVQHLERTIDDERKEELKQKTGLPLSTYFSAAKLRWLIDNDDTIKEEYEKGDGNLMFGTVDTWLIYHLTKERSFVSDVTNASRTYFMDLETRDYDDDLLDFWGIDPTRVALPKIVSSSEFYGSFAAPNLSNLGFHNKITPEAYEILKTITGIPICGCLGDQSASLVGQLAFKPGSAKCTYGTGCFLLYNTGNRKLISEHGTVTTIGFWFPNLKDEDANPHYALEGSIAVAGSIIQWLRDNLKLIEHARDVGPLASQVDNAGGVVFIPAFSGLYAPYWDGGARGTIFGMTQYTSSSHIARAALEGVCYQVRAILRAMANDAGASEDFLEEALNRQNEKKPLSALSVDGGMSKADEVLQIQADILGPCVTVKRANISECTALGAAIAAGLSFKDEEERVWKDFDDIYEKINGTDDEKNNFKAKLPDSDRRKYWKRWEKAIDRAKGWLDEDN

SEQ ID NO: 69538 - DNA, 1512 bp, Yarrowia lipolytica CLIB99
  CDS (1)..(1512)
atgtcttcctacgtaggagctctcgaccagggtaccacctccacccgtttcattctcttttcgcctgacggcaagcccgtggcatcccaccagatcgaattcacccagatctacccccaccccggatgggtggagcacgaccccgaggagctcgtgagctcgtgtctggagtgcatgtcgtcggtggccaaggaaatgcgaacccagggcatcaaggtggccgacgtgaaggcgatcggaatcaccaaccagcgagaaaccaccgtgctttgggacattgagaccggccagcccctgtacaacgccattgtgtggtccgacgcccgaaccggcgacaccgtcaagaagctcgaggcccagcccggcgctgacgaaatccccaagctctgtggcctgcccctgtccacctactttgccggagtcaaggtccgatggatcctggataacgtcaaggaggcccgagagtgctacgatcgaggcaagctggccttctccaccatcgactcgtggctgctctacaacctcacgggcggcctcaacggcggcgcccacatcaccgacacctccaacgcctcccggtccatgttcatgaacattgagaccctcaagtacgacgagaagctcatcaagttctttggcgtcgagaagctcattctccccaagattgtctcgtccgccgaggtctacggccgaatcggaaccggccccttcgccaacatccccctggccggctgtctcggtgaccagtccgccgccctcgtcggccagaaggcctttgagcccggccaggccaagaacacatatggaaccggctgcttcctgctctacaacgccggcgagaagcccatcatctccaacaacggcctgctgaccaccgtcggctaccacttcaagggccagaagcccgtctacgctctggagggctccatctccgtcgccggctcgtgcatcaagtggctgcgagacaacattggtctcattgagtcttccgagcagattggagagcttgcctcccaggtcgacgactctgccggcgtggtgtttgtcaccgctctgtccggcctgtttgccccctactggcgaaccgacgcccgaggcaccattctgggtctcactcagttcaccaccaaggcccacatttgccgagccgccctggaggctacttgtttccagacccgggccattctcgacgccatggccaaggactctggtaagcccttcaccaagctgcgagtcgacggaggaatgaccaactcggacattgctatgcagatccaggccgacattcttggcattgaggtcgagcgacccgccatgcgagagaccaccgctctgggtgccgccattgctgccggctttgccgttggcgtgtggaagtccattgaggatcttaaggacatcaacaccgagggcatgaccgagtttgcttccaagaccaacgaggaggagcgggccgccatgatgaagcagtggaaccggggcattgagcgagctgttggctggcttgagtaa

SEQ ID NO: 69539 - protein, 503 aa, Yarrowia lipolytica CLIB99
MSSYVGALDQGTTSTRFILFSPDGKPVASHQIEFTQIYPHPGWVEHDPEELVSSCLECMSSVAKEMRTQGIKVADVKAIGITNQRETTVLWDIETGQPLYNAIVWSDARTGDTVKKLEAQPGADEIPKLCGLPLSTYFAGVKVRWILDNVKEARECYDRGKLAFSTIDSWLLYNLTGGLNGGAHITDTSNASRSMFMNIETLKYDEKLIKFFGVEKLILPKIVSSAEVYGRIGTGPFANIPLAGCLGDQSAALVGQKAFEPGQAKNTYGTGCFLLYNAGEKPIISNNGLLTTVGYHFKGQKPVYALEGSISVAGSCIKWLRDNIGLIESSEQIGELASQVDDSAGVVFVTALSGLFAPYWRTDARGTILGLTQFTTKAHICRAALEATCFQTRAILDAMAKDSGKPFTKLRVDGGMTNSDIAMQIQADILGIEVERPAMRETTALGAAIAAGFAVGVWKSIEDLKDINTEGMTEFASKTNEEERAAMMKQWNRGIERAVGWLE

SEQ ID NO: 69540 - DNA, 1737 bp, Pan troglodytes
  CDS (1)..(1737)
atgatcaaaacaacctttttttcttctacatcccttctcttccatccagagctgctgagccgacctactggtgtcatggcagccccgaagacagcagctgtggggccgttggtgggagcggtggtccagggcaccaactccactcgctttctggttttcaattcaaaaacagcggaactacttagtcatcacaaagtggaattaacacaagagttcccaaaagaaggatgggtggaacaagaccctaaggaaattcttcagtctgtctacgagtgtatagcgagaacgtgtgagaaacttgatgaactgaatattgatatatccaacataaaagctgttggtgtcagcaatcagagggaaaccactgtaatctgggacaagttaacaggagagcctctctacaatgctgtggtgtggcttgatctaagaacccagactactgttgaggatcttagtaaaaaaattccaggaaatagtaacttcgtcaagtctaagacaggccttccactcagcacttacttcagtgcagtaaaacttcgttggatgcttgacaatgtgagaaacgtccaaaaggctgttgaagaaggtagagctctttttggtaccattgattcatggcttatctggagtttgacaggaggagttaatggaggtgtgcattgtacagatgtaacaaatgcaagtaggacaatgctttttaatatccattctttggaatgggataaagagctctgtgacttttttgaaattccaatggaccttcttccaaatgtcttcagttcttctgagatctatggcctaattaaaactggagccctggaaggtgtgccaatatctgggtgtttgggggaccaatgtgctgcattagtaggacaaatgtgcttccaggagggacaagccaaaaacacctatggaacaggttgcttcttactgtgtaatacaggtcgtaaatgtgtgttttctgaacatggccttctgaccacagtagcttacaaactaggcagagagaagccagcatattatgcactggaaggttctgttgctatagcaggtgctgttattcgttggctaagagacaatcttggaattatagagacctcaggagacattgaaagacttgctaaagaagtaggaacttcttatggctgttactttgtcccagccttttcagggttatatgcaccttattgggagcccagtgcaagagggatactctgtggcctcactcagtttaccaataaatgtcatattgcttttgctgcattagaagctgtttgtttccaaacccgagagattttggaagccatgaaccgtgactgtggaattccacttcgtcatttgcaggtagatggaggaatgaccaacaacaaagttcttatgcaactacaagcagatattcttcatattccagtaataaaaccctttatgcctgaaacaactgcactaggagctgccatggcagcaggggctgcagagggagtaagcgtttggagccttgaaccccaggctttgtcggttctcaggatggaacgatttgaaccacagatccaggccacagaaagtgaaattcgttatgccacatggaagaaagccgtaatgaagtcaatgggttgggttacccgtcagtctcctgaaagtggtgatccttctatcttctctagtctgcctttgggattttttatagtgagtagcatggtaatgctaattggagcaagatatatatcgggtgtaccataa

SEQ ID NO: 69541 - protein, 578 aa, Pan troglodytes
MIKTTFFSSTSLLFHPELLSRPTGVMAAPKTAAVGPLVGAVVQGTNSTRFLVFNSKTAELLSHHKVELTQEFPKEGWVEQDPKEILQSVYECIARTCEKLDELNIDISNIKAVGVSNQRETTVIWDKLTGEPLYNAVVWLDLRTQTTVEDLSKKIPGNSNFVKSKTGLPLSTYFSAVKLRWMLDNVRNVQKAVEEGRALFGTIDSWLIWSLTGGVNGGVHCTDVTNASRTMLFNIHSLEWDKELCDFFEIPMDLLPNVFSSSEIYGLIKTGALEGVPISGCLGDQCAALVGQMCFQEGQAKNTYGTGCFLLCNTGRKCVFSEHGLLTTVAYKLGREKPAYYALEGSVAIAGAVIRWLRDNLGIIETSGDIERLAKEVGTSYGCYFVPAFSGLYAPYWEPSARGILCGLTQFTNKCHIAFAALEAVCFQTREILEAMNRDCGIPLRHLQVDGGMTNNKVLMQLQADILHIPVIKPFMPETTALGAAMAAGAAEGVSVWSLEPQALSVLRMERFEPQIQATESEIRYATWKKAVMKSMGWVTRQSPESGDPSIFSSLPLGFFIVSSMVMLIGARYISGVP

SEQ ID NO: 69542 - DNA, 1533 bp, Mycoplasma mobile 163K
  CDS (1)..(1533): transl_table=4
atggaaaaatatatagtaactttagatagtggaactacaagtgtaagaactttaattataaataaacatggtgatgttgtaagtgttgctcaacaagaaatttctcaaatttatccaagaagtggttgagtagaacatgatccattagaaatttgaaatagtcaaagacaaacaatgcaatcagcaaaacataaagctaaaattaaaagtgttgatgttgctgcagttggaattactaatcaacgtgaaacaattcttatttgagataaattaacaggattgcctgtttataatgctttagtttgacaagatacaagaacacatgatttttgtgaagcattgattaaaaaaggtcatcaaaaaatgattcaagaaaaaacaggacttttaattaatccatattttagtggaactaaactaaaatgaattctagaaaatgttgaaggtgtgggtaaaaaattagcaaaaaaagaattattagcaggaacaatcgacacatgattaatttgaaaattgacaaatggaaaagttcatgcaacagatgtttctaatgcttcaagaactttattatttaatattcacacaatgaaatgagatgatgaaattcttgaattattaaacattcctaaagaaatacttcctgaagttaaagcttcaaatggtgattttggaattgttgatccactacattgatcaaataatgcacatggaaaagtaccaattagatcagcaattggagaccaacaatcagctttatttggacaattatcttttaataaaggagatgttaaaaacacttacggtacaggagcatttatgctattaaatactggtgaaaaagcaatcaattctaaaaatagattactaacaactgttgcatgacaattagaaaaagaaaaagctatttatgctttagaaggttcagtttttgtagcaggagctagtttaaaatgattaagagactctttaagattgatttatgcttcggatgaaagtgattattatgcaaatagagttcaagatgatgggcaaagagtatatgttgtgcctgcttttacaggtttaggtgccccatattgagattcaagtgcaaaaggtgcaatttttggtctagaaagatctactaatcgtgaacatttagttaaagctacacttgaatcaattgcttatcaatcaaatgatttattaaaggctatggaaagtgatttgaaagaaaaaattaaagttatgaaagttgatggtggagtttcaaatagtaagtttttattacaatttcaagcagatattagcaatttagaagtcataaaacctaaaaatattgaaacaacagcaatgggtgcagcatatttagcgggtttagcggtcaaattttgaactaatttagctgaaattgaaaaaatttcaaaaatcgatactaattcaaaatcaaaaattactgaagataaaagaaaatttttattaaaaggatgaaatgaggctgttaaaagaactttaaattgatctaaagatatagaagaagtgaaaaatgaataa

SEQ ID NO: 69543 - protein, 510 aa, Mycoplasma mobile 163K
MEKYIVTLDSGTTSVRTLIINKHGDVVSVAQQEISQIYPRSGWVEHDPLEIWNSQRQTMQSAKHKAKIKSVDVAAVGITNQRETILIWDKLTGLPVYNALVWQDTRTHDFCEALIKKGHQKMIQEKTGLLINPYFSGTKLKWILENVEGVGKKLAKKELLAGTIDTWLIWKLTNGKVHATDVSNASRTLLFNIHTMKWDDEILELLNIPKEILPEVKASNGDFGIVDPLHWSNNAHGKVPIRSAIGDQQSALFGQLSFNKGDVKNTYGTGAFMLLNTGEKAINSKNRLLTTVAWQLEKEKAIYALEGSVFVAGASLKWLRDSLRLIYASDESDYYANRVQDDGQRVYVVPAFTGLGAPYWDSSAKGAIFGLERSTNREHLVKATLESIAYQSNDLLKAMESDLKEKIKVMKVDGGVSNSKFLLQFQADISNLEVIKPKNIETTAMGAAYLAGLAVKFWTNLAEIEKISKIDTNSKSKITEDKRKFLLKGWNEAVKRTLNWSKDIEEVKNE

SEQ ID NO: 69544 - DNA, 1350 bp, Picrophilus torridus DSM 9790
  CDS (1)..(1350): transl_table=11
atgataggtgcagttgatgagggtacaggctccacaagattcaccgtctatgataatgaaatgaacacattatattcaagcaaaaggagaataagaacatttcataacaatagaacggcagaacaggacccaaatgaaatttataacaaaacaatgataaatatcaaagatgccattaaaagatttcatatcagggcaattggcgtaacaaatcaaagggagacatcaatattctggaacaatgagggcatgccactggcaaatgcaatatcatggcaggataagagattttcctcatacgcaaaaatgttaaaaaaggaatacggcgatctttttattaaaaaaacgggcttaataccagatccatacttcagcgcgataaagataaaatacctaatgtcaagaaatccattgttaagggagaaggcagccaatggcaggataaaattcggaacggttgattcttatatattatacaagatgctgaacaggcatgttacagattactcaaatgcatcaagaacaatgcttttcaacataaaaaatctggaatacgatgatgaaatcctaaaaattcttgatataccagaaaagatgcttccagagcccatgccatcagattcattctttggttcatggcatggtattgatataaacgctgttttaggcgatcaaaattcatcacttttcggtcataatttaataaaggacgatccggtaaaggccacttttggaaccggaacatttataatgtcattgacttcagatttaaatgtaagcagcaggcttttaaaaacaatagcatggtccatggaaaataatataaagtatgcacttgagggctcaatatttgattcaggatcattttacaactgggcaaggagtacattttcaggagatcctgtttatcagaacaggatagttatggttcctgcattttctggccttggtgctccatactgggaacctggtgcaagaacagtaataacaggcattgactataactcaaccggttctgagctgctttctgcagcaatccagggcatcggctttcaggtctatgatatactaaaggagataaaaaacaggaagtacatgacatgcgacggctctggctcaagaaatgagtttttaatgcagttcatatcagatctatcaaacatcgatgtaataacattaaatgaacatgagataacatcatttggcatagctgcaatggccggcacatcctctggaattataaaggatataaataaaccaggcatagaaagaatttatacgccatcaggaagggattacagatatttatataaaaaatggaggcatgccgttaatttatcaatatcatag

SEQ ID NO: 69545 - protein, 449 aa, Picrophilus torridus DSM 9790
MIGAVDEGTGSTRFTVYDNEMNTLYSSKRRIRTFHNNRTAEQDPNEIYNKTMINIKDAIKRFHIRAIGVTNQRETSIFWNNEGMPLANAISWQDKRFSSYAKMLKKEYGDLFIKKTGLIPDPYFSAIKIKYLMSRNPLLREKAANGRIKFGTVDSYILYKMLNRHVTDYSNASRTMLFNIKNLEYDDEILKILDIPEKMLPEPMPSDSFFGSWHGIDINAVLGDQNSSLFGHNLIKDDPVKATFGTGTFIMSLTSDLNVSSRLLKTIAWSMENNIKYALEGSIFDSGSFYNWARSTFSGDPVYQNRIVMVPAFSGLGAPYWEPGARTVITGIDYNSTGSELLSAAIQGIGFQVYDILKEIKNRKYMTCDGSGSRNEFLMQFISDLSNIDVITLNEHEITSFGIAAMAGTSSGIIKDINKPGIERIYTPSGRDYRYLYKKWRHAVNLSIS

SEQ ID NO: 69546 - DNA, 1488 bp, Acinetobacter sp. ADP1
  CDS (1)..(1488): transl_table=11
atgagctacttacttgccctcgatcaaggaacgacatctagccgcgccattatcttcgatgaaaaaggccagatccatgcaactgcacaacgtgaaacacgtatcaaaaccccaaattctggttgggtagaacaagatgccaatgaaatatggtcaagccagattgctgttattcagcaagccttggcttcagctcatattctggcaaaggatatcaaggctttaggactgaccaatcaacgtgaaacaacagtcgtttgggataaacgcacaggtaaagcacttgcgcccgcaattatctggcaagatcgacgtgcagcacagtggtgtaataccttaattgaaaatggcatgctggtacaggttcagcaaaaaacaggtttaagaattgacccctattttagtgcaggaaaattggtctggttacttgaaaatattgcgggatttcgaatacttgccgaacagggacatgccgcgtttggtaccattgatagttggctggtctggaatttaactcaaggtgcagagcatatcattgaggccagtaatgcgtctcgtaccatgctcatgaacctttcaacacaaatgtgggatgaagatttacttaataaatttaatattccagcagcaattctacctaaaatcattagctcagatgcatatgtggccgatactgcacaaggtcttttgggaagtacaattccgattactggaatattgggtgatcaacaagcagcgttatttggtcagtcatgttttgaggtaggttctgccaaaaacacctatggcacaggatgttttatgctgttcaatacaggagatcaacttcaatttagtcaaaatcagttgctcactacccttgcatggcaatgtcaaaatcaaacccgttatgcactcgaaggcagtgtatttatggcaggcgccattgtgcaatggttacgtgatggtcttggactcattcagcatagtgcccaagttgagcaacttgccagtcaggtgcaaagtacagaaggtgtcgttttggtgcccgcatttactgggcttggtgcgccgcactgggacagtgaagcgcgtgctttgctttgtggaatgtcgcgcggtaccacaaaagcacatattgctcgtgcagcacttgaagcgattgccttccaagtctctgatgtgttgtgtgccatgcagtctgatttatcgcggccattaaaagaacttcgtgtcgatgggggtgccagccaaaacgatatgctcatgcaatttcaggccgatattttaaatgtacctgttctacggcctaaaatgcttgaatcaaccgcttggggtgcagcagccatggccggcttaaaagcaggtgtttttaccaatctggatgaaattgcagcgtcatggcaacttgatcgtacttttgagccaaagatgaaaaatgacgaacgtgaatcacgtttgtgtgaatggagtcaggcactcaaaagagcgaagtccaatttgatataa

SEQ ID NO: 69547 - protein, 495 aa, Acinetobacter sp. ADP1
MSYLLALDQGTTSSRAIIFDEKGQIHATAQRETRIKTPNSGWVEQDANEIWSSQIAVIQQALASAHILAKDIKALGLTNQRETTVVWDKRTGKALAPAIIWQDRRAAQWCNTLIENGMLVQVQQKTGLRIDPYFSAGKLVWLLENIAGFRILAEQGHAAFGTIDSWLVWNLTQGAEHIIEASNASRTMLMNLSTQMWDEDLLNKFNIPAAILPKIISSDAYVADTAQGLLGSTIPITGILGDQQAALFGQSCFEVGSAKNTYGTGCFMLFNTGDQLQFSQNQLLTTLAWQCQNQTRYALEGSVFMAGAIVQWLRDGLGLIQHSAQVEQLASQVQSTEGVVLVPAFTGLGAPHWDSEARALLCGMSRGTTKAHIARAALEAIAFQVSDVLCAMQSDLSRPLKELRVDGGASQNDMLMQFQADILNVPVLRPKMLESTAWGAAAMAGLKAGVFTNLDEIAASWQLDRTFEPKMKNDERESRLCEWSQALKRAKSNLI

SEQ ID NO: 69548 - DNA, 1491 bp, Erwinia carotovora subsp. atroseptica SCRI1043
  CDS (1)..(1491)
atgtatacgccggttattttggcaatcgatgaagggacgacgaacgccaaggcgattgccgtcgatgagcgaggacgcattctggctaaagctgccgttgctttgcaggtgacacacccgcaaccgggcagatccgaacaggatgcgatggcgatctggcgtgcggtttgtcaggcggcagaggtttgcttgtcatcattacaccgtgctcaggtggtgggtgtcgccattagcaatcagcgtgagtcggtgctgatttgggacaggcaaaccggaaaaccgatgacgccattggtcagttggcaggatcgtcgtgcggagaaattctgtcaggcattacaaggaagcgctgaggcacgtctgatcgaatcccgtaccggactgcaagtcgatccgctttttcccgccgccaaactgcatgccatgctggcggaattgccaaacggtgtcgcccgtgcaatgcagggggagttgtgcatcggaacggtggattgctggcttaactggcagtttagcggggggcgggcgttctccaccgactattccaacgcggcgagaacccaactgtttaatattcaccgcggctgctgggatgaggatctgctggcgctgttcggtatccccagcgtttgtctgcctgccgtcacgccttcctcggcgttacacggtcacaccggcgtgacgggcatcagtgggcttgccgcttgcgtaccgattgtggcgctgattggggattcccatgctgcgctgtacggtcagggcatcacccaaagcggtgaaatcaaggcgacatacggcaccggttcgtcgctgatgaccaccatcaacacgccgcaccttcacgccactgggctcagcactacgatcgcttggcacgatggcgaactgcgctacgcgctggaaggcaatatcacccataccggctcgggatttgcctggattggtcagatgctgggcgtcccttccgttacgcaactgaccgaactggcgctcagcgccgaatcgaatcagggtgttttctttgttcctgccttatccgggctaggtgcaccctattgggatgtgcaagcgcgcggcctgctgtgtggtttatgcgacgccaccacaccggccatcatcgctcgcgctgggcttgaagcgattgcgtatcaagttgccgatgtctttttcgctatggaacaggtgtcgcaggccgctttacccgctctgcgtgttgacggtggcgcgacgcaaaaccgctggctgatgcagtttcaggctgacttattacaacgccctctgattcgcaatcacaacgcggaagtatctgcgttgggggcggcctatctgggcggcaagatgctgggatggtgggagcataacgaacagatcgccgcgctgccgagagaggtggaagtcatcgaaccgtcggcgacaaatcacgccattctggagagctaccaacagtggcgtacggcggtggcgcgagcacgtttgcggcctgaagcatga

SEQ ID NO: 69549 - protein, 496 aa, Erwinia carotovora subsp. atroseptica SCRI1043
MYTPVILAIDEGTTNAKAIAVDERGRILAKAAVALQVTHPQPGRSEQDAMAIWRAVCQAAEVCLSSLHRAQVVGVAISNQRESVLIWDRQTGKPMTPLVSWQDRRAEKFCQALQGSAEARLIESRTGLQVDPLFPAAKLHAMLAELPNGVARAMQGELCIGTVDCWLNWQFSGGRAFSTDYSNAARTQLFNIHRGCWDEDLLALFGIPSVCLPAVTPSSALHGHTGVTGISGLAACVPIVALIGDSHAALYGQGITQSGEIKATYGTGSSLMTTINTPHLHATGLSTTIAWHDGELRYALEGNITHTGSGFAWIGQMLGVPSVTQLTELALSAESNQGVFFVPALSGLGAPYWDVQARGLLCGLCDATTPAIIARAGLEAIAYQVADVFFAMEQVSQAALPALRVDGGATQNRWLMQFQADLLQRPLIRNHNAEVSALGAAYLGGKMLGWWEHNEQIAALPREVEVIEPSATNHAILESYQQWRTAVARARLRPEA

SEQ ID NO: 69550 - DNA, 1512 bp, Erwinia carotovora subsp. atroseptica SCRI1043
  CDS (1)..(1512)
atgaacccggaaaaaaaatacattgtcgcgatcgaccaaggcacaaccagctctcgcgccgtcgtactggatcacgatgcaaatatcgttagcgtttcacagcgtgaattcacccagatttatccaaaagcgggctgggtagagcacgacccgatggaaatttgggcaacacaaagctcaacgctggtcgaagtactagcgaaagccgatatcagtgcggatgaagtcgcgggtattggtatcaccaaccagcgtgaaaccaccgtcgtatgggaaaaagagagcggcaagccgatttataacgccatcgtctggcagtgtcgtcgtaccgctgaaatttgcgagaaactgaagaaagacggtctggaagagtacgttcgcaacaccaccgggctggtggtcgatccctacttctctggcaccaaggtgaaatggattctggatcacgttgaaggctcccgtgagcgcgctaaacgcggcgaattgctatttggtactatcgatacctggctgatttggaaaatgacgcaagggcgtgttcacgtaacggattacaccaacgcctcccgcaccatgctgtttaacattcatacgctagaatgggatacccgcatgctggaagcgctggatatcccgcgcgagatgctgccggaagtacgcggctcttcagaggtctacggccagaccaacatcggcggtaaaggcggcacgcgtattcctatcgccggtatcgcgggtgaccagcaggcggcgctttacggccagctctgcgtcaaccctgggcaggcgaaaaacacctacggcactggctgtttcctactaatgaataccggtaaagaagccgtgcagtccaaacacggtctgctgaccactatcgcctgtggcccgcgcggtgaagtgaactacgcgctggaaggctccgtgttcgttggcggcgcatctatccaatggctgcgtgacgagctgaagctgatcggcgactccatggactccgaatacttcgcgacaaaagtgaaggacaccaacggcgtctatgtcgtccccgctttcactggtttgggagccccctactgggacccgtatgcccgtggcgcgatcttcggtctgacccgtggcgtgaacgctaaccacatcatccgtgcgacgctggaatccatcgccttccagacccgtgacgtgctggatgccatgcaggcagacgcggggacgcgtctgaaatcactgcgtgtcgacggtggcgcagtcgccaacaacttcctgatgcagttccagtccgatatcctcggcacgcgcgtggaacgtccggaagtacgtgaatccaccgcattgggtgccgcgttcttggctggccttgccactggcttctggaacgatctggatgaagtgaagagcaaagcgactattgagcgtgaattccgccccagcatagaaacggtggagcggaacgttcgttacagcggctggcagaaagccgttgctcgtgctcgtaactgggaagatcacgacgcctaa

SEQ ID NO: 69551 - protein, 503 aa, Erwinia carotovora subsp. atroseptica SCRI1043
MNPEKKYIVAIDQGTTSSRAVVLDHDANIVSVSQREFTQIYPKAGWVEHDPMEIWATQSSTLVEVLAKADISADEVAGIGITNQRETTVVWEKESGKPIYNAIVWQCRRTAEICEKLKKDGLEEYVRNTTGLVVDPYFSGTKVKWILDHVEGSRERAKRGELLFGTIDTWLIWKMTQGRVHVTDYTNASRTMLFNIHTLEWDTRMLEALDIPREMLPEVRGSSEVYGQTNIGGKGGTRIPIAGIAGDQQAALYGQLCVNPGQAKNTYGTGCFLLMNTGKEAVQSKHGLLTTIACGPRGEVNYALEGSVFVGGASIQWLRDELKLIGDSMDSEYFATKVKDTNGVYVVPAFTGLGAPYWDPYARGAIFGLTRGVNANHIIRATLESIAFQTRDVLDAMQADAGTRLKSLRVDGGAVANNFLMQFQSDILGTRVERPEVRESTALGAAFLAGLATGFWNDLDEVKSKATIEREFRPSIETVERNVRYSGWQKAVARARNWEDHDA

SEQ ID NO: 69552 - DNA, 1548 bp, Propionibacterium acnes KPA171202
  CDS (1)..(1548): transl_table=11
atgcagataagaaaggcaaccaacatgagcgatgagaagtttgtactcgccattgacgagggcactacttccgcccgtgccatcatctttaaccacgccggccagatcatggccgttggccagcaggagttcgagcagatcttcccgcgtgctggatgggttgagcatgacccgatcgagatctgggaggccgttcgcgacgtcgttgggctcgccctgaccaaggccaacatcaaccgccaccagctggctgctgctggtatcaccaaccagcgcgagaccgcagtggtgtgggacaagaacaccggtgagccggtttataacgccatcgtgtggcaggacacgcgcactcaaaagatctgtaacgaactagctggtgacaagggcgccgaccgctacaaggagatctgtggtctgggcctgtcgacctatttctctggcccgaaggtcaaatggattctcgacaacgttgagggagcccgtgcgagggccgaggccggcgatctgctcttcggtaacatggacacttgggtgctgtggaacctgactggcggtactaacggtggcgtgcacatcaccgatccgaccaacgcgtcccgaaccatgctcatggacgtccgaaagctgcagtgggacgactcgatgtgcgaggtcatggggattccgaagtccatgcttcctgagatcaagtcctcctccgagatctacggctatggtcgcaagaacggcctgctgatcgataccccgatctccggcattcttggcgatcagcaggccgccacttttggccaggcttgcttccaaaagggcatggcgaagaacacgtacggcaccggctgcttcatgctcatgaacacaggtgaggaggccatcttctccgagaacggtctgctgaccaccgtctgctacaagatcggtgaccagcccaccgtctatgccctggaaggttcgattgccgtcgctggatcgctggtacagtggctgcgcgacaacctcaagatgttcgagaccgccccgcaaatcgaagctctcgctaacaccgtcgaggacaatggtggcgcctactttgtgccggccttctctggcctgttcgcgccgtactggcgtccagacgcccgtggtgccctcgtgggcttgacccgctacgtcaaccgtggccacattgcccgcgccgtgctcgagtcaaccgccttccagactcgcgaggttcttgaggctatgaacgccgactccggtgtgccgctgacggagctgcgcgtcgacggtggcatgaccgccaacgaaaccctcatgcagttccaggccgaccaggtcaatgtgccggtggttcgccccgtggtcgccgaaaccaccgctctgggcgccgcctacgccgctggcatcgctgtcggtttctgggaaggcgagaatgacgtcaccgacaactgggccgaggacaagcgctgggaacccaagatggacaagaatgagcgcgaacgtctgttccgcaactggaagaaggctgtcactaagaccttcgactgggtggacgacgacgtcaaggagtga

SEQ ID NO: 69553 - protein, 515 aa, Propionibacterium acnes KPA171202
MQIRKATNMSDEKFVLAIDEGTTSARAIIFNHAGQIMAVGQQEFEQIFPRAGWVEHDPIEIWEAVRDVVGLALTKANINRHQLAAAGITNQRETAVVWDKNTGEPVYNAIVWQDTRTQKICNELAGDKGADRYKEICGLGLSTYFSGPKVKWILDNVEGARARAEAGDLLFGNMDTWVLWNLTGGTNGGVHITDPTNASRTMLMDVRKLQWDDSMCEVMGIPKSMLPEIKSSSEIYGYGRKNGLLIDTPISGILGDQQAATFGQACFQKGMAKNTYGTGCFMLMNTGEEAIFSENGLLTTVCYKIGDQPTVYALEGSIAVAGSLVQWLRDNLKMFETAPQIEALANTVEDNGGAYFVPAFSGLFAPYWRPDARGALVGLTRYVNRGHIARAVLESTAFQTREVLEAMNADSGVPLTELRVDGGMTANETLMQFQADQVNVPVVRPVVAETTALGAAYAAGIAVGFWEGENDVTDNWAEDKRWEPKMDKNERERLFRNWKKAVTKTFDWVDDDVKE

SEQ ID NO: 69554 - DNA, 1515 bp, Streptococcus pyogenes MGAS10394
  CDS (1)..(1515): transl_table=11
atgtcgcaagaaaagtatatcatggctattgatcagggaacaacaagttcacgagcgattattttcaatcaaaaaggggaaaaggttagcagtagccaaaaagaattccctcagattttcccacacgctggttgggtagagcacaatgctaatcagatttggaattcggttcagtctgttattgcgggtgcttttattgaatccagcatcaaaccaagccaaattgaagcaatcggaattaccaaccaacgtgagaccacagtggtttgggacaaaaaaacgggtgtacctatttataatgctattgtgtggcaatcacgacagacggcaccaattgctgagcaactcaaacaagatggccatacaaaaatgatccatgaaaagacaggccttgttattgatgcctacttttctgcaaccaagatccgttggattttagaccatgttcctggtgctcaagaacgagctgaaaaaggcgagttactttttggaaccattgatacttggctggtttggaaactaacagatggtgctgttcatgtgacggattattccaatgcggctcgtaccatgctctataatattaaagacttaacatgggatgatgagattttagagcttttaaatattccaaaagatatgcttccagaggttaaatccaattctgaaatttatggcaaaacagctgcctttcatttttatgggggcgaagtgcctatttcaggtatggcgggtgaccaacaggcagctttgtttggccaactagcttttgatcctggtatggtgaaaaacacttatggcacaggttctttcattatcatgaatactggtgatgagatgcagttatcgagtaataatcttttgaccaccattggttacgggattaatgggaaggttcactatgccttggaaggttccatctttattgcaggctctgccattcaatggttgcgagatggtcttaaaatgattgagacctcaccagagtctgaacagttcgctctagcatcaactagtgacgatgaagtttatgttgtgcctgcttttaccggtttaggagctccttactgggattctaatgcgcgtggatctgtctttggcttgacacgtggtaccagcaaagaagactttgtcaaagcaaccttacaatctatcgcctatcaagtgcgagatgttattgataccatgcaggtggattcaggtattgacattcaacaactccgtgtggatggcggtgcagccatgaataatatgctcatgcaattccaagctgatattttggggattgacatcgctcgtgctaaaaatttagaaacaacagctctaggggcagctttcttggcagggcttgctgttgggtattgggaagatatggatgctttgaaggaattaaacgccactggacaactcttcaaagctagcatgaatgaatctcgcaaggaaaaactgtataaaggttggaaacgcgctgttaaagcaactcaagtgttcacgcaagacgatgacgcagaataa

SEQ ID NO: 69555 - protein, 504 aa, Streptococcus pyogenes MGAS10394
MSQEKYIMAIDQGTTSSRAIIFNQKGEKVSSSQKEFPQIFPHAGWVEHNANQIWNSVQSVIAGAFIESSIKPSQIEAIGITNQRETTVVWDKKTGVPIYNAIVWQSRQTAPIAEQLKQDGHTKMIHEKTGLVIDAYFSATKIRWILDHVPGAQERAEKGELLFGTIDTWLVWKLTDGAVHVTDYSNAARTMLYNIKDLTWDDEILELLNIPKDMLPEVKSNSEIYGKTAAFHFYGGEVPISGMAGDQQAALFGQLAFDPGMVKNTYGTGSFIIMNTGDEMQLSSNNLLTTIGYGINGKVHYALEGSIFIAGSAIQWLRDGLKMIETSPESEQFALASTSDDEVYVVPAFTGLGAPYWDSNARGSVFGLTRGTSKEDFVKATLQSIAYQVRDVIDTMQVDSGIDIQQLRVDGGAAMNNMLMQFQADILGIDIARAKNLETTALGAAFLAGLAVGYWEDMDALKELNATGQLFKASMNESRKEKLYKGWKRAVKATQVFTQDDDAE

SEQ ID NO: 69556 - DNA, 1521 bp, Leifsonia xyli subsp. xyli str. CTCB07
  CDS (1)..(1521): transl_table=11
atggctgaatacatcgtcgctatcgaccaaggcacaacaagcacccgggcgatcatcttcgacaagtccgggtcgatcgtctcgaccgggcaattggagcacgagcagatcttcccgaagccgggctgggtcgagcacaaccccgtcgagatctggaacaacacccgcgaggtcatcgggcaggcgctctcgaaggccgatctgacccgccacgacatcgcggcggtgggcatcaccaaccagcgcgagaccgcggtggtgtgggacaagaacaccggggagccggtctacaacgcgatcgtctggcaggacacccgaacgcagccgatcgtggaccggctcgccgcggagggcggcgtcgagcgcttcaagccgatcgtgggcctcccgctcgcgacctatttctcgggaaccaagatcgtgtggatactcgagaacgtcgagggagtccgcgagcgcgccgaacgcggcgatctgctgttcggcaccaccgaaagctgggtcctctggaacctcaccggtggcaccgacggcggtgtgcatgccaccgatgtgaccaacgcctcccgcaccctgttcatggacctggagacgctgagctggcgggacgacatcctcgacgtgttcggggtgcccaagtcgatgctcccggagatcaagagctcttccgaggtctacggcgcggtcgagtcgtcgagcttgctccgcgaggtgcccgtggcgggcatcctgggcgaccagcaggccgctacgttcggccaggcggcgttcgatccgggtgagtccaagaacacctacggcaccggcaacttcctcatcttcaacacaggggaagagatcgtccactccaagaacggcctcctcaccacgctcggctacaagctgggcgacggcaaaccgcactacgccctggagggctcgatcgctgtcaccggttcgctggtgcagtggctgcgcgacaacctcggcgtcatctcgagcgctcccgagatcgaggagctggcccaaacggtcgaggacaacggcggcgcttacttcgtgccggcgttgtccgggctgttcgcaccgtactggcgcgcggacgcacgcggtgcgctcgtgggtctgacccgctatgtgaacaagggccacatcgcccgcgccgccctggaagcgaccgcgtttcagacccgtgaggtgctggacgcggtgaacgcggactcgggcgtcgacctcacggagctgaaggtggacggcggcatgatcgccaacaacaccctgatgcagttccaggccgacatcctgggcgttcccgtcgtccgtccggtcgtcgccgagaccaccgctctcggcgccgcctacgccgccggcctcgctaccggcttctgggagaacctggacgatctgcgcaagaactggaaggaggaccgccgctgggagcccaagatggatgccgccgagcgcgaccgccagctccgcctctggaagaaggccgtgacgaagaccttcgactgggtggacgacgacgtgcgcaacggctga

SEQ ID NO: 69557 - protein, 506 aa, Leifsonia xyli subsp. xyli str. CTCB07
MAEYIVAIDQGTTSTRAIIFDKSGSIVSTGQLEHEQIFPKPGWVEHNPVEIWNNTREVIGQALSKADLTRHDIAAVGITNQRETAVVWDKNTGEPVYNAIVWQDTRTQPIVDRLAAEGGVERFKPIVGLPLATYFSGTKIVWILENVEGVRERAERGDLLFGTTESWVLWNLTGGTDGGVHATDVTNASRTLFMDLETLSWRDDILDVFGVPKSMLPEIKSSSEVYGAVESSSLLREVPVAGILGDQQAATFGQAAFDPGESKNTYGTGNFLIFNTGEEIVHSKNGLLTTLGYKLGDGKPHYALEGSIAVTGSLVQWLRDNLGVISSAPEIEELAQTVEDNGGAYFVPALSGLFAPYWRADARGALVGLTRYVNKGHIARAALEATAFQTREVLDAVNADSGVDLTELKVDGGMIANNTLMQFQADILGVPVVRPVVAETTALGAAYAAGLATGFWENLDDLRKNWKEDRRWEPKMDAAERDRQLRLWKKAVTKTFDWVDDDVRNG

SEQ ID NO: 69558 - DNA, 1488 bp, Yersinia pseudotuberculosis IP 32953
  CDS (1)..(1488): transl_table=11
atgtcaacgccaatcattctggctattgatgaagggacaaccaacgccaaagccattgcggtagatcgtgccgggcgagttctggcgaaagcctcggtaccattacaactggaacatcctcagcccggttgggcagaacaggatccgctggcgatttggctggcggtttctcaggcggttgaggggtgcctaaatcaattggcgggcgcacaggtggcggggattgccatcagtaatcagcgtgaatcggtactgatttgggaacgggaaaccggcacgccgctcacgccagtcgtaagctggcagtgccgtcgttcagaggctttctgtctggctttgcgccaattaccggctgcggcgatggttgcggaacggactggattgcagattgatcccctgtttcctgcggccaaaattcacggcatgttggcgcagatccctcatggcgctgaacgtgccgctcacggtgagctgtgtgttggcacgcttgattgctggctgacctggcagtttagcgaagggcaaagtttctcgactgacttctctaatgcggcccggacccagctgtttaatatccattcaggtcaatgggaccccgatttactggcgctgtttggtatcccaagtctttgcctgcccgccgtcttaccctcggcatccatccacggacacaccgcgcgcaccgggattctcggcctggagcagggcgtgcctatcgtggcacacattggtgattcgcacgccgcgctgtacgggcaaggcggcgaccaggccggtgaaatcaaagccacttatggcaccggctcctctctgatgatgaccctaaaacaggcctgtgcaccaagccacggcctaagcaccaccattgcctggcatgacggcgaattacgctatgcccttgaaggtaacatcacccataccggctcaggagtggcatgggtctcgcgcatgttagggatcagtgatttgtcacgtctgactgacatggcagaaagccaatcaggtaatcaaggcgtctattttgtaccggcattatcaggactgggtgcgccttattgggacagtcaggcgcgtggtttgttctgtggtctgacggatgccacgacaccggcagtactggcgcgagcggcacttgaatcagtcgcttatcaaatagccgatgttttctttgcgatggagaatgcggctcatcatcgccttgaacggctgcgggttgatggcggtgcgaccagtaatcgctggctgatgcagtttcaggccgatttattacagcgcacattgatacgtaatcacacggcagaagtgtcagcactgggtgccgcgtatttgggcgggaaaacccttggttggtggcaggatagccaacaactggctgcgctcccccgtgaagtggaatacatcgaaccgcgcattcacagtgcggagatgcaagataactatagcctctggcaaacggccatcgcgcgtgcgcgttttcagccgaaataa

SEQ ID NO: 69559 - protein, 495 aa, Yersinia pseudotuberculosis IP 32953
MSTPIILAIDEGTTNAKAIAVDRAGRVLAKASVPLQLEHPQPGWAEQDPLAIWLAVSQAVEGCLNQLAGAQVAGIAISNQRESVLIWERETGTPLTPVVSWQCRRSEAFCLALRQLPAAAMVAERTGLQIDPLFPAAKIHGMLAQIPHGAERAAHGELCVGTLDCWLTWQFSEGQSFSTDFSNAARTQLFNIHSGQWDPDLLALFGIPSLCLPAVLPSASIHGHTARTGILGLEQGVPIVAHIGDSHAALYGQGGDQAGEIKATYGTGSSLMMTLKQACAPSHGLSTTIAWHDGELRYALEGNITHTGSGVAWVSRMLGISDLSRLTDMAESQSGNQGVYFVPALSGLGAPYWDSQARGLFCGLTDATTPAVLARAALESVAYQIADVFFAMENAAHHRLERLRVDGGATSNRWLMQFQADLLQRTLIRNHTAEVSALGAAYLGGKTLGWWQDSQQLAALPREVEYIEPRIHSAEMQDNYSLWQTAIARARFQPK

SEQ ID NO: 69560 - DNA, 1497 bp, Symbiobacterium thermophilum IAM 14863
  CDS (1)..(1497): transl_table=11
atgaacaagggttacgtcctcgccctggaccagggaaccacctcttcccgggccatcctcttcaaccgggacggccggctcgtggggcaggtgaaccatgagttccggcagatctacccgcagcccggctgggtcgagcacgacccccgggagatctggtccacccagctgcgcgccgtccaggacgtgctggcccgcaccggcgtccggctgagcgaggtggccgcgatcggcatcaccaaccagcgggagacgacggtggtgtgggacgccgaaaccggcgagcccgtgtacaacgcgatcgtctggcagtgccgccgcaccgcccccatctgcgccgagctggcggcgcggggctgggcgccgcgcatccgggagaagaccggcctggtcatcgacgcctacttctcgggaaccaaagtgaagtggattctggacaacgtccccggcgtgcgggagaaggcggagcaggggcggctgcgcttcggcaccatcgacgcctggctcatctggaacctgaccggcgggcgggtgcacgccaccgactactccaacgcctcccgcaccatgctgttcaatatccaccagctcgcgtgggacgaggagatcctgcacgaactcggcatcccggcgtcgctgctaccccgggccctcccctccagccacgtctacggggagaccgatcccgcggtgctcggcgcggccatccccatcgccggcgtggcgggggaccagcaggcggcgctcttcgggcaggcctgcttccagccgggcgatgccaagaacacctacgggaccggctgcttcatgctgatgaacaccggcgaccgggcagtgccgtcggagagcggtctgctcaccaccatcgcctggggcatcggcgaccgggtggagtatgcgctggagggctcgatcttcatcggcggcgcggcggtgcagtggctgcgggacgagctccgcttcttcgaccgcgcggccgattccgaggccctggccctctccgtccccgactcgggcggggtgtacgtggtgccggccttcgtgggcctcggagctccgtactgggacatgtacgcccgcggcatcgtcgtgggcctcacccggggcacgggccgggcccacatcacccgggccacgctggagtccattgcgtaccagacccgcgacgtgctgggggcgatggagaaggactcgggcatccggctgaaccggctgaaggtggacggcggtgccgtcgccaacaacttcctcatgcagttccagtccgacatcctcggcgtaccggtcgagcggccgaagatcgcggaaaccacggccctgggtgcggcctacctggccggcctggcgaccggcttctggcgcagccaggcggaactggccgacaagtgggccctggaccggggcttcaccccggccctgccggccgaggagagagaacggctctacgccggctggcgacgggcggtggagcgcgcccggggctgggccgccgagtag

SEQ ID NO: 69561 - protein, 498 aa, Symbiobacterium thermophilum IAM 14863
MNKGYVLALDQGTTSSRAILFNRDGRLVGQVNHEFRQIYPQPGWVEHDPREIWSTQLRAVQDVLARTGVRLSEVAAIGITNQRETTVVWDAETGEPVYNAIVWQCRRTAPICAELAARGWAPRIREKTGLVIDAYFSGTKVKWILDNVPGVREKAEQGRLRFGTIDAWLIWNLTGGRVHATDYSNASRTMLFNIHQLAWDEEILHELGIPASLLPRALPSSHVYGETDPAVLGAAIPIAGVAGDQQAALFGQACFQPGDAKNTYGTGCFMLMNTGDRAVPSESGLLTTIAWGIGDRVEYALEGSIFIGGAAVQWLRDELRFFDRAADSEALALSVPDSGGVYVVPAFVGLGAPYWDMYARGIVVGLTRGTGRAHITRATLESIAYQTRDVLGAMEKDSGIRLNRLKVDGGAVANNFLMQFQSDILGVPVERPKIAETTALGAAYLAGLATGFWRSQAELADKWALDRGFTPALPAEERERLYAGWRRAVERARGWAAE

SEQ ID NO: 69562 - DNA, 1491 bp, Bacillus cereus ZK
  CDS (1)..(1491): transl_table=11
atgaaaaaatatattctttcattagaccaaggaacaactagctcacgcgcaattcttttcaataaaaaaggtgaaattgttcattcagctcaaaaagaatttacacaacattttccaaagccaggctgggtagagcataacgcgcaagaaatttggggatctattttagcagttatcgcaacttgcttaagcgaagcagatgtaaaaccagaacaaatcgctggtatcggtattacgaaccaacgtgaaacagcggttgtatgggataaaacgactggtaaaccaatttataatgctatcgtatggcaatctcgccaaacagctgaaatttgtgatgagttaaaagaaaaaggttatggcgaaatggttcgcgaaaaaacgggtcttttaattgacgcatacttctctggtacgaaagtaaaatggattttagataacgttgaaggtgcaagagagaaagcagaaaacggcgatctattattcggaacaattgatacgtggcttgtatggaaactatctggtggtaaagcgcatgtaacggattactcaaatgcatcacgtacattaatgtttaacattcacgacttacagtgggatgatgaacttctagacatgttaacagtaccaaagagcatgcttccagaagtacgtccatcatctgaagtgtatggagaaacaattgactatcacttcttcgggcaaaatgtaccgattgcaggtgtagctggtgaccaacaagcagcattatttggacaagcttgtttcggtgaaggtatggcgaaaaatacttacggaactggttgcttcatgttaatgaacactggtgaaaaagcagtagcttctgagcacggtctattaacaacaattgcatggggaatagatggtaaagtaaactacgcattagaaggaagtattttcgtagcaggttctgcaattcaatggttacgtgacggaatgcgcatgtttaaagatgcaagtgagagtgaagtgtatgcttctcgcgttgaatcaactgacggtgtatacgttgtaccagcattcgtaggattaggtacaccttactgggatagtgaagtacgcggcgctatgtttggtgtaacgcgcggtacgacgaaagaacacttcattcgtgcaacactagaatctttagcttaccaaacaaaagacgtattatgcgcaatggaagcagattcaggtattgaactaaaaacattacgagttgatggcggagcagttaaaaataacttcttaatgaagttccaaagtgatattttagacgttcctgtagagcgtccagtgatcaatgaaacaacagctttaggtgcagcgtatttagctggtcttgcggttggatattggaaaaaccaagatgaaattaaagaacagtggcatatggacaaacgctttgaaccaacgatggaagcggaaacaagcgaagagctatatgctggatggaaaaaagcaattgaagcaacaaaagctttcaaataa

SEQ ID NO: 69563 - protein, 496 aa, Bacillus cereus ZK
MKKYILSLDQGTTSSRAILFNKKGEIVHSAQKEFTQHFPKPGWVEHNAQEIWGSILAVIATCLSEADVKPEQIAGIGITNQRETAVVWDKTTGKPIYNAIVWQSRQTAEICDELKEKGYGEMVREKTGLLIDAYFSGTKVKWILDNVEGAREKAENGDLLFGTIDTWLVWKLSGGKAHVTDYSNASRTLMFNIHDLQWDDELLDMLTVPKSMLPEVRPSSEVYGETIDYHFFGQNVPIAGVAGDQQAALFGQACFGEGMAKNTYGTGCFMLMNTGEKAVASEHGLLTTIAWGIDGKVNYALEGSIFVAGSAIQWLRDGMRMFKDASESEVYASRVESTDGVYVVPAFVGLGTPYWDSEVRGAMFGVTRGTTKEHFIRATLESLAYQTKDVLCAMEADSGIELKTLRVDGGAVKNNFLMKFQSDILDVPVERPVINETTALGAAYLAGLAVGYWKNQDEIKEQWHMDKRFEPTMEAETSEELYAGWKKAIEATKAFK

SEQ ID NO: 69564 - DNA, 1554 bp, Mannheimia succiniciproducens MBEL55E
  CDS (1)..(1554): transl_table=11
ttgaacacatattttataaattactcaagtaggagattaactatgtctgagaaaaaatacatcattgcgttagaccaaggtacaacaagttctcgtgccgtgttattagatcatgatgcgaatattgtggaaatcgctcaacgtgaatttactcagatttatcctaaagccggttgggtagaacataacccgatggaaatctgggcgacacaaagttctactttaaacgaagtggtggcaaaagccggtatcacttccgatgaaattgccgctatcggtatcaccaaccagcgtgaaaccacaatcgtatgggaaaaagaaaccggcaatccggtttataacgcaattgtatggcaatgccgtcgtacttccgatattaccgataaattaaaggcggacggttacgaagactatatccgtcaaaccacaggtttagtggtggatccttatttctcaggcactaaagtaaaatggattttggataatgtagaaggggcgcgtgcaaaagcggaacgcggcgaattgttattcggtacggtagatacttggctggtgtggaaattaacccaaggtcgcgtacatgtgacagactataccaatgcttcccgtactatgctattcaatatccataccaaacaatgggatgacaaaatgctggaaattttggatattccgcgttcaatgttacctgaagtgaaaaactcttccgaagtttacggtcaaaccaatatcggcggtaaaggcggtgtgcgtattccggttgcaggtattgccggtgaccaacaagcggcgctttacggtcatttatgtgtgactgcgggtcaagccaaaaacacttatggtacgggctgctttatgttgcttcataccggtgataaagccattacttctaaaaacggtttgttaacaaccatcgcctgtaatgcaaaaggcgaaccggaatatgcgcttgaaggttccgtatttattgccggcgcatccatccaatggttgcgtgacgaacttaaaatcgtacatgatagctacgacagcgaatacttcgccaccaaagtgccgagcaccaacggcgtttatgttgtgccggcgtttaccggcttaggcgcgccgtattgggatccgtatgcacgcggtgcgattttaggtttatcccgtggtgcaaaccgtaaccatattgtgcgcgcaacccttgaatctatcgcttatcaaacccgcgacgtgctggaagcgatgcagtccgactccggtgaaaaattaaaatatctccgcgtggacggcggcgccaccgcaaacaacttcttaatgcaattccaggcggatattcttgacgtaaacgttgaacgtccggtagtgaaagaagtaactgcgttaggtgcggcatatcttgccggccttgccgtcggattctggaaagatctaagcgaattgcaagacaaagcccgggtagaacgcacatttacgccggataacgataacgaaaaacgcgaacgtcgttataaaggctggaaaaaagcggttcgccgtgcattagaatgggcgaaagaagacgtggaataa

SEQ ID NO: 69565 - protein, 517 aa, Mannheimia succiniciproducens MBEL55E
MNTYFINYSSRRLTMSEKKYIIALDQGTTSSRAVLLDHDANIVEIAQREFTQIYPKAGWVEHNPMEIWATQSSTLNEVVAKAGITSDEIAAIGITNQRETTIVWEKETGNPVYNAIVWQCRRTSDITDKLKADGYEDYIRQTTGLVVDPYFSGTKVKWILDNVEGARAKAERGELLFGTVDTWLVWKLTQGRVHVTDYTNASRTMLFNIHTKQWDDKMLEILDIPRSMLPEVKNSSEVYGQTNIGGKGGVRIPVAGIAGDQQAALYGHLCVTAGQAKNTYGTGCFMLLHTGDKAITSKNGLLTTIACNAKGEPEYALEGSVFIAGASIQWLRDELKIVHDSYDSEYFATKVPSTNGVYVVPAFTGLGAPYWDPYARGAILGLSRGANRNHIVRATLESIAYQTRDVLEAMQSDSGEKLKYLRVDGGATANNFLMQFQADILDVNVERPVVKEVTALGAAYLAGLAVGFWKDLSELQDKARVERTFTPDNDNEKRERRYKGWKKAVRRALEWAKEDVE

SEQ ID NO: 69566 - DNA, 1503 bp, Burkholderia pseudomallei K96243
  CDS (1)..(1503): transl_table=11
atgcaggatcagtacatcctcgcgctcgaccagggcacgaccagctcccgcgccatgctgttcgatcgacaaggcaacatcgtatcgatcgcgcagaaggaattcgaacaaatttatccgcagccgggctgggtcgagcacgatccccaggagatctggtcgacgcaggcgggcgtcgcggccgaggccgtcacgcgcgtcggcctgaacggcacggcgatcgccgcgatcggcatcacgaaccagcgcgagacgacgatcgtctgggatcgcgagacgggtcatccgatctacaacgcgatcgtctggcaggatcgccgcaccgccgatttctgcgacaagctcaaggcgcagggcctcagcgagaaggtgcgcgcgaagacgggcctgccgatcgactcgtacttctcggccaccaagatccgctggattctcgacaacgtcgagggcgcgcgcgagaaggcgcgccagggcaagctcgcgttcggcacggtcgacagctggctcgtgtggaacttcacgaagcacgagctgcacgtgaccgacgtgacgaacgcgtcgcgcacgatgctcttcaacatccacacgctcgactgggacgacgagttgctcgacgcactcgagattccgcgcagcatgctgccgcaagtgcgcgcgtcctccgagatctacgggccgacgaagaccaccgtgttcgcctcgaagattccgctcgccggcatcgcgggcgatcagcaggccgcgctcttcggccagatgtgcacgagctcgggcatggtgaagaacacctacggcaccggctgcttcctgatgatgaacaccggcgagacgccgatcgaatcgcggaacaacctcgtcacgacgatcgcctggcaagtcgacggcaaggtcagctacgcgctcgaaggcagcatcttcatcgcgggcgcggtcgtgcagtggctgcgcgacgggctcggcatcatcaagagcgcgtcggagatcgaggcgctcgccgccggcgtgccgcacacggacggcgtctatctcgtgcccgcgttcgccggcctcggcgcgccgcactggaacgcgcgcgcccgcggctcgctgttcggcgtcacgcgcggcacgacgtccgcgcacctcgcgcgcgcggcgctcgattcgatcgcgtatcaatcgctcgacgtgctcaaggccatggaggccgattcgggcatccgcatcggcgagctgcgcgtggacggcggcgcgagcgcgaacaacctgctgatgcagttccaggcggatctgctcggcgtcgacgcggtgcgcccgcgcatcaccgagacgaccgcgctcggcgccgcgtatctcgcgggcctcgcgatcggctactggcagaacgtcgacgagctgcacagccaatggcagctcgagcgccgcttcgcgccttcgatgcaggccgagcaggtgggctcttgcctcgccggctggcagcgcgcggtgcgcgcggcgaaggcatgggcggacgacacgcagtaa

SEQ ID NO: 69567 - protein, 500 aa, Burkholderia pseudomallei K96243
MQDQYILALDQGTTSSRAMLFDRQGNIVSIAQKEFEQIYPQPGWVEHDPQEIWSTQAGVAAEAVTRVGLNGTAIAAIGITNQRETTIVWDRETGHPIYNAIVWQDRRTADFCDKLKAQGLSEKVRAKTGLPIDSYFSATKIRWILDNVEGAREKARQGKLAFGTVDSWLVWNFTKHELHVTDVTNASRTMLFNIHTLDWDDELLDALEIPRSMLPQVRASSEIYGPTKTTVFASKIPLAGIAGDQQAALFGQMCTSSGMVKNTYGTGCFLMMNTGETPIESRNNLVTTIAWQVDGKVSYALEGSIFIAGAVVQWLRDGLGIIKSASEIEALAAGVPHTDGVYLVPAFAGLGAPHWNARARGSLFGVTRGTTSAHLARAALDSIAYQSLDVLKAMEADSGIRIGELRVDGGASANNLLMQFQADLLGVDAVRPRITETTALGAAYLAGLAIGYWQNVDELHSQWQLERRFAPSMQAEQVGSCLAGWQRAVRAAKAWADDTQ

SEQ ID NO: 69568 - DNA, 1533 bp, Mycoplasma hyopneumoniae 232
  CDS (1)..(1533): transl_table=4
atgctagaaaatacagctaaaaaatttattatcaccctcgattcagggacaacttcatgtcgaagtttgatttttgatcaaaaaggtagggttatttcacttgtccaaaaagaatttagtcaacattttcccagatcaggatgagtcgaacatgacccgattgaaatatggaatacccaggtctatacaatgcaggcagcaaaaacaaaagcggggttaaaatcgactgattttgtcgcccttggactaacaaatcaacgggaaactgtcgttttatgagataaaacaaatggcgagccagtctataatgcaattgtctggcaggatcgccgcacgagtgatttttgtgattatttaattgaaaaaggttatcaaaattatataaaagaagtaacaggtctaattattaatccttattttagcgggacaaaaattcgctgaattttaaaaaatgttaaaaaagcaaaggaagttttagctgctggtaatcttttagcaggaacaattgatagctgacttctttgaaaattaactaacggaaaagtacatgcaactgatataacaaacgcttcaagaacgatgttatttgatataaaaaaacgaaaatgagaccaaaaaattcttgatcttttagaaattccttacagtattctcccaaaagttttagcatcagcagatgattatggatttgtttctccttttcattgatcaattaatgcaaaaacaaaagtaccaatttatgcactaattggcgatcaacaatcggccttatttggtcaacttgcaactgaatttggaatggttaaaaatacctatggaaccggatgttttatgctagttaatactggtgaaaaactaataaaatcaaagaataatttacttacaacagtggcctgacaaatcggaaataatccaatccagtacgcacttgaaggatcagtttttattgccggagccgcaatccagtggctcagagatggactttctttgattgaaaactcttcagattgcgattctttagtctcaaaagctaaaaaaaatgattatcatattattcttgttccatcttttaccggacttggggcaccttattgggactcctattcgcgtggggcaatttttggacttgaaaggggaacaaaaaaagaacatcttatcaaagcaagtcttgaatcaattgcatttcaggcaaatgatctaattaaggcgatcgaatcagatctaggaacaaaaatcagcttgatgaaagttgatggtggagtttctaaaagtgattatctaatgcaatttcagtcatcaatttcgcaggttgaaatccaaaggccaaaaaatattgaaacaacagcaatgggagcagcttttcttgcgggtttatatgccaaattttggaattcactagctgaattaaagcaaattttagttcctgaaaaagtttttgtccctgaatttgaccaatttatggtaaaaaaattaacctccaattgggacttagctgttagaaaaacgctaaattggaaaaaagatattaaataa

SEQ ID NO: 69569 - protein, 510 aa, Mycoplasma hyopneumoniae 232
MLENTAKKFIITLDSGTTSCRSLIFDQKGRVISLVQKEFSQHFPRSGWVEHDPIEIWNTQVYTMQAAKTKAGLKSTDFVALGLTNQRETVVLWDKTNGEPVYNAIVWQDRRTSDFCDYLIEKGYQNYIKEVTGLIINPYFSGTKIRWILKNVKKAKEVLAAGNLLAGTIDSWLLWKLTNGKVHATDITNASRTMLFDIKKRKWDQKILDLLEIPYSILPKVLASADDYGFVSPFHWSINAKTKVPIYALIGDQQSALFGQLATEFGMVKNTYGTGCFMLVNTGEKLIKSKNNLLTTVAWQIGNNPIQYALEGSVFIAGAAIQWLRDGLSLIENSSDCDSLVSKAKKNDYHIILVPSFTGLGAPYWDSYSRGAIFGLERGTKKEHLIKASLESIAFQANDLIKAIESDLGTKISLMKVDGGVSKSDYLMQFQSSISQVEIQRPKNIETTAMGAAFLAGLYAKFWNSLAELKQILVPEKVFVPEFDQFMVKKLTSNWDLAVRKTLNWKKDIK

SEQ ID NO: 69570 - DNA, 1500 bp, Nocardia farcinica IFM 10152
  CDS (1)..(1500): transl_table=11
atgcgtcgctatgtggccgccctcgatcaaggcacgacctcgaccaggtgcatcgtcttcgaccacggcggtcgcgtgctcggcctggcccagcgcgagcacgagcagatcttcccgcgcccgggctgggtggagcacgacgcggaaaccatctggcgcaacaccgaactcgtcctcgccgaggcgatgcggaccctcgagctgagcgccgccgacatcgccgccgtcggcatcaccaatcagcgcgagaccacgctggtctgggagcgcgccaccggcaagcccatccaccacgccatcgtctggcaggacacccgcaccgaccgcctcgtcggcgaactcggcggcgcgcaggggccgacccgctaccaggaccggaccggcctgccgctgtccacctacttcgccggacccaagctgcgctggatcctcgaccacgtcccggatgcgcgggagcgcgcggaggccggggaattgtgcttcggcacgatggacagctggctgctgtggaacctcaccggcgcacacatcaccgacgtcaccaacgcctcgcgcaccatgctcatggatctgcgcacccagcggtgggacgaggacatctgcgccgacttcggggtgcccccggccatgctgccggagatccgcagctcctcggaggtctacggcgagatcaccgcgggcccgctggccggtgtcgcggtggcgggcatcctcggtgaccagcaggccgccaccttcggccaggcctgcctgtcgcccggtgaggccaagaacacctacggcaccggcaatttcatgctcctcaacaccgggaccacgccggtcttcagcaaacacggcctgctcaccacggtgtgctaccggctcgacgaccagcccgccgtctacgccctggagggctcgatcgccgtcaccgggtcgctggtgcagtggctgcgtgacaacctcggcctgatctcctccgccgacgagatcgaaccgctcgcgcgcagtgtcgacgacaacggcggcgcctacatcgtgcccgccttctccggcctgttcgccccgcgctggcgtccggacgcgcgcggggtgatcgcgggcctcacccggttcgtcaccaaggcgcacctggcccgcgcggtgctcgaatccaccgccttccagacccgcgaggtggtcgacgccatgcgcgccgacgccgaatcccagcagctcgacctggaattgacgacgttgaaggtggacggcggcatgacggccaacgatctgctcatgcagttccagtccgacatcctcgacgtgccggtggtgcgcccggtggtcgccgaaaccaccgcgctcggcgccgcctacgccgccggcctcgccgtcggctactggtcgggcaccgacgacatccgcgccaactgggccgccgacaccacctggcgcccgacgatgagcgaccaggaccgcgccacccacctggccgcctggaacaaggcggtggaacgcacctacaactggaccgcctga

SEQ ID NO: 69571 - protein, 499 aa, Nocardia farcinica IFM 10152
MRRYVAALDQGTTSTRCIVFDHGGRVLGLAQREHEQIFPRPGWVEHDAETIWRNTELVLAEAMRTLELSAADIAAVGITNQRETTLVWERATGKPIHHAIVWQDTRTDRLVGELGGAQGPTRYQDRTGLPLSTYFAGPKLRWILDHVPDARERAEAGELCFGTMDSWLLWNLTGAHITDVTNASRTMLMDLRTQRWDEDICADFGVPPAMLPEIRSSSEVYGEITAGPLAGVAVAGILGDQQAATFGQACLSPGEAKNTYGTGNFMLLNTGTTPVFSKHGLLTTVCYRLDDQPAVYALEGSIAVTGSLVQWLRDNLGLISSADEIEPLARSVDDNGGAYIVPAFSGLFAPRWRPDARGVIAGLTRFVTKAHLARAVLESTAFQTREVVDAMRADAESQQLDLELTTLKVDGGMTANDLLMQFQSDILDVPVVRPVVAETTALGAAYAAGLAVGYWSGTDDIRANWAADTTWRPTMSDQDRATHLAAWNKAVERTYNWTA

SEQ ID NO: 69572 - DNA, 1476 bp, Legionella pneumophila str. Paris
  CDS (1)..(1476): transl_table=11
atgaactatatactagctattgaccagggaacaagtagcactcgcgctatgatctacacccttcaaggtgatttaatcgcaaatagtcagtatcctcttactcaatattaccccaatttgggttgggtagaacacgatcctgaggaaatatggcaaaaaactctgaatgcgatgagggatgtcgtatctcaagttcaaggaaaagcaattttatgctgtggccttaccaaccaacgggaaaccactctgatttggaacaaaaaaacaggggaatgcctcgcgccagctattgtgtggcaagatagacgtacggaagagttttgttattccttgtctgaatactcatcaatgatacaagagaaaaccggattacttcctgatccctatttttcagcgagcaaattaaactggttactaaagaataatgctcaagctcaatcactaattaaccagggggatttggcatttgggacaatagacagttttttaatatggcgcatgactaaaggtgccagtcatgctaccgatatcaccaacgcatccagaactatgctgtttaatattcatgatgaaaaatgggataagcagttactcgagcttttttctatttcagaatcgatattaccagaggtttactccagtgataatcattttggggtgatagataaagaatggctgggagtagaaataccaattaccggggttgcaggcgatcaacaagccgctttaattgggcaaggttgttttaatggcggaatggttaaagctacttttggtacggggggatttttattgctcaatacaggtgataaaccggttttctcaaagcataaattgttgactactattgcctataaaattaaagaaaaaacagcttatggtttggagggtagtatttatcatgccggaacaactgttaaatggttacgcgatgaaatgaagttgatatctcattctgctgaaactgaagtattggcacaaagtcttgatagcaataacggtgtatatcttgtttcatcttttactggtcttggagcacctcattggttatcaataacaggaacggctattattggtgtatcccgttcaacgaatagagcgcattttgccagagccgccctggaaggagtttgttatcaaacacgtgatgtattaacctgtatgagagatgatagtcaattggatttgactttattaagagcggatggagggatggcagtaaaccaatggtttctacaatttatggctgatcagtgtcagttgacaattcaaaaacccaaggacattgaaacgactgccaaaggggcagcagtattagccgcaataggttctggtctatttgattcagtttcttcagtaaataaggtatgggacgttgagaacgagtttcagccatccagggaaagagaggtagttgaaaaagattttcgtggctggttagaggcgttggcaatggttaaagcaaggcatgcatag

SEQ ID NO: 69573 - protein, 491 aa, Legionella pneumophila str. Paris
MNYILAIDQGTSSTRAMIYTLQGDLIANSQYPLTQYYPNLGWVEHDPEEIWQKTLNAMRDVVSQVQGKAILCCGLTNQRETTLIWNKKTGECLAPAIVWQDRRTEEFCYSLSEYSSMIQEKTGLLPDPYFSASKLNWLLKNNAQAQSLINQGDLAFGTIDSFLIWRMTKGASHATDITNASRTMLFNIHDEKWDKQLLELFSISESILPEVYSSDNHFGVIDKEWLGVEIPITGVAGDQQAALIGQGCFNGGMVKATFGTGGFLLLNTGDKPVFSKHKLLTTIAYKIKEKTAYGLEGSIYHAGTTVKWLRDEMKLISHSAETEVLAQSLDSNNGVYLVSSFTGLGAPHWLSITGTAIIGVSRSTNRAHFARAALEGVCYQTRDVLTCMRDDSQLDLTLLRADGGMAVNQWFLQFMADQCQLTIQKPKDIETTAKGAAVLAAIGSGLFDSVSSVNKVWDVENEFQPSREREVVEKDFRGWLEALAMVKARHA

SEQ ID NO: 69574 - DNA, 1527 bp, Photobacterium profundum SS9
  CDS (1)..(1527): transl_table=11
atgactactgagcaaaaatatattgttgcacttgatcaaggtacaaccagttctcgtgccgtcatactggatcacgatgcgaatatcatttgttcgtcacaacgcgagtttactcaaatttacccgaaagcgggctgggtagagcatgatccactagagatttacgcaactcaaagttcaaccctagtagaagtattggctaaagcaggcatccgctctgatgaaattgcgggcattggtattaccaaccaacgtgaaaccaccattgtttgggataagaacaccggtaagcccgtttataatgcgattgtttggcagtgtcgtcgtaccgctagcatttgtgaagaattaaaagcgcaaggcttagaagaatacatccgcgaaaataccggccttgtggttgacccatatttctctggtaccaaggttaagtggattctcgacaatgttgaaggtgctcgtgaagaagctgaagctggcaacctattattcggtactgttgatacgtggctaatctggaagatgactcagggacgtacattcgttactgattacactaacgcatcacgtaccatgctgtttaatatcaacacacttcagtgggacgagaagttacttaaagcactggatattccactatctatgatgccagaagtaaaagcttcatcagaagtttacggcaaaaccaacattggtggtaaaggcggcacacgtatccctatttgtggtattgctggtgatcagcaggctgcacttttcggtcagatgtgtgtggaagctggtcaagcgaagaacacctatggtacaggctgtttcttactgatgaacacaggtaaagaaaaagtcacttctcaaaatggccttttaacaacacttgcttgtggtcctaaaggcgaagttgcttatgcactggaaggtgcagtatttatggggggggcatccattcagtggcttcgtgatgaagtgaaattactgggtgatgcaaaagattcagaatactttgcagagaaagtgggcagctcaaatggcgtctacgttgtaccagcatttactggtcttggtgccccatattgggacccgtatgcgcgtggtgcaatcgttggtttaacacgtggtgttaattctaaccacatcatccgtgcgacacttgaaagtgtggcttaccaaacccgtgatgttcttgatgcaatgcaagcggattctggtatcaagcttgcgacattgcgtgttgatggcggtgccgtagccaataacttcttaatgcaattccaatcagatgtattggatacgcaagtattccgccctgtcgtaacagaagtaacagcattgggtgctgcttaccttgccggtttagctatcggattctgggatagcattgatgaacttcaagataaagcgaagcttgatcgtcaattcatcccttgcgcgaatgataagaagcgtgaccgtcgctaccgcggctggcagcgtgcagtagaatgcgcgaaaggttgggctatcgatgaagaagacgaagacgacgaataa

SEQ ID NO: 69575 - protein, 508 aa, Photobacterium profundum SS9
MTTEQKYIVALDQGTTSSRAVILDHDANIICSSQREFTQIYPKAGWVEHDPLEIYATQSSTLVEVLAKAGIRSDEIAGIGITNQRETTIVWDKNTGKPVYNAIVWQCRRTASICEELKAQGLEEYIRENTGLVVDPYFSGTKVKWILDNVEGAREEAEAGNLLFGTVDTWLIWKMTQGRTFVTDYTNASRTMLFNINTLQWDEKLLKALDIPLSMMPEVKASSEVYGKTNIGGKGGTRIPICGIAGDQQAALFGQMCVEAGQAKNTYGTGCFLLMNTGKEKVTSQNGLLTTLACGPKGEVAYALEGAVFMGGASIQWLRDEVKLLGDAKDSEYFAEKVGSSNGVYVVPAFTGLGAPYWDPYARGAIVGLTRGVNSNHIIRATLESVAYQTRDVLDAMQADSGIKLATLRVDGGAVANNFLMQFQSDVLDTQVFRPVVTEVTALGAAYLAGLAIGFWDSIDELQDKAKLDRQFIPCANDKKRDRRYRGWQRAVECAKGWAIDEEDEDDE

SEQ ID NO: 69576 - DNA, 1533 bp, Haloarcula marismortui ATCC 43049
  CDS (1)..(1533): transl_table=11
atggcagacacatacgttggcgcgatcgatcagggaacgaccggtacccgcttcatggtgttcgaccacagcggccaggtcgttgcgaatgcctacgagaagcacgaacagatttacccggagcccggctgggttgagcacgaccccgtcgaaatctgggaaaacacgcaggaagtcgtgacgaaggggctggcggatgcaggtgtcggtgccgaacagctcgaagcgcttggcatcacgaaccagcgtgagacgacgatcgtctgggacaaggagaccggcaaaccggtccacaacgcgctggtctggcaggaccgccgaaccaccgaccgcgtcgaggaaattcaggaagaggacaaagtcgaatggatccgggggaagaccgggctggaatgtgacgcctacttctcggcgaccaagaccgaatggatcctcgacaacgcggaaccactcaagatgcagagctcgcgcggcgctgacctccgtgagcgagccgaagacggtgaactcctgatggggaccatcgacgcgtggctcatctacaagctcaccggcaaccacatcacggatgtctcgaacgcatcgcggacgatgctgtacaacatccacgacatggagtgggacgatgaactcctcgaagagttcggcgttccggagtccatggttccggaagtccgcccgtcctccgacgagagtctgtacgggcacaccgacgcggacggcttcctcaaagaggaagtccccgttgcgggcgcgctgggcgaccagcaggccgcgctgttcggccagacctgcttcgacaagggtgatgcgaagaacacctacggcaccggcgcgttctacctgatgaacactggctccgaagcagtcgcctcggataacggcctgctgacgaccgtcggcttccagatgtccggtgagcccgtccagtacgcgctggaaggctccatcttcatcgccggcgcggccatcgaatggctcgaggacgtcgacctcatcaacaacgccgcccagacagcagaactggcccgctcggttgaatcaaccgacggtgtctacatggtgccggccttcacgggtctcggcgctccgcactgggacggccgcgcccgcgggacgattgtcggaatgacccgcggaacgcgaaaagagcacatcgtgcgtgcgaccctggaatccatcgcgtaccagacccgcgacctcgcggaagcgatggaggaagactccggtgtcgagatgacgacgctgcgagtcgacggtggtgcagtcaagaacaacttcctctgtcagctccagtccgacatcatccagacggacatcgctcgaccacaggttgacgagaccactgccctcgggtcggcatacgcagccggcctcgccgtcgggtactgggacaccgtcgacgaacttcgggacaactggcaggtcgacgaggagttctcgccggagatggacgctggaaaggcagacaagatgtacgcccgctgggacgacgccgtcgaccgttcccgtgactgggcacaggaggaataa

SEQ ID NO: 69577 - protein, 510 aa, Haloarcula marismortui ATCC 43049
MADTYVGAIDQGTTGTRFMVFDHSGQVVANAYEKHEQIYPEPGWVEHDPVEIWENTQEVVTKGLADAGVGAEQLEALGITNQRETTIVWDKETGKPVHNALVWQDRRTTDRVEEIQEEDKVEWIRGKTGLECDAYFSATKTEWILDNAEPLKMQSSRGADLRERAEDGELLMGTIDAWLIYKLTGNHITDVSNASRTMLYNIHDMEWDDELLEEFGVPESMVPEVRPSSDESLYGHTDADGFLKEEVPVAGALGDQQAALFGQTCFDKGDAKNTYGTGAFYLMNTGSEAVASDNGLLTTVGFQMSGEPVQYALEGSIFIAGAAIEWLEDVDLINNAAQTAELARSVESTDGVYMVPAFTGLGAPHWDGRARGTIVGMTRGTRKEHIVRATLESIAYQTRDLAEAMEEDSGVEMTTLRVDGGAVKNNFLCQLQSDIIQTDIARPQVDETTALGSAYAAGLAVGYWDTVDELRDNWQVDEEFSPEMDAGKADKMYARWDDAVDRSRDWAQEE

SEQ ID NO: 69578 - DNA, 1488 bp, Thermus thermophilus HB8
  CDS (1)..(1488): transl_table=11
gtggcgtttctcttggctttggaccagggcaccaccagcagccgggccatcctcttcaccctggaggggaggcccgtggcggtggccaagcgggagttccggcagctttacccgaaacccgggtgggtggagcacgaccccctggagatctgggagaccaccctttgggcggcgcgggaggttctcaggagggccggggcggaggcaggggaggtcctggccctggggatcacgaaccagcgggagaccaccctcctctgggaccggaagacggggaagcccctccacaacgccatcgtctggcaggaccggaggacgacccccctgtgcgaggccttgagggcaaagggcctcgagcccttgttccgggagaggaccgggctcctctttgacccctacttctcggggacgaagctcgtgtggcttctggagaacgtgcccggcctaaaggcgcgagcggaggggggcggggtggccttcggcaccgtggacacctggctcatctggaacctcacgggggggaaggtccacgccaccgaccccacgaacgcgagccgcaccctgctcttcaacctccacaccctcgcctgggacccggagcttcttgaggccctagggatccccgccgccctcctcccggaggtgcggccctcggacggggacttcggggaaaccctccccgagcttttgggggcgcccgtccccatacggggggtcttgggggaccagcaggcggccctcttcggccaggcggccctaggagggggggaggggaagtgcacctacggcaccggggccttcctcctcctgaacacggggaaaaggcccgtcctctcggaaaagggcctcctcgccacggtggcctggagccttggggggagggccacctacgccctcgaggggagcctcttcgtggcgggggccgcggtggggtggctcaaggaggtgggcctcatccgggaaagcgccgaggtggaggccctggcggcaagcgtggaggacacgggggacgtctacttcgtccccgccttcaccgggcttggcgccccctactgggacccctacgcccggggaaccctcctcggcctcacccgggggacgagccgggcccacctggcccgggcggccctggagggggtggccttccaggtgcgggacgtggtcctggccatggaggaggaggccggggtccggctcaaggtcctcaaggcggacgggggcatggcgcaaaaccgcctcttcctcaagatccaggcggacctcctcggggtgcccgtggcggtgccggaggtgacggagaccaccgccttgggggcggccctcatggccggggtgggggcgggggccctttccccggaggacgtggcggggcgcttccgcgaggcggagaggttcctccccacgatgcccgaagggaggcgggaggccctctaccggaggtggcgggaggcggtggaaagggccaagggctgggccagggaggggtag

SEQ ID NO: 69579 - protein, 495 aa, Thermus thermophilus HB8
MAFLLALDQGTTSSRAILFTLEGRPVAVAKREFRQLYPKPGWVEHDPLEIWETTLWAAREVLRRAGAEAGEVLALGITNQRETTLLWDRKTGKPLHNAIVWQDRRTTPLCEALRAKGLEPLFRERTGLLFDPYFSGTKLVWLLENVPGLKARAEGGGVAFGTVDTWLIWNLTGGKVHATDPTNASRTLLFNLHTLAWDPELLEALGIPAALLPEVRPSDGDFGETLPELLGAPVPIRGVLGDQQAALFGQAALGGGEGKCTYGTGAFLLLNTGKRPVLSEKGLLATVAWSLGGRATYALEGSLFVAGAAVGWLKEVGLIRESAEVEALAASVEDTGDVYFVPAFTGLGAPYWDPYARGTLLGLTRGTSRAHLARAALEGVAFQVRDVVLAMEEEAGVRLKVLKADGGMAQNRLFLKIQADLLGVPVAVPEVTETTALGAALMAGVGAGALSPEDVAGRFREAERFLPTMPEGRREALYRRWREAVERAKGWAREG

SEQ ID NO: 69580 - DNA, 1491 bp, Azoarcus sp. EbN1
  CDS (1)..(1491): transl_table=11
atgagttatctgctggccctggatcaggggacgacgagttcgcgggcgctcgtgctggaccgcgacgggcaggtgaagggagctgcccagcagacgttcgcgcagcactacccgcagcccggctgggtcgagcacgatccggcggagattctcgcgacccagttcgattgcgcgcgcaccgcccttgagcgggccggcgtcgccgcttccgcgctggctgcagtcggcatcacgaatcagcgcgaaaccacgctgttgtgggaacgttcgaccggccgggcgcttgcgccagcgatcgtctggcaggatcggcgcaccgcggcggcatgcgaccggctgcgcgaggctggtcacgccgacacgatccgtgcgagcaccggcctcgaggtcgacgcctatttctcggcgacgaagctcgcctggctgctcgaccatgtccccggcgcgcgtgcccgggcgcgggcgggcgaactggcgttcggcaccgtcgacagctggctggtctggcatctcagcggcggggcgctgcacgtgaccgacgccggtaatgcgtcgcgaacgatgctgttcaacattcaccgctgcgagtgggacgaaacgctgctcgcgctgctcgacattccgcccgcgctgttgccgcgcgtcgtcgacagcagcggagtgtgcggcaccacctgcgccgaggtgctcggcgcggcggtaccgatcgccggcatcggcggagaccagcaggcagcgacgttcggccaggcatgctttgctcccggaatggcgaaaaacacttacggcaccggttgcttcctgctgatgaacaccggcgcggcgccggtgacctcgacgaaccgcctgctgacgacgatcgggtggcgctcgcggggcgagacctgctacgcgctcgaaggcagcattttcatcggtggcgcgctggtgcagtggctgcgcgacgggctggggctgatcaggcgtgccgaggacgtcgaggcgctcgctgcgagcgtcccggacagcgagggcgtcgtgctggtgccggcgtttaccgggctcggcgcaccgtactgggacgcgtacgcgcgcggcacgttgttcgggctgacccgcggcacgggtgctgcgcacatcgcccgtgcggccctcgaggcgatcgcgctgcagacggtggatctcgtcgccgcgatggaccgtgacggcgccgggccgctggccgaactgcgagtcgatggcggggcggcggcaaacgacctgctgatgcagatccaggcggatctgctcggggttccggtggtccgtccgaagatgctcgagaccactgcgctcggagcggcgtatctcgcggggctcggagtggggatgtggtccggcatcgaggagcttgcgtcgcactggcgcgccgaacgccgcttcgagccggtgatggctgaggatcggcgcgaggcggcaatcgcgcgctggcggcgggcggtcgaacgggcccggggctgggtcgcggcatga

SEQ ID NO: 69581 - protein, 496 aa, Azoarcus sp. EbN1
MSYLLALDQGTTSSRALVLDRDGQVKGAAQQTFAQHYPQPGWVEHDPAEILATQFDCARTALERAGVAASALAAVGITNQRETTLLWERSTGRALAPAIVWQDRRTAAACDRLREAGHADTIRASTGLEVDAYFSATKLAWLLDHVPGARARARAGELAFGTVDSWLVWHLSGGALHVTDAGNASRTMLFNIHRCEWDETLLALLDIPPALLPRVVDSSGVCGTTCAEVLGAAVPIAGIGGDQQAATFGQACFAPGMAKNTYGTGCFLLMNTGAAPVTSTNRLLTTIGWRSRGETCYALEGSIFIGGALVQWLRDGLGLIRRAEDVEALAASVPDSEGVVLVPAFTGLGAPYWDAYARGTLFGLTRGTGAAHIARAALEAIALQTVDLVAAMDRDGAGPLAELRVDGGAAANDLLMQIQADLLGVPVVRPKMLETTALGAAYLAGLGVGMWSGIEELASHWRAERRFEPVMAEDRREAAIARWRRAVERARGWVAA

SEQ ID NO: 69582 - DNA, 1479 bp, Silicibacter pomeroyi DSS-3
  CDS (1)..(1479): transl_table=11
atgacctttattctggcgatcgaccagggcaccacttcgagccgggcgatcctgttcgatggcgagatgcggcgggtggcgaccgcgcagcgtgaattcacccagcatttccccgaagcgggctgggtggaacacgacgccgaagagatctggcaaacgacggtcgaggtctgccgcgaggtgatcgccgggcaggggatcgggcccgaacagatcgccgggatcggcatcaccaaccagcgggaaaccaccgtggtctgggacaaggccggcggtgcgcccgtgcatcgcgccatcgtctggcaggaccggcgcaccgctgcgatttgtgagcggctgcgccatgcggggtgcgaggatgactttaccgcccagaccggtctgctgctggacccgtatttctcgggcaccaaggtgaaatggatcctcgacaccgtgccgggcgcgcgggatcgcgcggcggcgggcgagctgctgttcggcaccatcgattcgtttttgatctggcggctgaccggtggccgggttcatgcgagtgatgcgaccaacgccgcgcgcacgctgatgttcgatatccatcagggggaatggagcaaggacatctgcgagcttcttgacgtgccgatgtcgatgctgcccgaggtgcgcgactgcgctgccgatttcggcacgacggatctgtttggcgggcaggtgccgatcctgggcgttgccggcgaccagcaggcggccaccatcgggcaggcctgtttccagcccggcatgatgaaatccacctatggcaccggttgttttgcgctgctcaataccgggacacagccggtcgcctcgcagaaccggctgctgacgaccatcgcctatcagctggacggccagcggacctatgcgctggaaggctcgatcttcattgccggggcggcggtgcagtggctgcgcgacgggctgggtatcatcgagaacgcggcgcaaagcggcgcgttggcggctcgcgccgatccggcccagaatgtcatcctggtgcccgcctttaccggtctgggcgccccctattggaagcccgattgccggggcgcaatgttcgggctgacgcgcaactccggtccggccgagttctgcaaggcggcgctggaaagcgtggcctatcagacccgcgatctgtgggaggcgatgcagggcgattggggtgcggatgcggatgtgatcctgcgtgtcgatggcggtatgagcgcgtccgactgggcgatgcagggcctggccgatcgtctgggcgcgccggtggaccgcccggtgatgcaggagaccacggcgctgggcgcggcctggctggccgggatgcgggcaggggtttaccccgatcaggcaggctttgccgcgacctgggcgctagatgcccggttcacccccaagatggtcgagggcgaccgcgaagccgcctatcgccgctggaaagcggcagtggcggcggcgatgatggtctag

SEQ ID NO: 69583 - protein, 492 aa, Silicibacter pomeroyi DSS-3
MTFILAIDQGTTSSRAILFDGEMRRVATAQREFTQHFPEAGWVEHDAEEIWQTTVEVCREVIAGQGIGPEQIAGIGITNQRETTVVWDKAGGAPVHRAIVWQDRRTAAICERLRHAGCEDDFTAQTGLLLDPYFSGTKVKWILDTVPGARDRAAAGELLFGTIDSFLIWRLTGGRVHASDATNAARTLMFDIHQGEWSKDICELLDVPMSMLPEVRDCAADFGTTDLFGGQVPILGVAGDQQAATIGQACFQPGMMKSTYGTGCFALLNTGTQPVASQNRLLTTIAYQLDGQRTYALEGSIFIAGAAVQWLRDGLGIIENAAQSGALAARADPAQNVILVPAFTGLGAPYWKPDCRGAMFGLTRNSGPAEFCKAALESVAYQTRDLWEAMQGDWGADADVILRVDGGMSASDWAMQGLADRLGAPVDRPVMQETTALGAAWLAGMRAGVYPDQAGFAATWALDARFTPKMVEGDREAAYRRWKAAVAAAMMV

SEQ ID NO: 69584 - DNA, 1509 bp, Francisella tularensis subsp. tularensis Schu 4
  CDS (1)..(1509): transl_table=11
atgtcaaaagatttcatcttagctgtagatcaaggtacaacaagttcacgagcaattatctttgataaaaagggtaatataagaaagattgctcaaaaagaattcacacaaatatatcctaaaagtggttgggtagaacatgatgcaatggaaatatggggtactcaaagtggcgtaatgcgtgaggcactagagtttggccgcgttaagccagatcaaattgcagcaataggtattacaaatcagcgcgagacagttgtagtttgggataaagaaacaggtgatcctgtctataatgctatagtgtggcaatgtcgccgtacttcgagtatttgtgatgaaatcaaacgagatcctcaatttgtcaaatatatcaaagaaaatactggtctggttgtagatgcgtatttttcaggcactaaagtaaaatggattttagataacgttgaaggtgctagagaaaaagcaaatgccggcaaattattaatgggtactatagatacttggttgatttggaatctaactcgcggtaaagtgcatgcgacagactatagtaatgcttcgcgcactatgttatttaatattaatagtttagagtgggataaaaaaatacttgattacttaaatattcctgaatcaatgttacctgaggttaaaaactcaagtgaggtttttggagttacagatagccatactttaggtggtgctgagattcctattgctggtgttgcaggagatcagcatgcagcattatttggtcattgctgttttgaaaaaggtatggcaaaaaatacttatggtacgggttgttttgccttgatgaatgtcggcgataagccagtttattcagatgaaggtttattgaccactatcgcatgggcagaaaatggtaagccaacttatgctttagaaggtagtgtatttatagcaggagctgttattcagtggattcgtgatggtttgggactagtgcgttctgctgaggatagtgagtactatgctactaagattgattctacaaatggtgtatatttggtgcctgcgtttgttggtcttggcacaccatattgggatatgtatgctcgtggtacgatagttggtattacccgcgatacaaagcgtgagcatattattcgtgcagctctagaggctatagcatatcaagctaaagatgtcttagaatgtatgaaagaggatacgggacttgatcttgctggtttgcgtgttgatggtggcgcggtacaaaataacttcctaatgcagtttcaatctgatattttacaatctgaaatctcaaaaccgaaagtaaatgaaattactggtttgggggctgtcttcttagctggtttagcagttggtttttggaaggataaacaagaattgaaatctattcttacaactgaaaaagtttttgaaccgcaaaaagactctcaagctgttgctcatgattatagaggttggaagaaagcagtagaaagaagtaaggcttgggcagagtgttatagttaa

SEQ ID NO: 69585 - protein, 502 aa, Francisella tularensis subsp. tularensis Schu 4
MSKDFILAVDQGTTSSRAIIFDKKGNIRKIAQKEFTQIYPKSGWVEHDAMEIWGTQSGVMREALEFGRVKPDQIAAIGITNQRETVVVWDKETGDPVYNAIVWQCRRTSSICDEIKRDPQFVKYIKENTGLVVDAYFSGTKVKWILDNVEGAREKANAGKLLMGTIDTWLIWNLTRGKVHATDYSNASRTMLFNINSLEWDKKILDYLNIPESMLPEVKNSSEVFGVTDSHTLGGAEIPIAGVAGDQHAALFGHCCFEKGMAKNTYGTGCFALMNVGDKPVYSDEGLLTTIAWAENGKPTYALEGSVFIAGAVIQWIRDGLGLVRSAEDSEYYATKIDSTNGVYLVPAFVGLGTPYWDMYARGTIVGITRDTKREHIIRAALEAIAYQAKDVLECMKEDTGLDLAGLRVDGGAVQNNFLMQFQSDILQSEISKPKVNEITGLGAVFLAGLAVGFWKDKQELKSILTTEKVFEPQKDSQAVAHDYRGWKKAVERSKAWAECYS

SEQ ID NO: 69586 - DNA, 1497 bp, Bacillus clausii KSM-K16
  CDS (1)..(1497): transl_table=11
atgaaaaacccatacattttatccatcgatcaaggaacaactagttcacgcgcgattttatttgacagccaaggagaaatcaaaaaaacggcgcaacgggaattcacccaatacttcccaaatccaggctgggtagagcataatgccaatgaaatttggacatccgttcttgccgtcatcgctgaagtcttttccgagtccgatgttgagccaaaagatgtggctggaattggcattacaaaccaacgggaaacaacggtcgtatgggataaacacacaggaaaaccgatatacaatgctttggtttggcaatcacggcaaactgaaaagatttgcgctgatttgcgggaaaaagggttgaacgagacattccgtaaaaaaacgggcttattgcttgatccttatttctctggcacaaaagtaaaatggattcttgaccatgtagatggcgcaagagaaaaagctgaaaaaggcgacctgttgtttggcacaattgattcatggctcatttggaaactaagcggcggcaaagctcatgtgaccgattatacaaatgcagctcggacgcttatgtacaatatccacgagttgaaatgggacgacgaactgctcgaactgctcgatgttccaaagcaaatgctgccggaagtccgctcctcttctgaagtatacgccacaaccgttgactaccatttctttgggcaaaatgtgccaattgctggcgtcgccggtgaccagcatgcggctttattcgggcaagcgtgttttgaaaaaggaatggttaaaaacacttacggcactggctgttttattttgatgaatacaggagaacaagcggttgagtcgaaaaacgggcttttgacaacactggcatggggaattgatggaaaagttgagtacgcccttgaaggcagtgtatttgttgccggttcggcaattcaatggttacgggatggccttaaaattattgaaaatgccccgcaaagtgaagcgttagcgacacgagtaacgtccgctgatggtgtctacttagtccctgcatttgttggcctaggtaccccatattgggacagcgaagcaagaggcgccatgtttgggttaacccgtggcacagagcatgctcatattgtccgtgccacgctggaatcacttgcttatcagacaaaagatgtgatggcagcaatggaacaagacgctggcatggaatcgaaaaagctccgtgccgatggaggcgctgttgctaatgactttttaatgcaattccaaagcgatctccttgatgcacccgttgaaattccttccgttacagagacgacggcgcttggtgctgcctatctagctggcctcgctgttggcgtctggaaaagcaaagaagatatcgcccgcaaatggaatatggaccgttcatttgaaccaaaaatgaacgccgatgagcgagatgcgttatacaaaggctggaaaaacgccgttaacgcaacgatggcattcaagccgtga

SEQ ID NO: 69587 - protein, 498 aa, Bacillus clausii KSM-K16
MKNPYILSIDQGTTSSRAILFDSQGEIKKTAQREFTQYFPNPGWVEHNANEIWTSVLAVIAEVFSESDVEPKDVAGIGITNQRETTVVWDKHTGKPIYNALVWQSRQTEKICADLREKGLNETFRKKTGLLLDPYFSGTKVKWILDHVDGAREKAEKGDLLFGTIDSWLIWKLSGGKAHVTDYTNAARTLMYNIHELKWDDELLELLDVPKQMLPEVRSSSEVYATTVDYHFFGQNVPIAGVAGDQHAALFGQACFEKGMVKNTYGTGCFILMNTGEQAVESKNGLLTTLAWGIDGKVEYALEGSVFVAGSAIQWLRDGLKIIENAPQSEALATRVTSADGVYLVPAFVGLGTPYWDSEARGAMFGLTRGTEHAHIVRATLESLAYQTKDVMAAMEQDAGMESKKLRADGGAVANDFLMQFQSDLLDAPVEIPSVTETTALGAAYLAGLAVGVWKSKEDIARKWNMDRSFEPKMNADERDALYKGWKNAVNATMAFKP

SEQ ID NO: 69588 - DNA, 1518 bp, Azotobacter vinelandii
  CDS (1)..(1518)
atgacccagaccaacaacaagcactacatcgtcgccctggaccaaggcaccaccagttcccgggccatcgtgctcgaccgcgacgccaacgtcgtcagcgtggctcagcacgagttcacccagatctatccgcaatcgggctgggtcgagcacgatcccatggagatctgggccacgcagagcgccaccctggtggaggccctggcccaggccggcatcgaccaccggcaggtggccgccatcggcatcaccaaccagcgcgaaaccacggtgatctgggacaaacagagcggccggccgatccacaacgccatcgtctggcaatgccgacgcagtgccgcgatctgcgaggaactcaaacgcgacagcctggaggaacatgtcagggaacgtaccggcctggtcatcgatccctatttctccgcaaccaaaatcaaatgggtcctcgaccacgtcgagggcagccgcgagcgtgcgcggcgcggcgaattgctgttcggcaccgtcgactcctggctgatctggaagatgacccagggccgggtgcacgtcaccgacttcaccaacgccgcgcgcaccatgctcttcgacatccacgcgctggactgggatgcgcgcctgctcgaggccctcgacatcccgcgcgagatgctgccgcaggtgaggtcgtcctccgaggtctacggccatgcctgcatcgccggcggcgacgaggacgacggcatcccgatcgccggcatcgccggggaccagcaggccgcgctcttcggccacatgtgcgtggagcccggccagggcaagaacacctacggcaccggctgcttcctgctgatgaacactggcgccaaggccgtgcgctcgggccacgggctgctcaccaccatcgcctgcgggccgcgcggggaggtcgcctacgcgctggaaggggcgatcttcaatgccggctccacggtgcagtggctgcgcgacgagctcaagctgatcgacgattcgttcgattccgaatatttcgccaccaaggtccaggacagcaacggcgtctacctggtaccggccttcaccggcctgggcgcaccctactgggacccctacgcgcgcggcgcggtgttcggcctgacccgcggcgtgaaggccgaccacctgatccgcgccgcgctcgaatccatcgcctaccagacctgcgacgtgctcgacgccatgcagcgggacgccggcgagcgcctcaaggcgttgcgcgtggatggcggcgcggtgagcaacaacttcctcatgcagttccaggccgatctgctcggcacgccagtcgagcgtccggcggtgaaggaagtcaccgcgctcggcgccgcttacctggcaggcctggccaccggattctggagcggcctcgacgaactgcgcgacaaggcgcggatcgagcgggtgttcgagccggcctgctccgaagagaaacgccgctcgctgagtgccggctggaagaaggcggtgctgcgcagccagcgctgggccgaggacgactag

SEQ ID NO: 69589 - protein, 505 aa, Azotobacter vinelandii
MTQTNNKHYIVALDQGTTSSRAIVLDRDANVVSVAQHEFTQIYPQSGWVEHDPMEIWATQSATLVEALAQAGIDHRQVAAIGITNQRETTVIWDKQSGRPIHNAIVWQCRRSAAICEELKRDSLEEHVRERTGLVIDPYFSATKIKWVLDHVEGSRERARRGELLFGTVDSWLIWKMTQGRVHVTDFTNAARTMLFDIHALDWDARLLEALDIPREMLPQVRSSSEVYGHACIAGGDEDDGIPIAGIAGDQQAALFGHMCVEPGQGKNTYGTGCFLLMNTGAKAVRSGHGLLTTIACGPRGEVAYALEGAIFNAGSTVQWLRDELKLIDDSFDSEYFATKVQDSNGVYLVPAFTGLGAPYWDPYARGAVFGLTRGVKADHLIRAALESIAYQTCDVLDAMQRDAGERLKALRVDGGAVSNNFLMQFQADLLGTPVERPAVKEVTALGAAYLAGLATGFWSGLDELRDKARIERVFEPACSEEKRRSLSAGWKKAVLRSQRWAEDD

SEQ ID NO: 69590 - DNA, 1485 bp, Desulfitobacterium hafniense DCB-2
  CDS (1)..(1485)
atgaagaagtacgtccttgccttggatcaggggacaaccagctgccgggccatcctttttgatagggaaagccaaatcgtcggcgtggcgcaaaaggaatttacgcaaatttacccccagcccggctgggtagagcatgatccggaagaagtatggagcactcaatacggggtcattgccgagctgctggcccgctatcaagtaaccagcgaagagattgcggggatcggaattaccaatcagcgggaaaccacggtggtttgggacaaacatacgggaaagtctgtaaccaatgcgattgtctggcagtgtaggagaacggctcccctctgtgatgaactaaagatgaaaggattagagcctttgttcaaggagaaaacaggcttagtcttggatgcctatttttcaggcactaaaatccgctggatcttagatcgggtgccgggtgcccaggaaaaggccgaaaagggcgagctgctctttggcaccatggatacctggctggtgtggaatctgaccaagggccgcattcatgttacagactactccaatgcctcccgcactctcctctataatattaagaccttggcttgggacccggatctgcttcaggtgctcaatattcctttagccatgctcccagaggtaaagccctccagcactatctacggagagacagccgccgagggccttttcgggcatcctattcctattgccggcattgccggggatcagcaagcagccctcttcgggcaggcctgctttgcaccggggatggccaagaatacctatggcaccggctgctttatgctgcttaatacaggagaagaactctatgaatcccggcatggcctcatcagcaccatcgcctgggggctcgatgaaaaagtaatctatgccctggagggcagtgtctttatggctggagcggtaatgcaatggctgcgggatgaattaaagcttattgaaaccgctggggattcggaatacttcgcaggcaaggttgccgacaatggcggcgtttacctggtgcctgcttttacggggctgggggcaccttactgggatatggacgctcggggggccattgtgggcttgacccgcggcagcaataaaaatcatatcattcgtgccgctttggagtccatggcttatcagaccagggacattctggaggctatggaggcggattctcaattgcctctccaacttctcaaagtggatgggggagcggtggtcaacaacctcttgatgcagtttcaggcagatattttgggtgtggaagtggaacgcccccattgtattgaaaccacagccttaggagcggcctatctggctgggctggcgataggattctggagcagcaaagaggaattaagagacaaggcaaaaatggaacgctcttttaaacctcagatggcagaggagcgcaaagaaaagtattatcaagggtggcataaagccgtcagacagatcatggagtaa

SEQ ID NO: 69591 - protein, 494 aa, Desulfitobacterium hafniense DCB-2
MKKYVLALDQGTTSCRAILFDRESQIVGVAQKEFTQIYPQPGWVEHDPEEVWSTQYGVIAELLARYQVTSEEIAGIGITNQRETTVVWDKHTGKSVTNAIVWQCRRTAPLCDELKMKGLEPLFKEKTGLVLDAYFSGTKIRWILDRVPGAQEKAEKGELLFGTMDTWLVWNLTKGRIHVTDYSNASRTLLYNIKTLAWDPDLLQVLNIPLAMLPEVKPSSTIYGETAAEGLFGHPIPIAGIAGDQQAALFGQACFAPGMAKNTYGTGCFMLLNTGEELYESRHGLISTIAWGLDEKVIYALEGSVFMAGAVMQWLRDELKLIETAGDSEYFAGKVADNGGVYLVPAFTGLGAPYWDMDARGAIVGLTRGSNKNHIIRAALESMAYQTRDILEAMEADSQLPLQLLKVDGGAVVNNLLMQFQADILGVEVERPHCIETTALGAAYLAGLAIGFWSSKEELRDKAKMERSFKPQMAEERKEKYYQGWHKAVRQIME

SEQ ID NO: 69592 - DNA, 1494 bp, Desulfovibrio desulfuricans G20
  CDS (1)..(1494)
atgagcaaatacattctggcactcgatcagggcacaaccagctcccgcgccattctgttcacccgcgagggcgacatcaagcagatcgcccagaaagagttcacgcagatatacccccagcccggctgggttgagcataatgccaacgaaatattcgacacccagtcgtgggtgatgaccgaatgcctgcagcgtgccggcgtcaacgccagcgaagtggccgccataggcatcaccaaccagcgtgaaaccaccgtggtgtgggacagaaaaagcggcgctcccgtgcacaacgccattgtgtggcaggaccgccgtaccgcctccatctgcgatgaaatgaaaaaacgcggactggcggaaaccatccgcgaaaaaaccggccttgtcatcgacgcctatttttcgggcaccaaggtcaaatggattctggataacgtgcccggcgcccgtgcaaaggcggaacgcggcgaactgtgcttcggcaccatcgacacgtgggttatctggaacctgaccaaaggcaaggaacacgtcaccgacgaatccaacgccagccgtaccatgctgttcaacatccacaccggtgactgggatgaagaactgctgaagattctggatgttccgcgttccatgctgccccgcgtggccggttcttccgaagtggtggccgaaacgcatcccgagttcctcggcaaggctgtgccggtttccggcatcgccggcgaccagcaggctgccaccttcggcaacgcctgccttaccgaagggatggccaaaaacacctacggtacaggctgcttcatgctgctgaacaccggcaagcaggctcacatcagcaaaaacaacctgctgaccaccaccggttggaacacgccttccggccgttactactgccttgaaggcagcgtgttcatcgccggtgccgtggtgcagtggctgcgtgacggtctggggattatccagagcgctcccgaagtggaacagctggcactgagtgtgccggacaacggcggtgtggtgcttgtgcctgcatttgccggtctgggtgcaccgcactgggaccagtacgcacgcggcaccatggtgggcgtcacccgcggtaccaccaaggcgcatatagcccgtgccgcgctggaatccatagcactgcagacgctggatatcatggactgcatgcagaaggacgccggaatcaatctggctgccctgcgtgcggacggcggtgccacccgcaacaacctgctcatgcagttccaggcagatgtgctcggtgtgcctgtcgagcgtcccaaagtgacggaaaccaccgcgctgggcgctgcgtatctggcaggtcttgccgtgggcttctggaagagcgaagacgaaatcaccgccatgtggcagcttgaccgtcgttttgagccgaacatgagcgccgaagtgcgtgaaaagctggtctacaactggaagcgcgccgtggaacgttccaaggagtgggcggaagactaa

SEQ ID NO: 69593 - protein, 497 aa, Desulfovibrio desulfuricans G20
MSKYILALDQGTTSSRAILFTREGDIKQIAQKEFTQIYPQPGWVEHNANEIFDTQSWVMTECLQRAGVNASEVAAIGITNQRETTVVWDRKSGAPVHNAIVWQDRRTASICDEMKKRGLAETIREKTGLVIDAYFSGTKVKWILDNVPGARAKAERGELCFGTIDTWVIWNLTKGKEHVTDESNASRTMLFNIHTGDWDEELLKILDVPRSMLPRVAGSSEVVAETHPEFLGKAVPVSGIAGDQQAATFGNACLTEGMAKNTYGTGCFMLLNTGKQAHISKNNLLTTTGWNTPSGRYYCLEGSVFIAGAVVQWLRDGLGIIQSAPEVEQLALSVPDNGGVVLVPAFAGLGAPHWDQYARGTMVGVTRGTTKAHIARAALESIALQTLDIMDCMQKDAGINLAALRADGGATRNNLLMQFQADVLGVPVERPKVTETTALGAAYLAGLAVGFWKSEDEITAMWQLDRRFEPNMSAEVREKLVYNWKRAVERSKEWAED

SEQ ID NO: 69594 - DNA, 1512 bp, Actinobacillus pleuropneumoniae serovar 1 str. 4074
  CDS (1)..(1512)
atgactaaagaatacattattgcgttagaccaaggtacgacaagctctcgtgcggtgttactcgacaaaaacgccaatatcgtagaggtttctcaacgtgaatttacccaaatttatccgcaagtcggttgggtggaacataatccgatggaaatttgggcgacgcaaagttcgacattaaatgaagtggtggcaaaagcgggcattacttccgataaaattgcggcaatcggtattaccaaccaacgtgaaaccacgattgtttgggaaaaagaaaccggtaaaccggtttacaatgcgattgtatggcaatgccgtcgtacggcggatatttgtgcgaaattaaaagaagacgggcatgaagcttatattcgtaaaacgaccggtttagtggtggacccgtatttctccggtacgaaagtaaaatggattttagataatgttgaaggcgcaagagaaaaagccgagctcggcgagctgttattcggtacggtagatacttggttggtttggaaattaacccaaggtcgcgtgcacgttaccgattacacaaacgcttcccgtactatgatgttcaatattcataccaaacaatgggacgataaaatgttggaattattaaatattccgcgttctatgttaccggaagtaagaaattcatcggaagtttacggcgaaaccaatatcggcggtaaaggcggcgtacgtattccggtagccggtatggcgggcgaccaacaagcggcgctttacggtcatttatgcgtagaagccggtcaggcgaaaaatacttacggtaccggttgctttatgttgatgaataccggtaatgaagcggtcgaatcgaaaaacggtttgctgactaccatcgcatgtaacgcaaaaggcgaaccgtgctatgcgttggaaggttcgatttttatgggcggtgcttcgattcagtggttacgtgacgaacttaaaatcgtacatgacagtaaagactccgaatattttgcaacaaaagaagacagcacaaacggtgtgtatgtcgtaccggcgtttaccggcttaggcgcgccgtattgggatccgtatgctcgaggtgcgattttaggactttctcgcggtgcaaaccgtaaccatatcgtacgtgcgacattagagtctatcgcatatcaaacccgtgacgtattggatgcgatgcaatcggatagcggtaaacatcttgcgactttacgtgtggacggcggtgcggttgccaataacttcttaatgcaattccaagcggatattctcaatgctaacgtagaacgtccggtcgtgcgtgaagttaccgctttaggtgcggcatatcttgccggtcttgctgtaggattctggaaagatttgcaagaattacgcggtaaagcgtcgattgagcgtacctttgttccggatggcgacgaagcaaaacgtaccagacgttataaaggttggaaaaaagcggttaaacgtgcgttagaatgggcaaaagaagacgcagaggaataa

SEQ ID NO: 69595 - protein, 503 aa, Actinobacillus pleuropneumoniae serovar 1 str. 4074
MTKEYIIALDQGTTSSRAVLLDKNANIVEVSQREFTQIYPQVGWVEHNPMEIWATQSSTLNEVVAKAGITSDKIAAIGITNQRETTIVWEKETGKPVYNAIVWQCRRTADICAKLKEDGHEAYIRKTTGLVVDPYFSGTKVKWILDNVEGAREKAELGELLFGTVDTWLVWKLTQGRVHVTDYTNASRTMMFNIHTKQWDDKMLELLNIPRSMLPEVRNSSEVYGETNIGGKGGVRIPVAGMAGDQQAALYGHLCVEAGQAKNTYGTGCFMLMNTGNEAVESKNGLLTTIACNAKGEPCYALEGSIFMGGASIQWLRDELKIVHDSKDSEYFATKEDSTNGVYVVPAFTGLGAPYWDPYARGAILGLSRGANRNHIVRATLESIAYQTRDVLDAMQSDSGKHLATLRVDGGAVANNFLMQFQADILNANVERPVVREVTALGAAYLAGLAVGFWKDLQELRGKASIERTFVPDGDEAKRTRRYKGWKKAVKRALEWAKEDAEE

SEQ ID NO: 69596 - DNA, 1485 bp, Pseudomonas aeruginosa UCBPP-PA14
  CDS (1)..(1485)
atgtcccactatctcctcgccatcgaccagggcaccaccagctcccgcgccatcgtgttcagtgcccagggcttgccggtgacgagctgccagcaggaattcaagcagtacttcccgaaggacggctgggtggagcacgacggcgaggaaatctggctgaccaccctccaggtctgtcgcgacgcgctcgctcgcaagggcttgcgcgcgggcgacatcgccgccatcggcatcaccaaccagcgcgagaccacgctggtctgggacgccgccagcggcgacctgatccacccggccatcgtctggcaggatcgtcgtaccgccgactactgtgccgaactcaaggccgccggccacgaggcgaacgtcagcgcgcgcaccgggctgctgatcgatccgtatttctccgccaccaagctgcgctggatcctcgacaacgtgcccggcgcccgccagcgcgccgaacgcggcgagctgcgcttcggcaccgtcgactgcttcctgctctggcgcctgaccggcggccgctcccatcgcaccgacgcgaccaacgcttcgcgcaccctgctgttcaacatccacagccaggactgggacgaggaattgctggcgctgttcgagatcccgcgcagcctgctgccggaggtactcgactgcgcggcggagttcggcgtcagcgagccgtcgctgcttggcgcggcgatcccggtgctgggcatggccggcgaccagcaggccgcgctgatcggccaggcctgcttccagccgggcatggtgaagagcacctacggcaccggctgcttcatgatccagaacactggcgagcagccggtgacctcgaagaaccgcctgctcaccacggttggctaccgtctggacggcaaggtcagctacgcggtggagggcagcatcttcgtcgccggcgccgcggtgcaatggctgcgcgacggcatcaagctgatcgaccacgcccacgagagcgaagccctggcgatccaggccggcgactccaacggcgtctacctggtgccggcctttaccggcctcggcgcgccctactgggacccgaaggcgcgcggcgcgatcttcggcctgacccgcgacaccggaatcaaggagatcgtcaccgccggtctgcaatcggtctgctaccagacccgcgacctgctcgaagcgatgcgccaggacggcacgccgcccagcgcgctgcgggtggacggcgggatggtggtgaacaactgggtgatgcaatttctcaccgacatccttggtgtcaccgtggagcgcccggaagtcaccgagaccaccgccctcggcgtggcctacatggccgggctgaaggcaggcttctatcgcgacctggacgacatcgccagccactggcacctgcagcgccgcttcgccgcacacatggccgaggagcgccgcggcgaactctacgccggctggcagaacgcggtgcgacgggtgcgcagcgaggcctga

SEQ ID NO: 69597 - protein, 494 aa, Pseudomonas aeruginosa UCBPP-PA14
MSHYLLAIDQGTTSSRAIVFSAQGLPVTSCQQEFKQYFPKDGWVEHDGEEIWLTTLQVCRDALARKGLRAGDIAAIGITNQRETTLVWDAASGDLIHPAIVWQDRRTADYCAELKAAGHEANVSARTGLLIDPYFSATKLRWILDNVPGARQRAERGELRFGTVDCFLLWRLTGGRSHRTDATNASRTLLFNIHSQDWDEELLALFEIPRSLLPEVLDCAAEFGVSEPSLLGAAIPVLGMAGDQQAALIGQACFQPGMVKSTYGTGCFMIQNTGEQPVTSKNRLLTTVGYRLDGKVSYAVEGSIFVAGAAVQWLRDGIKLIDHAHESEALAIQAGDSNGVYLVPAFTGLGAPYWDPKARGAIFGLTRDTGIKEIVTAGLQSVCYQTRDLLEAMRQDGTPPSALRVDGGMVVNNWVMQFLTDILGVTVERPEVTETTALGVAYMAGLKAGFYRDLDDIASHWHLQRRFAAHMAEERRGELYAGWQNAVRRVRSEA

SEQ ID NO: 69598 - DNA, 1518 bp, Pseudomonas aeruginosa UCBPP-PA14
  CDS (1)..(1518)
atgaccgacaagcacaacaagaaatacgtcgtcgccctggaccagggcaccaccagctcccgcgccatcgtcttcgaccgcgatgccaacgtggtcagccaggcccagcgcgagttcgcccagttctatccgcaggccggctgggtcgaacacgatccgatggaaatctgggccacgcagagttcgaccctggtcgaggccctcgcccaagccagcatcgagcacgaccaggtggccgccatcggcatcaccaaccagcgcgagaccacggtggtctgggaccgtcacagcggtcggccgatccacaacgccatcgtctggcagtgccggcgcagcgcggcgatctgcgcgcagctcaagcgcgacgggctggaagactacatccgcgaaaccaccggtctggtcaccgacccgtacttttccgggaccaagctgaagtggatcctcgacaacgtcgaaggcgcccgcgaacgcgcgcgcaacggcgacctgttgttcggcaccatcgacacctggctgatctggaagctcaccgaaggcaaggtccacgtcaccgactacaccaatgcctcgcggaccatgctgttcaacatccacagcctcgactgggacgcacggatgctcgaggtgctcgacattccccgctcgatgctgcccgaggtgcgcaactcttcggaggtctacggcaacgcccggatcggcggggtcggcggcggcgagctgccgatcgccgggatcgccggcgaccagcaggccgccctgttcggccagatgtgcgtggaaccgggccaggcgaagaacacctacggcaccggctgcttcctgctgatgcacaccggcgacaaggcggtgaagtccacccatggcctgctcaccaccatcgcctgcggcccgcgcggcgaggtcggctacgccctggagggcgcggtgttcaacggcggctccacggtgcagtggttgcgcgacgaactgaaggtgatcaacgactccttcgattccgaatacttcgccaccaaggtcaaggacagcaacggcgtctacctggtaccggccttcaccggactcggcgcgccctattgggacccctatgcgcgcggcgcagtgttcggcctgacccgtggagtcaaggccgaccacctgatccgcgccaccctggaatccatcgcctaccagacccgcgacgtgctcgacgccatgcagcgcgatgccggcgaacgcctgcgcgctctgcgcgtcgacggcggggcggtggccaacaacttcctcatgcagttccaggccgacatcctcggcacccgcgtggagcgcccggtgatgcgcgagaccaccgccctcggcgccgcctacctggccggcctggcctgcggcttctggagcagcctcgacgagctgaagagcaaggcggtgatcgagcgggtgttcgagccggagtgcgacgagccccggcgcgaaaagctctatgccggctggaaaaaagcggtggagcgcactcgcggctgggacgacggcgaactgtga

SEQ ID NO: 69599 - protein, 505 aa, Pseudomonas aeruginosa UCBPP-PA14
MTDKHNKKYVVALDQGTTSSRAIVFDRDANVVSQAQREFAQFYPQAGWVEHDPMEIWATQSSTLVEALAQASIEHDQVAAIGITNQRETTVVWDRHSGRPIHNAIVWQCRRSAAICAQLKRDGLEDYIRETTGLVTDPYFSGTKLKWILDNVEGARERARNGDLLFGTIDTWLIWKLTEGKVHVTDYTNASRTMLFNIHSLDWDARMLEVLDIPRSMLPEVRNSSEVYGNARIGGVGGGELPIAGIAGDQQAALFGQMCVEPGQAKNTYGTGCFLLMHTGDKAVKSTHGLLTTIACGPRGEVGYALEGAVFNGGSTVQWLRDELKVINDSFDSEYFATKVKDSNGVYLVPAFTGLGAPYWDPYARGAVFGLTRGVKADHLIRATLESIAYQTRDVLDAMQRDAGERLRALRVDGGAVANNFLMQFQADILGTRVERPVMRETTALGAAYLAGLACGFWSSLDELKSKAVIERVFEPECDEPRREKLYAGWKKAVERTRGWDDGEL

SEQ ID NO: 69600 - DNA, 1494 bp, Fusobacterium nucleatum subsp. vincentii ATCC 49256
  CDS (1)..(1494): transl_table=11
atgaaatatattgtagcattagatcaaggtacaacaagttcaagagcaattttatttgatgaatctcaaaatataattggagtagctcaaaaagaatttacacaaatatatccaaatgaaggttgggtagaacatgatcctatggaaatatgggctagccaaagtggagttttaagtgaagttattgccagagctggaataagtcaacatgatatcatagccttaggaattacaaaccaaagagaaactacaatagtttgggataagaaaacaggaaagccagtatataatgcaatagtttggcaatgtagaagaactgccaaaatttgtgatgaattgaaaaagatagatggatttagtgattatgtaaaagataacacaggacttttagttgatgcttatttctctggaacaaaaataaaatggattttagataatgtagaaggtgcaagagaaagagcagaaaaaggagaactattatttggaaccgttgatacttggttaatttggcaattaactaatggaaaagtacatgcaacagattatactaatgcttcaagaactatgctttataatataaaagaattaaaatgggatgaaaaaatactaaaaactttaaacattcctaaatcaatgttaccagaagttaaagattcaagtggaacatttggatatgcaaatcttggtggaaaaggtggacatagaataccaatagcaggagttgcaggagatcaacaatctgcattatttggacaagcatgttttgaagaaggagaatctaaaaatacttatggaactggttgtttcttgcttatgaacacaggagaaaaatttgtaaaaagtaacaatggacttatcacaactattgcaataggacttaatggaaaagttcaatatgcacttgaaggaagtgtgtttgtaggtggagctagtgttcaatggttaagagatgaattaaaattaatctctgaatcaagagatactgaatattttgctagaaaagttaaagataatggtggagtttatgtagtaccagcatttgtaggattaggagcaccttattgggatatgtatgcaagaggagctattttaggtttaactcgtggagcaaataaaaatcatattataagagcaactttggaatcaatagcttatcaaacaaaagacgttttaaaagctatggaagaagattcaggaataaaattaaatggtttaaaagttgatggtggagcagcagctaataatttcttaatggaatttcaagcagatatcttaggagaatctgtaaaaagacctactgttttagaaacaacagccttaggagcagcatatcttgcaggacttgcagttggattctgggaaaataaaaatgaaattaaacaaaaatgggtattagataaagaatttacacctaatatgtcaaaagaagaaagagataaaaaatatgctggttggttaaaagctgttgaaagaactaaaaaatgggaagaataa

SEQ ID NO: 69601 - protein, 497 aa, Fusobacterium nucleatum subsp. vincentii ATCC 49256
MKYIVALDQGTTSSRAILFDESQNIIGVAQKEFTQIYPNEGWVEHDPMEIWASQSGVLSEVIARAGISQHDIIALGITNQRETTIVWDKKTGKPVYNAIVWQCRRTAKICDELKKIDGFSDYVKDNTGLLVDAYFSGTKIKWILDNVEGARERAEKGELLFGTVDTWLIWQLTNGKVHATDYTNASRTMLYNIKELKWDEKILKTLNIPKSMLPEVKDSSGTFGYANLGGKGGHRIPIAGVAGDQQSALFGQACFEEGESKNTYGTGCFLLMNTGEKFVKSNNGLITTIAIGLNGKVQYALEGSVFVGGASVQWLRDELKLISESRDTEYFARKVKDNGGVYVVPAFVGLGAPYWDMYARGAILGLTRGANKNHIIRATLESIAYQTKDVLKAMEEDSGIKLNGLKVDGGAAANNFLMEFQADILGESVKRPTVLETTALGAAYLAGLAVGFWENKNEIKQKWVLDKEFTPNMSKEERDKKYAGWLKAVERTKKWEE

SEQ ID NO: 69602 - DNA, 1533 bp, Psychrobacter sp. 273-4
  CDS (1)..(1533)
atggcacaacagccaacgattttaaaaacgccgcaagcaggctttgttgagcaagatgcccagcaaatttggcagacgcaaatcagctgcgcccatgacgtcattaatcaggcggggctgctcgctaccgatgttagtggtattgcgattaccaatcagcgtgagtctattgtcatatgggataagcacacaggtaagccgcttgcgccagccattatttggcaagacagacgtacggcgagttactgtcaattgcttgctgatgaaaacttaatggccacgacgcaagttgttacaggtattagcaataacagcagccaaggcaatatggcaagtgaagtacaacgtatcacaggtttgcgcttagatccgtattttagtgccagcaaaatcgcttggctattagagcacaaccctaagttgagcgtacgcgccagtaaaggtgagatagcggttggcacgatagacagctggctgatatataagctaacaggcggtgagcatgtcattgatgtaaccaacgcttctcgtaccttgttatatgatatccataagctggcatggtcggaggagttgtgtgcccgatttggtatacccataaatattttgcctaaagttctaccatctgatggcgactttggcaaaactaaaaaagggctgtttgctaagcaaattcctatacatgcggtattgggcgatcagcaagcggcgctttttgggcaaggctgtcttgaggcaggtatggcaaaaaatacttacggtacgggctgttttatgttgatgaatatcggtcaaaaaccgatgcttagtgagcataagctattgacgaccattgcatggcaacgaaaatcagcaccaactcgtcccgaccatttatcatttgagcaaatcgtgcaatctggtaaacgtatgctacagcctcccaacagagaagtgacttatgcgttagaaggcagtgtatttatggcaggcgcaatcgtacagtggctgcgtgataatctgggtatgttccaaaagagcggggaagtggaagatttagcgcggcaagttgagagtagtgaggaggtagtgttactaccagcatttacgggactgggtgccccttattggcgctcagacatcagtgccagtattactggtatgagccgcggtacgaccaaagcgcatattgcacgggcggcattagaggctattgcttatcagacgtatgatgtgctcatcgccatgcaaaaagacagcccgcaggcactcactgagctaagagtagatggcggcgcagcaaataatgatttgctgatgcagtttcaagcagatttactaggcgtgccggtactacgcccaaaagacacagagattacagcaaaaggggttgcgttacttgctggtttaaagacaggtttatatgatgataccacgatgcaagcctcctggcaggtggatcgaatttttgagcctagcatgtctatagatgtgcgtgagcagcatcttaataaatggcaacaagctatcagtagagcgttaatgactccttga

SEQ ID NO: 69603 - protein, 510 aa, Psychrobacter sp. 273-4
MAQQPTILKTPQAGFVEQDAQQIWQTQISCAHDVINQAGLLATDVSGIAITNQRESIVIWDKHTGKPLAPAIIWQDRRTASYCQLLADENLMATTQVVTGISNNSSQGNMASEVQRITGLRLDPYFSASKIAWLLEHNPKLSVRASKGEIAVGTIDSWLIYKLTGGEHVIDVTNASRTLLYDIHKLAWSEELCARFGIPINILPKVLPSDGDFGKTKKGLFAKQIPIHAVLGDQQAALFGQGCLEAGMAKNTYGTGCFMLMNIGQKPMLSEHKLLTTIAWQRKSAPTRPDHLSFEQIVQSGKRMLQPPNREVTYALEGSVFMAGAIVQWLRDNLGMFQKSGEVEDLARQVESSEEVVLLPAFTGLGAPYWRSDISASITGMSRGTTKAHIARAALEAIAYQTYDVLIAMQKDSPQALTELRVDGGAANNDLLMQFQADLLGVPVLRPKDTEITAKGVALLAGLKTGLYDDTTMQASWQVDRIFEPSMSIDVREQHLNKWQQAISRALMTP

SEQ ID NO: 69604 - DNA, 1503 bp, Anabaena variabilis ATCC 29413
  CDS (1)..(1503)
atgcagacatcatcttccggctatatcctagcgttggacttgggaacaactggaaaccgggcatttatctttaacaatgcaggtaaaatagttgctcaagcatataaggaactaacacaacattatccccaaccaggatggttagagcatgacgcggaagaaatctggcaagatacctgctgggtgatgaaaacagccatcgccaatgcacaaatatctcctagtgaaattgctgctataggtttgactgtacaacgggaaacttgcctactgtgggacaaaacgacggggaagccattacataaagccattgtttggcaagaccgccgcacggctcccctgtgtcatcagttacaggaaaaaggctatgctcaggaaatttacagtcgcactggtttagtggttgatgcttatttctcagcaactaaactccgatggttattagactacatcacaggcgttgatttaaaaaatgttctggcaggtacaattgatacctggatactgtggaaattaacaggcggaaaagtccacgccaccgaccacagcaatgctagccgcaccatgttgatgaatctgaaaactggtgaatgggatgagcaactattagagattttgcaaattcctgcccatattctgccgcaaattcagcccagcttaggaaaatttggtctgaccgataccagcttgttagatacagctatccccatcacagccattttaggcgatcaacaagcagctttgtttggtcatggctgcgatcgccccggtttaatgaaatgtacttatggcactggtagttttttggtggctcacactggctctaatattgttcgttctcaacatcaattaatttctacaatcgcctggacacaatataattcccaggaaaatatcaatatcggttatgctctagaaggcagtatgtttaccagtggtgcttgtattcaatggttacgtgatggtatcaaattaattaagacggctgcggaaactgagacaatggcaaatcaagtagatgataacggtggggtgtactttgtccccgcttttagtggactaggcgcaccctactgggatatgaacgctagaggagctttttttggcattaccgccagcgtccaaccacagcatttagtccgggctgtattagaagcgatcgcctatcaagtgttagaagtagtacaagccatcaatgcctcttgtagtagccccatgcagcgcctaattgtcgatggtggtgcttgcgaaaacaatttcctcatgcagttccaagcggatgttttaggtattcccgtagaacgtcccaccatgcgcgacacaacggtacaaggtgcagccttcgccgcaggtttagctgtgggattttgggatagttacacagcattagttaaccaacgccagatagaccgcatttttgaaccaggagagggaagccaaaacgccatatacaactttgcgacatggcaaaaggcagttaaacggagtcttgattgggtgtag

SEQ ID NO: 69605 - protein, 500 aa, Anabaena variabilis ATCC 29413
MQTSSSGYILALDLGTTGNRAFIFNNAGKIVAQAYKELTQHYPQPGWLEHDAEEIWQDTCWVMKTAIANAQISPSEIAAIGLTVQRETCLLWDKTTGKPLHKAIVWQDRRTAPLCHQLQEKGYAQEIYSRTGLVVDAYFSATKLRWLLDYITGVDLKNVLAGTIDTWILWKLTGGKVHATDHSNASRTMLMNLKTGEWDEQLLEILQIPAHILPQIQPSLGKFGLTDTSLLDTAIPITAILGDQQAALFGHGCDRPGLMKCTYGTGSFLVAHTGSNIVRSQHQLISTIAWTQYNSQENINIGYALEGSMFTSGACIQWLRDGIKLIKTAAETETMANQVDDNGGVYFVPAFSGLGAPYWDMNARGAFFGITASVQPQHLVRAVLEAIAYQVLEVVQAINASCSSPMQRLIVDGGACENNFLMQFQADVLGIPVERPTMRDTTVQGAAFAAGLAVGFWDSYTALVNQRQIDRIFEPGEGSQNAIYNFATWQKAVKRSLDWV

SEQ ID NO: 69606 - DNA, 1551 bp, Ralstonia eutropha JMP134
  CDS (1)..(1551)
atgaaccagcagaccacgcaggccgcgcagcagcagttcgtactggcgctggaccagggcacgagcagttcgcgggccattctgttcgaccacgccggcaatgtggtacggcttgcccagcgcgaattccgccaatattacccacatcccggccacgtcgagcacgacccgtacgaaatctggcagacgcagctcgcggtcgcgcacgaggtcctgaacgacgcgggtatctcggcctcgcagttgcgcgcaatcggcatcacgaaccaacgcgaaaccacggtcctgtgggaccgcaagaccggcgagcccgtgggccgcgcgctggtctggcaagaccgccgcaccgcgcccatgtgcgaggcactgcaggcggccggccatgccggcatgatccgcgacaagaccgggctcgtcatcgatgcctacttctccggcaccaagctgcgctggatgctcgacaacgtcaagggcgcgcgcgaacgcgcccagcgcggcgaactggcgttcggcacgatcgacagctggctgatctggcagctcaccgacggcgcgcgccatgtgaccgacgtgtccaacgcttcgcgcacgatgctgttcaatatccacagcttcgcatgggacgatgcgctactcgcattgctggacatcccgcacaaggtgctgccggaggtggtgccctccagtggccaggtcgcgcgcacggtgccgcggctgtttggcgcggaagtccctattgccggcatcgcgggcgaccagcaggccgccacgttcggccaggcctgcctgtctccgggcatggccaagaacacgtatggcacgggttgcttcctgctgatgaatacggggccgcagccggtggtctcgcgcaaccgcttgctgacgacggtcggatggcagatcaacgggcagacgcaatactgcctggaaggcggtgtctttatgggcggcgccacgatccagtggctgcgcgatggcctgaagatcatcgcaagcgccccggaggtcgagccactcgcgcgccagtgcacggacacgggcggtgtggtgctggtgccggcctttgccggcctcggcgcgccgcactgggatgcattcgcacgcggcacgctggtcggtatgacgcgcggcaccggccgcccgcagatcgcacgcgcggcgctggaatcgattgcgctgcagagcgtggacgtgctcgatgccatgcagaaggacgccggcatttcgctcgcggaacttcgcgtagacggcggcgcgtcgcgcagcgacctgctgatgcagatgcaggccgacctgctcggcacgaccgtggtacgtccgcgcatcaccgaaacgacggcactgggcgcagcctacctggccggcctcgccaccgggtactggagcgaccaggagcagatttcccggcaatggcaggtgcagcagcgcttcgagcccaacctgtccgccgatgaacgcgcgcaccggctgtcgcgctggcaccgcgccgtggaacgggcccgcgactgggcccgggaagatcacgaggccaccagcggcaagagaacgtga

SEQ ID NO: 69607 - protein, 516 aa, Ralstonia eutropha JMP134
MNQQTTQAAQQQFVLALDQGTSSSRAILFDHAGNVVRLAQREFRQYYPHPGHVEHDPYEIWQTQLAVAHEVLNDAGISASQLRAIGITNQRETTVLWDRKTGEPVGRALVWQDRRTAPMCEALQAAGHAGMIRDKTGLVIDAYFSGTKLRWMLDNVKGARERAQRGELAFGTIDSWLIWQLTDGARHVTDVSNASRTMLFNIHSFAWDDALLALLDIPHKVLPEVVPSSGQVARTVPRLFGAEVPIAGIAGDQQAATFGQACLSPGMAKNTYGTGCFLLMNTGPQPVVSRNRLLTTVGWQINGQTQYCLEGGVFMGGATIQWLRDGLKIIASAPEVEPLARQCTDTGGVVLVPAFAGLGAPHWDAFARGTLVGMTRGTGRPQIARAALESIALQSVDVLDAMQKDAGISLAELRVDGGASRSDLLMQMQADLLGTTVVRPRITETTALGAAYLAGLATGYWSDQEQISRQWQVQQRFEPNLSADERAHRLSRWHRAVERARDWAREDHEATSGKRT

SEQ ID NO: 69608 - DNA, 1512 bp, Rubrobacter xylanophilus DSM 9941
  CDS (1)..(1512)
atggcgggcgagtacgtactggccatagaccagggcacgacggggaccacggtcttgatcttcgaccgggaggggcgggttgcgggccgggcctactcggagttcacgcagcactaccccaggccgggctgggtggagcacgacccgaacgagatctgggatgtctccatgcgggtcgtgggcgaggcgctgggggacgctaaggtctccgcccggcagctcgccgccatcgggataaccaaccagcgcgagaccaccgtgatgtgggaccggcgcaccggggagccggtggccaacgccatagtctggcaggacaggcgcaccgcgggcacctgcgaccggctcaaggacgaggggctcgaggagaccttccgcaaaaagacgggtctggtcatagacgcctacttctcgggcaccaaggtcaagtggtttctggacaacgtcgcgggcctcagggagagggccgggcgcggcgaggtcgccttcgggaccgtggactcctggctggtgtacaggctcaccggcggccgggcccacatcaccgactactccaacgcctcccggaccctcatgtacaacatctacgacctgcggtgggacgaggagctcctggagatcctcggggtcccggaaggggtgctcccggaggtcaagcccagctcccacgtctacggcgagaccgaccccggggccttcttccaggcctccgtgccggtggccggcatcgcgggcgaccagcaggccgcgctcttcgggcaggccgcctacgagcgggggctcgccaagaacacctacggcacgggctccttcgtgctgatgaacaccggcaacgaggccgtgccgagcaaggagggcctcctcaccaccatcgcctggggcatcggcgaggagcccgtggagtacgccctcgagggggccatcttcatcaccggggccgccgtgcagtggctgcgggacggtctggggatcatccggagcgccgccgagaccgaggagctggccaagagcgtgcagtccaacgacggggtctacttcgtcccggcgctcgtgggcctgggggcgccgcactgggacgcctacgcccgcgggacgatcgtcggcatcacccgcggcaccaccaaggcccacctggcgcgcgcggccctggagagcatgtgctaccagacgctcgacgtggtgcgcgccatggagcgcgactccgggatagagctcaaggagctcagggccgacggcggggccgtggccaactccttcctcatgcagttccagtcggacatcctcggcgtgccggtggaggtgccggagatcaccgagaccactgcgctcggctcggcgtacctggccggccttgcgaccggcttctgggagagccgggaggagctcgacgccaggtggcggctctcccggcgctacgagccctccatgcaggagggggagcgcgagcggctgcaccggaggtggctgcgggcggtggagcgctcccggggctgggaccgcgaggaggagggatga

SEQ ID NO: 69609 - protein, 503 aa, Rubrobacter xylanophilus DSM 9941
MAGEYVLAIDQGTTGTTVLIFDREGRVAGRAYSEFTQHYPRPGWVEHDPNEIWDVSMRVVGEALGDAKVSARQLAAIGITNQRETTVMWDRRTGEPVANAIVWQDRRTAGTCDRLKDEGLEETFRKKTGLVIDAYFSGTKVKWFLDNVAGLRERAGRGEVAFGTVDSWLVYRLTGGRAHITDYSNASRTLMYNIYDLRWDEELLEILGVPEGVLPEVKPSSHVYGETDPGAFFQASVPVAGIAGDQQAALFGQAAYERGLAKNTYGTGSFVLMNTGNEAVPSKEGLLTTIAWGIGEEPVEYALEGAIFITGAAVQWLRDGLGIIRSAAETEELAKSVQSNDGVYFVPALVGLGAPHWDAYARGTIVGITRGTTKAHLARAALESMCYQTLDVVRAMERDSGIELKELRADGGAVANSFLMQFQSDILGVPVEVPEITETTALGSAYLAGLATGFWESREELDARWRLSRRYEPSMQEGERERLHRRWLRAVERSRGWDREEEG

SEQ ID NO: 69610 - DNA, 1503 bp, Mesorhizobium sp. BNC1
  CDS (1)..(1503)
atgacagggtacattttggcgattgaccagggcacgacatcgagccgggccgtcatcttcgacggcgcgatgaagatcgtggcggtgggccagaaggaatttccgcagcactaccccgcctccggctgggtcgagcacgacccagaggacatctggaagagcgtcgtggcgacggtgaagacggcgctcaggaaagcgaagctggaggcctcccggatcaccgcgatcggcatcaccaaccagcgcgaaacggcggtaatctgggatagggcgaccggcatgcccattcacaacgccatcgtctggcaggaccgccgcaccgcccccctctgcgcgaagctcaagaaggccgggctggagccgaaattcacccgcaagacagggttgctgctcgatccttatttttccggcaccaaatttgcctggctgctggacaatgtcaaaggcgcgcgccggcgcgctgagaagggcgagcttctggccggcacgatcgacacgtatctcatttggcggctgacgggcggcaggatgcacgcaaccgacgcgactaacgcctcgcgcacgctgctctacaacatttcgaagaatgcctgggacgccgaccttctgaagatcctgcgcattccgacagcccttttgccggaagtgaaggactgcgcggcggagttcggggtgacggagaagaagatattcggcgccgagatcccgatccttggagtggccggcgaccagcaggcggccaccatcgggcaggcctgcttcgagcctggcatgctgaaatccacttacggcaccggttgcttcgccgtgcttaacacgggcgaaaggctcatccgctccaagaacaggctgctttccaccatcgcctatcggctcgacggcaagactacctatgcgctggagggctcgatcttcatcgcgggtgccgccgtgcagtggctgcgcgacgggatcaaggtgatcggcaaggccgcggagagcggagcgcttgcggagcgttcggacgaaacgcagcagatctatctcgtgccggcctttgtggggcttggcgcgccgcactgggacgccgatgcgcgcggcgcgattttcggactgacccgcaactcaggcccggcggaattcgcgcgcgcggctttggaatccgtcgcctaccagacccacgatcttctcgtggctatgaaaagggattgcggcaacaccttcggaaaaacggtgctgcgggtggacggcggcatggtcgcctccagctggactatgcagtgcctcgccgacattctcgacgcgccggtggatagcccgacaatcacggagacaaccgcgctgggggccgcctggcttgccggttccaaggccggcatctggcctgacagggcaacatttgccaagagctgggcgctcgagcgccgtttcgagcctcagatggatggcaggcagcgcaaggcgaagcttgccggctgggccgacgcggtatcgcgcacgttgacagcgcgtgcgccgtgctaa

SEQ ID NO: 69611 - protein, 500 aa, Mesorhizobium sp. BNC1
MTGYILAIDQGTTSSRAVIFDGAMKIVAVGQKEFPQHYPASGWVEHDPEDIWKSVVATVKTALRKAKLEASRITAIGITNQRETAVIWDRATGMPIHNAIVWQDRRTAPLCAKLKKAGLEPKFTRKTGLLLDPYFSGTKFAWLLDNVKGARRRAEKGELLAGTIDTYLIWRLTGGRMHATDATNASRTLLYNISKNAWDADLLKILRIPTALLPEVKDCAAEFGVTEKKIFGAEIPILGVAGDQQAATIGQACFEPGMLKSTYGTGCFAVLNTGERLIRSKNRLLSTIAYRLDGKTTYALEGSIFIAGAAVQWLRDGIKVIGKAAESGALAERSDETQQIYLVPAFVGLGAPHWDADARGAIFGLTRNSGPAEFARAALESVAYQTHDLLVAMKRDCGNTFGKTVLRVDGGMVASSWTMQCLADILDAPVDSPTITETTALGAAWLAGSKAGIWPDRATFAKSWALERRFEPQMDGRQRKAKLAGWADAVSRTLTARAPC

SEQ ID NO: 69612 - DNA, 1509 bp, Dechloromonas aromatica RCB
  CDS (1)..(1509)
atgcaagatcgttccgaccagttcgttctcgcgcttgaccagggaacgaccagcacacgcgccatcctgttcgggcggaagggcgatattcatggcgtcgcccagcaggaaatcacccagcattacccgcaacccgggtgggtcgagcacgacgctgaagaaatatggcaggcgcagcttgccgtggcgcgagcggcactccgcgataacggcatattggccaagcagatcgtcgctgtcggcatgaccaaccagcgggaaacgacggtgctttgggatcgatccagcggtgaaccgctgcaccgcgctatcgtctggcaggatagacgcaccgccgggctttgcgacgaattgacaacggccggccacgccgggctgttccgcgaacgcactggtctcgtactcgatgcctatttttccggcaccaagttaaagtggctgctcgaccacattcccggcgctcgctcccgggccgagcgtggcgaactggctttcggcaccatcgacagctggctgacctggaaactctccggcgggcgcgcccatgtcaccgacccgtcgaatgcctcgcgcaccctgctcttcgacatccaccgctgctgctgggatgaggaattactggccttgctcgacattccgatggcgctgctgccgcgcatcgtcgacagcagcggcgaaatcgccaccatcgccgccgaatggctgggcgccgagatcccgctcagtggcatcgctggcgaccagcaggcggccactttcggccaggtctgtctccagcatggcatggccaagaacacctacgggactggctgcttcttgctgatgaataccggccaagcccccatggcgtcctgccaccggctactgaccaccatcggctggcagcggcaagggaagaccacttacctgctcgaaggcagcgtcttcatgggcggtgccacagtacagtggttgcgcgacggcctcgggctgatctccagcgcggaccagatcgagtcgctggcagcgagcgtcgcggataacggcggtgtctacctggtgccggcccacaccggcctcggcgcgccatactgggacccgttcgcccgaggcgccttgttcggcatgactcgcggcaccacccgcgcccacatcgcccgtgccgcgctggaagccatcgcattccagagtgccgatgtgctgcaggccatggaaaaggatgccggtcaaagcctgagcgaacttcgcgtcgacggcggtgcggcacgaaacgacctgctgatgcagtttcaggcagatttgctcggcgtgcccgtggtgcggccgcaggtgaccgaaaccacggcgcttggtgccgcctatctggctggactggccgtgggtttctggcaagacgaggccgagctgacggcactgtggcgggccgaccggcgctttgagccgtccatggccgaggaccggcgcagtgcgctgttcgccgactggcaccgcgccgtcgaacgcagcctgcattgggcaaacgcgacatga

SEQ ID NO: 69613 - protein, 502 aa, Dechloromonas aromatica RCB
MQDRSDQFVLALDQGTTSTRAILFGRKGDIHGVAQQEITQHYPQPGWVEHDAEEIWQAQLAVARAALRDNGILAKQIVAVGMTNQRETTVLWDRSSGEPLHRAIVWQDRRTAGLCDELTTAGHAGLFRERTGLVLDAYFSGTKLKWLLDHIPGARSRAERGELAFGTIDSWLTWKLSGGRAHVTDPSNASRTLLFDIHRCCWDEELLALLDIPMALLPRIVDSSGEIATIAAEWLGAEIPLSGIAGDQQAATFGQVCLQHGMAKNTYGTGCFLLMNTGQAPMASCHRLLTTIGWQRQGKTTYLLEGSVFMGGATVQWLRDGLGLISSADQIESLAASVADNGGVYLVPAHTGLGAPYWDPFARGALFGMTRGTTRAHIARAALEAIAFQSADVLQAMEKDAGQSLSELRVDGGAARNDLLMQFQADLLGVPVVRPQVTETTALGAAYLAGLAVGFWQDEAELTALWRADRRFEPSMAEDRRSALFADWHRAVERSLHWANAT

SEQ ID NO: 69614 - DNA, 1482 bp, Rhodobacter sphaeroides 2.4.1
  CDS (1)..(1482)
atgaaccacatcctcgccatcgatcagggcaccacctcgtcgcgcgcgatggtcttcgacgaggccctcacgctgaagtcggtcgcgcaggaggaattcccgcagatctacccgcgcccgggctgggtcgagcacgacccctcggacctctggtcgagcgtcgccgccaccgcgcgggcggcggtcgagcgggccgagatcgacggcagcctcgcggcgatcgggatcaccaaccagcgcgaaaccgtcgtcgtctgggagcgtgcctcggggcatccgatccacaatgccatcgtctggcaggaccggcgcacggccgatctctgccatgccctggccgaggcagggcacgagcccacgatcaccgagcggacgggcctgctgctcgatccctatttctcggccaccaagctcaaatggctgctcgatcatgtggagggcgcccgcgcccgcgcgcggcggggcgagctgctgttcggaacggtggacagctacctgatctggaagctcaccggcgggcgcgcgcatgtgaccgacgccaccaatgccgcgcgcaccatgctcttcgacatcggccgcggcatctgggacccggagatttgcggccttctcgacattccgatggagatgctgcccgaggtccgggattgcgcggcccccttcggcatgacgcgcgcggatctcttcgggcgcgagatcccgatcctcggcgtggcgggcgaccagcaggccgccacctgcggccaggcctgcttccggcccggcatgatgaaatcgacctacggcaccggctgcttcgcgctgctgaacaccggcgaggagcgggtgacgagccgcgcgcggctgctgaccaccatcgcctatcagctcggcggcaagcgcacctacgcgctggagggctcgatcttcatagcgggcgccgtggtgcaatggctgcgcgacgggctgaagatcatccgtgaggcgggcgagacgcagggcctcgccctctcctcggacgcggcgcaggatctggtgatcgtgcccgccttcaccggcctcggcgcgccctggtggaagcccgagagccgcggcgcggtcttcggactcacccgcaactcgggccctgcggaattcgcccgcgccgcgctcgaaagcgtgggctaccagacgcgcgacctgctcgaggcgatgcgggcggactgggcggcgggggccgagggcgtgctgcgggtcgatggcgggatggcggcctcggactggtcgttgcagtttctggccgacatcatcggcgcgccggtcgaccggccggtggtgcgcgagacgacggcgctcggtgtcgcgtggctcgcggggatgcaggcggggctctgcccggggccggaggagttcgcggccgactgggcgctggagcgacggttcgagccgcaaatggaggcgtcggtgcgcgaggcgaaatacgaccgttggggtcgggccgtgcgcgcggtgatggcggtatga

SEQ ID NO: 69615 - protein, 493 aa, Rhodobacter sphaeroides 2.4.1
MNHILAIDQGTTSSRAMVFDEALTLKSVAQEEFPQIYPRPGWVEHDPSDLWSSVAATARAAVERAEIDGSLAAIGITNQRETVVVWERASGHPIHNAIVWQDRRTADLCHALAEAGHEPTITERTGLLLDPYFSATKLKWLLDHVEGARARARRGELLFGTVDSYLIWKLTGGRAHVTDATNAARTMLFDIGRGIWDPEICGLLDIPMEMLPEVRDCAAPFGMTRADLFGREIPILGVAGDQQAATCGQACFRPGMMKSTYGTGCFALLNTGEERVTSRARLLTTIAYQLGGKRTYALEGSIFIAGAVVQWLRDGLKIIREAGETQGLALSSDAAQDLVIVPAFTGLGAPWWKPESRGAVFGLTRNSGPAEFARAALESVGYQTRDLLEAMRADWAAGAEGVLRVDGGMAASDWSLQFLADIIGAPVDRPVVRETTALGVAWLAGMQAGLCPGPEEFAADWALERRFEPQMEASVREAKYDRWGRAVRAVMAV

SEQ ID NO: 69616 - DNA, 1542 bp, Burkholderia cepacia R18194
  CDS (1)..(1542)
atgaccgcttcccgaaacgtcattctcgccatcgacgaaggcacgtccggcacacgtgccgcgcttgtcgacgcgagtgggcacgtgtcgtgccttgaatacctgccgctgtcggtcgacagcccgcggccgggcgtcgtcgaacaggatgcgaatgccatcctcgacaagacgctcgcggtctgccgcgccacgctcgcgcatgcgcagcgaatgggggtacgcgtcgtcgcgctggcgctcgcgacgcagcgcgcgaccgccgtgctgtgggatacgcggaccgggcgcgcactcgtgcccgcgatggtctggcaggacacgcgtcatgccgccgagctcgaccgtctcgcggccgactgggatcgcgtgctcgtgccgcaggtcggccggccggccggcgtgcgttcgccgtatctgtgggccgtgcaccagatgcgctcgtcgcgggcggtcgccgatgcgcatcgtgccggctgtctcgcgttcggcacgatcgatacgtggctgctgtggcacctgtcggatgcgcgcgagtgcgtgacgacgccgaccaacgcaacctccgccagcgcgtacctgctcggcgagcatcggtatttcgatccgtggctcgaggcattgggtttcccgcacgcgttgttgcccgcgctgcgcgaggatgccgacgcgttcggccgcacgcgcgaagacgtgctcggtatcggcgtaccgatcctcgcgtgtgcgggcgaccagttcgcgggcgccgtcggtctcggctgcgtcgagcgtggccaggcgatgtgcgtgcatggcaccggcagcttcgtcgacctgttgaccggcacggtacgccccgacgccggatcgcacgcacaacccggtcacgcgcacgacggcacgctggcgatgaccgcgcggcggcatggcggcgtgtcgcattactcgctcgaaaccttcgtcgcgacgaccggctcggcgttgcgctgggtctgcgaaaaactgcgctggttcgacgatccggcgcagatcagcacgctggccggcacggtgcaatcggcgcgcggcgtgacgttcgtgccggcgctcaccggcctgcgtgtgccgcggatggagccgaacgcgcgtgcgctgctgtcgggcatctcgatcgcgacgacgcaggccgaggtggcgtacgcggtgctcgaaggcatcgcgcattcggtcgcgtcgtgcatggaggccaaccaggccgtcgcgcgggccgacgtatcggagctgatcgtcggcggcggcctcgcgggcagcgacacgctgctgcagatccaggccgacgtgagcggcgtacccgtgcgccggatgcgcgagggcgatcgcgcgagcctgcgcggtgcggcgtttctcgcgggtgcgtcggggctgttgtgggattcgctcgacgcggcccgcgcgacgctcgtcaccgacgccgttttcgaaccctcgatcgatgcggacagccggcagcgccggcgcgcggcctggcatgcgcggatcgcatccgagctcgcgcacgcggccgatttcgctcatgcgtga

SEQ ID NO: 69617 - protein, 513 aa, Burkholderia cepacia R18194
MTASRNVILAIDEGTSGTRAALVDASGHVSCLEYLPLSVDSPRPGVVEQDANAILDKTLAVCRATLAHAQRMGVRVVALALATQRATAVLWDTRTGRALVPAMVWQDTRHAAELDRLAADWDRVLVPQVGRPAGVRSPYLWAVHQMRSSRAVADAHRAGCLAFGTIDTWLLWHLSDARECVTTPTNATSASAYLLGEHRYFDPWLEALGFPHALLPALREDADAFGRTREDVLGIGVPILACAGDQFAGAVGLGCVERGQAMCVHGTGSFVDLLTGTVRPDAGSHAQPGHAHDGTLAMTARRHGGVSHYSLETFVATTGSALRWVCEKLRWFDDPAQISTLAGTVQSARGVTFVPALTGLRVPRMEPNARALLSGISIATTQAEVAYAVLEGIAHSVASCMEANQAVARADVSELIVGGGLAGSDTLLQIQADVSGVPVRRMREGDRASLRGAAFLAGASGLLWDSLDAARATLVTDAVFEPSIDADSRQRRRAAWHARIASELAHAADFAHA

SEQ ID NO: 69618 - DNA, 1503 bp, Burkholderia cepacia R18194
  CDS (1)..(1503)
atgcaggatcagtacatcctcgcgcttgaccagggcaccacgagttcccgcgcgatgctgttcgatcgccagggcaatatcgtttcgatcgcccagaaggaattcgagcagatctacccgcaacccggctgggtcgagcacgatccgcaggaaatctggtcgacgcaagccggcgtcgccgccgaagccgtcacgcgcacgggcctgaacggcacgtcgatcgccgcgatcggcatcaccaaccagcgtgaaaccacgatcgtctgggatcgcgagacgggccagcccgtctacaacgcgatcgtctggcaggatcgccgcacggccgacttctgcgattcgctgaaagcacagggcttcgaggcgaaggtgcgtgcgaagaccggcctgccgatcgattcgtacttctcagggaccaagatccgctggattctcgacaacgtgccgggcgcacgcgagaaggcgaagcagggcaagctcgcgttcggcaccgtcgacagctggctcgtgtggaacttcacgaagcacgaactgcacgtgaccgacgtgacgaacgcgtcgcgtacgatgctgttcaacatccacacgcgcgagtgggacaacgaactgctcgacatgctcgacatcccgcgcagcatgctgccggaagtgaaggcgtcgtcggaaatctacggccatacgaagaccaccgtgttcgcgtcgaagatcccgctcgcgggtatcgcgggcgaccagcaggcggcgctgttcggccagatgtgcacgcagtccggcatggtgaagaacacctacggtaccggctgcttcctgatgatgaacaccggcgacaagccgatcgaatcgaagaacaacctcgtcacgacgatcgcgtggcagatcggcgacaacgtgcagtacgcgctggaaggcagcatcttcatcgcgggcgcggtggtgcagtggctgcgcgacggcgtcggcatcatcaagtcggccgccgagatcgaagcgctcgccgcaagcgtgccgcacaccgacggcgtctacctggtgcccgccttcgccggcctcggcgcaccgcactggaacgcgcgggcgcgcggctcggtgttcggcgtcacgcgcggcacaacctccgcgcacctcgcacgcgcggcgctcgattcgatcgcgtaccagtcgctcgacgtgctggccgcgatggaagccgattcgggcatcagcatcggcgagctgcgcgtcgacggcggcgcgagcgcgaacgacctgctgatgcagttccaggcggacctgctcggcgttgacgcggtgcgtccgcagatcaccgagacgaccgcgctcggcgcggcctacctcgcgggcctcgcgatcggctactggaagagcctcgacgacgtgcgcgaccagtggcagctcgatcgccgcttctcgccgtcgatgccgaaggagcacgtcgaacgctgcatgtcgggctggcagcgtgcggtgcgtgccgcgaaggcatgggccgacgacgcccagtaa

SEQ ID NO: 69619 - protein, 500 aa, Burkholderia cepacia R18194
MQDQYILALDQGTTSSRAMLFDRQGNIVSIAQKEFEQIYPQPGWVEHDPQEIWSTQAGVAAEAVTRTGLNGTSIAAIGITNQRETTIVWDRETGQPVYNAIVWQDRRTADFCDSLKAQGFEAKVRAKTGLPIDSYFSGTKIRWILDNVPGAREKAKQGKLAFGTVDSWLVWNFTKHELHVTDVTNASRTMLFNIHTREWDNELLDMLDIPRSMLPEVKASSEIYGHTKTTVFASKIPLAGIAGDQQAALFGQMCTQSGMVKNTYGTGCFLMMNTGDKPIESKNNLVTTIAWQIGDNVQYALEGSIFIAGAVVQWLRDGVGIIKSAAEIEALAASVPHTDGVYLVPAFAGLGAPHWNARARGSVFGVTRGTTSAHLARAALDSIAYQSLDVLAAMEADSGISIGELRVDGGASANDLLMQFQADLLGVDAVRPQITETTALGAAYLAGLAIGYWKSLDDVRDQWQLDRRFSPSMPKEHVERCMSGWQRAVRAAKAWADDAQ

SEQ ID NO: 69620 - DNA, 1464 bp, Listeria monocytogenes str. 1/2a F6854
  CDS (1)..(1464): transl_table=11
atgaagaaacactatcaaatagccattgatcaaagcacatctggtacgaaagtattattgtttaaagaaggcaaacttgtagatcgtttagataaaaagcatcgacagttgtatccaaagaaaggctgggtggaacataatcccatcgaaatttgtcaaaatgtccgtacattaattgcggacatcttgacaaaacatgatttaattacagcggatatcgagcgacttgctttgacgaatcaacgggaaacaattgtagcttgggataaacaaacggggaagccactttataatgcgattgtatggcaatgtaatcgaacaaaagaaatttgcgaaacgttaaaagaagctggttatgaaaaaagaattaaacagcttaccggactgaaaattgattcttatttttctgcttctaaaatgatgtggttattggaaaatatttcagcggtgcgggatgcagcaagtcgtaatcaattggcatttggcacaatggacgcttggttgttattttcacttacggatgatagtaattatttcacagaccgaacaaatgctagccgcacactcctttatgatattgaaaaaaatgattggtcagatgagttactcgaacttttcggagtcaaacgtgcttatttaccagaagtgaaacaatctgctggaagttttggaagttatcaggagataccaattcatagtgtgatggctgattcagaagcggcactttatggacaaggctgtgatacatttggggcagtgaaggcgacgcttgggacaggatgctctgttatgatgcaaattggtgagaacagattacctgaaaacgatgctattttgacaactcttgcctgggatgttgcaggcgtgaaccagtttgcgttagaagggattattcgttcttgtggagacacattggtttttttatccgaacaattagaactatttaatgattacgatacagcttgtaagcgagcatttcaattaccatgcaatgagggtgttgtgctaattcctggacaattaggtttaggcgccccttattggaatacagatatacgagcagagattcttggcctcacgcgagaacatacaaaatggcatattattcgtgccggttttacaagtattgcatttcaaattaaggctgttattgaccaaatggagttaatgataggtcaaaatattaagcgcttacaagtagacggtgggttaacaaagcaacatgaattgatgcaatatttagctgatgttttaaaagcagaagtggcagtcagtcccgtggaagaactttcggcaattggtgctattgaaattgccgacaataacctacaaaataagagaacgatagcaaaattgtaccaaccaaatatcactcatacacatgctctggaagattttcaagaatgggaaaaacaagtgaaaagcagtattctaaaattacagaaggtgaggaattttaaatga

SEQ ID NO: 69621 - protein, 487 aa, Listeria monocytogenes str. 1/2a F6854
MKKHYQIAIDQSTSGTKVLLFKEGKLVDRLDKKHRQLYPKKGWVEHNPIEICQNVRTLIADILTKHDLITADIERLALTNQRETIVAWDKQTGKPLYNAIVWQCNRTKEICETLKEAGYEKRIKQLTGLKIDSYFSASKMMWLLENISAVRDAASRNQLAFGTMDAWLLFSLTDDSNYFTDRTNASRTLLYDIEKNDWSDELLELFGVKRAYLPEVKQSAGSFGSYQEIPIHSVMADSEAALYGQGCDTFGAVKATLGTGCSVMMQIGENRLPENDAILTTLAWDVAGVNQFALEGIIRSCGDTLVFLSEQLELFNDYDTACKRAFQLPCNEGVVLIPGQLGLGAPYWNTDIRAEILGLTREHTKWHIIRAGFTSIAFQIKAVIDQMELMIGQNIKRLQVDGGLTKQHELMQYLADVLKAEVAVSPVEELSAIGAIEIADNNLQNKRTIAKLYQPNITHTHALEDFQEWEKQVKSSILKLQKVRNFK

SEQ ID NO: 69622 - DNA, 1500 bp, Rubrivivax gelatinosus PM1
  CDS (1)..(1500)
atgacctacctgctcgccctcgaccagggcacctccagctcgcgcagcatcgtgttcgaccgcggaggccgcatccgcgcgatggcgcagcgcgagttccgccagctctacccgcaaccgggctgggtggagcacgacccgatggagatctgggagacccagctcgccacggcccgcgaggcgctggcccaggcggggttgacggcgtccgacatcgcggccatcggtatcaccaaccagcgcgagaccacgctgctgtgggaacgtgcgagcggccggccgatcgccaacgccatcgtctggcaggaccgccgcaccgagcccctgtgcgcgcgctggcgcgagcagggtctggccgatgcggtgcgcgacgtgaccggcctggtcatcgacccctacttctcggccagcaagatcgcgtggctgctcgaccacgtgccgggcgcccgcacgcgagccgagcgcggcgagctggccttcggcacggtggacagctggctgctgcggcagctgaccggcggccgtgtgcacgccaccgacaccaccaacgcctcgcgcacgatgctgttcgacatcgaccgcggcgcctggagcgagccgctgctggcggcgctggacatcccgcgcgcgctgctgccggcagtgcagcagtctgcctcgcatttcggcgacaccgagcccgcgctgctgggccatgccgtgccggtgtgcggcatcgccggcgaccagcaggccgcgctgttcggccaagccggcttccaggccgggctggcgaagaacacctacggcaccggctgcttcctgctgatgcacaccggcgcacagcggcaggcctcgacccacggcctgatcaccaccgcggcggcgcaggtggacagcacggcaccgcgccagtacgcgctggagggcagcgtgttcatcggcggcgcggtggtgcagtggctgcgtgatggcttgcacgcgatccgcggcagcggcgaggtgcaggcgctggccgagagcgtgcccgacgccggcggcgtggtggtggtgccggccttcaccggcctgggcgccccctactggcggccggaggccagcggcgcgatcgtcggcctgacgcgcggcagcacggtggcccacatcgcgcgcgcggcgctggagagcatcgcgttccagagcgcggcgctgctcgacgcgatgagccgcgacgcggtggccgccggcgggcagccggtcagcgagctgcgcgtcgacggcggtgcctgcgtcaacgacctgctgatgcagttccaggccgacctgctgggcattccggtcgtgcggccgcaggtgatcgagaccacggccctcggcgcggcgtgcctggccggactgggctgtggcctctacgccggcaccgacgagctggcggcgcagtggcaggccgagcgacgcttcctgccgacgatgccgcgcgagcgcgcggcggagcggatggcgcgctgggaacgcgcggtgcgccagacggtcgctccctga

SEQ ID NO: 69623 - protein, 499 aa, Rubrivivax gelatinosus PM1
MTYLLALDQGTSSSRSIVFDRGGRIRAMAQREFRQLYPQPGWVEHDPMEIWETQLATAREALAQAGLTASDIAAIGITNQRETTLLWERASGRPIANAIVWQDRRTEPLCARWREQGLADAVRDVTGLVIDPYFSASKIAWLLDHVPGARTRAERGELAFGTVDSWLLRQLTGGRVHATDTTNASRTMLFDIDRGAWSEPLLAALDIPRALLPAVQQSASHFGDTEPALLGHAVPVCGIAGDQQAALFGQAGFQAGLAKNTYGTGCFLLMHTGAQRQASTHGLITTAAAQVDSTAPRQYALEGSVFIGGAVVQWLRDGLHAIRGSGEVQALAESVPDAGGVVVVPAFTGLGAPYWRPEASGAIVGLTRGSTVAHIARAALESIAFQSAALLDAMSRDAVAAGGQPVSELRVDGGACVNDLLMQFQADLLGIPVVRPQVIETTALGAACLAGLGCGLYAGTDELAAQWQAERRFLPTMPRERAAERMARWERAVRQTVAP

SEQ ID NO: 69624 - DNA, 1494 bp, Rhodospirillum rubrum
  CDS (1)..(1494)
atgattatccgcgatgacctgatcctggccatcgaccagggcacatcgggaacgcgcgccttgttgttcgaccagcacgggccggtccatagcggcggccggctggcgctggcgcccacccatccgcgcgacggttgggtcgagatcgatcccgaggatatctggctcgacgtgctgaccgcttggcgtcaggtcctcgaaggcagcggcgccgatcacgtcaccgccatcgccctggccacccagcgcgacaccaccatcgtctgggaccggcgtaccggcaagccggtctataacgccatttcctggcttgatcggcggggcgcggcgcgctgccgggagttggtggagaccggctatgaaagcttggtgcgggtgcgcagcggtctggtcgtcgacagcgcctttgccgccaccaaggtggcctggatccttgagaacgtcgagggcgcccgggcggcggccgaagccggccatctcgccttcggcaccgtcgacagctttctgctgtggcgattgaccggcggcgccgttcacgccaccgacgcgtcgaacgccagccggacgatgctgttcaacatccatagccagcgctgggacgccgatctgctggcgttgtttggcgttccctggcagatgatgcccgaggtgcgcgacagcgcctgcgtttttggccatacggaccgcgccggcttcggccggccgattccgatcgccgcgatgatcggcgatcaaagcgccgccctgatcggccagggctgcctgacgccgggcatgatcaaggccggaatgggggcgagttgcgtgatgatcgccaataccggaccgacggcgctggcctcccgccacggcctgctgacctcgatcgcctatcggctcgacggcgaggtcacctatgcgctggaagggacggtcttcagcgccggggcggcgatcggctggctgagcgaaagcctgggggtgatcgaacgccccgagatcaccgagcttctggcccgcgggatgaaaggcaatcgcggggtgtacatggttccggccttcagcggcctgggcgccccctattgggatccgggggctcggggggccattttcggcctgtcccatgacacgggggttcccgaactggcgcgcgccgccctggaaagcgtcgcctatcaggcctacgacctgctcgaggcgatgatcgccgatggcctgcccaggccagcggtgctgcgggtcgaaggggcgatgagcgccaatgactggctgctgtcgtttctggccaatatccttgaggtgccggttgaacgaccggccatcgccgagacggcggccatgggcgccgccctgctggcgggggtccaccttgggctgtatggctcgctcgacgcggccggcaacgcctgggagggcaatgggcgttttgacccggcgatcgatccggcctatcgccgtcaactgcttgacggctggcgcaaagccgtcggacgggttcaggagtcggcgccatga

SEQ ID NO: 69625 - protein, 497 aa, Rhodospirillum rubrum
MIIRDDLILAIDQGTSGTRALLFDQHGPVHSGGRLALAPTHPRDGWVEIDPEDIWLDVLTAWRQVLEGSGADHVTAIALATQRDTTIVWDRRTGKPVYNAISWLDRRGAARCRELVETGYESLVRVRSGLVVDSAFAATKVAWILENVEGARAAAEAGHLAFGTVDSFLLWRLTGGAVHATDASNASRTMLFNIHSQRWDADLLALFGVPWQMMPEVRDSACVFGHTDRAGFGRPIPIAAMIGDQSAALIGQGCLTPGMIKAGMGASCVMIANTGPTALASRHGLLTSIAYRLDGEVTYALEGTVFSAGAAIGWLSESLGVIERPEITELLARGMKGNRGVYMVPAFSGLGAPYWDPGARGAIFGLSHDTGVPELARAALESVAYQAYDLLEAMIADGLPRPAVLRVEGAMSANDWLLSFLANILEVPVERPAIAETAAMGAALLAGVHLGLYGSLDAAGNAWEGNGRFDPAIDPAYRRQLLDGWRKAVGRVQESAP

SEQ ID NO: 69626 - DNA, 1488 bp, Rhodospirillum rubrum
  CDS (1)..(1488)
atgccctttcttcttgccatcgaccagggaaccaccagcagccgggccatcgttttcgatcacgagggccagccgatcgcccgggcccaaaaggacctggtccagtatttccccggcgatggctgggttgaacacgacgcgacggcgatctgggaagacagcttggcggtggcccgcgaggcgctggaccgggccgatgtcgccgcccatgccatcagcgccatcggcctgaccaatcaacgcgaaaccgccgtgctgtgggagcgcgccagcggccagccggttcataacgccatcgtctggcaagatcgccgcacggcggcgctgtgccgcgaactgaaggcccagggccatgaggcgctggtgcggcgcaagaccggcctgctgatcgatccctatttctcggccaccaagatcggctggatgcttgatcacgatccggtgttgcgccggcgggccgaagccggcgagctggcgttcggcacggtcgaatcctggctgctctataagctgaccggcggcgccgtccacgccagcgacgccacgaacgccgcccgcaccttgctgttcgacatccgcgccaaccgttgggacgaggatcttctggcgctgtttcgcatccccgccgccctgctgccccgggtggtcgataacgccgggcgctttggcgaaaccctgcccgggctgttcggcgcgccgatcccgatcaccggcatggccggcgaccagcatgccgccatggtcggccagggctgcttcacccggggcatgatcaaatcgacctatggcaccggcgccttcgccctgctcaacatcggccagaccttcgtcgaaagccgcaatcaattgctgaccaccctggcctaccggctgaatggccagagcacttatgccctggaaggctcgatcttcgtcgccggggcggcggtgcaatggctgcgcgacgggttgcgggcgatttccagcgccgccgaaacccaggtcctggccgaagccgtggccgatacgggcggctgctatatggttccggccttcaccggcctcggcgccccctattgggacccggaggcgcgcggcgccatccttggcctgacgcgcgacacctcgcttgaacaggtcgcccgcgccgccctggaggcccagggctatcaaacccgcgacctgctcgatgccatggccgccgacagcggcaccaagccgctggccctgcgcgtcgatggcggcatggtcgctaatgattgggtctgtcagttcctggccgatatcaccggcatcgccgttgaacgcccgcgggtgatcgaaaccacggcgctgggcgccgccgccctggccggcctgggagcgggggtcttcgccagcccggccgaccttggcggccaatggcaccgcgaccgcctgttcaccccgcatatgcccgccagccgccgcgaaagcctgtacgccggctgggtccaggcggtgcgccgggtggccagcgatctgcggtaa

SEQ ID NO: 69627 - protein, 495 aa, Rhodospirillum rubrum
MPFLLAIDQGTTSSRAIVFDHEGQPIARAQKDLVQYFPGDGWVEHDATAIWEDSLAVAREALDRADVAAHAISAIGLTNQRETAVLWERASGQPVHNAIVWQDRRTAALCRELKAQGHEALVRRKTGLLIDPYFSATKIGWMLDHDPVLRRRAEAGELAFGTVESWLLYKLTGGAVHASDATNAARTLLFDIRANRWDEDLLALFRIPAALLPRVVDNAGRFGETLPGLFGAPIPITGMAGDQHAAMVGQGCFTRGMIKSTYGTGAFALLNIGQTFVESRNQLLTTLAYRLNGQSTYALEGSIFVAGAAVQWLRDGLRAISSAAETQVLAEAVADTGGCYMVPAFTGLGAPYWDPEARGAILGLTRDTSLEQVARAALEAQGYQTRDLLDAMAADSGTKPLALRVDGGMVANDWVCQFLADITGIAVERPRVIETTALGAAALAGLGAGVFASPADLGGQWHRDRLFTPHMPASRRESLYAGWVQAVRRVASDLR

SEQ ID NO: 69628 - DNA, 1542 bp, Ralstonia metallidurans CH34
  CDS (1)..(1542)
atggaacgcatgacatccacgacatctcatcagccgcagtacgtgctggccctggatcagggcaccagcagttcgcgcgccatcctgttcgatcacctgggcaatgtcgtacgcatcgcccagcgtgagtttcggcaatattatccgcatcccggccacgtcgagcacgacccctatgagatctggcagtcgcaactggccgtggcgcacgaggtactgggcgacgcgggcgtcagcggcacgcagatttctgccatcggcatcacgaaccagcgcgaaaccacggtgctgtgggatcgcaagaccggtgaaccggtgggccgcgcgctggtctggcaagaccgccgcaccgcaccgatgtgcgaggacctgcaggcagcgggccacgcggagacatttcagcgcaagaccggactgatcgtcgacgcctatttctccggcaccaaactgcgctggatgctcgacaactacgagggcgcccgcgcacgcgccgagcgcggcgagttggcctttggcaccgtcgatagctggctgatctggcagttgaccgatggtgcgcggcacgtcaccgacgtttccaatgcttcgcgcacgatgctgttcaacatccacgatttccgctgggacgatgaactcctgggcctgctggatattccgcgcaacctgctgccggaagtggtgccgtcgagcggcgaggtcgcgcgcgcatcggcacggctgttcggcgtggagattccgattgccggcatcgccggcgaccagcaggccgccacgtttggccaagcttgcctgcggccgggcatggccaagaacacctatggcaccggctgcttcatcctgatgaacaccggcgacaaacccgtaacatcgcacaaccggctgatcacgaccatcggctggcagatcggcggcaatacccagtactgtctggaaggcggcgtattcatgggcggcgcgacgatccagtggctgcgcgacggcctcaagctgatccacagcgcccccgaggtagagcctctggcccgccagtgcaccgacaccggcggcgtggtgctggtgccggcattcgccggcctcggcgcgccgcactgggatccgttcgcacgcggcacgttggtcggcatcacgcgcggtaccggcgggccgcacatcgcccgggccgcgctcgaatccatcgcgctgcagagcgtggatgtgctcgacgccatgcagaaggacgccggcatctcgctggccgaactccgggtcgatggcggtgcctcgcgcagcgacctgctgatgcagatgcaggccgacctgctcggcaccgtcgtggtccggccgcgcgtgaccgaaaccaccgcgctaggcgcggcatatctcgccgggctggcaactggttactggaccgaccccgaagaaatcacgcggcagtggcaggtggagcagcgcttcgagccgaagctgtccgccgacgaacgcgaacgccgcattgcgcgttggcaccgcgccgtcgaccgcgcccgcgactgggcgcgcgagtccgatgacgccgcacgctga

SEQ ID NO: 69629 - protein, 513 aa, Ralstonia metallidurans CH34
MERMTSTTSHQPQYVLALDQGTSSSRAILFDHLGNVVRIAQREFRQYYPHPGHVEHDPYEIWQSQLAVAHEVLGDAGVSGTQISAIGITNQRETTVLWDRKTGEPVGRALVWQDRRTAPMCEDLQAAGHAETFQRKTGLIVDAYFSGTKLRWMLDNYEGARARAERGELAFGTVDSWLIWQLTDGARHVTDVSNASRTMLFNIHDFRWDDELLGLLDIPRNLLPEVVPSSGEVARASARLFGVEIPIAGIAGDQQAATFGQACLRPGMAKNTYGTGCFILMNTGDKPVTSHNRLITTIGWQIGGNTQYCLEGGVFMGGATIQWLRDGLKLIHSAPEVEPLARQCTDTGGVVLVPAFAGLGAPHWDPFARGTLVGITRGTGGPHIARAALESIALQSVDVLDAMQKDAGISLAELRVDGGASRSDLLMQMQADLLGTVVVRPRVTETTALGAAYLAGLATGYWTDPEEITRQWQVEQRFEPKLSADERERRIARWHRAVDRARDWARESDDAAR

SEQ ID NO: 69630 - DNA, 1521 bp, Ralstonia metallidurans CH34
  CDS (1)..(1521)
atgaaaaacaggaacgtcatcctggcgatcgacgaaggcacgtctggtacgcgtgccgcggtggttgccagcgacggccacgtctcgtgtcagcagtacaccacgctgcaggtggattcaccgcgtcccggcgtggtggagcaggacgccaacgtgctgctggaaaagacactggaagtctgccgcgccacgctggccgaagccgaacgcaacgacttgtgcatcgtcgcgctggccatcgccacgcagcgctccaccggcgtgctgtgggacaccgtaacggggcgtgcgctggtgcccgcaatggtctggcaggacacgcggtacgcggcggacctcgatcagatggcatccacgtgggacccgcgcttgcgcgccaccgttggtcgtccagccggcgtgcgctcggcttacctgtgggccgcgcgacatctgcgggagacgcgcgccgtcgccgatgcgtggcgcgatcgccggcttgcgttcggcaccgtcgatagctggctgctgtggcacctgtccaccgaacgcgcgtgtgtgaccacaccgacgaatgccacatcgtgcagtgcctatgttcttggtgaacaccgctacctgacggagtgggtcgaggcgctcggattcccgcaagagttgctgccagagttgcgccaggatgccgacgacttcgggcgcacgcgccgcgacctgcttggcgtcgacgtgccgatcctcgcctgcgcgggcgaccaactggcgggcgcagtcggcctcggttgtctcgacgccggccagtcgatgtgcctgcacggcaccggcagctttgttgatctcgtcatcggcccggacctgcccgagcgcagcgggcagtcggacagcacgctgacgatgacggcacgtcgcttcgagggggtttcgcacttttcggtggaaacgttcgtggctactaccggctcggcgctgaactgggtttgcgacaagctgcactggttcgaaagcgcgaagcagatcagcgcattggctgcgtcggtgccgtcatcgcgcggcgtgacgttcattcccgcgctgacgggcttgcgtgtgccgcagatgcggcccgaggcgcgcgctgcgttgaacggggtgtcgatggccaccactcaggcggagatcgcctacgcaatcctggaaggcatcgcgcattccgtggcgtcctgcatcgatgccaaccgcgatattgccggcgtgccggtgcgtgatctcgtcgtcggcgggggattgtcgggcagcgacgcgctgctgcagatgcaggctgaccttacgggcctgccgattcatcggatgcaggagaccgaccgggccagcctgcgtggcattgcctatctggctggcgcatcggggctgatgtgggattcgctgcagcaagcccgcaccaccacgttgccggatgcggtgttcatgccgcgcatcggcgacgacgaacgggaggaacggcgtgcgctctggcacgcgcgtgtcgcttccgagctttcccacgtgcaggcatttgccgcgcattga

SEQ ID NO: 69631 - protein, 506 aa, Ralstonia metallidurans CH34
MKNRNVILAIDEGTSGTRAAVVASDGHVSCQQYTTLQVDSPRPGVVEQDANVLLEKTLEVCRATLAEAERNDLCIVALAIATQRSTGVLWDTVTGRALVPAMVWQDTRYAADLDQMASTWDPRLRATVGRPAGVRSAYLWAARHLRETRAVADAWRDRRLAFGTVDSWLLWHLSTERACVTTPTNATSCSAYVLGEHRYLTEWVEALGFPQELLPELRQDADDFGRTRRDLLGVDVPILACAGDQLAGAVGLGCLDAGQSMCLHGTGSFVDLVIGPDLPERSGQSDSTLTMTARRFEGVSHFSVETFVATTGSALNWVCDKLHWFESAKQISALAASVPSSRGVTFIPALTGLRVPQMRPEARAALNGVSMATTQAEIAYAILEGIAHSVASCIDANRDIAGVPVRDLVVGGGLSGSDALLQMQADLTGLPIHRMQETDRASLRGIAYLAGASGLMWDSLQQARTTTLPDAVFMPRIGDDEREERRALWHARVASELSHVQAFAAH

SEQ ID NO: 69632 - DNA, 1500 bp, Burkholderia fungorum LB400
  CDS (1)..(1500)
atgcaggatcagtacattctcgcgcttgaccaaggcaccaccagctcgcgcgcgatgctgttcgaccggctcggcaatatcgtgtcgaccgcccagaaggaattccagcaaatctacccgcgtccgggttgggtcgagcacgatccgcaggaaatctggtcgacccaggccggcgtcgccgccgaggccgtgacgcgcgccggcatgaacggcacctcgatcgccgcgatcggcatcaccaatcagcgcgaaaccaccatcgtatgggatcgcgaaaccggccatcccatctataacgcgatcgtctggcaggaccgccgcactgcggacttctgcgaccagctcaaggagcaggggctcgaagaaaaagtccgcgcgaaaaccggcctgccgatcgattcgtatttctcggcgaccaagatccgctggattctcgacaacgtcgaaggtgcgcgcgaaaaagccaaacaggggcgtcttgcgttcggcaccgtcgatagctggctggtgtggaatttcaccaagggcggcctgcatatcaccgacgtcaccaacgcgtcgcgcacgatgctgttcaacatccactcgctgaagtgggacgacgaactgctcgaagcgctcgacattccgcgcagcatgctgccggaagtgcgcgcttcgtcggaaacgtatgggccgaccaagaccaccgtgttcgcttcgaagattccgctcgcgggcattgccggcgatcagcacgccgcgctcttcggccagatgtgcacggagtcgggcatggtgaagaacacctacggcacgggctgcttcctcgtgatgaacaccggcgacaagccgatcgaatcgaagaacaatctcgtcaccacgatcgcgtggcagatcggcgaccagatcaattacgcgctggaaggcagcatcttcattggcggcgccgtggtgcagtggctgcgcgacggcctcgggatcatcaggaacgccgctgaaatcgaaacgctggcgcgcagtgtgccgcattgcgacggcgtgtatctggtgccggccttcgccggtctcggcgcgccgcactggaatgcgcgcgctcgcggcacgctgttcggcgtgacgcgtggcacgtcgtcggcgcatatcgcacgcgcggcgctcgactcgatcgcttatcaatcggtcgacgtactgaaggcgatggaagccgactccggcattcgcatcggcgaattgcgggtggacggcggcgcctgcgcgaacaatctgctgatgcaattccaggcggacattctcggcgtcgacgccgtgcgtcccaaggtgtcggaaacgacagcattgggtgccgcttatctggccggtctcgcggtgggttactggaaagatgtcgacgagctgcaaagccagtggaaactcgaccgccgcttcacgcctgccctgccgcacgccgaggtcaaggcatgcctcgacggctggaagcgcgcgatccgcgccgcgaaggcgtgggccgatacaccctga

SEQ ID NO: 69633 - protein, 499 aa, Burkholderia fungorum LB400
MQDQYILALDQGTTSSRAMLFDRLGNIVSTAQKEFQQIYPRPGWVEHDPQEIWSTQAGVAAEAVTRAGMNGTSIAAIGITNQRETTIVWDRETGHPIYNAIVWQDRRTADFCDQLKEQGLEEKVRAKTGLPIDSYFSATKIRWILDNVEGAREKAKQGRLAFGTVDSWLVWNFTKGGLHITDVTNASRTMLFNIHSLKWDDELLEALDIPRSMLPEVRASSETYGPTKTTVFASKIPLAGIAGDQHAALFGQMCTESGMVKNTYGTGCFLVMNTGDKPIESKNNLVTTIAWQIGDQINYALEGSIFIGGAVVQWLRDGLGIIRNAAEIETLARSVPHCDGVYLVPAFAGLGAPHWNARARGTLFGVTRGTSSAHIARAALDSIAYQSVDVLKAMEADSGIRIGELRVDGGACANNLLMQFQADILGVDAVRPKVSETTALGAAYLAGLAVGYWKDVDELQSQWKLDRRFTPALPHAEVKACLDGWKRAIRAAKAWADTP

SEQ ID NO: 69634 - DNA, 1503 bp, Thermobifida fusca
  CDS (1)..(1503)
atgaccgaacagtacgtagcggcaattgaccagggcaccacgtcgagtcgctgcatcatcttcaaccgccacggcgacgtggtcgccctcgggcagcgggagcaccgccagatcttcccccgcccgggctgggtcgagcacgacgcggaagagatctgggcgaacgtcgtcgccgtcgtggaggaggcgctcgccgcgggcgggctgcgccgccaccagttggccgcggtcgggatcaccaaccagcgggagacgaccgtggtgtgggaccggcagaccggtcaacccgtccaccacgcgatcgtgtggcaggacacccgcaccgaccgcctgctgcgagtcctgggcgggacggaaggccaggaccggttccggcagcggtgcggactcccgctcgccacctacttctccgggccgaaactgcgctggctgctcgacgaaatccccgggctgcgggagcgggcgcagcgcggcgaagtgctgttcggcaccatggacacctggctggtgtggcagctcaccgggcggcacgtcaccgacgtcaccaatgccagccgtaccatgctgatgaacctgcgcaccctggactgggatgccgaaaccctggacgcgatggggatccccgcagcgatgctcccggagatccggtccagtgcggaggtgtacggcacagccaccggccccttggcgggagtgcccgtggccgcagctctgggcgaccagcatgccgccttgttcgggcagacctgcttcgaccccggcgatgtgaaaggcacctacgggacgggggcgttcctggtgctcaacacgggtaccgagccggtcgtctccaccaacgggctgctcaccacggtgggctaccagatcggcggccagcccgcggtgtacgcgctcgaagggtcgatcgcgatggcgggctcgctcgtgcagtggctccgcgacaacctggggatgatcacgcacgccgcggagatcgaagaactcgcttcgcaggtcgcagacaacggcggctgctacatcgtgcccgcgttctccgggctgttcgcgccgcactggcggagcgacgcccgcggcatcatcgccggcctgacctcctatgtgaccaaagcgcacctggcccgcgcagtgctggaagcgacagcgtggcagacccgcgaagtggtggacgcgatgaacagcgactcagggatcccgctagcctcgctgaaagtggacggcggcatggtcgccaaccggctactgaaccagatcctcgccgacgtgctggacgtggaagtggtgcggcccaaagtggcggagacgacctgcctcggggctgcctacgcggcgggcctcgccgtgggctactggccggacttggacagtctgcgcgccaactggcagcacgacgccacgtggacgccgcagatcgacgcgcaggtgcgggaccgcgaataccgcaactggacgaaagcggtacgccgcaccttcggctgggtggaatccgaggaggacgcgtcctga

SEQ ID NO: 69635 - protein, 500 aa, Thermobifida fusca
MTEQYVAAIDQGTTSSRCIIFNRHGDVVALGQREHRQIFPRPGWVEHDAEEIWANVVAVVEEALAAGGLRRHQLAAVGITNQRETTVVWDRQTGQPVHHAIVWQDTRTDRLLRVLGGTEGQDRFRQRCGLPLATYFSGPKLRWLLDEIPGLRERAQRGEVLFGTMDTWLVWQLTGRHVTDVTNASRTMLMNLRTLDWDAETLDAMGIPAAMLPEIRSSAEVYGTATGPLAGVPVAAALGDQHAALFGQTCFDPGDVKGTYGTGAFLVLNTGTEPVVSTNGLLTTVGYQIGGQPAVYALEGSIAMAGSLVQWLRDNLGMITHAAEIEELASQVADNGGCYIVPAFSGLFAPHWRSDARGIIAGLTSYVTKAHLARAVLEATAWQTREVVDAMNSDSGIPLASLKVDGGMVANRLLNQILADVLDVEVVRPKVAETTCLGAAYAAGLAVGYWPDLDSLRANWQHDATWTPQIDAQVRDREYRNWTKAVRRTFGWVESEEDAS

SEQ ID NO: 69636 - DNA, 1464 bp, Novosphingobium aromaticivorans DSM 12444
  CDS (1)..(1464)
atgactgacgagcgccgcatccttgttctcgacgaaggaacgacctcgacccgtgcgatcctctattccgcgcgaggcgaggtgctgggctgtgcgcaggaagaactgacgcaatactatcccgcgcccggccttgtcgaacacgatgcggccgagatctgggagcggaccctgcgctgcgcgcgcgccatggtggcgcaggcgggcggggccgggcgaattgccggtatcggcgtcaccaaccagcgtgaaactgtcgtcgcctgggatcgttcgaccggcaagccgctgacccgtgccatcgtgtggcaggaccgccgaactgaagagcgttgccgcgagctgcgcgatgcaggtcatgaggcggcgatccagcaggcaaccggcctgctgctcgatccctacttttcagccagcaagatggagtggattctccgaaacgtccccgaagcgcgcgcgctgggttcgcggctggcgttcgggacggtggaaagctggctggtctggaacctgaccggtggcctgcatgtcagcgacgtgaccaatgccagccgcacctcgctgtttccgctcgaaggcgcgagctgggacgaaggactgtgcgatctgttcggcgtgcccctttcggccttgcccgaagtggtgccgagcgcaggcgcattcggcacgacgcgggcagacctgctgggcggagcgattcccgtcaccgggcttgccggcgatcagcaggccgcgacaatcgggcagggctgtttccgtgcgggcgaggccaaggcgacgctcggcaccggggccttcatccttgccaacatgggcacccgaccgccgcgttcggcgcatcgcctgcttggcacggtactgtgcgaggtggacggcgtgcgcactttcgcgctggaaggttcggtctttgccgcgggcagcgtggtcaagtggctgcgcgacagcattggcctgctgggcacgtcagcggagagcgaggcgctggcaaggtccgtgccggacagcggcggcgtggtcgtcgttccggcgttgtcggggctgggcgcgccctactggaaacccgatgcgcgcgcgagcatccacggcctgtcctttgcgacgacgcgggcgcatctcgtgcgtgcggcgctcgaggcgatggcgcacgtgttccatgacctcggtcatgcctttgccgcagatggggcagggtggcaggtgctgcgcctggacggcggtatgagcgccaacgactggctggcacaggacatcgccgacgtgctcggcatccgctgcgagcggccggtcgacgtggagacgaccgcacgcggggccgcgatcctggcggcgatcggtgctgggctatgcccttcgctcgaccatgcgcgaaccatcgtcgcaccttccgccgcgttcgagccagggatggcggcgcaagaacgtcacgggcgtttggtccggtggcgcgaggctatcgggggatag

SEQ ID NO: 69637 - protein, 487 aa, Novosphingobium aromaticivorans DSM 12444
MTDERRILVLDEGTTSTRAILYSARGEVLGCAQEELTQYYPAPGLVEHDAAEIWERTLRCARAMVAQAGGAGRIAGIGVTNQRETVVAWDRSTGKPLTRAIVWQDRRTEERCRELRDAGHEAAIQQATGLLLDPYFSASKMEWILRNVPEARALGSRLAFGTVESWLVWNLTGGLHVSDVTNASRTSLFPLEGASWDEGLCDLFGVPLSALPEVVPSAGAFGTTRADLLGGAIPVTGLAGDQQAATIGQGCFRAGEAKATLGTGAFILANMGTRPPRSAHRLLGTVLCEVDGVRTFALEGSVFAAGSVVKWLRDSIGLLGTSAESEALARSVPDSGGVVVVPALSGLGAPYWKPDARASIHGLSFATTRAHLVRAALEAMAHVFHDLGHAFAADGAGWQVLRLDGGMSANDWLAQDIADVLGIRCERPVDVETTARGAAILAAIGAGLCPSLDHARTIVAPSAAFEPGMAAQERHGRLVRWREAIGG

SEQ ID NO: 69638 - DNA, 1470 bp, Novosphingobium aromaticivorans DSM 12444
  CDS (1)..(1470)
atgagcggcgatctggtactggtgatcgatgcgggcacgacctcgacgcgggctctcctgttcgggcgggacgggcgctgccatggcgttatgcaaagcgaatttgcgcagcattatccccgcccgggccaggtcgaacacgatgcggacgagatctggcgcgcgacgcttggctgcatgcgcgaggtggtcggggtcgtcggtatcgagcgcatcgcggcgattggggtaaccaaccagcgcgagaccgtcgtcgcctgggatcgcacgaccgggcaacccctggcgcgggccatcgtctggcaggatcgccgcaccgcgcccatgtgcgaccggttgcgatcggaaggggcggagccgctggtccagtcccgaaccgggctgctgcttgatccctatttctcgggcaccaagatgcgctggatgctcgacaacgagccagcggtcgccggagccgcgcgcgacgggcggctggctctgggcacggttgaatcatggctggtgtggaagctcacgggtggagcgcgccacgtaaccgatgccagcaacgccagtcgcacgctgcttctcgctctcgatggcgcggactgggatgaggagttgctcgacctgttcggcgtgccgcgcgcggtgctgcccgaggttaccgacagtctgggagaatttggcgcggcgctgcctgaatggctggacgcgtccgtgccggtcagaggtctggccggggaccagcaggccgcaaccatcgggcagggctgtcttgcgcccggcgaagtcaaggcaacctacgggaccggtgccttcgtgttggcggcaatgggtgacgcggtgccgcgttcgggccatcgcctgctcggcacggtgctggttcaggacaagggcgttcgcagttttgcgctggaaggttcggtctttgtcgcagggagcctgatcaagtggctgcgcgatgcgatgggcctggtcggctccgccgcagaaacggccgcgcttgcggcttcggtgccggacagtggcggggtcgtgctggtgccggcgctctccggcctcggagcgccgcactggcggcccgatgcgtccgcggcgcttacaggaatgacgttttcgaccacgcgcgcccatgtcgtgcgcgccgcgctggaggcgatggcgcaccagacgctcgacctcatggacgccttcgccgccgaccgcgcaccctggacctcgcttcgcatcgatggcggcatgagtgcgaacgattgggtggcgcaggatcttgccgatatcctcgacctgcctgtggagcggccggtcatggtcgagactacggccctgggcgcggggatgctggcggcggtcgcgtccggctggttcggatcgctgggcgaagcggaggccatgcgcgggtccgtcacgcggttcgaaccgcgcatggcgccaggtgtccgggccgcgcggatcgcgcggtggcgcgaggcgctcgcgaaagtctga

SEQ ID NO: 69639 - protein, 489 aa, Novosphingobium aromaticivorans DSM 12444
MSGDLVLVIDAGTTSTRALLFGRDGRCHGVMQSEFAQHYPRPGQVEHDADEIWRATLGCMREVVGVVGIERIAAIGVTNQRETVVAWDRTTGQPLARAIVWQDRRTAPMCDRLRSEGAEPLVQSRTGLLLDPYFSGTKMRWMLDNEPAVAGAARDGRLALGTVESWLVWKLTGGARHVTDASNASRTLLLALDGADWDEELLDLFGVPRAVLPEVTDSLGEFGAALPEWLDASVPVRGLAGDQQAATIGQGCLAPGEVKATYGTGAFVLAAMGDAVPRSGHRLLGTVLVQDKGVRSFALEGSVFVAGSLIKWLRDAMGLVGSAAETAALAASVPDSGGVVLVPALSGLGAPHWRPDASAALTGMTFSTTRAHVVRAALEAMAHQTLDLMDAFAADRAPWTSLRIDGGMSANDWVAQDLADILDLPVERPVMVETTALGAGMLAAVASGWFGSLGEAEAMRGSVTRFEPRMAPGVRAARIARWREALAKV

SEQ ID NO: 69640 - DNA, 1470 bp, Ferroplasma acidarmanus
  CDS (1)..(1470)
atggcaggagaatacatattatctatagatgcaggaactacaaattgcaaagccgttatttttgatagaagtggtgaaataactggcaaatcatccatacgcatggtatcatattatcccagggaaggttgggtagaacagaatccatattttattatttctgcagtgaaaaaagttatctcacaggcaataaaaatagctggcattgatcctggagatattgaatcggcaggaattacaaaccagagggaaactactgttatctggaacaggaaaactggtgttccgatttacaatgcaattgtatggcaggacaggcgtactgaaaatgttatgagaaaaatggaaaattatataaccgttatagaggaaaaaacaggcctcaggccagatccatatttcagcgctggaaaaatacaatggctcctggataatgtggaaggtgcgagggaaaaagcatcgaagggagaattagcattcggcaccgtagattcatggctcttattcaatatggcggggtcagggccccacgctaccgattataccaatgcatcaaggacaatgctatacaatatccgtaaactggagtgggatagtgaaatgctggaattattcaatattccagattccttgctccctgacgttgagccatcgctcaatgattttggatcaatttctatttctccaggaaaggaaatacctgtatacgcaattataggagaccagcagtctgccctgttcggtcatgctgccatatcaaaaggcatggcaaaaaacacatacggtacaggttcatttatgctggctaacacaggaaataacatcccggcaaccggttccctgatcgggactatagcatacgggttagaatataaaaaagtgagttacgctgttgaaggaagcattttcagtgcgggttcttctattgactggatgaagaatattcttaatgtgaaatcttacgataaactggaagaaatggcattgaaggcgcacagttccaatgcataccttgtccctgcctttacagggcttggctctccatactgggatcctacggccaggggaactattgttggattgacccattccaccggcaggaatgagatggcacggatggcatacgaatcagtagcttaccagacagaggacgttttgcaggaagttaaaaaagtaacaccggtgaaggaattaaaggtggatgggggattgacccgcagccaatttcttatgcaactccagtcaaatctttccggcttaaatattataaaaactaataccactgaaattacagctacaggttctgcatatatagcagggcttgcatcaggtttctggaagctggaccagctgggtgccatgtcatcgactgaaagaaagttttctcctgataatagttctggaggtgcacactcaggatattttggctggaaacaggcagtagctatatcctttggatgggaaaactag

SEQ ID NO: 69641 - protein, 489 aa, Ferroplasma acidarmanus
MAGEYILSIDAGTTNCKAVIFDRSGEITGKSSIRMVSYYPREGWVEQNPYFIISAVKKVISQAIKIAGIDPGDIESAGITNQRETTVIWNRKTGVPIYNAIVWQDRRTENVMRKMENYITVIEEKTGLRPDPYFSAGKIQWLLDNVEGAREKASKGELAFGTVDSWLLFNMAGSGPHATDYTNASRTMLYNIRKLEWDSEMLELFNIPDSLLPDVEPSLNDFGSISISPGKEIPVYAIIGDQQSALFGHAAISKGMAKNTYGTGSFMLANTGNNIPATGSLIGTIAYGLEYKKVSYAVEGSIFSAGSSIDWMKNILNVKSYDKLEEMALKAHSSNAYLVPAFTGLGSPYWDPTARGTIVGLTHSTGRNEMARMAYESVAYQTEDVLQEVKKVTPVKELKVDGGLTRSQFLMQLQSNLSGLNIIKTNTTEITATGSAYIAGLASGFWKLDQLGAMSSTERKFSPDNSSGGAHSGYFGWKQAVAISFGWEN

SEQ ID NO: 69642 - DNA, 1485 bp, Clostridium thermocellum ATCC 27405
  CDS (1)..(1485)
atgaataatttttacgttctcagcatagatcagagcactcaagggactaaagcggttattctaaacgactctggaattattcaagcaagacatgatctcccacataagcaaatcataaatgaaaatggatgggtttcccatgatccggaagaaatctatgaaaatgtaattaagaccgtgaaaatggtagtggaaaaagcaggcatagataaaaaccggattctttgcgtgggaatttcaaaccagagagagacaacagtcgtatgggacaagaaaacaggcaagcctctttgcaatgcaattgtttggcaatgcaacagagcaaaagatatttgtgaaagaataaaaaaggcgggatacgagaattgtatagccgcaaaatcgggtttaaagctttctccgtattatccggccggtaagatgacatggtttatggagaatgttccggatgtagacaaaaaagcagatgacggagatgcggcttttggaacaatagatagctggcttgtttataaactgacaaagggaaaaagttataaaaccgattattcaaatgccagtcgtacccagcttttaaatttaaccacactgaagtgggatgaacaactctgcgacatatttggaataccggttaaagcacttcctgagatttgtgattcaaattcagtgtttggcgaaactgattttgaaggttatcttgaaaagcccattccaatctgcggggtacttggggattcccatggtgcgttgtttggacacaactgcagaaaagaaggttcgataaaagttacttatggaacaggctcatccgttatgctaaacacgggcaacataccgattttcagcaaacatggattatccacctctcttgcctgggtaatcgacggaaaagcttcttatgttctcgaaggcaatattaactataccggtgcggttatttcatggcttaaagatgctcttggattgattcagtctgcgaaagaaacggctgagttgtcaaaaagggcaaacccaaatgatggaacttatttggttcccgcatttaccggtttgggggctccgtactggaaaagcgaagccaaggcgatcattgccggaatgagccgttcgaccggcaaagcagagctggtgaaagcggctaatgaatctattgcttatcaaattaatgatgttattttggcaatgcgaaaagatacggggttggaaatttcggaattgtgtgttgacggaggaccgaccagggatgattatctgatgcagttccagagcgatatttctgatgcagatattaaaatacccaatattgaggagctttctgcaacaggagcggcttttctggccggaatgtcagccaatctgtatgatgacaccgtgtataatgccatatcatatcgattttaccattccaaaatgaattctcaagtacgcaatgaaaaagttgatggttggaaagcagcagtaaatatgcttttaagcaaggagtga

SEQ ID NO: 69643 - protein, 494 aa, Clostridium thermocellum ATCC 27405
MNNFYVLSIDQSTQGTKAVILNDSGIIQARHDLPHKQIINENGWVSHDPEEIYENVIKTVKMVVEKAGIDKNRILCVGISNQRETTVVWDKKTGKPLCNAIVWQCNRAKDICERIKKAGYENCIAAKSGLKLSPYYPAGKMTWFMENVPDVDKKADDGDAAFGTIDSWLVYKLTKGKSYKTDYSNASRTQLLNLTTLKWDEQLCDIFGIPVKALPEICDSNSVFGETDFEGYLEKPIPICGVLGDSHGALFGHNCRKEGSIKVTYGTGSSVMLNTGNIPIFSKHGLSTSLAWVIDGKASYVLEGNINYTGAVISWLKDALGLIQSAKETAELSKRANPNDGTYLVPAFTGLGAPYWKSEAKAIIAGMSRSTGKAELVKAANESIAYQINDVILAMRKDTGLEISELCVDGGPTRDDYLMQFQSDISDADIKIPNIEELSATGAAFLAGMSANLYDDTVYNAISYRFYHSKMNSQVRNEKVDGWKAAVNMLLSKE

SEQ ID NO: 69644 - DNA, 1476 bp, Microbulbifer degradans 2-40
  CDS (1)..(1476)
atgagtgaaaactgcattctctcgattgatattggcacccattcaactcgcgtagcaataattaacacgcgcggccaaatactttggttaaaaaaattttcttacactttacattatataaacgaagcttttatagaacaggatgcatggcccatagtcgaacaccttaaaggtttgatcgacgaagccacgcaaacagagttttctatctgcgctgcaggtattgcttgtcagcgttcaactgtattggcatgggatagtgagaccggcaagcccctgcatgcagcgttaagctggatggatacccgcgcgaagggtgaagtaacagctttagcaaggcagcagaaggcaattaagcaaaaaactgggctggtattgtcgccacattacggtgctacaaaactcgcttggttacagcgccatttaaccgaaaatggcgagcgtgttttccaaatggggccgctcataagttttgttttgttccatcttgtggctggccgcccttttatttgcgatgaaagtaatgctgccagaacgcaactttacgatatctatacccgcaactggagcttgtcgctaaagcagttgtttggggtaggcactgggcttttgccgcaagtattaccctgttgtgcaaattacggcaatataatgaacgcacgtggtaaatctatccctcttgttgccgtaagtggagaccagaatgccgcttactttgcactgcacagcttagaggtttttcgcaagggtggcgcggttgtggctaacttaggtacaggtgcatttttacttgtagaaacccatctagagcactcgccatcgaacttgcttcatacgttgctctatagttctgagggcagtgtacagtacgcattggaggccacaatcaatggcgccggtagtgcagtagaatggctgtgcgagcaatggataagagcgggtgttagagaaggggcgagcaccgagcgcgaccgtgatcaattctttaaagagctggctttatggtttgagcggtatcaaacagcagacgttaaaatacccgtatttattaatactctagggggcgtggccgcaccctattggcggcaggatatacctcataattttataggtgttagcgactcgtctagttggtacgctaaagctatggcggtgttcgaaagtattgcgttttgggtgcggcgtaacgtagaagaaatagaggcgtcacgtccagttaaattgcttgtagtcagcggcgggctattggtgaataatggtttcaggcaaatgcttgctagcgcagtgggtaaaaaagtggtggtaaatacccagctagaatccacattagtgggcgtagctggtttagctttcgcgcagttggggcagtctattaccgttgatgactcacaaacctcgactgtttactcgccaatattttgcgatgagctggaagagcgctatcaaaccttcaaacactatttagataattactag

SEQ ID NO: 69645 - protein, 491 aa, Microbulbifer degradans 2-40
MSENCILSIDIGTHSTRVAIINTRGQILWLKKFSYTLHYINEAFIEQDAWPIVEHLKGLIDEATQTEFSICAAGIACQRSTVLAWDSETGKPLHAALSWMDTRAKGEVTALARQQKAIKQKTGLVLSPHYGATKLAWLQRHLTENGERVFQMGPLISFVLFHLVAGRPFICDESNAARTQLYDIYTRNWSLSLKQLFGVGTGLLPQVLPCCANYGNIMNARGKSIPLVAVSGDQNAAYFALHSLEVFRKGGAVVANLGTGAFLLVETHLEHSPSNLLHTLLYSSEGSVQYALEATINGAGSAVEWLCEQWIRAGVREGASTERDRDQFFKELALWFERYQTADVKIPVFINTLGGVAAPYWRQDIPHNFIGVSDSSSWYAKAMAVFESIAFWVRRNVEEIEASRPVKLLVVSGGLLVNNGFRQMLASAVGKKVVVNTQLESTLVGVAGLAFAQLGQSITVDDSQTSTVYSPIFCDELEERYQTFKHYLDNY

SEQ ID NO: 69646 - DNA, 1515 bp, Pediococcus pentosaceus ATCC 25745
  CDS (1)..(1515)
atggcagacaaatatattcttgccatcgacgaagggacgactagtactcgtacaatcatctttgatcatgctggaaataaaatggcagatgctcaaagagaatttccacagtactttccgaaacctggatgggtagaacataatgccaacgaaatatggaatgccgtattgtcgaccattgctaatgcatttatcgagtcaggaattaagcccaaccaaattagtggaattggtattaccaatcaacgagaaactaccgtgatttgggataaaaagaccgggcttcccatttataacgctgtagtgtggcaatctcgacagacagcagaaattgctgaacaactcgtaaaagatgggtatggcgacatgattcaccaaaaaacgggactagttacagacgcttacttctcggcaaccaaaattcgctggattcttgaccacgttgatggcgcacaagcacgcgccgaacgcggcgagctgttgtttggaaccattgatacatggctaatgtggaaattaacggatggtgatgtgcacgtcactgactattccaacgctagccgcaccatgttatataacattcacaaattagaatgggacaaagaaattctcgctttacttaatatccccgcttcaatgcttccggaagttaaacctaactctaccatttacggtaaaaccaaagattaccacttttatggtagcgaagttcccatctctggaatggctggcgatcagcaagcggccttatttggtcaattagctttcgaacccggaatggtcaaaaatacctacgggactggtgcatttaccgtaatgaacacaggtgaaaaaccgcaattatctgataataatttattaaccaccattggttacggtattaatggcaaagtctattacgcactagaaggtagtatttttgtggctggttcggcaattcaatggcttcgtgatggaatgaaactgtttaaaaaggcttctgaatcagaggcagccgctgttgcttctcaaaatgataatgaagtctatgttgtaccagcttttaccggactgggtgctccgtactgggatcctaatgctcgaggttcagtttttggaatcactcgtggaactacccgtgaagatttcattaaagctacccttcaatcccttgcataccaatctcgtgacgttattgacactatgaaaaaggattcaggaattgatattccttccattcgtgtcgatggtggcgcttctaataatgattacttgatgcaattccaatctgatattttaggaattgaaattgatcgtgctagtgatctcgaaaccaccgctctaggcgccgcatttcttgcgggattagcagttggattctggaaagaccttgaagatttaaagaaagaatataagccagggaaggtattcaaaccaaagatgtcaactgatgagcgtgaagacttatacacaggttggcaagaagcggttgcagcaactcgtcaatttaaacatcgaccacgacaatcaaaataa

SEQ ID NO: 69647 - protein, 504 aa, Pediococcus pentosaceus ATCC 25745
MADKYILAIDEGTTSTRTIIFDHAGNKMADAQREFPQYFPKPGWVEHNANEIWNAVLSTIANAFIESGIKPNQISGIGITNQRETTVIWDKKTGLPIYNAVVWQSRQTAEIAEQLVKDGYGDMIHQKTGLVTDAYFSATKIRWILDHVDGAQARAERGELLFGTIDTWLMWKLTDGDVHVTDYSNASRTMLYNIHKLEWDKEILALLNIPASMLPEVKPNSTIYGKTKDYHFYGSEVPISGMAGDQQAALFGQLAFEPGMVKNTYGTGAFTVMNTGEKPQLSDNNLLTTIGYGINGKVYYALEGSIFVAGSAIQWLRDGMKLFKKASESEAAAVASQNDNEVYVVPAFTGLGAPYWDPNARGSVFGITRGTTREDFIKATLQSLAYQSRDVIDTMKKDSGIDIPSIRVDGGASNNDYLMQFQSDILGIEIDRASDLETTALGAAFLAGLAVGFWKDLEDLKKEYKPGKVFKPKMSTDEREDLYTGWQEAVAATRQFKHRPRQSK

SEQ ID NO: 69648 - DNA, 1515 bp, Trichodesmium erythraeum IMS101
  CDS (1)..(1515)
atgaccacaaacacagaaaaatatattcttgctcttgacctcggtaccactggtaaccgagcaatattattcaattctcaaggtgctagtgtcgctcaagcatataaagaactctcccaatattatccacacccaggctggttagagcataatgccgaagaaatatgggaagacacttatgcaatgatcaaggatgttttccgagatactggtgtttccagctctaatgtggaagcgatcggtttaacagtacaacgagaaacctgtctcctctgggataaaactacaggcaaaccccttcacaaagccattgtttggcaagaccgtcgcaccgcatctttatgtcaagagttagcagcaaaaggtgaagcagaaaaaatcaaaacgcgcaccggattagttttagatgcttacttttcagctactaaactatcatggttgctagactgggtcaaggaagaaaaacctaatcttgacctcaaaaatgttttagcaggtaccattgatacttgggttttgtggaaactaactggtggaaaagttcatgctactgaccacagtaacgccagtcgtacaatgttaatgaatatcgaatctctaaattgggaccaggaattattagacctgtttcaaattcctagagaaatgatgccacaaattcaacctagtttcagtatatttggcaagagtgaaccagatttattaggtggatcaattcccattgctgcagtcttaggagaccaacaagctgctttatttgctcatggttgcaatttcccaggaatgtcaaaatgcacctatggtacaggtagcttcttaattgcaaatactggaaatcatgtcaccaaatcgcaaaatcaattattatcaactatagcttggactcagttagtcaaagggaaactgcaagcaacttatgctttagaaggagcaatgtttactacgggagcttgtattcagtggttgcgcgacgggataaaattaattgactctgtggcagaaacagaaaatttagctttacaagtggaagacactaatggtgtttattttgtacctgctttaagtggtcttggcgcgccccactgggatatggatgctcgtggtgcaattttgggaattactgggggagtgcagcgagaaaatattatcagagcagttttggagtcaattgcttttcaagtaaaagaggttgtggatgcagtgaataaggatagcggaattcctatgagtcatttgaaagttgatggtggagtttcgcagaataattttttaatgcaatatcaggcgaatttgttgggtattccagttgaacgccctgcttttattgatgcgactgctcaaggcgctgcttttgctgctggtctcacaataggtttatggaataattatcagaaattgctgagtaataataaagtaggacaggtgtttgaacctaataaaaatgcgaccaaagtacaagaaagttttgtggtttggcaaaaagcagttagtagagccaaaaattggattaattaa

SEQ ID NO: 69649 - protein, 504 aa, Trichodesmium erythraeum IMS101
MTTNTEKYILALDLGTTGNRAILFNSQGASVAQAYKELSQYYPHPGWLEHNAEEIWEDTYAMIKDVFRDTGVSSSNVEAIGLTVQRETCLLWDKTTGKPLHKAIVWQDRRTASLCQELAAKGEAEKIKTRTGLVLDAYFSATKLSWLLDWVKEEKPNLDLKNVLAGTIDTWVLWKLTGGKVHATDHSNASRTMLMNIESLNWDQELLDLFQIPREMMPQIQPSFSIFGKSEPDLLGGSIPIAAVLGDQQAALFAHGCNFPGMSKCTYGTGSFLIANTGNHVTKSQNQLLSTIAWTQLVKGKLQATYALEGAMFTTGACIQWLRDGIKLIDSVAETENLALQVEDTNGVYFVPALSGLGAPHWDMDARGAILGITGGVQRENIIRAVLESIAFQVKEVVDAVNKDSGIPMSHLKVDGGVSQNNFLMQYQANLLGIPVERPAFIDATAQGAAFAAGLTIGLWNNYQKLLSNNKVGQVFEPNKNATKVQESFVVWQKAVSRAKNWIN

SEQ ID NO: 69650 - DNA, 1485 bp, Silicibacter sp. TM1040
  CDS (1)..(1485)
atgacctatattctcgcgattgatcaagggacgacttcgacccgcgcgatcctgtttgacggtgacatgcaggtcgccgctgtggcgcaggaggagtttacccagcattaccccaatgcgggatgggtggaacacgaccccgaggacctttggtccacgaccctggcgacttgccgcaaagtgatggcagacaaaggtatttccgcctctgatattgccgggatcggcatcaccaaccagcgcgaaaccaccgttgtctgggacaaggccaccggccgcgcgatccacaacgcgattgtctggcaggaccgccgcaccgccgagatctgcgaaggtctgcgcgacgaaggccatgaggacatggtgcgcgaaaccacggggcttttgcttgatccctatttctccggcaccaaggtcaaatggattctcgacactgtcgagggggcccgcgcccgtgccgaggccggtgatctgctgtttggcaccatcgacagttttctgatctggcgtctcacgaacgggcagtcgcacgtcacggacgccaccaacgcggcgcgcaccctgatgtatgacatcaagtccggcagctggagcacagagatctgcgccatgctggaggtgccgcaggccatgctgcccgatgtgctcgacagcgcggcagacttcggcaccacgtccccggaccattttggtggcgcgatccccatcctgggcgttgcgggcgatcagcaggcggcgacagtgggccagacctgtttcaagccggggatgatgaaatccacctatggcaccgggtgttttgcactcttgaacacgggcgatacgccggtgctgtcaaagaaccgcatgctcacaaccatcgcctaccagctggatggcaaacccacctatgcgctcgaaggctcgatctttatcgcaggcgcagcggtgcaatggttgcgcgacgggcttggcatcatcggcaaggccagcgagtccggggtgctggctgacaaggcggatccaacccaggacgtgatccttgtgcccgcctttacaggccttggcgcaccctactgggaaccggactgccgcggcggcatgtttggcctcacccgcaactcgggccctgcggaatttgcccgcgccgcgttgcagagtgtggcctaccagacccgcgacctctgggaggcgatgcgcgccgactgggaaggagaggccaatgtcaccctgcgcgtcgatggcggcatgagcgccagcgactgggccatgcagagcctctccgacacgcttggcgctgccgtcgatcgccccgtcatgcaggaaaccaccgcgctgggcgcggcgtggcttgcgggcatgaaagcaggcgtctaccccgatcaggagggctttgcggccacttgggccctggatcgcgagtttaaaccaaagctcgacgctgcccgtcgcgaagaggcctatgcccgttggaaacgcgccgtgcaggctgtcatcggagtctga

SEQ ID NO: 69651 - protein, 494 aa, Silicibacter sp. TM1040
MTYILAIDQGTTSTRAILFDGDMQVAAVAQEEFTQHYPNAGWVEHDPEDLWSTTLATCRKVMADKGISASDIAGIGITNQRETTVVWDKATGRAIHNAIVWQDRRTAEICEGLRDEGHEDMVRETTGLLLDPYFSGTKVKWILDTVEGARARAEAGDLLFGTIDSFLIWRLTNGQSHVTDATNAARTLMYDIKSGSWSTEICAMLEVPQAMLPDVLDSAADFGTTSPDHFGGAIPILGVAGDQQAATVGQTCFKPGMMKSTYGTGCFALLNTGDTPVLSKNRMLTTIAYQLDGKPTYALEGSIFIAGAAVQWLRDGLGIIGKASESGVLADKADPTQDVILVPAFTGLGAPYWEPDCRGGMFGLTRNSGPAEFARAALQSVAYQTRDLWEAMRADWEGEANVTLRVDGGMSASDWAMQSLSDTLGAAVDRPVMQETTALGAAWLAGMKAGVYPDQEGFAATWALDREFKPKLDAARREEAYARWKRAVQAVIGV

SEQ ID NO: 69652 - DNA, 1518 bp, Exiguobacterium sp. 255-15
  CDS (1)..(1518)
atggaaaacaagtacatcttagcactcgaccaaggaacaacaagctcacgcgccattatttttgaccacgatggtcaaatcgtgaactctgcgcaacgtgaattcaaacaatacttcccgcaaccgggctgggtcgagcatgatgccaatgaaatttggggatcaatcctcgctgtcatggcggattctctcggaacggctgatatcaaaccgagccaaatcgcaagtatcggaattacgaaccaacgtgagacgacggtcgtctggaacaaagaaacaggtaaacctgtctatcacgcgcttgtctggcaatcccgtcaaacatccggtatctgtgatgagctgaatgcacagggtctgaaccaaacattccgtgataaaacaggtcttctgattgacgcctacttctcagggacaaaagtgaagtggattttggataacgtcgaaggtgcacgggagcaggcagaaaacggagaacttctcttcggaacaatcgacacatggctcgtctggaagctgtctggcggaaaaacgcatatcacagactatacaaacgcctcacggacattgatgtacaacatttacgaacaaaaatgggatgatgagttacttgaaatcctgacagttccaaaatcaatgttaccggaagtccgtcaatcaagtgaagtgtatgacaacacagttccgtatcatttcttcggttttgaagttccgattgccggaatcgccggtgaccagcaagcagccctctttggtcaaacatgtttcgaaccgggtgaaggaaagaacacgtatggtacaggttgcttcatgctcatgaacactggtgaaaaagccgtttcgtctgaccacggtctgctgacgacaatcgcctggggtgtcgacggaaaagtcgaatatgcactcgaaggatcgattttcgttgccggatcagcgattcagtggttacgtgacggtttacggatgttgaaaaatgcgaaagactcagaaggctatgccttgaaagtcgattcgacagaaggcgtttacgtcgttcctgccttcgtcggactcggtgccccgtactgggatagtgacgttcgcggcgcaatcttcggcttaacacgcggaacggagaaagaacatttcgtccgtgcgactcttgaatcccttgcttaccagacacgtgatgtcttgacggcgatggaaaaagattcaggaatcgaattgaaaacgttgcgcgttgacggtggtgcggtttcaaacgacttcttgatgcagttccagtcggatatcttaggtgtaccggttgaccgtccggaaatcaatgagacaacagctctcggtgctgcctatctcgccggtctcgcagtcggttactggaaagacaaagcagaaatcaaacaacaatggaaactgaaccatcagtttaaaccagaaatgaaagaagacgatcgcgaacagcgttatgccggatggcaaaaagcggtcgaagcaaccatggcgtttaaaccaaacaaaaaagaagtcaacgcctga

SEQ ID NO: 69653 - protein, 505 aa, Exiguobacterium sp. 255-15
MENKYILALDQGTTSSRAIIFDHDGQIVNSAQREFKQYFPQPGWVEHDANEIWGSILAVMADSLGTADIKPSQIASIGITNQRETTVVWNKETGKPVYHALVWQSRQTSGICDELNAQGLNQTFRDKTGLLIDAYFSGTKVKWILDNVEGAREQAENGELLFGTIDTWLVWKLSGGKTHITDYTNASRTLMYNIYEQKWDDELLEILTVPKSMLPEVRQSSEVYDNTVPYHFFGFEVPIAGIAGDQQAALFGQTCFEPGEGKNTYGTGCFMLMNTGEKAVSSDHGLLTTIAWGVDGKVEYALEGSIFVAGSAIQWLRDGLRMLKNAKDSEGYALKVDSTEGVYVVPAFVGLGAPYWDSDVRGAIFGLTRGTEKEHFVRATLESLAYQTRDVLTAMEKDSGIELKTLRVDGGAVSNDFLMQFQSDILGVPVDRPEINETTALGAAYLAGLAVGYWKDKAEIKQQWKLNHQFKPEMKEDDREQRYAGWQKAVEATMAFKPNKKEVNA

SEQ ID NO: 69654 - DNA, 1491 bp, Exiguobacterium sp. 255-15
  CDS (1)..(1491)
atggagaactacattttgtcattagatcaaggaacaacgagtacacgggcgattttattcaaccgttccggagaaatcgttcattccgcacaacgtgagtttacgcagtactttccaaaaccaggttgggtcgaacacaatgccaatgaaatttggggaagtgtcctttcggtcgttgcaacctgtttaacggaagccaacgtcaaagcgacacaaatcgctggaatcggcattacgaaccaacgggaaacagcggtcgtctgggagaaagagactggaaaaccgattcataatgcagttgtctggcaatcgagacaaacagctgaaatttgtgaagagttacggagtgcaggacatgccgaattgttccgtgcaaaaacaggtttgttgattgatgcctatttctccggaacgaaggtcaagtggattcttgatcacgttgaaggttcccgggaacgggcagaacgtggtgaactgttgtttggaacgattgatacctggttgatttggaagttgtcaggcggtaaagcccatgtcacggattattccaatgccagccggacgttgatgtataacatccacgagctaaaatgggatgacgaattacttcagctcctcgatgttccaaaagccatgcttcctgaagtccgtccgtcttctgaagtttatgcgcatacagctggctatcacttcttcggtgaatcggttccgattgccggagctgccggagatcaacaggccgctttattcggtcaagcttgtttcgaaaaaggaatggcgaaaaacacatacggaacaggatgtttcatgttgctgaatacgggcgacaaagctgtgacatcggaacacggtctcttgacgacgattgcgtggggaatcgacggaaaagtccagtatgcgctcgaaggcagtatttttgtcgccggttcagcgattcaatggttacgagatggtcttcgcctgattaacgatgcgaaggaaacagaagcttacgcgacgcgtgtgacgtcttcagacggggtctacgtcgttcctgcattcgtcggtctcgggacaccgtactgggacagtgatgtccgtggtgcagtcttcggtctgacgcggggaacggaaaaagaacacttcatccgggcgacacttgaatcgctggcatatcagacgcgtgacgtcttgacagcgatggaacaggattccggaatcgaaatgtctgccttacgtgtcgatggtggtgccgttaaaaatgatttcctcatgcaattccagagtgatatcatccaggcaccggtcgagcgtccggaaattaatgaaacgacggccctcggggcagcatatcttgcaggactagctgttggattctttgagaatcaaaaacagatttcagcccactggaagatggatcgtcgctttgagatggatatggcggaagcagagagcgaagatctttacgctggatggaaaaaagctgttcaagcggcgatgttgtttaaatga

SEQ ID NO: 69655 - protein, 496 aa, Exiguobacterium sp. 255-15
MENYILSLDQGTTSTRAILFNRSGEIVHSAQREFTQYFPKPGWVEHNANEIWGSVLSVVATCLTEANVKATQIAGIGITNQRETAVVWEKETGKPIHNAVVWQSRQTAEICEELRSAGHAELFRAKTGLLIDAYFSGTKVKWILDHVEGSRERAERGELLFGTIDTWLIWKLSGGKAHVTDYSNASRTLMYNIHELKWDDELLQLLDVPKAMLPEVRPSSEVYAHTAGYHFFGESVPIAGAAGDQQAALFGQACFEKGMAKNTYGTGCFMLLNTGDKAVTSEHGLLTTIAWGIDGKVQYALEGSIFVAGSAIQWLRDGLRLINDAKETEAYATRVTSSDGVYVVPAFVGLGTPYWDSDVRGAVFGLTRGTEKEHFIRATLESLAYQTRDVLTAMEQDSGIEMSALRVDGGAVKNDFLMQFQSDIIQAPVERPEINETTALGAAYLAGLAVGFFENQKQISAHWKMDRRFEMDMAEAESEDLYAGWKKAVQAAMLFK

SEQ ID NO: 69656 - DNA, 1497 bp, Chloroflexus aurantiacus
  CDS (1)..(1497)
atggcaaagtacgccgctgctatcgaccagggcacaaccagtacccgctgtatgatcttcgaccatagcgggaatgtcatttgctacgatcagaaagaacacgagcagatttatccccgccccggctgggtagaacacagccctgatgagatttgggagcgtacccaaagtgtgattcgtggggcactaagcaaaggcggcctgagcgcaagcgatattgtcgccgtcggcattaccaatcagcgcgagacaacggtggtctggaatcgcaaaacaggccgaccggtgtacaatgcgatagtctggcaagacacccgcaccgaccagatttgtaatgaacttgccgccgacggcggtcaggatcggttccgccccaaggttggcttgccactggcaacctacttctccggtcccaagattcgctggattctcgacaatgtgcccggcgcccgtgaggcggcggaggccggtgatgtggtgtttggtaacatcgataccttcctgacctggtggctcaccggtgggcccaacggtggtgtccacgttaccgatgtgaccaacgcctcacgcacgatgttgatgaatctcgaaacccttgattgggatgatgagattctcggcattatggggattccgcgccagatgctgcccaagatcgtaccctccagcatggtttacggtacggcaacaggtgaactggccggtgtgccggtggccggtatcctgggcgatcagcaggcggctatggtcggacaaacctgcttcgatgtcggtgaggccaaaaatacctacggtaccggttcgtttatgctgctcaacaccggcacgaaactggttccatccaagagtggcctgctgaccaccgtctgttacaagttcggcgatcaacccgccgtctacgccctcgaaggctcaatcgctatcaccggtgctctggtgcagtggctccgcgataacctcggtctgattacatcctcggcagaagtcgaggcgctggcaaatctggtcgaagataacggcggtatctacttcgtgccggccttctctggactcttcgcaccctactggcgctcggacgcccgtggtgtgattgtcggcctgactcgttatgtcaacaaagaccacctcgcccgcgccgtgctcgaagccactgcctaccagacgcgcgaggtgctcgacgcgatggagcaggactcaggcgtcaagctgaccgccttgaaggtcgacggtggtatggtgtacaataataccctgatgcaattccaggccgatattttgggtgtgcccgttattcggcccaaggttgcagagaccacatcgctcggtgctgcctatgcagccggtttagcagtcggcttctggtcaaataccgatgagatgcgggccaactggggtgttgatcacacctggacaccacagatggatgaagcaacccgcgagcggctctatcggggctggaagaaggcagttacccgtaccttcgattgggtggagtaa

SEQ ID NO: 69657 - protein, 498 aa, Chloroflexus aurantiacus
MAKYAAAIDQGTTSTRCMIFDHSGNVICYDQKEHEQIYPRPGWVEHSPDEIWERTQSVIRGALSKGGLSASDIVAVGITNQRETTVVWNRKTGRPVYNAIVWQDTRTDQICNELAADGGQDRFRPKVGLPLATYFSGPKIRWILDNVPGAREAAEAGDVVFGNIDTFLTWWLTGGPNGGVHVTDVTNASRTMLMNLETLDWDDEILGIMGIPRQMLPKIVPSSMVYGTATGELAGVPVAGILGDQQAAMVGQTCFDVGEAKNTYGTGSFMLLNTGTKLVPSKSGLLTTVCYKFGDQPAVYALEGSIAITGALVQWLRDNLGLITSSAEVEALANLVEDNGGIYFVPAFSGLFAPYWRSDARGVIVGLTRYVNKDHLARAVLEATAYQTREVLDAMEQDSGVKLTALKVDGGMVYNNTLMQFQADILGVPVIRPKVAETTSLGAAYAAGLAVGFWSNTDEMRANWGVDHTWTPQMDEATRERLYRGWKKAVTRTFDWVE

SEQ ID NO: 69658 - DNA, 1494 bp, Polaromonas sp. JS666
  CDS (1)..(1494)
atgacttatttgctcgcccttgaccagggcacctccagctcccgcagcattgtgtttgacgagctgggccacatcgtggcccaggcccagcaggagctgccccagatctatcccaaaccaggctgggtcgaacatgacccgatggaaatctggcgcacccaactggccacggcgcgcgaagcgctcggcaaagcgggactgaaagcgagcgacattcgcgccctgggcatcaccaaccagcgcgaaaccacggtggtgtggcaccgcgcgaccggccaacccatccataacgccatcgtctggcaggaccgtcgcgccgaagcgacctgcgcgcaactgcgcgagcagggcaaggaagcgctgatccagtccaagaccggcttgttgattgatgcctatttttcgggcaccaagctcaagtggctgctcgacaacgtacccggcgtgcgcgcgcaggccgaacgcggcgagctggcctttggcaccatcgacagctggctgatgtggcaactgacgggcggcgcgctgcacgccactgacgtcagcaatgcctcgcgcaccatgctgttcaatgtgcgcaccaaccagtgggacgccgagctgctggacctgctgggcattcccgcttcgctcatgccccaggtgctgccgtccagcgcgcactacggcgaaacccggcccgagctgctgggccacgcgatagcgatcggcggcgtcgccggcgaccagcaaagtgcgctgtttggccaggcctgcttcaaggcaggcatggccaaaaacacctatggcaccggctgcttcatgctgatgcacaccggcacgcaattccagacctcgcacaacggcctgctgaccaccagcgccgcgcaaaccacggcgcaccccgaatttgccatggagggcagcgtgtttgtcggcggtgcggtggtgcagtggctgcgcgatggcctgcacgccatccagggcagcggcgaggtgcaggcgctggcgcaaagcgtgcccgactccggcggcgtcatgatggtgccggccttcaccggcctgggcgccccctactggaaacccgatgcccgcggcaccatcaccgggctgacccgcggcaccactgtggcccatattgcgcgtgccgcgctggaaagcattgcctaccagagtgccgccctgctgcaggccatgagccgggatgcggtgagcagcggtgcggcgcccctggccgagctgcgcgttgacggtggggcgtgcgccaatgatttgctgatgcagttccaggccgacctgctgggcattccggtgctgcgaccggcggtgattgaaaccacggccctgggcgcggcttacctggccggcctttccagcggggtgtaccgcagcacggacgagctgtccggcatgtggcgcgcggagcggacgtttttgcctaccctgggcgccgacagcgcggcggcgttgatgaatcggtgggagcatgccgtcaggcagacggtgcttccgtaa

SEQ ID NO: 69659 - protein, 497 aa, Polaromonas sp. JS666
MTYLLALDQGTSSSRSIVFDELGHIVAQAQQELPQIYPKPGWVEHDPMEIWRTQLATAREALGKAGLKASDIRALGITNQRETTVVWHRATGQPIHNAIVWQDRRAEATCAQLREQGKEALIQSKTGLLIDAYFSGTKLKWLLDNVPGVRAQAERGELAFGTIDSWLMWQLTGGALHATDVSNASRTMLFNVRTNQWDAELLDLLGIPASLMPQVLPSSAHYGETRPELLGHAIAIGGVAGDQQSALFGQACFKAGMAKNTYGTGCFMLMHTGTQFQTSHNGLLTTSAAQTTAHPEFAMEGSVFVGGAVVQWLRDGLHAIQGSGEVQALAQSVPDSGGVMMVPAFTGLGAPYWKPDARGTITGLTRGTTVAHIARAALESIAYQSAALLQAMSRDAVSSGAAPLAELRVDGGACANDLLMQFQADLLGIPVLRPAVIETTALGAAYLAGLSSGVYRSTDELSGMWRAERTFLPTLGADSAAALMNRWEHAVRQTVLP

SEQ ID NO: 69660 - DNA, 1650 bp, Anopheles gambiae str
  CDS (1)..(1650)
atggtcgagtttgaaccgttggctctgtgggcgacggcacgagtgtgcctggagacggcggtacagaatctgatcatactggacatcaacccgcacgacattgtggcggtcggggtgtgcaatcagcgcgagacgacggtgctgtgggaccgcaccacgggcgaaccgctgtgcaatgcgatcggctggtgcgacacgcgcacctcgagcgtggtcggaagcatcctgcagcgtgtgcggggcaagaagcactacctcaagtcggtgtgcgggctgacggtgagcaactgcttcagcgcggtcaaactacgctggatgatggagcacgtcgacggggtgcagcgggcgatggacgaagggcgggccgcgttcggcacgctggacagctggatcatctggatgctgacggggggcgtcgaggccggcattcacgtgacggacgtgacgaacgcttcgcggacgatgctgatgaacctggagcgccgcgtgtgggacgaaaggctgtgtcgattctttcgcattccaagcaacattctgccggagattcgaagctgctcggaggtgtacggatacattaacgagggcccgttgagcgggacgccgatcgcaagttgcctgggcgatcagcaggctgccctgctcgggcaaatgtgtctgggcgcggggcaagccaactgcaccatcgacgaaggcatgttcgtgctgtttaacactgcccgggagatcatcgattccgaccatgggctgctttcgaccgtggcctttcagcttggaccccgtgccgacccgcactacgcactggaaggtgcgatcgcccatgccggttcttcgatcggttggttaaagcgtacgctcgccctggacccggtcgcatccgatgcgatgaacagcagcgcactgtttcccgacggccctgccaatactcagctgatggcttctttctgctcggccgtcagttccccggttccgccgtacggcgagacgaaaacgctcgccggtggcggcgtcggccaacggggtggtgtcatttttgtacctgcattcagtggatattacacgccgtactggcggtacaaagcgcggggcatgatgttcggcataacgctgcaaacgacgccgcagcagatcctggccgccgcccacgaagcgatctgccaccaggtgcgcgaagtgctggaatcgctcgctaaggattgtcccacgtggccccggctggcgaagcttaccgtcgggggcgatctcagcgaacagcgggcgctggtgcagctgctgtcggatctgaacggggtgctggtggagcggccgcaaacatcgacaccggcctgcctcggggcaatgctcgccgccgggctggccaccgaaatactgtccatcgatcagtttcgccagaactgtgtgccaccgatcgatttgttcagtacagcgtttaattctagtcaaagagatatgaagttccgccgttggaaaatggctgtcgatcggtgtttaaacttcgattccgtgtcggatagcgacccggtgaagctgatcggcgacgggcgtgatccggattcgtacgtgcgctgctcgatccccgggtcggtctttatcgtttcgtcgttcgtgcttattgtggccgcccagctgatgaagcagcacggtttcgcgtag

SEQ ID NO: 69661 - protein, 549 aa, Anopheles gambiae str
MVEFEPLALWATARVCLETAVQNLIILDINPHDIVAVGVCNQRETTVLWDRTTGEPLCNAIGWCDTRTSSVVGSILQRVRGKKHYLKSVCGLTVSNCFSAVKLRWMMEHVDGVQRAMDEGRAAFGTLDSWIIWMLTGGVEAGIHVTDVTNASRTMLMNLERRVWDERLCRFFRIPSNILPEIRSCSEVYGYINEGPLSGTPIASCLGDQQAALLGQMCLGAGQANCTIDEGMFVLFNTAREIIDSDHGLLSTVAFQLGPRADPHYALEGAIAHAGSSIGWLKRTLALDPVASDAMNSSALFPDGPANTQLMASFCSAVSSPVPPYGETKTLAGGGVGQRGGVIFVPAFSGYYTPYWRYKARGMMFGITLQTTPQQILAAAHEAICHQVREVLESLAKDCPTWPRLAKLTVGGDLSEQRALVQLLSDLNGVLVERPQTSTPACLGAMLAAGLATEILSIDQFRQNCVPPIDLFSTAFNSSQRDMKFRRWKMAVDRCLNFDSVSDSDPVKLIGDGRDPDSYVRCSIPGSVFIVSSFVLIVAAQLMKQHGFA

SEQ ID NO: 69662 - DNA, 1554 bp, Gallus gallus
  CDS (1)..(1554)
atgccgtgcgggcagccgggcagcggcgccgcccccgcgctctacgtagtgggggtggacgtgggcagcacgacagtgaagtgccacgtctatgaccgcgcggccggcgtcagaggttccagctgcaggaaggtggagtcgctgtacccgcggcccggatgggttgaactggatcccgaagttctgtggagtcagtttgtcggtgtcataaaagaggctgtgcaagctgctggacttcacatgaggcaagttgctgctcttggcatctcaacacaaagatccactttcatcacatggcacaagagaacgggaaaaccttttcataatttcataagctggcaagacttaaggagcgctgagctcgtgaattcctggaataggtcccttctgctgaaggtaatccatgttatttttacagtgcttcatttctttactggaaatgatcgatacttggctccaagtgtccttaccttttcaacacaacagacttctatgaagttgtcctgggtttttaaaaacatacctgaggctgatgaagctgccaaaaagaataactgctgctttggaacagtggacacgtggttactgtataggttgactaaaggttctgtatttgctacagattactcaaatgccagttctacgggtgtttttgaaccctttacgaaatgttggaaccccactttgtgtcatttactttccattccaatgtctatttatcctccagtgaaagacacaagcttcaattttggatcagctgactctgaaatatttggggtacctgttccaataatggcactggtagctgaccagcagtcagcaatgtttggagaatgctgctttcagccgggagatgttaaactgacaatgggcacaggtggtttctggaatgttaatacaggagggaatctctttgcatcgcacaagggtctctatccactgattggttggaagattggggaagaagttgtttacttaactgaaggctctatgtcaaacattggcactacaataaaatgggctcaggatataaatcttttcaccaatgtagatgaaacagcaaaaatggcacggagtattgttgattctcaaggcgtttgttttgttccaggttttcaggtttctgcaaatgatccatacttatgtgcctctttcatggggctgaaacctactactaccagaaaccatcttgtacgagctattctggaatctgtagctttcagaaacaaacagctttttgatattattgtgaagaaggtacgcattcctcttcagactgttcgagctgacggaggtgtcagtaataacagttttgtcatgcagatgacttcagatttgattaataagaaaatagaaaagccttcaaatacagatatgtctagtcttggtgcagcttttcttgcaggtcttgcatcaggactttggactgacaaagaacagctaaagaagctgaggcaaatagaaacagtttttgagccccagaaggacgagaaggaatacaaacctgctatggacacctggatgcgagcggtgaaatgctccttgcactggtag

SEQ ID NO: 69663 - protein, 517 aa, Gallus gallus
MPCGQPGSGAAPALYVVGVDVGSTTVKCHVYDRAAGVRGSSCRKVESLYPRPGWVELDPEVLWSQFVGVIKEAVQAAGLHMRQVAALGISTQRSTFITWHKRTGKPFHNFISWQDLRSAELVNSWNRSLLLKVIHVIFTVLHFFTGNDRYLAPSVLTFSTQQTSMKLSWVFKNIPEADEAAKKNNCCFGTVDTWLLYRLTKGSVFATDYSNASSTGVFEPFTKCWNPTLCHLLSIPMSIYPPVKDTSFNFGSADSEIFGVPVPIMALVADQQSAMFGECCFQPGDVKLTMGTGGFWNVNTGGNLFASHKGLYPLIGWKIGEEVVYLTEGSMSNIGTTIKWAQDINLFTNVDETAKMARSIVDSQGVCFVPGFQVSANDPYLCASFMGLKPTTTRNHLVRAILESVAFRNKQLFDIIVKKVRIPLQTVRADGGVSNNSFVMQMTSDLINKKIEKPSNTDMSSLGAAFLAGLASGLWTDKEQLKKLRQIETVFEPQKDEKEYKPAMDTWMRAVKCSLHW

SEQ ID NO: 69664 - DNA, 1440 bp, Xenopus laevis
  CDS (1)..(1440)
atgagctctcccaggaatggatacagggatcggctgatcctcgctgtggatgtcgggagcagcgtgttgaggtgtcacctgtacaaccagtcgggcgagatctgcgggagtgcagaggacaagctgaaagttctgtatcctcaggccggatatgtggaaatcgatcctgagtccttatgggagcagtttgtcagggttgtgaaagaggcagtcgcagatgcagggatccagatgagtcaagtggctggtcttgggatttcaacacagagaggaacattcatcacatggaacaagaaaactggagaaacttttcataacttcatcagttggcaggacctacgtgcagctgacctggtttcttcttggaaccgctctctgctgctcaaggctgttcatggggtttgcacggccttgcatttcttcactcggaggaaacggttcctggcagccagcttgatcaatttcactacacagcatgtatctctgcggctggtctgggtcttacaaaacattccacaggtgcgtcaagcagcagagaaaggaaactgttgctttggtaccatcgacacatggctgctgcataagctcactaaaggcactgtttttgcaacagactattcaaacgcaagtggaacagcagtttttgatccttatctaatgtgctggagctcttttctctgctctctgctgtcgattcccttgtctatatttcctcctgtggaggacacaagtcacagcttcgggcttgcagatcctactatatttggagctccggtgcctatccttgcattggtcgctgaccagcaagctgccatgtttggacagtgctgtttcgatgtggggagcgtcaagttaacgatgggaacaggatcattcatttctattaatactggagaaacacttcacacatctattgcaggtttgtacccgctgattggctggaaagttggtgacgaggttgtgtgtttggctgaaggaaatgcctctgacactggcaccgctatcaaatgggctgaggagctaaatctcttcaccagtgttgccgacactgaggcaatggccaggagcgtccctgattgcggggggatttaccttgtaccatctttttctggcttgcaggcacctataaatgatccctacgcctgtgcctcattcatgggcctcaaaccatccaccagcaagagccatctggtgagagccatcctggagtcagtggcatacaggaataagcagctgtacgacactgtgctcagggaaaccactatccccatcacacttatcagggcagatgggggtgtcagtaataacaacttcatcatgcagatgacagcggatttacttggtcaaactatcgacaaaccaaaacacacagacatgtcttctctgggagctgctttccttgctggtatggctgtttatggtccactaaagacgagctaa

SEQ ID NO: 69665 - protein, 479 aa, Xenopus laevis
MSSPRNGYRDRLILAVDVGSSVLRCHLYNQSGEICGSAEDKLKVLYPQAGYVEIDPESLWEQFVRVVKEAVADAGIQMSQVAGLGISTQRGTFITWNKKTGETFHNFISWQDLRAADLVSSWNRSLLLKAVHGVCTALHFFTRRKRFLAASLINFTTQHVSLRLVWVLQNIPQVRQAAEKGNCCFGTIDTWLLHKLTKGTVFATDYSNASGTAVFDPYLMCWSSFLCSLLSIPLSIFPPVEDTSHSFGLADPTIFGAPVPILALVADQQAAMFGQCCFDVGSVKLTMGTGSFISINTGETLHTSIAGLYPLIGWKVGDEVVCLAEGNASDTGTAIKWAEELNLFTSVADTEAMARSVPDCGGIYLVPSFSGLQAPINDPYACASFMGLKPSTSKSHLVRAILESVAYRNKQLYDTVLRETTIPITLIRADGGVSNNNFIMQMTADLLGQTIDKPKHTDMSSLGAAFLAGMAVYGPLKTS

SEQ ID NO: 69666 - DNA, 1554 bp, Dictyocaulus viviparus
  CDS (1)..(1554)
atggttctgcttgcggccatcgatcaaggaacgtcaagtagccgtttcctcgtttttgaggcagacagcggagagttgttggcaagccaccaaattgaagtgcaacaactttttccgaatccaggatgggtagaaatgaatccaatagaaattgttgatacggtaaaagaatgtatgacaaaagtagctgaacaattggaatcactttcaatcgcaaaatatgaaatcaaatcgattggaatagccaatcagagagagactactgtagtatgggatagcgagacaggaatgccgttatggaatgcgatagtatggctagataaccgtacagaggcactagcagaggaaagcattaagagaacaccaagcaggtcaaaagatgagttcaagagaaagactgggcttccaattcatccgtactttagtgcactaaaacttaaatggcttatggaaaacgttgatattgtgaaagaagcaaatgcacgaggtaaattaatgtttggaactatcgatacgtggctaatttggaaactaacaggagaacatgttactgatgttacaaatgcctcaagaactctgctgttcgatttacacaaacggaaatggtccactgaaatgtgtgaatttttcgacataccgcaacaacttcttccaaaaatcaagtcaagtgctgagatctacggccatattaccagtgggccgtttggaggggtcgcaatagcaggttgtttgggtgatcagcaagctgcaatggttggtcataactgcttaaacagaggtgacacgaagaacacctacggtaccggcacattcatgctgtgcaatattggtacaaatctaaaaatcagtaagagtggtctgttaacaacagtcgggtatcagttaggtcctgaatcacctcttgtatttgcgtttgaaggttccggttctatcggtggtaacgtggtccgtttccttcgcgataattttaactttataaaggaaactcgtcaaaaagcctccaatagctactgttttaaggatgcgtcggaaatggaggagatttgtcgaagtgtcgattctactgaaggtgtcgtttttgttccatgctttaccggtctctatactccctattgggatccgacagctaaaggcacaatccttggcttaacacaggtaacaacaaaagctcacatttgtttggctgcacttcaagctgtagcatttcaaagcgctgaaatgcttgaagaaattcaacaagaactcgaagacactccaatacatcatttttcgactgatggtggtatgacagcaaacgttcttttcaacgaaatacaatccgatattattggaaagcctattaaaactttgaaaattaccgaaatcacaggatggggtgcagctgtggcggcaggaattggttctcaacaaatatgcctcgatgcattttcctctaaacaaccaccggcaaccatctatgaacctcaaactgatgaacgacaacgagaatttgaaatgagtcgttggaaaaaaggcgtacgaagagcctgtaattggtctcatacttgtagctaa

SEQ ID NO: 69667 - protein, 517 aa, Dictyocaulus viviparus
MVLLAAIDQGTSSSRFLVFEADSGELLASHQIEVQQLFPNPGWVEMNPIEIVDTVKECMTKVAEQLESLSIAKYEIKSIGIANQRETTVVWDSETGMPLWNAIVWLDNRTEALAEESIKRTPSRSKDEFKRKTGLPIHPYFSALKLKWLMENVDIVKEANARGKLMFGTIDTWLIWKLTGEHVTDVTNASRTLLFDLHKRKWSTEMCEFFDIPQQLLPKIKSSAEIYGHITSGPFGGVAIAGCLGDQQAAMVGHNCLNRGDTKNTYGTGTFMLCNIGTNLKISKSGLLTTVGYQLGPESPLVFAFEGSGSIGGNVVRFLRDNFNFIKETRQKASNSYCFKDASEMEEICRSVDSTEGVVFVPCFTGLYTPYWDPTAKGTILGLTQVTTKAHICLAALQAVAFQSAEMLEEIQQELEDTPIHHFSTDGGMTANVLFNEIQSDIIGKPIKTLKITEITGWGAAVAAGIGSQQICLDAFSSKQPPATIYEPQTDERQREFEMSRWKKGVRRACNWSHTCS

SEQ ID NO: 69668 - DNA, 1596 bp, Pandanus amaryllifolius
  CDS (1)..(1596)
atggcgggcaggaaggaggtgttcgtggcggcgatcgaccaggggacgacgagcacgcggttcatcatctacgaccaggatgcgaaggccgtcgcctcccaccaggttgagttcactcagttctaccccgaggccgggtgggtggagcacaacccgatggagatcctggagagcgtgcgggtgtgcatggccaaggcgctggacaaggccacggccgacgggtacaacgtggacggcgggctcagggccatcgggctcaccaaccagagagagaccacggtggcgtggagcaagtccacgggtcttcccctctacaacgccatcgtctggatggacgtccgcaccagctctatctgcaggagattggagaaagagttgtcagggggaagaacccactttgtagagacctgtggcctgcccatcagcacctatttcagtgccctcaagatcctgtggttgatggagaacattagtgctgtcaaagaagccattaagttgggggatgccctgttcggcaccgtcgacacttggctgatatggaacctcactgggggttgttgcggtgtggaccgggagcagaacactgtccatggacttcatatcacggactgttcaaatgcttccaggaccatgcttatgaacctgaagacacttgattgggatcaccccacattagaaaccttgggtattcccatagaaatcttgcctaagatcattagcaattcggagaccattggtgtaattgccaatgggtggcccctatctggtattcctattgccggttgccttggggatcagcatgctgcaatgctaggccagttatgcaggaagggggaagccaagagtacctatgggacgggtgccttcattcttcttaacacaggtgaggaggtcatccagtcatctcatgggctgctcagcacacttgcttacaagttaggcccgcatgcacagacaaattatgcacttgaagggtccactgctattgctggtgcagctgttcagtggctgagggatggccttggtatcatacggtctgcagctgagattgaagaattggcagagggtgtagagaacactggaggagtgtactttgtgccagcattcaatgggctgtttgcaccttggtggcgtgaggatgcacggggggtgtgtttgggtatcacgaggttcacaaacaaggggcacatcgctcgagcagtgctagagagcatgtgcttccaggtgaaagatgtgctcaactcaatgcacaaggatgttggtgatgttggggaggcgaagaacaaggaaggcgagtttttgcttcgtgttgatgggggtgccactgttaacaatcttctgatgcagattcaggctgatctgttgggtagtccagttgtgagacctgccgacattgagactacagcccttggtgcagcatatgcagctggattagctaccggagtttggactgcagaacaaatatttgcttctgggcacatagagaaggctactgtgttccgtccaaaattggatgaggagaagaggaaaaagaggactgagtcttggtgcaaggctgtgtctagaacttttgatttggcagacctatcactttga

SEQ ID NO: 69669 - protein, 531 aa, Pandanus amaryllifolius
MAGRKEVFVAAIDQGTTSTRFIIYDQDAKAVASHQVEFTQFYPEAGWVEHNPMEILESVRVCMAKALDKATADGYNVDGGLRAIGLTNQRETTVAWSKSTGLPLYNAIVWMDVRTSSICRRLEKELSGGRTHFVETCGLPISTYFSALKILWLMENISAVKEAIKLGDALFGTVDTWLIWNLTGGCCGVDREQNTVHGLHITDCSNASRTMLMNLKTLDWDHPTLETLGIPIEILPKIISNSETIGVIANGWPLSGIPIAGCLGDQHAAMLGQLCRKGEAKSTYGTGAFILLNTGEEVIQSSHGLLSTLAYKLGPHAQTNYALEGSTAIAGAAVQWLRDGLGIIRSAAEIEELAEGVENTGGVYFVPAFNGLFAPWWREDARGVCLGITRFTNKGHIARAVLESMCFQVKDVLNSMHKDVGDVGEAKNKEGEFLLRVDGGATVNNLLMQIQADLLGSPVVRPADIETTALGAAYAAGLATGVWTAEQIFASGHIEKATVFRPKLDEEKRKKRTESWCKAVSRTFDLADLSL

SEQ ID NO: 69670 - DNA, 1560 bp, Glycine max
  CDS (1)..(1560)
atggcaaatgaagatgtgtttgttggcgcgatcgaccaaggaacgagcagcagcaggttcataatatacgacgcgaagactggagtagtaggatgccaccacgtggagttcacccagttctacccgcaagccgggtgggtggagcatgaccccatggagatcttggagagtgtgaaggtgtgcgtggccaaggccgtcgataaggccaccgctgatggcttcaacgtcgataaaggcttgaaggccattggtctcaccaatcagagagagaccactctcctctggagcaaatccaccggcctccctcttcacaacgccattgtttggatggatgctcgcacttcttccatttgcaggagattggaaaaggagttatctggcggtagaaaccattttgtggagagttgtggcttgcctattagcacatacttcagtgctttgaagctgctgtggttgatggaaaatgtagatgccgtaaaggaggccataaagaaaaaggatgcgctgtttggaactattgacacttggttgatatggaatctaactggtggggtgaatgggggattgcatgttaccgatgtttcaaatgcatctcgtacaatgctcatgaatctaaaaacccttgactgggatgcatctaccttaaaaacccttaatattcctgctgaaattttgcctaatattgttagtaatgccgaaattataggagaggttgggtctggatggccaattgctggtgtccctattgctggatgtttaggggatcaacatgctgcaatgttaggacaatcatgccgtaaaggggaggctaagagcacttatggcacaggtgctttcatactactaaatactggtgaagggataattcaatcgaagcacggtcttttatccactatagctttcaagcttggcccaaaagctccaaccaattatgcattggaaggatcagttgctattgctggagctgcagtgcagtggcttagagacggtcttggcatcatttctagtgctgcagagatagaggagatggcattacaggttgaatccactggtggggtttactttgttcctgcttttaatggattgtttgccccatggtggcgtgaggatgctcgcggggtttgtattggaataacaaggtttacaagcaagggtcacattgcccgagctgtgcttgagagcatgtgtttccaagtgaaagatgtcttggattcaatgcataaagattcaggagaaagtgaatcccaaaaaacagagtttttgcttagagtggatggtggggcaactgtaaacaacctgctgatgcagattcaggcagatttggtgggatgtccagtaattagacctgctgacatagagacaacagcacttggagcagcctatgctgccggattagctactgggatttggaaagaagattttattttcaatactgaggagaagttgaagaatgctagagttttccgtcctgtaatgactgaggaagtaaggaaaaagaaagttgactcttggtgcaaagctgttagtaaaactttcgacttagctgatcttgctatttaa

SEQ ID NO: 69671 - protein, 519 aa, Glycine max
MANEDVFVGAIDQGTSSSRFIIYDAKTGVVGCHHVEFTQFYPQAGWVEHDPMEILESVKVCVAKAVDKATADGFNVDKGLKAIGLTNQRETTLLWSKSTGLPLHNAIVWMDARTSSICRRLEKELSGGRNHFVESCGLPISTYFSALKLLWLMENVDAVKEAIKKKDALFGTIDTWLIWNLTGGVNGGLHVTDVSNASRTMLMNLKTLDWDASTLKTLNIPAEILPNIVSNAEIIGEVGSGWPIAGVPIAGCLGDQHAAMLGQSCRKGEAKSTYGTGAFILLNTGEGIIQSKHGLLSTIAFKLGPKAPTNYALEGSVAIAGAAVQWLRDGLGIISSAAEIEEMALQVESTGGVYFVPAFNGLFAPWWREDARGVCIGITRFTSKGHIARAVLESMCFQVKDVLDSMHKDSGESESQKTEFLLRVDGGATVNNLLMQIQADLVGCPVIRPADIETTALGAAYAAGLATGIWKEDFIFNTEEKLKNARVFRPVMTEEVRKKKVDSWCKAVSKTFDLADLAI

SEQ ID NO: 69672 - DNA, 1893 bp, Pichia farinosa
  CDS (1)..(1893)
atggtacgtcgtcaaagtaacgcccctacgcatccattaattgcatccattgatattggaaccacttcggcgagaaccatcttgtttgatgaacatggaaccgaaattgccaagaatcagatcgagtattctaccacggcctcggaggcgccggctgattccaaaaataaggaacaatttagaagaaggtcttccttgatgaggcataatgagcccattttcagtgctgagggtattgccatttcgattactgacgatgttatgatcgaaaacaacgctgccagcgttggtccaactttgcgttatcctaagccaggttgggttgagtgtatgcctgtgcacatattggcaaacgcggtccagtgtttagctgcatccttgataaccttgcgtaagatcaaccagaatcccgctctcaagatcaagtacaaggtgaaagcaataggtattgctaacatgagagagaccacgatcgtatggtctcgtaaaacaggaaagccattgagcaatggtatcacctggactgatacgagaactgcagaaatcgtgcagcacttagaacgtatgacagatgacgagaaaaaggctgaattgaaccagaaaaccggtttacctctttcaacctacttttcagctgccaagttacgttggttattagataatgatgatacaattagagaagagtatgagaaaggcgaaggcaatttaatgtttggaactgttgacacttggttaatctacaacatgacgaaagaaaaatcttttgtttcggatgtcacaaacgcctcaagaacatatttcatggacttggaaacgaaggattacgacgatgagttattagagttctgggacatcgatcctactaggatctgtttgccaaagattgtgtcaagttctgaattttatggttcgtttgctactcctaacttatctaacttaggattccataataagattcacaccctgggcttaagaaatcttgaagactcttactgtaccccaatttgtggttgccttggtgatcagtctgcttccttagttggccagttagcgttccgtccaggttctgccaaatgtacatatggtaccggttgtttcttgttgtataacacaggtattcgaaaattgatttcgcaacatggtgccttaagtacaatcggatactggttcccaactttatccgaagacgacgggaagccacgttacgcattggaaggttcaattgcagtcgctggttcgattattcagtggcttagagacaacttgaagcttatagagcaatcgaaagatgtaggtccattggcttccctggttcatgactccggtggtgttgtatttattcctgcattctctggtctttatgctccctactggaacagcggtgcaagaggtactatctttggtatgactcagtacacctcagctagtcatatagccagagcagcccttgaaggtgtatgtttccaagttagatctattcttaaagctatggctgacgacgctggtactagcgcggactttttggaagaagccttaaatactcagaatgagtctactcctttggccacattggcagtagatggtggtatgtccaaggcagatgaagtcttgcaaattcaagctgatattttgggaccctgtgtaactgttaagagggctcagatatctgaatgtacagcattaggtgctgcaattgctgcaggattatctttcaaagacgaaaatgaaagagtgtggaaagattttaatgatgtgtttgaaaaaattgatgctgcaaacggaaacaactccttcaaagccaagttaccagacgcagagagaagaagaaattggagaagatgggaacgtgccattgacagggctaaagattggttggatcagaacaatgactaa

SEQ ID NO: 69673 - protein, 630 aa, Pichia farinosa
MVRRQSNAPTHPLIASIDIGTTSARTILFDEHGTEIAKNQIEYSTTASEAPADSKNKEQFRRRSSLMRHNEPIFSAEGIAISITDDVMIENNAASVGPTLRYPKPGWVECMPVHILANAVQCLAASLITLRKINQNPALKIKYKVKAIGIANMRETTIVWSRKTGKPLSNGITWTDTRTAEIVQHLERMTDDEKKAELNQKTGLPLSTYFSAAKLRWLLDNDDTIREEYEKGEGNLMFGTVDTWLIYNMTKEKSFVSDVTNASRTYFMDLETKDYDDELLEFWDIDPTRICLPKIVSSSEFYGSFATPNLSNLGFHNKIHTLGLRNLEDSYCTPICGCLGDQSASLVGQLAFRPGSAKCTYGTGCFLLYNTGIRKLISQHGALSTIGYWFPTLSEDDGKPRYALEGSIAVAGSIIQWLRDNLKLIEQSKDVGPLASLVHDSGGVVFIPAFSGLYAPYWNSGARGTIFGMTQYTSASHIARAALEGVCFQVRSILKAMADDAGTSADFLEEALNTQNESTPLATLAVDGGMSKADEVLQIQADILGPCVTVKRAQISECTALGAAIAAGLSFKDENERVWKDFNDVFEKIDAANGNNSFKAKLPDAERRRNWRRWERAIDRAKDWLDQNND

SEQ ID NO: 69674 - DNA, 1494 bp, uncultured marine alpha proteobacterium HOT2C01
  CDS (1)..(1494): transl_table=11
atgtctttagatgggtatttactctcaatagatcaaggcacaaccagttcacgggccttaattttagatattcaaggaaatatcattagtcaaaaaaactttgaatttaaacagtatttcccaaatgatggctgggttgagcatgatccaatagaaattttaaaaacaacacaagacgctattaaatatgtaattaaagaaacaaacattagcccaaaagatattaatattgcaggtataacaaatcaaagagagacggttgttgcatggaacaaaataacaggaaagccagtctacaatgctattgtgtggcaagacaggcgaacagaaaacttttgtgagacattaagagaaaataatttaacaaaactaattcaatcaaagactggtctcataatagatccttacttttcagcaacaaaaattaaatggattattgaaaatattgaagaagcaaaaaaaacaattcatgaaaatcatttgttagttggaactattgactcctggctcatttggaattttacaaaaggtgaatgtcattatactgatgttacaaatgcatcaagaacaatgctttataatataaatgaagattgttgggatgatgaattattagatatttttaatattaacaaatatattttgcctgatgttaaaaattgcgttgatgattttggagaaatagatagcagtttttttggtgaaaaaattccaataggtggcgtagctggcgatcaacaggcagcaactattggacaggcctgtttcaaagaaggaatggttaaatcaacttatggtacaggttgctttttattaatgaatactggaaacaaatttatagagtcagaatctaaattgttgtctaccaaagcttataatatattcgataaaaaagattttgctttagagggcagtatcttcaatgcgggcactgttgttcaatggatgcgtgatgaaatgaattttattaacgatgcaagcaaggtcgaagagcttgcaaagaacagcaagaacacaatacaattcatccctgcttttactggtttgggtgctccatattggaactctgatgtaaggggtcaaattacaggaattactcgagatacctctaaggctgatattgccatggcagcactaaaatcaatttgttatcaaacaagagaccttctagagtgccttcttgacgatacagaactaaagagaagtgattttactattcgagttgatggaggcatgtctaaaaataatcttatgatgcaattgttatcggatatcactcaagtgagaattgaaaggcctttgaatcaagaatcaacagctatgggcgcagcttacttagccggaatgaaatctggcgtttacaaagatgttgcagaggtcgagaaattatggaagactgactgcaaatttgaaccctctattacattggatgaagcagatcaacaatataacagatggttaaaaatggtaagaggactgattaataatggttga

SEQ ID NO: 69675 - protein, 497 aa, uncultured marine alpha proteobacterium HOT2C01
MSLDGYLLSIDQGTTSSRALILDIQGNIISQKNFEFKQYFPNDGWVEHDPIEILKTTQDAIKYVIKETNISPKDINIAGITNQRETVVAWNKITGKPVYNAIVWQDRRTENFCETLRENNLTKLIQSKTGLIIDPYFSATKIKWIIENIEEAKKTIHENHLLVGTIDSWLIWNFTKGECHYTDVTNASRTMLYNINEDCWDDELLDIFNINKYILPDVKNCVDDFGEIDSSFFGEKIPIGGVAGDQQAATIGQACFKEGMVKSTYGTGCFLLMNTGNKFIESESKLLSTKAYNIFDKKDFALEGSIFNAGTVVQWMRDEMNFINDASKVEELAKNSKNTIQFIPAFTGLGAPYWNSDVRGQITGITRDTSKADIAMAALKSICYQTRDLLECLLDDTELKRSDFTIRVDGGMSKNNLMMQLLSDITQVRIERPLNQESTAMGAAYLAGMKSGVYKDVAEVEKLWKTDCKFEPSITLDEADQQYNRWLKMVRGLINNG

SEQ ID NO: 69676 - DNA, 1539 bp, Trypanosoma congolense
  CDS (1)..(1539)
atgaagtatgtcggatccattgaccagggcacaaccagtacccgttttattatttttgatgagaggcagaggcctgtcgctgtccaccaggtgccacacacgcagcacaccccgcaccccggatggctggaacacgatgcgatggaaatattccgttccgcgtgcaagtgcattgctggcgctattgccaagctgaagaagaaagatccgtcgttcagcaggattgaggcgatcggcatcacaaaccagcgtgagacaacagtggcgtgggatcgcgtgacgaagcagcccctgtgctttgcccccgtgtggaatgacctgcgtacgtacgacataacgaagagagtgacggcagagtgcggtggtggcgacccgatgtttgcctccaagatgactgggctgccagtgagcacgtacttctccgcatttaagatgaagtggatgatggagaacgttcccgccgttgcggaggcatgtcgtcgcgggacgctgtgcttcggtaccattgacacatggttgatgtacaagctgagcaatggtaaggcgtttgtgaccgatgtgacgaatgcctcgcggaccttcctcatggacctccgcacaaggaggtggtctccggagctgtgcgagaagctgcagatcccggtcgaatgcctgcctgaaatccgcagtaacagtgagctcttcgcgcacgttgagaccaatgagtgtggcgttgcaactgcccttgggcgattgacgcccatcatgggaagcatcggcgaccaacaagccgccctgttcggcaacatgtgcttccagaagggcgaggcgaaaaacacgtacggtactgggtgcttcctcctgatgaacgttggcgacaaggtacgcttctccaagcacggactgctctccaccgtcggcttccaggtgggcagggacggtccttgccactacgctctcgagggttccattgcgtgcgccggtgcgacggttgaatggatgcgacggaacatgaacctgttcggccacatcagtgaatgcgagaagcttgcccgcagtgttcccggcactcagggtgttgtcttcgttcccgccttctccgggctgctggcgccctattgggacccctcggctcgtgggaccatcgtcgggatgacgcttaagacgacacgcgcacatatcatccgtgcagccctgcaggccatcgctctgcagctcaacgacgtcgttggctcgatgaaacgtgatgctggcctcagccttacttccctccgtgttgacggcggcctcacgaagaacggactgctgatggaaatccaatccaacctactgggtgttgacatccttgtcccgtcgatgcacgagactactgcactcggtgccgccctgtgtgccggtctcgctgctggtgtatggtcctctctggatgaagtaaaggctgtctcactccgcgagaactcgtggaggacggtcagccccactggctcccccgaggagcgcacggagatgattgccgaatggaaggaggcactcaagcgcacaaagtgggccaagctataa

SEQ ID NO: 69677 - protein, 512 aa, Trypanosoma congolense
MKYVGSIDQGTTSTRFIIFDERQRPVAVHQVPHTQHTPHPGWLEHDAMEIFRSACKCIAGAIAKLKKKDPSFSRIEAIGITNQRETTVAWDRVTKQPLCFAPVWNDLRTYDITKRVTAECGGGDPMFASKMTGLPVSTYFSAFKMKWMMENVPAVAEACRRGTLCFGTIDTWLMYKLSNGKAFVTDVTNASRTFLMDLRTRRWSPELCEKLQIPVECLPEIRSNSELFAHVETNECGVATALGRLTPIMGSIGDQQAALFGNMCFQKGEAKNTYGTGCFLLMNVGDKVRFSKHGLLSTVGFQVGRDGPCHYALEGSIACAGATVEWMRRNMNLFGHISECEKLARSVPGTQGVVFVPAFSGLLAPYWDPSARGTIVGMTLKTTRAHIIRAALQAIALQLNDVVGSMKRDAGLSLTSLRVDGGLTKNGLLMEIQSNLLGVDILVPSMHETTALGAALCAGLAAGVWSSLDEVKAVSLRENSWRTVSPTGSPEERTEMIAEWKEALKRTKWAKL

SEQ ID NO: 69678 - DNA, 1497 bp, Flavobacterium meningosepticum
  CDS (1)..(1497)
atggatgaaaaactaattttagcactagatcagggaacaacttcttcaagagcaatcttgttcaacaagaatggagaaataaaatttgtttcacagaagaactttgaacaaatattccctacaccgggatgggtagaacacgatccgaatgagatatggtcttcccagatttccgttgcagcagaagtaattgcaaaagccggaatttcgggtcttgaagttgctgccataggaatcacaaaccaaagagaaactactgttgtatgggacagacataccagtgaacctatttataatgctattgtatggcaggacagaagaacatccaaatactgcgacgaactaaaatcccagggacacacagatgaaataaaagaaaaaacaggacttgttctggacgcttatttttctgccactaaactaaaatggatactggataatgtagaaggtgccagagaaaaagccgaagctggcgatctttgttttggtacagtcgatacgtggctgatatggaaactgacaagaggaaaaatgtttattaccgatgtttccaatgccagcagaaccatgttgttcaacatccataaaatggattgggatgaggatttactgaaactgtttaatattccaagagctattcttccggaagtaaagcaaagcagtgaggtatatggtgaaacagctactaccctcttttctacaaagattcctattgcaggaatcgcgggcgatcagcaggctgctttattcggacaaatgtgtactaagcccggaatggtaaaaaacacatacggaacaggctgttttctgttaatgaatactggtaacgaggctgtttcttccaaaaacaatctgttaactaccgtagcctggaaaattaacggcgaagtcagctatgcacttgaaggaagtgtttttgttggcggagctgccatacagtggttaagagatggtttaaaaattattcatgacgcggcagaagtaagtactcttgcgggaagcgttaaggataatggcggtgtttattttgttcctgcacttacaggacttggagcaccttactgggatcaatatgcacgcggaactattgtaggaataacacgcggaacaactgatgctcatgttgcaagagcaactttagagggaattgcttttcaggtatatgatattgtaaaggctatggaagccgatgccggaacagaaagttctgagctgcgtgtagatggtggtgcctctgctagcaatttgttgatgcagatacaatctgatttatttggttttaaaattattcgtcctcagacgcttgagaccacagcattgggagcggcatatctggccgggcttgcagttggcttctgggaaagtatagatgaaattcaatctcagtggattattgagaaggaattccagcctgcactggaaaaagatcaggtaaacaaaatgatcaactcatggcacaaagctgtagaacgttcacaagcctggactgaggaatag

SEQ ID NO: 69679 - protein, 498 aa, Flavobacterium meningosepticum
MDEKLILALDQGTTSSRAILFNKNGEIKFVSQKNFEQIFPTPGWVEHDPNEIWSSQISVAAEVIAKAGISGLEVAAIGITNQRETTVVWDRHTSEPIYNAIVWQDRRTSKYCDELKSQGHTDEIKEKTGLVLDAYFSATKLKWILDNVEGAREKAEAGDLCFGTVDTWLIWKLTRGKMFITDVSNASRTMLFNIHKMDWDEDLLKLFNIPRAILPEVKQSSEVYGETATTLFSTKIPIAGIAGDQQAALFGQMCTKPGMVKNTYGTGCFLLMNTGNEAVSSKNNLLTTVAWKINGEVSYALEGSVFVGGAAIQWLRDGLKIIHDAAEVSTLAGSVKDNGGVYFVPALTGLGAPYWDQYARGTIVGITRGTTDAHVARATLEGIAFQVYDIVKAMEADAGTESSELRVDGGASASNLLMQIQSDLFGFKIIRPQTLETTALGAAYLAGLAVGFWESIDEIQSQWIIEKEFQPALEKDQVNKMINSWHKAVERSQAWTEE

SEQ ID NO: 69680 - DNA, 1692 bp, Xenopus laevis
  CDS (1)..(1692)
atggccgcgtccaacagagttattctgggacctctggtgggagccattgaccaaggaacgagttcgacacgatttctggtttttaatgcaaaaacagcagaactgctaagccaccatcaagtagaaatcaaacaaaagtttccaaaagaaggatgggtagagcaagatccaaaggaaattttacggtctgtttatgaatgtgtagagaagacgtgtgagaagctgacccaactaaacattgacatcacaaatatcaaagcaattggagtcagtaaccaaagggaaacaactgtggtgtgggacaagacaacaggagagcctctgtacaatgctattgtttggctagatttgagaacacaatcaactgtagaacgacttttaaaaagaattccaggcaaaaataagaattttttcaagagtcggactggtcttccacttagcacttacttcagtgcagtgaaaattcgatggcttctagacaatgtggaagagattagacatgctgtttcagagggaagagcaatgtttggaacagttgattcctggatcatttggagtcttactggtgcaaagaatggaggggtgcattgtacagatgtgaccaatgccagcagaacaatgctgtttaatattcatacattggaatgggacacagagctctgccagttttttgatatacctatggaattattgccaaaagtgagaagttcatcagagatctacggtcttatgaaaatctgtcctagcctgaagtctggagctttgactggagttccaatatctgggtgtttaggagaccagtcagctgctttagtaggacaaatgtgtttccaagatggacaagctaaaaatacatatggtacaggctgctttttgctgtgcaacacaggctcaaagcctgtgctctctgaccatggccttttgacaactgttgcttacaagctaggaagggatacacctgcatgttatgccctcgagggttcagttgccatagcaggagcagtagtacgctggttgagagacaatcttggaattgtgaagactactgaggaagtagaaaaactcgctgctgaagttgggacgtcatatggctgctactttgttcctgcattttcaggtttatacgctccctattgggagccgagtgccagaggtatcatctgtggcctcacccagtttacaaacagaaaccatattgcatttgctgctcttgaagctgtgtgtttccagactagagagattctggatgctatgaaccaagattgtggcattcctctcaatcaacttcaggttgatgggggtatgacaagcaacaaaatcctaatgcagttgcaggctgatatactgtgcattccagtagtgaaaccatccatgcctgaaacaactgcactgggtgctgctatggctgcaggcgctgctgaaggtgttggcgtctggagcctaaatcctggagatttaactgctgtaacatgtgaacggtttgaaccacaaatcaacccagaagaaagtgaatttcgatatgctagatggaaaaaggcagtgttgaaatcaatggactgggaatcagcagagcctacctccaatggaaatggtgactgtagtatcttctgtagtcttcctctggggctttatatagtgagtagcatggtattattaatcggagcaaagtacatctcaggtcttaataaataa

SEQ ID NO: 69681 - protein, 563 aa, Xenopus laevis
MAASNRVILGPLVGAIDQGTSSTRFLVFNAKTAELLSHHQVEIKQKFPKEGWVEQDPKEILRSVYECVEKTCEKLTQLNIDITNIKAIGVSNQRETTVVWDKTTGEPLYNAIVWLDLRTQSTVERLLKRIPGKNKNFFKSRTGLPLSTYFSAVKIRWLLDNVEEIRHAVSEGRAMFGTVDSWIIWSLTGAKNGGVHCTDVTNASRTMLFNIHTLEWDTELCQFFDIPMELLPKVRSSSEIYGLMKICPSLKSGALTGVPISGCLGDQSAALVGQMCFQDGQAKNTYGTGCFLLCNTGSKPVLSDHGLLTTVAYKLGRDTPACYALEGSVAIAGAVVRWLRDNLGIVKTTEEVEKLAAEVGTSYGCYFVPAFSGLYAPYWEPSARGIICGLTQFTNRNHIAFAALEAVCFQTREILDAMNQDCGIPLNQLQVDGGMTSNKILMQLQADILCIPVVKPSMPETTALGAAMAAGAAEGVGVWSLNPGDLTAVTCERFEPQINPEESEFRYARWKKAVLKSMDWESAEPTSNGNGDCSIFCSLPLGLYIVSSMVLLIGAKYISGLNK

SEQ ID NO: 69682 - DNA, 1509 bp, uncultured bacterium
  CDS (1)..(1509): transl_table=11
atgtcagcacaaaaagacattattattgcgcttgatgaaggcaccaccaatgccaaagccgtagcgctggatggtcagggaaacgtggtcgcgaagttctcccgcgcgctggcgatccacacgccccgtgaaggctgggttgaacagtcaggtgatgcacttctggacgcatcactggatgttgtggcacaagccattacctgcgtcggcgcacaacgcgtcgcagcgctggcgatcagcaatcaacgtgaaacggcgataggctggtatcgtgccagcggtcgccctctcggccctgctatcacctggcaatgttcgcgcacggccgatttttgccgtgcattacgtgaacaggggcacgaggcgtacataaaatccatcaccggattacccgttgccccactcttttccgcctctaaaatgcgctggctgctggagtcagttcccaacggtatgacgctcgcacagcaaggggaaatatgtctcgggaccatcgatagctggttactgtggaacttaacgcacggcgaggaatttcgttgcgacatctccaacgcttcacgcacgcagttgctcaatctcaacagcggacaatgggatagcgagatgttggctctatttggtattccgcagcaggcgttgcccgaagtttgcccttccagccaccattttggcgtaacaaaaggtctggagaggatacctgatggaatccctattctggcgatgattggcgactctcatgctgcgctttttgcccatgggctgggtatggaaggctgcgtcaaagcgacctatggcaccggatcttccgttatggctcccgtattctcggcgcagtccgaggtgagcgcgctggcaacgaccattgcctggcatgacgctgacaccctggtctacgggctggaaggtaatattccgcatacgggagatgccgtcgcatggatggccgatagcacaggtcttagcgaattaccggaagagcaactgcttcatgagctcaatacgctgcccgccacggttgactccacgctgggcgtctattttgttccggcccttaccgggctgggcgcgccctggtgggatgaagatgcccgggggttgattcacggtctcagccgcggagtgaaacgcgcacatctggtacgtgcggcactggagtcgattacctatcagattgccgatgttgttttagcgatgcgccagcacaacggttttcgactcagcgcgttaatggttgatggcgggccaacaaaaaatgactggctaatgcagtatcaagccgatttattgggctgtccggtgatgcgcagcgatatccctgaactttccgctatcggtgccggattgctggcacgcaagaagctgcaaggtgcatctaccagccagttgcgagattatctgcccgatcacgtatcgttccagccaaacatggcgcgccatgggagattgcaaaaacgctggcatgaatggcaaggagccgtcgaacgcacccgttggcaaacccgttaa

SEQ ID NO: 69683 - protein, 502 aa, uncultured bacterium
MSAQKDIIIALDEGTTNAKAVALDGQGNVVAKFSRALAIHTPREGWVEQSGDALLDASLDVVAQAITCVGAQRVAALAISNQRETAIGWYRASGRPLGPAITWQCSRTADFCRALREQGHEAYIKSITGLPVAPLFSASKMRWLLESVPNGMTLAQQGEICLGTIDSWLLWNLTHGEEFRCDISNASRTQLLNLNSGQWDSEMLALFGIPQQALPEVCPSSHHFGVTKGLERIPDGIPILAMIGDSHAALFAHGLGMEGCVKATYGTGSSVMAPVFSAQSEVSALATTIAWHDADTLVYGLEGNIPHTGDAVAWMADSTGLSELPEEQLLHELNTLPATVDSTLGVYFVPALTGLGAPWWDEDARGLIHGLSRGVKRAHLVRAALESITYQIADVVLAMRQHNGFRLSALMVDGGPTKNDWLMQYQADLLGCPVMRSDIPELSAIGAGLLARKKLQGASTSQLRDYLPDHVSFQPNMARHGRLQKRWHEWQGAVERTRWQTR

SEQ ID NO: 69684 - DNA, 1488 bp, Borrelia hermsii
  CDS (1)..(1488): transl_table=11
atgaaatatattctatctcttgaccaaggcacaactagttcaagagcggtaatattcgataagaatgcaaacataaaaggatttgcaaaaaaggaatttaaacaaatttatccacatccaagttgggttgagcacgatccaaacgaaatatggggctctctactaggagttatggcagaagctttagcaaacgcaagaacttttcccaataatattgaagcaattggaatcacaaatcaaagagaaacgaccattatttgggataggaacacaggacatccaatttataacgcaatagtctggcaagacagaagaaccgcacaactttgtgatgaattaaaatcaaaaggaaaagataaaatttttttacaaaaaacaggtcttgtattagatgcttactttagcggcacaaaaataaaatggatactggacaatgttgcaggagcaagaaaacgagcagaaaaaggggaactatgtttcggaacaatagatacttggatagtatggaaccttactaaaggaaaaatacatattacagattattctaacgcatcaagaactctacttttaaacattaaatcacttaaatgggactgtgatctattacaaatattagacatcccaaaatcacttttacctgaacttaaacaaagttccgaggtgtatggcaaaaccgacgcttccgcactgggaacagaaatcattatttcaggaattgcaggggatcaatttgcagcaacatttggacaagcatgtcttcaaaaaggaatggctaaaaatacctatggaactggctgctttgtcactgtcaacataggaaaaaaacccatcataaatgaacaaaaaattttaacgtcaattgcatggggaagaaaaaattcaataacttatgtttttgagggaagtgttttcattgggggagctgtaattcaatggttaagagacaatctagaactatttagaaaaagcggtgatgcagaggcagtagcagcctcagtagataataatgggggcatttatttcgtgccagcatttgtaggacttggaacacctcattgggatccttatgccagaggaatgattattggacttacaagaagctcaacaaaagaacatattacaagagcggctcttgaaagcattgcattgcaaagctttgatgtactaaccgaaatgcaaaactctattcaagaatttgaaataaaggaattaagagttgatgggggagctagtaaaaataatctacttatgcaattccaagctgatattttacagtgcaatgttgtaaggcccaaaatcacagaaacgaccgctcttggttctgcctatctagcaggacttgctgttggatattgggaaagtgctgaagagattacaagtctttggaaatcagataaaatatttgaaccttcaatggaaaaaagtaaaagagaagatttaatctataattggaataaagctattaagagggcaaaagcttggatttaa

SEQ ID NO: 69685 - protein, 495 aa, Borrelia hermsii
MKYILSLDQGTTSSRAVIFDKNANIKGFAKKEFKQIYPHPSWVEHDPNEIWGSLLGVMAEALANARTFPNNIEAIGITNQRETTIIWDRNTGHPIYNAIVWQDRRTAQLCDELKSKGKDKIFLQKTGLVLDAYFSGTKIKWILDNVAGARKRAEKGELCFGTIDTWIVWNLTKGKIHITDYSNASRTLLLNIKSLKWDCDLLQILDIPKSLLPELKQSSEVYGKTDASALGTEIIISGIAGDQFAATFGQACLQKGMAKNTYGTGCFVTVNIGKKPIINEQKILTSIAWGRKNSITYVFEGSVFIGGAVIQWLRDNLELFRKSGDAEAVAASVDNNGGIYFVPAFVGLGTPHWDPYARGMIIGLTRSSTKEHITRAALESIALQSFDVLTEMQNSIQEFEIKELRVDGGASKNNLLMQFQADILQCNVVRPKITETTALGSAYLAGLAVGYWESAEEITSLWKSDKIFEPSMEKSKREDLIYNWNKAIKRAKAWI

SEQ ID NO: 69686 - DNA, 1491 bp, Bacillus subtilis var
  CDS (1)..(1491): transl_table=11
atggaaacgtacattttatccttagatcaggggacgacaagttcaagagcgattctgtttaataaagaaggcaaaattgtccactctgctcaaaaggaatttacacaatacttcccgcatcctggctgggttgagcataatgccaatgaaatttggggctctgtcctcgcggttatcgcctcagtcatctctgaatcaggaatcagcgcttctcaaattgccggcatcggcatcacgaaccagcgcgagacgacggttgtgtgggataaagatacaggaagtcctgcctataatgcaatcgtttggcagtccagacagacgcccggcatttgtgaggaacttcgtgaaaaaggatataatgataaattcagaaaaaaaactgggcttttaatcgatccatactactccggcacgaaggtgaagtggattttagacaatgtggaaggcgcgggagaaaaagcggaaaaaggcgagctgctgtttggaacgattgatacgtggctcatttggaaaatgtcaggcggaaaagcgcatgtgaccgattactccaatgcctcaagaacactgatgtttaatatttacgatttaaaatgggacgatgaactgctcgacattctaggcgtaccgaaatccatgctccctgaagtgaagccgtcctctcatgtgtatgcggagactgttgattatcacttcttcggaaaaaatatcccgattgcgggagcggcgggcgaccagcagtccgcattgttcggccaggcatgctttgaagaaggcatggggaaaaacacatacggcacaggatgtttcatgctgatgaataccggggaaaaagcaattaagtccgaacatgggcttttgacaacaatcgcttggggcattgacggaaaagtgaactatgcgttagaaggaagcatttttgtcgcaggctctgccatccagtggcttagagacggtttgagaatgttccaggattcatcgctaagcgaatcttatgcagaaaaagtggattcaactgacggcgtgtatgtcgttccagcatttgtcggactgggaacgccttactgggacagtgatgtgcgcggttcggttttcggcctgacaagagggacaacaaaagagcactttatccgtgcgacactggagtcattggcttatcaggcaaaagatgtgcttgacgcaatggaagcagattcaaacatttcattaaagacgcttcgtgtagatggaggagctgtgaaaaacaatttcctgatgcagttccaaggagacctgttgaatgttcctgtggagcgcccggaaattaatgaaacgactgcgcttggcgcggcttatttggcaggtatcgctgtgggattctggaaggaccgttctgaaatcgcgaaccagtggaatctggataaacggtttgagcctgaattagaagaagaaaaacgaaatgagctgtataaaggctggcaaaaagccgtgaaagcagctatggcttttaaataa

SEQ ID NO: 69687 - protein, 496 aa, Bacillus subtilis var
METYILSLDQGTTSSRAILFNKEGKIVHSAQKEFTQYFPHPGWVEHNANEIWGSVLAVIASVISESGISASQIAGIGITNQRETTVVWDKDTGSPAYNAIVWQSRQTPGICEELREKGYNDKFRKKTGLLIDPYYSGTKVKWILDNVEGAGEKAEKGELLFGTIDTWLIWKMSGGKAHVTDYSNASRTLMFNIYDLKWDDELLDILGVPKSMLPEVKPSSHVYAETVDYHFFGKNIPIAGAAGDQQSALFGQACFEEGMGKNTYGTGCFMLMNTGEKAIKSEHGLLTTIAWGIDGKVNYALEGSIFVAGSAIQWLRDGLRMFQDSSLSESYAEKVDSTDGVYVVPAFVGLGTPYWDSDVRGSVFGLTRGTTKEHFIRATLESLAYQAKDVLDAMEADSNISLKTLRVDGGAVKNNFLMQFQGDLLNVPVERPEINETTALGAAYLAGIAVGFWKDRSEIANQWNLDKRFEPELEEEKRNELYKGWQKAVKAAMAFK

SEQ ID NO: 69688 - DNA, 1518 bp, Lactobacillus rhamnosus
  CDS (1)..(1518): transl_table=11
gtgacaaacgaacagcagtatattctggcgattgatgaaggaacaaccagcacgcgtaccatcatcatcgatcacaatgggcaaaaagttgctgatgcccagcgcgaatttccacagtattttccacatcctggttgggttgaacataacgcaaatgaaatctggaatgctgcgttatccacgattgccacagcgtttatcgaatcgcatattcagccgcgccaaattgttgggatcggcattacgaatcagcgggaaacaacggtcgtgtgggataagcaaactgggctgcccatttacaacgccattgtttggcaatcccgtcaaaccagcgacattgctgatcaacttaaagcggatggctatgctgatctagttcacgatgccaccggtttgctaattgattcctacttctctgctaccaaaattcgctggattctggatcatgtaccaggagcgcaggaacgggctgaaaatggtgaattgctttttggcaccattgacacttggctatcatggaagctttctggcggtgccattcatgtcaccgactacaccaatgcttcacgaaccatgctcttcaatatccacaagttggattgggatgatgagatcttacggattctcaacatccccaagcaaatgctgccggaagttcgcagcaattcagaaatttatggggatgcagcagcctatcatttcttcggcagtaccgttcccattgccggtatggtcggggatcagcaagcagcattattcggacagctggctatcgaaccgggaatggtcaaaaacacgtatggtaccggtgcctttatcgtcatgaataccggcgataagccaaccttgtcgaatcataatctgctaaccactattggctacggacttaacggcaagatcacttatgccttggaaggttcggtctttgtggctggcagcgccattcaatggttacgtgatgccatgaaactgattgagcgttcaagcgactccgaagctgccgcacgagcatccaagagtcaaaacgaggtctatgtcgtccctgcctttactggcttaggtgctccttactgggattcggatgcacgtggcgctattttcggaattacccgtggaacaactcgggaagacttcatcaaggcaacgttacaatcgcttgcttatcaatcccgtgatgttgtcgacacgatgaacaaggataccggcatgccgattccagctctgcgcgttgatggcggggctgctaataacgattacctcatgcagtttcaggcggatatccttggtattccgattgaacgcgccgccaaccttgagaccactgccatgggtgccgccttctttgccgggctagcaaccggattctggaacagcaccgatgaactccaaagtatcgtcaaggtcggtaagcgctttgaaccgaccatggacgtatcagaccgggaatcactttacgaaggctggaaacaagccgttgccgccacccaacagtacaagcacacctccaagcaagactaa

SEQ ID NO: 69689 - protein, 505 aa, Lactobacillus rhamnosus
MTNEQQYILAIDEGTTSTRTIIIDHNGQKVADAQREFPQYFPHPGWVEHNANEIWNAALSTIATAFIESHIQPRQIVGIGITNQRETTVVWDKQTGLPIYNAIVWQSRQTSDIADQLKADGYADLVHDATGLLIDSYFSATKIRWILDHVPGAQERAENGELLFGTIDTWLSWKLSGGAIHVTDYTNASRTMLFNIHKLDWDDEILRILNIPKQMLPEVRSNSEIYGDAAAYHFFGSTVPIAGMVGDQQAALFGQLAIEPGMVKNTYGTGAFIVMNTGDKPTLSNHNLLTTIGYGLNGKITYALEGSVFVAGSAIQWLRDAMKLIERSSDSEAAARASKSQNEVYVVPAFTGLGAPYWDSDARGAIFGITRGTTREDFIKATLQSLAYQSRDVVDTMNKDTGMPIPALRVDGGAANNDYLMQFQADILGIPIERAANLETTAMGAAFFAGLATGFWNSTDELQSIVKVGKRFEPTMDVSDRESLYEGWKQAVAATQQYKHTSKQD

SEQ ID NO: 69690 - DNA, 1455 bp, Lactobacillus rhamnosus
  CDS (1)..(1455): transl_table=11
atggcagatagttacatcatgcccattgatgaaggcacgaccagtacgcgcgcggttattttggatcatgctggcaagatggtgggcgaggcgctaaaggagtttacccagtattttcttaaaccgggctgggtggagcacgatgcgaatgagatttgggaagcggtgttgtcgacgattgcggatacctttatttcgtctggggtgcagccgcggcaaattgcaggactcgggattacgaatcagcgtgaaacaacggtgatttgggataagacaacggggctgccgatttatcatgcgattgtgtggcagtcacggcagaccaatgcgttggcggaagcgttgcggcaggctggtcatggcaaaatgattcatgagaagaccggcttgctgattgacgcctatttttccgctacgaagattcgctggattttggatcatgttccgggagcccaagagcgcgcggaaaatggcgagttgctgtttggcacgattgatacgtggctgagttggaagttatcaggcggcgcgattcatgtgacggactacacgaatgccagtcgaacaatgttattcaacattcatacgttggattgggatgacgagattttgcagttgctgcatattccgcgggccatgttgcctgaggtgcgcagtaattcggaaatttacggtactggcgcggcttatcatttcttcggcagcacggttccgattgcagggatggccggtgaccagcaaagcgccttgtttggccagttagcgttggcgccggggatggtgaagaatacatatggtactggctcgtttattgtgatgaatacaggcgataagccgaaaatgtctgctaataacttgttgacgacgattgcatatggcgtgaacgggcagattaattatgctctggaaggctcggtgtttgtcgcgggctcggcgattcagtggctgcgcgatcaaatggggttggtggcgcaatcgcctgacacccagcaagcagccgaggcagccactagtgatgatgaggtttatgtggtgcctgcgtttacaggcttaggggcaccgtattgggatgccgaagcacgcggggcagtttttggcttgacccgcgggaccactaaagacgactttattaaagcgacgttgcaggctttggcttatcaaacgcgtgatgtggttgataccatgtacaaggacacgcagattgccgtcccagccttacgcgttgacggtggggcagctcgcaatgattacctgatgcagtttcaggcggatatcctgaataagcctttggaacgagccgccaatttagagacgaccgccagcggattaaaagtgacacctgccatcaccgatcaattaatggttttggccgtatcggtcgtttggcattccgtcgtatttacgaattgggtgcaaagagcaatgacatccaggttgttgcgatcaacgatttga

SEQ ID NO: 69691 - protein, 484 aa, Lactobacillus rhamnosus
MADSYIMPIDEGTTSTRAVILDHAGKMVGEALKEFTQYFLKPGWVEHDANEIWEAVLSTIADTFISSGVQPRQIAGLGITNQRETTVIWDKTTGLPIYHAIVWQSRQTNALAEALRQAGHGKMIHEKTGLLIDAYFSATKIRWILDHVPGAQERAENGELLFGTIDTWLSWKLSGGAIHVTDYTNASRTMLFNIHTLDWDDEILQLLHIPRAMLPEVRSNSEIYGTGAAYHFFGSTVPIAGMAGDQQSALFGQLALAPGMVKNTYGTGSFIVMNTGDKPKMSANNLLTTIAYGVNGQINYALEGSVFVAGSAIQWLRDQMGLVAQSPDTQQAAEAATSDDEVYVVPAFTGLGAPYWDAEARGAVFGLTRGTTKDDFIKATLQALAYQTRDVVDTMYKDTQIAVPALRVDGGAARNDYLMQFQADILNKPLERAANLETTASGLKVTPAITDQLMVLAVSVVWHSVVFTNWVQRAMTSRLLRSTI

SEQ ID NO: 69692 - DNA, 1497 bp, Clostridium tetani
  CDS (1)..(1497): transl_table=11
atggcaaagtatgtaatggctttagaccaaggaacaactagttcaagatgtataatatttaatgagagaggacttattgtaagtgtagctcaaagagaatttaaacagatatatcctaaaggtggatgggtagaacatgatccaatggaaatatgggcaactcaattcagtgtagctacagaagcaatggcaaaagcaaatatagaggctagtgaaatagcaagtataggaattacaaaccaaagagaaactaccatagtatgggataagagaacaggactacctgtgtacaatgctatagtatggcaatgtagaagaactgcacaaatatgtgatgaattaaaggaaaaaggtttaacagaaacaattagaaataaaacaggtcttgtattagatgcttatttctcaggaacaaaaataaaatggatattagacaatgttgcaggagcaagagaagaggcagaaaaaggaaacttaatatttggtacagtagatacttggttaatttggaatcttacaaagggaaaagtacatgtaacagattattcaaatgcatcgagaactatgatatataatatacatgaactaaaatgggatgatgaactattagaagctttagatattccaaaatcaatgcttccagaagttaagccatcaagctatgtttatggagaaaccaattcaactctatttggatcatcaattccaatagcaggagttgcaggagaccaacaagcagctttatttggacaaatgtgtcatcaagaaggaacagctaaaagtacttatggaacaggatgcttcttacttatgaatacaggagaaaaagctgttaagtcagaaaatggactattaacaactatagcttttggcattgatgataaagttgaatatgctttagaaggtagcatattcataggtggagctgctatacagtggttaagagatgaacttagaatgcttaaagattctccagaatcagaaagatatgctacagcagtagaagacacaaatggagtatatatggtaccagcctttgtaggtcttggagcaccttactgggatccttatgcaagaggcgctatagtaggacttacaagaggagctacaaaggaacactttataagagcaacacttgaatccttagcatatcaaacttatgatgttttaaatgcaatgagagaagattcaggaatagacttaaaagctcttagagtagacggaggagcaagtgcaaatgacttcttaatgcaattccaagcagatatattaggagtacctgttcaaagaccagaagtaattgaaacaactgcattgggagctgcataccttgcaggacttgcagtgggatattggaaagataaaaaagatgtagctcaaaactgggcaatttctaaaactttcgaaccagatatgattaaagaaagaagagaagaattgttagaaggatggcatgaagctgttaagagatctatgaattgggaaaagagtgaataa

SEQ ID NO: 69693 - protein, 498 aa, Clostridium tetani
MAKYVMALDQGTTSSRCIIFNERGLIVSVAQREFKQIYPKGGWVEHDPMEIWATQFSVATEAMAKANIEASEIASIGITNQRETTIVWDKRTGLPVYNAIVWQCRRTAQICDELKEKGLTETIRNKTGLVLDAYFSGTKIKWILDNVAGAREEAEKGNLIFGTVDTWLIWNLTKGKVHVTDYSNASRTMIYNIHELKWDDELLEALDIPKSMLPEVKPSSYVYGETNSTLFGSSIPIAGVAGDQQAALFGQMCHQEGTAKSTYGTGCFLLMNTGEKAVKSENGLLTTIAFGIDDKVEYALEGSIFIGGAAIQWLRDELRMLKDSPESERYATAVEDTNGVYMVPAFVGLGAPYWDPYARGAIVGLTRGATKEHFIRATLESLAYQTYDVLNAMREDSGIDLKALRVDGGASANDFLMQFQADILGVPVQRPEVIETTALGAAYLAGLAVGYWKDKKDVAQNWAISKTFEPDMIKERREELLEGWHEAVKRSMNWEKSE

SEQ ID NO: 69694 - DNA, 1506 bp, Sulfolobus solfataricus
  CDS (1)..(1506): transl_table=11
atgaatactatgtcacataagtttgttctagccctagatgagggtactacaagtgctagggctatactcttcgatagtgacttaaacatagtaaacatagggcaatatgaattcccgcagtactatcctcaacctggctatgtggaacatgaccctgaggaaatatgggaagctcaaatgttagccgtaaaaaaggctataagtaaaatagatgctaaacaaatagtagcaatagggataacaaaccaaagggagacaacggtattatgggatgctaaaagcggtaaaccggtttacaatgcaattgtatggcaggatagaagaacttctccaataacggactggctaaaagcaaattactttaaaatgataaaggacaaaactgggttagttccagacccttactttagtgcatctaagataaagtggatacttgataatgtgcccaatgttagggagaaagcagaaagaggagaaattaagttcgggaccctagatacttatttaatctggaggcttactaacggaaaagctcatgtaactgattactctaacgcttctagaacaatgctttttaatataaataaattagaatgtgatagagaaatcttagaacttctaaaaatacccgaatctatattgccagaggttaaaccatcaagtgaaatttacggttacagtgaggcgttaggaaacttaatacctatatctggggacgcaggagaccaacaagcagctttattcggtcaagtagcgtttaacgtaggtgagataaaagctacttatggtaccggtagtttcattttaatgaatataggcaataacccaatacgatcagaaaacctcttaactacaatagcttggggtcttgagaagaataaggcaacgtatgcattagaggggagtatattcataactggtgcagctgtacaatggtttagggacggcttacgggcaatagacgtttcagatgagattgaacctttagcctcaaatgtggaagataatggcggtgtctatttcgttccagcttttgttggattgggagctccttactgggatccatatgctagaggtctcataataggcataactagaggaactactaaagctcatatagctagggctattttagaatcaatggcctatcaaactagagatgtaattgaggtaatgcaaaaggaatccggcatcagtataaattcgcttaaggttgacggaggtgcagctaaggataaccttttaatgcaattccaagctgatatattaggtattaaggtaatcagacctaaagttatggaaactacttctatgggagttgcaatgctagcaggtttaggtgtaggcttatggaactctttagaggaattaaggagcatatggaaggttgataaggaattcattccaagtatgagtgaggagaaaaggagggcattgtactctgggtggaaggaggctgtaaagagagctatgggatgggctaaagttgtaggaggtcaagtttaa

SEQ ID NO: 69695 - protein, 501 aa, Sulfolobus solfataricus
MNTMSHKFVLALDEGTTSARAILFDSDLNIVNIGQYEFPQYYPQPGYVEHDPEEIWEAQMLAVKKAISKIDAKQIVAIGITNQRETTVLWDAKSGKPVYNAIVWQDRRTSPITDWLKANYFKMIKDKTGLVPDPYFSASKIKWILDNVPNVREKAERGEIKFGTLDTYLIWRLTNGKAHVTDYSNASRTMLFNINKLECDREILELLKIPESILPEVKPSSEIYGYSEALGNLIPISGDAGDQQAALFGQVAFNVGEIKATYGTGSFILMNIGNNPIRSENLLTTIAWGLEKNKATYALEGSIFITGAAVQWFRDGLRAIDVSDEIEPLASNVEDNGGVYFVPAFVGLGAPYWDPYARGLIIGITRGTTKAHIARAILESMAYQTRDVIEVMQKESGISINSLKVDGGAAKDNLLMQFQADILGIKVIRPKVMETTSMGVAMLAGLGVGLWNSLEELRSIWKVDKEFIPSMSEEKRRALYSGWKEAVKRAMGWAKVVGGQV

SEQ ID NO: 69696 - DNA, 1479 bp, Thermotoga maritima
  CDS (1)..(1479): transl_table=11
atgtacgttctcgcaatagatcagagtacctctggtacgaaagctattatattcgatgagaaaggaggaattgttcacagggtaacggtgtaccacaaacagtactatccaaaaccaggctgggtagaacacgatcctgaggagatctttcgaaacaccttagatgcatgcagaaaagtcattgaagaatcgggtataaaaccgctcgagatagaagctctagctattacgaaccaaagagaaacaaccatcttgtgggagaagaaatcagggaaaccagtctacaacgctgtggtctggcagtgtcagagaggggcttctctctgtgaagagataaagaaaaggggattggaagggaagataaaagaaaaaacaggactcgtagttgatccttatttctctgccagtaaaatcaggtggattctggacaatgtggaaggcgtaaaaaacaaggcaaagcaaggagaaattgcttttggaacagtggacagctggctgatctggaaattgactaaaggggaagttcatgcaacagacttttcaaatgcgagccgcacacttcttctcaacattcatgaactgagatgggatgaagaagtactggagatctttgaaattccacctgaaatcctccctgaactgaaaagttcagattctgtcttcggttacaccgatttgggatttttaccgaaaaaaattcccatagtcggtgtcatgggagattcttctgccgctctctttggacagggaggattctattcaggggatataaaggttacctacggtacagggagttccaccatgttgaacataggggaaaaaccaaatgtatcagattcgcccattgtgtgctctgttggatgggtcgtaaaagagacttccagttatgtactcgagggtaacattcattcagcaggtgacacaattgtttggttaaaggaaaaactcggaatcataagcgatccctctgaaacagaaaaaatagcactctctcttgaaaacaacggaggggtttatttggttcctgccttcgttgggcttggggccccgtactggcgaagtgatgtgaaagcggctattctggggcttcaaaggaatcatggaaaagaacatgttgttcgagcggctttggagtccatagcctatcaagtgagagatatcttcgaggagatggtcagaatatccagtaaggaacccaccgaggtcagggcagatggaggaatcacaagaaacagatttcttatgcagtttcaggcggatattctgaacataccagttttagtaagcaacatagaggaagtatcagcgagaggagtagcttttgttgctttgcttcatctcggagcgttcagcgatcttgaagagataaggcaaaagataacttacagggaaaaatacgaaccccggatgggtgatgaattacgggaaatgtactatgaagggtggaaaactgctatcagaaaactactcaccgagtga

SEQ ID NO: 69697 - protein, 492 aa, Thermotoga maritima
MYVLAIDQSTSGTKAIIFDEKGGIVHRVTVYHKQYYPKPGWVEHDPEEIFRNTLDACRKVIEESGIKPLEIEALAITNQRETTILWEKKSGKPVYNAVVWQCQRGASLCEEIKKRGLEGKIKEKTGLVVDPYFSASKIRWILDNVEGVKNKAKQGEIAFGTVDSWLIWKLTKGEVHATDFSNASRTLLLNIHELRWDEEVLEIFEIPPEILPELKSSDSVFGYTDLGFLPKKIPIVGVMGDSSAALFGQGGFYSGDIKVTYGTGSSTMLNIGEKPNVSDSPIVCSVGWVVKETSSYVLEGNIHSAGDTIVWLKEKLGIISDPSETEKIALSLENNGGVYLVPAFVGLGAPYWRSDVKAAILGLQRNHGKEHVVRAALESIAYQVRDIFEEMVRISSKEPTEVRADGGITRNRFLMQFQADILNIPVLVSNIEEVSARGVAFVALLHLGAFSDLEEIRQKITYREKYEPRMGDELREMYYEGWKTAIRKLLTE

SEQ ID NO: 69698 - DNA, 1482 bp, Clostridium tetani
  CDS (1)..(1482): transl_table=11
atggaagaatatattatggtattagatcagggaagtacaagatctaagtgcatactatttgataaaaaaggtgaagtgttaggagaaagtgaaagagaggtagaacccatatatcctaaactaggatggatggaatataatcctgttaatatatgggcaagtcagttctctgtaactacagaattattagcaaaatacaatatttcaatagaaaaaatagcttccattggaattacaaatcaaagggaaacggtattggtgtgggataagagaacaggaatcccagtatataatgcaattgcttggcaatgtagaagaacagtagaaattagtgaagaacttaataaaaaaggatatggtaaagttataaaagaaaaaacaggattagtactagatccttatttttcagctaccaaaataaagtggatattagataatgtagaaggagctagaaaagaagcagaaagaggtaatttagcctttggtactatggattcttggcttatatggaatttgacaaaaggtgaaaaacatatgacagattatagtaatgcttcaagaactatgttatttaatatacacacattgcagtgggatgaagaacttctagaaattttccaaatacctaaatccatgctacctgaagtgggaccatcaagtcacgtttatggacatacagacagtattttgtttggaaaagaagtacctataggaggagtagcaggagaccaaaattcatctctttttggacaaaccgcctttgaagaaggggcagctaaaaatacctatggcacaggatgttttatgcttatgaatacaggaaataaacccataaattcacaaaaaggacttataacaactatcgcttggggattagatggtgaagttacttatgccctagaaggttcagtttttatggctggagaaggtataaattggattaaagataatttgagaatgatagattcattggaggatgctgaagaatatgcgttatcagtggaggacactaataatgtatatatggttccagcctttggaggattaggagcaccatattggaatccagaagctaagggtgtagttataggtcttacaagaggaagcaagaaggagcattttataagagcggttatagaatctctggcatatcaaagttatgatgttttaaaagctatggaggaagattcaggtatagttttaaagaatttaagagtagatgggcaatattctgtaaataattttttaatgcaatttcaatcagatatattaaattgtaaagttgaaaagcctaaaaatattttaaatatagcaggtttaggtgccgcatattttgcaggattagctgttggtttttggaaaaacaaagaagatattttaaagaataatggtatagaaaaagaatttaacagtagtattgatgatagaagaagaaaagttcttgtagaaggttggaaggaagctatcaaaagaactatataa

SEQ ID NO: 69699 - protein, 493 aa, Clostridium tetani
MEEYIMVLDQGSTRSKCILFDKKGEVLGESEREVEPIYPKLGWMEYNPVNIWASQFSVTTELLAKYNISIEKIASIGITNQRETVLVWDKRTGIPVYNAIAWQCRRTVEISEELNKKGYGKVIKEKTGLVLDPYFSATKIKWILDNVEGARKEAERGNLAFGTMDSWLIWNLTKGEKHMTDYSNASRTMLFNIHTLQWDEELLEIFQIPKSMLPEVGPSSHVYGHTDSILFGKEVPIGGVAGDQNSSLFGQTAFEEGAAKNTYGTGCFMLMNTGNKPINSQKGLITTIAWGLDGEVTYALEGSVFMAGEGINWIKDNLRMIDSLEDAEEYALSVEDTNNVYMVPAFGGLGAPYWNPEAKGVVIGLTRGSKKEHFIRAVIESLAYQSYDVLKAMEEDSGIVLKNLRVDGQYSVNNFLMQFQSDILNCKVEKPKNILNIAGLGAAYFAGLAVGFWKNKEDILKNNGIEKEFNSSIDDRRRKVLVEGWKEAIKRTI

SEQ ID NO: 69700 - DNA, 1500 bp, Sulfolobus solfataricus
  CDS (1)..(1500): transl_table=11
atgcccggtggcttcatcttagcaatagatgagggaacaacaagtgctagagcaattatatataatcaagatttagaagtattaggaataggtcagtacgattttcctcaacattacccaagtccaggatatgtagagcacaatcccgatgagatatggaatgcacaaatgttagcaataaaagaagctatgaaaaaggcgaagatagagtctaggcaagtagctggaatcggagtgactaatcagagggagactaccatattatgggatgcgataagtgggaaaccaatttacaatgcaattgtttggcaagatagaagaacttctaatataactgattggctaaaggagaattactttggtatgataaaggataaaaccgggcttattcctgacccttactttagtggatctaaaataaagtggatattggataatctccctaatgtgaggagtaaggcagaaaagggcgaaataaagtttggaactatagatacttatcttatatggaagttaactaatggtaagattcacgtaactgattattcaaacgcgtcaagaaccatgctattcaacataaataagctagaatgggatagagaaatcttggaattattgaaaattccagagagtatattacctgaagtgagaccatctagcgatatttacgggtatactgaagttttgggatcctctattccaatctctggtgatgccggagatcaacaagctgccttgtttggtcaagtagcctatgacatgggcgaagtaaaatcaacctatgggactggaagtttcattctgatgaatataggtagcaatccgattttttcagaaaatttactaaccactatagcttggggtttagagagtaaaagggttacatatgctttagaaggaagtatattcataactggtgcggcagtacagtggtttagagatggtttaagagcaatagatgcatcggatgacatcgagccattagccgcaagtgtaccggatactggtggtgtctatttcgtaccagcatttgtcgggttaggtgcaccatactgggatccatacgcgaggggattgataataggtattacgagggggactacaaaggctcatatagctagagcaatactcgaatcaatagcataccaaaatagagacgtaatagaaataatggagaaagagtctgggactaagataaacatactaaaggttgatggtggtggggctaaggacaatttactgatgcaatttcaagcagatattttgggaattagggtagtaaggccgaaggtaatggagactgcatctatgggcgttgcaatgttagcaggtttagcaataaattattggaattcacttaacgaattgaaacaaaaatggactgtcgacaaagagttcattccctcaatcaataaagaagaaagggaaagacgctataatgcgtggaaagaggcagtgaagaggtcgctgggttgggaaaaatcgttaggtagtaaataa

SEQ ID NO: 69701 - protein, 499 aa, Sulfolobus solfataricus
MPGGFILAIDEGTTSARAIIYNQDLEVLGIGQYDFPQHYPSPGYVEHNPDEIWNAQMLAIKEAMKKAKIESRQVAGIGVTNQRETTILWDAISGKPIYNAIVWQDRRTSNITDWLKENYFGMIKDKTGLIPDPYFSGSKIKWILDNLPNVRSKAEKGEIKFGTIDTYLIWKLTNGKIHVTDYSNASRTMLFNINKLEWDREILELLKIPESILPEVRPSSDIYGYTEVLGSSIPISGDAGDQQAALFGQVAYDMGEVKSTYGTGSFILMNIGSNPIFSENLLTTIAWGLESKRVTYALEGSIFITGAAVQWFRDGLRAIDASDDIEPLAASVPDTGGVYFVPAFVGLGAPYWDPYARGLIIGITRGTTKAHIARAILESIAYQNRDVIEIMEKESGTKINILKVDGGGAKDNLLMQFQADILGIRVVRPKVMETASMGVAMLAGLAINYWNSLNELKQKWTVDKEFIPSINKEERERRYNAWKEAVKRSLGWEKSLGSK

SEQ ID NO: 69702 - DNA, 1503 bp, Anabaena sp
  CDS (1)..(1503)
atgcagatatcatcttccggctatatcctagcgttggacttgggaacaactggaaaccgggcatttatctttaacaatgcaggtaaaatagttgctcaagcatataaggaactaacacaacattacccccaaccaggatggttagagcatgacgcggaagaaatctggcaagatacctgctgggtgatgaagacagccatcgtcaatgcacaaatatctcctagtgaaattgcggctataggtttgactgtacaacgggaaacttgcctactctgggacaaaaccacggggagaccattacataaagccattgtttggcaagaccgccgcacggctcccctgtgtcatcagttacaggaaaaaggctatgctcaggaaatttacagtcgtactggtttagtagttgacgcttatttctccgcaactaaactccgatggttattagactacatcacaggcgttgatttaaaaaatgttttggcaggtacaatcgatacctggatattgtggaaattaacaggtgggaaagtccacgccaccgaccacagcaatgctagccgcaccatgttgatgaatttgaaaactggtgagtgggatgagcaactactagagattttgcaaattcctgcccatattctgccgcaaattcaacccagtttgggaaaatttggtgttacagataccagcttattagatgcagctatccccatcacagccattttaggcgatcaacaggcagctttgtttggtcatggctgcgatcgccccggtttaatgaaatgtacttatggcactggtagctttttagtagctcatactggctctaatattgttcgttctcaacatcaattaatttctacaatcgcctggacacaagccgataaacaggaaaatatcaatattggctatgctctagaaggcagtatgtttactagtggtgcttgtatccaatggttgcgtgacggcatcaagctaattaagacggctgctgaaactgagaccatggcaaatcaagtagccgataacggtggggtgtactttgtccccgcttttagtggactaggcgcaccctactgggatatgaacgctagaggagctttttttggcattacagccagcgtccaaccacagcatttagtccgggctgtattagaagcgatcgcctatcaagtgttagaagtagtacaagccatcaatgcctcttgtagtagccccatgcagcgcctaattgtcgatggtggtgcttgtgagaacaatttcctcatgcagttccaagcagatgttttaggtattcccgtagaacgtcccaccatgcgcgacacaacagtacaaggtgcagccttcgccgcaggtttagccgtgggattttgggatagttacacagcattagttaaccaacgccagatagaccgcatttttgaaccaggagaaggaagccaaaacgccacagccaattttgcgatatggcaaaaggcagttaaacggagtcttgattgggtgtag

SEQ ID NO: 69703 - protein, 500 aa, Anabaena sp
MQISSSGYILALDLGTTGNRAFIFNNAGKIVAQAYKELTQHYPQPGWLEHDAEEIWQDTCWVMKTAIVNAQISPSEIAAIGLTVQRETCLLWDKTTGRPLHKAIVWQDRRTAPLCHQLQEKGYAQEIYSRTGLVVDAYFSATKLRWLLDYITGVDLKNVLAGTIDTWILWKLTGGKVHATDHSNASRTMLMNLKTGEWDEQLLEILQIPAHILPQIQPSLGKFGVTDTSLLDAAIPITAILGDQQAALFGHGCDRPGLMKCTYGTGSFLVAHTGSNIVRSQHQLISTIAWTQADKQENINIGYALEGSMFTSGACIQWLRDGIKLIKTAAETETMANQVADNGGVYFVPAFSGLGAPYWDMNARGAFFGITASVQPQHLVRAVLEAIAYQVLEVVQAINASCSSPMQRLIVDGGACENNFLMQFQADVLGIPVERPTMRDTTVQGAAFAAGLAVGFWDSYTALVNQRQIDRIFEPGEGSQNATANFAIWQKAVKRSLDWV

SEQ ID NO: 69704 - DNA, 1479 bp, Aquifex aeolicus
  CDS (1)..(1479): transl_table=11
atgagtgttgttatttcaatagatgtagggacaactagagtaaaagttatcgcattttcaaaaaatggaaaaatagttgcaatttctgacagggaagtttcacagatatatccagaacctggatgggtagaacaagatcctcttgagctttgggaagccgttagaaagtctttgagcgaggttattcaacaggttgggttaaaggaaataaattcaattggaattacaaaccagagggaaactgttatcctttgggataaggaaaccggaagaccggtttacaacgcaatactctggcaggatttaagaactgaggatatatgtagaaaactctccgaatactctgaatacataaaggaaaatacaggccttctcttacatccttatttttccgcaagcaaagtaaactggataatagaaaacgtaaacggggtaaagaaagacattgagaggggaaaggtaatatttggaacagttgatacgtggattctctggaacttaacaggaggaaaggttcacaaaactgaaccgagtaacgcttcaagaacccttctattcaacattaaaagacttgaatacgatgatgaactgttaaaaatattcaggatacctaaaaatatactcccggaggtgaatgaaagttcttcccttttcggatacacggataaaagtattacaggtgttgaaatacctattacaggaattctgggtgatcagcaggcctcacttttcgctcacggaataagggaattagaggaggttaaaaacacttatggaacaggtttattccttatgcttttaacgggaagtaaaccgataatacccgaaaggttacttggaacagtagcctgggttataaatggtaaggtaaattacgcaattgaaggaagtgtactgaccggaggagcctgtataaagtggttaatggacaggcttaaattaataaagcaggctgccgatacggaatacctggcaaaatccatcagctcaaatgaaggtgtttacttcgttccagctttttcgggtcttggagctccttactgggatgcgtcagcaaggggaataataatagggattacgggaaggacaagaatagaacacatagcaagagctgcattagaagcaatagcgtatcaaacaagggatgtaattgaagaaatggaaaaggaaacgggagtgaagataaaaatcttaaaagcggatggaggagcttctcagaacaatttcctaatgcagtttcaggctgacattcttggcatacctgttgaaagacctaggcatgtagaacttacagctctgggagcggctggaattgcaggtatatactcaggaatgtggaagagtaaagaggaattcattgaggatacaagggaagttgaattaactttcagtccagaaatgaaaaaagaggaaagggagctttactactccaagtggaaggatgctgtaaagagagccatgaaatggagtatgttatga

SEQ ID NO: 69705 - protein, 492 aa, Aquifex aeolicus
MSVVISIDVGTTRVKVIAFSKNGKIVAISDREVSQIYPEPGWVEQDPLELWEAVRKSLSEVIQQVGLKEINSIGITNQRETVILWDKETGRPVYNAILWQDLRTEDICRKLSEYSEYIKENTGLLLHPYFSASKVNWIIENVNGVKKDIERGKVIFGTVDTWILWNLTGGKVHKTEPSNASRTLLFNIKRLEYDDELLKIFRIPKNILPEVNESSSLFGYTDKSITGVEIPITGILGDQQASLFAHGIRELEEVKNTYGTGLFLMLLTGSKPIIPERLLGTVAWVINGKVNYAIEGSVLTGGACIKWLMDRLKLIKQAADTEYLAKSISSNEGVYFVPAFSGLGAPYWDASARGIIIGITGRTRIEHIARAALEAIAYQTRDVIEEMEKETGVKIKILKADGGASQNNFLMQFQADILGIPVERPRHVELTALGAAGIAGIYSGMWKSKEEFIEDTREVELTFSPEMKKEERELYYSKWKDAVKRAMKWSML

SEQ ID NO: 69706 - DNA, 1491 bp, Bacillus anthracis
  CDS (1)..(1491): transl_table=11
atgaaaaaatatattctttcattagaccaaggaacaactagctcacgcgcaattcttttcaataaaaaaggtgaaattgttcattcagctcaaaaagaatttacacaacattttccaaagccaggctgggtagagcataacgcgcaagaaatttggggatctattttagcggttatcgcaacttgcttaagtgaagcagatgtaaagccagaacaaatcgctggtatcggtattacgaaccaacgtgaaacagcggttgtatgggataaaacgactggtaaaccaatttataacgcaattgtatggcaatctcgccaaacagctgaaatttgtgatgagttaaaagaaaaaggttatagcgaaatggttcgcgaaaaaacaggtcttttaattgacgcatacttctctggtacgaaagtaaaatggattttagataacgttgaaggtgcaagagagaaagcagaaaacggcgatctattattcggaacaattgatacgtggcttgtatggaaattatctggtggtaaagcgcacgtaacggattactcaaatgcatcacgtacattaatgtttaacattcacgacttacagtgggatgatgagcttctagacatgttaacagtaccaaagagcatgcttccagaagtacgtccatcatctgaagtgtatggagaaacaattgactatcacttcttcggtcaaaatgtaccgattgcaggtgtagctggtgatcaacaagcggcattatttggacaagcttgtttcggtgaaggtatggcgaaaaatacttacggaactggttgcttcatgttaatgaacacgggtgaaaaagcagtagcttctgagcacggtctattaacaacaattgcatggggaatagatggtaaagtaaactacgcattagaaggaagtattttcgtagcgggttctgccattcagtggttacgtgacggaatgcgcatgtttaaagatgcaagtgagagtgaagtatatgcttctcgtgttgaatcaactgacggtgtatacgttgtaccagcattcgtaggattaggtacgccttactgggatagtgaagtacgcggcgctatgtttggtgtaacgcgcggtacgacgaaagaacacttcattcgtgcaacactagaatctttagcttaccaaataaaagacgtattatgcgcaatggaagcagattcaggtattgaactaaaaacattacgcgttgatggcggagcagttaaaaataacttcttaatgaagttccaaagtgatattttagacgttcctgtagagcgtccagtgatcaatgaaacaacagctttaggtgcagcgtacttagctggtcttgcggttggatattggaaaaaccaagatgaaattaaagaacagtggcatatggacaaacgctttgagccaacgatggaagcggaaacaagcgaagagctatatgctggatggaaaaaagcaattgaagcaacaaaagctttcaaataa

SEQ ID NO: 69707 - protein, 496 aa, Bacillus anthracis
MKKYILSLDQGTTSSRAILFNKKGEIVHSAQKEFTQHFPKPGWVEHNAQEIWGSILAVIATCLSEADVKPEQIAGIGITNQRETAVVWDKTTGKPIYNAIVWQSRQTAEICDELKEKGYSEMVREKTGLLIDAYFSGTKVKWILDNVEGAREKAENGDLLFGTIDTWLVWKLSGGKAHVTDYSNASRTLMFNIHDLQWDDELLDMLTVPKSMLPEVRPSSEVYGETIDYHFFGQNVPIAGVAGDQQAALFGQACFGEGMAKNTYGTGCFMLMNTGEKAVASEHGLLTTIAWGIDGKVNYALEGSIFVAGSAIQWLRDGMRMFKDASESEVYASRVESTDGVYVVPAFVGLGTPYWDSEVRGAMFGVTRGTTKEHFIRATLESLAYQIKDVLCAMEADSGIELKTLRVDGGAVKNNFLMKFQSDILDVPVERPVINETTALGAAYLAGLAVGYWKNQDEIKEQWHMDKRFEPTMEAETSEELYAGWKKAIEATKAFK

SEQ ID NO: 69708 - DNA, 1491 bp, Bacillus subtilis
  CDS (1)..(1491): transl_table=11
atggaaacgtacattttatccttagatcaggggacgacaagttcaagagcgattctgtttaataaagaaggcaaaattgtccactctgctcaaaaggaatttacacaatacttcccgcatcctggctgggttgagcataatgccaatgaaatttggggctctgtcctcgcggttatcgcctcagtcatctctgaatcaggaatcagcgcttctcaaattgccggcatcggcatcacgaaccagcgcgagacgacggttgtgtgggataaagatacaggaagtcctgtctataatgcaatcgtttggcagtccagacagacgtccggcatttgtgaggaacttcgtgaaaaaggatataatgataaattcagagaaaaaacagggcttttaatcgatccttacttctccggcacgaaggtgaagtggattttagacaatgtggaaggcgcaagagaaaaagcggaaaaaggcgagctgctgtttggaacgattgatacgtggctcatttggaaaatgtcaggcggaaaagcgcatgtgaccgattactccaatgcctcaagaacactgatgtttaatatttacgatttaaaatgggacgatcaactgctcgacattctaggcgtaccgaaatccatgctccctgaagtgaagccgtcctctcatgtgtatgcggagactgttgattatcacttcttcggaaaaaatatcccgattgctggagcggcaggcgaccagcagtccgcattgttcggccaggcatgctttgaagaaggcatggggaaaaacacttacggcacaggatgtttcatgctgatgaataccggggaaaaagcaattaagtccgaacatgggcttttgacaacaatcgcttggggcattgacggaaaagtgaactatgcgttagaagggagcatttttgtcgcaggctctgccatccagtggcttagagacggtttgagaatgttccaggattcatcgctaagcgaatcttatgcagaaaaagtggattcaactgacggcgtgtatgttgttccagcatttgtcggactgggaacgccttactgggacagcgatgtgcgcggttcggttttcggcctgacaagagggacaacaaaagagcactttatccgtgcgacactggagtcattggcttatcagaccaaagatgtgcttgacgcaatggaagcagattcaaacatttcattaaagacgctccgtgtagacggaggagctgtaaaaaacaatttcctaatgcagttccaaggagacctgttgaatgttcctgtggagcgcccggaaattaatgaaacgactgcacttggcgcggcttatttggcgggtatcgctgtgggattctggaaggaccgttctgaaatcgcgaaccagtggaatctggataaacggtttgagcctgaattggaagaagaaaaacgaaatgagctgtataaaggctggcaaaaagccgtgaaagcagctatggcttttaaataa

SEQ ID NO: 69709 - protein, 496 aa, Bacillus subtilis
METYILSLDQGTTSSRAILFNKEGKIVHSAQKEFTQYFPHPGWVEHNANEIWGSVLAVIASVISESGISASQIAGIGITNQRETTVVWDKDTGSPVYNAIVWQSRQTSGICEELREKGYNDKFREKTGLLIDPYFSGTKVKWILDNVEGAREKAEKGELLFGTIDTWLIWKMSGGKAHVTDYSNASRTLMFNIYDLKWDDQLLDILGVPKSMLPEVKPSSHVYAETVDYHFFGKNIPIAGAAGDQQSALFGQACFEEGMGKNTYGTGCFMLMNTGEKAIKSEHGLLTTIAWGIDGKVNYALEGSIFVAGSAIQWLRDGLRMFQDSSLSESYAEKVDSTDGVYVVPAFVGLGTPYWDSDVRGSVFGLTRGTTKEHFIRATLESLAYQTKDVLDAMEADSNISLKTLRVDGGAVKNNFLMQFQGDLLNVPVERPEINETTALGAAYLAGIAVGFWKDRSEIANQWNLDKRFEPELEEEKRNELYKGWQKAVKAAMAFK

SEQ ID NO: 69710 - DNA, 1527 bp, Bordetella bronchiseptica
  CDS (1)..(1527): transl_table=11
gtgacggcaaatgaattcatcctggcgctggaccagggcacgaccagctcccgcgccatcgtgttcgaccgcgccggcacggtgcgcggcatggggcagcgcgaattccgccagcactacccgcggccgggctgggtcgagcacgatgccggcgaaatctggcaaagccagctcgaggtcgcgcgcgaggcgctgcgcaacgccggcgccagcgccgccgacctcgccgcgctgggcatcaccaaccagcgcgaaaccaccctgatctgggagcgcgccaccggccgcccgctggcccgcgccatcgtctggcaggaccgccgcaccgcggcgatgtgcgaaaaactgctgcacgacggccacggccggatgctgcaggagcgcaccggcctggtcgtcgacgcgtacttttccggcaccaagctggcctggctgctcgatcacgtgccgggcgcgcgcaagatggccgagcgcggcgagctggccttcggcacggtggacacctggctggtctggcagctgaccggcggcgccgtgcacagcaccgacccgagcaacgcctcgcgcaccatgctgttcgacctgcacgcccaggactggtcggacgatatcctggccctcttgaacattccgcgcggcatattgccgcgcatcgcccccagcagcgcgcgcatcggcgaaaccctgcccgagtggctgggcggctcgatccccatcgccggcgtggccggcgaccagcaggccgccacgttcgggcaggcctgcttcacgccgggcatggccaagaacacctacggcaccggttgcttcatgctgatgaacgtgggcgacgcgccggtggcctcgcgccacaacctgctgtccaccgtgggctggagcctgccggcgggcaacgccacgcacgccacctacatggtggaaggcggcgtgttcatggccggcgcagcggtgcaatggctgcgcgacggcctaggcatcatccagcgctcggccgacatcgaggccctggcggccagcgtggccgacacggacgacgtattcatggtgccggccttcgccggcctgggcgcgccgcactgggatccctacgcgcgcggcacgctggtgggcatgacgcgcggcaccacgcgcgcccacatcgcgcgcgccacgctcgaatcgatcgcgctgcaaagcgccgaactgctgtcgtgcatgaatgccgacagcggcatcccgctgtccgagctgcgcgtcgacggcggcgcggcgcgcaacgacctgctgatgcagatgcaggccgacctgctgggcgtgccggtggtgcgcccgcgcgtgcccgagtcgaccgcgctgggcgcggccgggctggcgggcctggcggtcgggttctggtcgagcctggacgagttcggcgcgcagtggcaggccgaacgcactttcgagccggcctggccggccgatgtgcgcgaagcccgcatgcaacgctggcgccaggcggtggagctatcgaagggctggtcgcgccctgccgccggccacgcgtga

SEQ ID NO: 69711 - protein, 508 aa, Bordetella bronchiseptica
MTANEFILALDQGTTSSRAIVFDRAGTVRGMGQREFRQHYPRPGWVEHDAGEIWQSQLEVAREALRNAGASAADLAALGITNQRETTLIWERATGRPLARAIVWQDRRTAAMCEKLLHDGHGRMLQERTGLVVDAYFSGTKLAWLLDHVPGARKMAERGELAFGTVDTWLVWQLTGGAVHSTDPSNASRTMLFDLHAQDWSDDILALLNIPRGILPRIAPSSARIGETLPEWLGGSIPIAGVAGDQQAATFGQACFTPGMAKNTYGTGCFMLMNVGDAPVASRHNLLSTVGWSLPAGNATHATYMVEGGVFMAGAAVQWLRDGLGIIQRSADIEALAASVADTDDVFMVPAFAGLGAPHWDPYARGTLVGMTRGTTRAHIARATLESIALQSAELLSCMNADSGIPLSELRVDGGAARNDLLMQMQADLLGVPVVRPRVPESTALGAAGLAGLAVGFWSSLDEFGAQWQAERTFEPAWPADVREARMQRWRQAVELSKGWSRPAAGHA

SEQ ID NO: 69712 - DNA, 1506 bp, Borrelia burgdorferi
  CDS (1)..(1506): transl_table=11
atgaaatacattttatctattgatcaaggtactactagctcgagagcaatggtatttgataaaaatgcaaacataaaggggtttgctcaaaaagaatttactcaaatttatccacaaccaagttgggtggaacatgatcctacagaaatatggggctcacaacttggagttataacagaagctatggcaaatgcaagaattttgcccaatgaaattgacgctattggaataactaatcaaagagaaactacggttatatgggaaaaaaatacaggaaagcccatctacaatgcaatagtatggcaagacagaagaactgcaaaaatttgtgaccaattaaaaaaagaaggaaaagataaaattattttggaaaaaacaggcttggtgctagattcttattttagtggaacaaaaataatgtggatattggataatgtagaaggtgccagacaaagagccgaaaatggcgaattatgctttggaacaatagatacatggatattgtggaacctgactcaaaaaaaagaacatgcaaccgattactctaatgcttcaagaacattattattaaacattaaaacattagagtgggatgatgaacttttaagcatattaaatgttccaagggcaattttgcctgaacttaaagaaagttctacaatatacggcaaaacagacaaagcactatttggagcagaaattcctattgcaggaattgctggggatcaatttgcagcaacatttggacaagcctgccttaaaaagggtatggccaaaaacacttatggaactggctgcttcttaacggttaatataggaaaagaaccaatcattagccacgacaagcttttaacttcaattgcatggggaagaaaaaaatctgtaacctacgttcttgaaggaagtgtttttattggaggagctgtaatccagtggttaagagacggtcttgaatttttcagaaaaagctcagatgcagaagcgttggcaagctctgtctcagataatggtggagtttattttgtgccagcatttgttgggcttggtgcacctcactgggattcttatgcaagaggaacaatcatcggaataacaagaggctcaacaaaagctcacattacaagagctgctcttgagagcatcgcatttcaaagcttcgatatactaaataccatgaaaaaatccattcccaactttgaaattcaagaattaagagtagacgggggagcaagtcaaaacaatctattaatgcaatttcaagctgatcttttagaatgtaaagttgtaagaccaaaaataacagaaacaaccgctcttggcgctgcttatcttgcaggacttgcaacgggttattggcaaagcgccgaagaaatcgtaagcctttggcaagtagacaagatatttgaaccttcaatgccaaaaaatcaaaaagaaaagcttcttgagaattggaacaaagcggttggaaaagcaaaatcctggatacagaattctcatagttcataa

SEQ ID NO: 69713 - protein, 501 aa, Borrelia burgdorferi
MKYILSIDQGTTSSRAMVFDKNANIKGFAQKEFTQIYPQPSWVEHDPTEIWGSQLGVITEAMANARILPNEIDAIGITNQRETTVIWEKNTGKPIYNAIVWQDRRTAKICDQLKKEGKDKIILEKTGLVLDSYFSGTKIMWILDNVEGARQRAENGELCFGTIDTWILWNLTQKKEHATDYSNASRTLLLNIKTLEWDDELLSILNVPRAILPELKESSTIYGKTDKALFGAEIPIAGIAGDQFAATFGQACLKKGMAKNTYGTGCFLTVNIGKEPIISHDKLLTSIAWGRKKSVTYVLEGSVFIGGAVIQWLRDGLEFFRKSSDAEALASSVSDNGGVYFVPAFVGLGAPHWDSYARGTIIGITRGSTKAHITRAALESIAFQSFDILNTMKKSIPNFEIQELRVDGGASQNNLLMQFQADLLECKVVRPKITETTALGAAYLAGLATGYWQSAEEIVSLWQVDKIFEPSMPKNQKEKLLENWNKAVGKAKSWIQNSHSS

SEQ ID NO: 69714 - DNA, 1503 bp, Bradyrhizobium japonicum
  CDS (1)..(1503)
atgtctttcgtcctcgccatcgaccagggcaccacctcctcgcgcgcgatcgtgttccgcagcgacatctcgattgctgcgcgtgcgcaagccgagtttccgcagcattttccggcctcgggctgggtcgagcacgagccggaggacatctggacctcgaccgtgatggtctgccgcgatgcgatcgcgcaggccggcatcagcgcgaaggatatcgccgcgatcggcatcaccaaccagcgcgagaccaccgtggtgtgggaccgcgccactgggcaggccgtgcaccgcgccatcgtctggcaggaccgccgcaccgccgacatctgcgcgaaactcaaggccgacggccgcgagcctgtgatctccgagaagaccggcctgatcatcgatccctatttctccggcaccaaggtcgcctggatcctcgaccacgtgcccggcgcgcgtgcccgcgccgcgcgcggcgagctgatgttcggcaccgtcgactgctatttgctctggcgcctcaccggcggcaaggtccacgccaccgacgccaccaacgcctcgcgcacgctgctgttcaacatccacaccggccagtgggacgacgaactgctcgagatcatcggcgtgccgcgctcgatgctgcccgaggtgaaggattcgtccgcccgtttcggtgagagcgtgcccgacctgttcggcggcgcgatcgcgatctccggcatcgccggcgaccagcaggccgcgaccatcggccaggcttgcttccgcccgggcatgatgaagtccacctacggcaccggctgcttcgcgctgctcaacaccggcaccacgcccgtggtgtcgaagaacaagctgctcaccaccgtcgcctaccagctcgacggcaaacgtacctatgcgctcgaaggctcgatcttcgtcgccggcagcgcggtgcagtggctgcgcgacggcctcggcatcatcaagcacgccgccgagaccggacctcttgctgatcagtccgactccatgcagagcgtctatctggtccccgccttcgtcggcatgggcgcgccctactggaatccgcgcgtgcgcggcgcgctgttcggcctcacccgcaacacgggacctgccgagctcgcccatgccgcgctggaaagcgtctgctaccagaccttcgacctctgggccgcgatgcgcgccgactggccgagctcggaaaccgccagcgtcgtgctgcgcgttgacggcggcatgaccgcgtcggactggaccatgcagcgcctcgccgatctcctcgacgcgccggtcgatcgccctgtgattcaggaaacgactgcgctcggcgccgcctatctcgccggcctcaatgcgggcgtctatcccgagccgaccaaattcgccgacaactggcgcctcgagcaccgcttcaagccgaacatgagcgaggcaacgcgcgagcggaagctcgcgggctgggcgcgagcggtgaagggcgtgctggcgagcgacgagggggcgtga

SEQ ID NO: 69715 - protein, 500 aa, Bradyrhizobium japonicum
MSFVLAIDQGTTSSRAIVFRSDISIAARAQAEFPQHFPASGWVEHEPEDIWTSTVMVCRDAIAQAGISAKDIAAIGITNQRETTVVWDRATGQAVHRAIVWQDRRTADICAKLKADGREPVISEKTGLIIDPYFSGTKVAWILDHVPGARARAARGELMFGTVDCYLLWRLTGGKVHATDATNASRTLLFNIHTGQWDDELLEIIGVPRSMLPEVKDSSARFGESVPDLFGGAIAISGIAGDQQAATIGQACFRPGMMKSTYGTGCFALLNTGTTPVVSKNKLLTTVAYQLDGKRTYALEGSIFVAGSAVQWLRDGLGIIKHAAETGPLADQSDSMQSVYLVPAFVGMGAPYWNPRVRGALFGLTRNTGPAELAHAALESVCYQTFDLWAAMRADWPSSETASVVLRVDGGMTASDWTMQRLADLLDAPVDRPVIQETTALGAAYLAGLNAGVYPEPTKFADNWRLEHRFKPNMSEATRERKLAGWARAVKGVLASDEGA

SEQ ID NO: 69716 - DNA, 1503 bp, Chromobacterium violaceum
  CDS (1)..(1503): transl_table=11
atgaccgatcagtacgtgctggccctggaccagggcaccaccagttcccgcgccattctgttcaaccgcagcggcgacatcgtgtcgctggcgcaaaaggagttccgccagatctacccgcagccgggctgggtcgagcacgatccgcaggaaatctggggcggccaggtgggcgtggccgccgaagcggtggccaaggccggcatcgacggccgcagcatcgccgccatcggcatcaccaaccagcgcgaaaccaccatcgtctgggaccgcgaaaccggccagccggtgtacaacgccatcgtctggcaggaccgccgcaccgccgagttctgcgatgagctgaaggcgcgcggcctcggcgaactgatccgttccaagaccggcctgctggtcgacgcctatttctccggcagcaagatcaagtggatcctggacaacgtgcccggcgcgcgcgaccgcgcccgcgaaggcaagctggccttcggcaccgtggacagctggctgatctggaatttcacccacggcaaggtgcatgtgaccgacgtgtccaacgcctcgcgcaccatgctgtacaacatccacaccctgcagtgggacgccgagctgctggacatcatgggcattccggccagcatgctcccggaagtgaagagctccagcgaagtgtacggccacacccacgccgcccacctcggcgtggaaatcccgatcgccggcgtggccggcgaccagcaggccgcgctgttcggccagcagtgcaccacgcccggcatggtgaagaacacctacggcaccggctgcttcatgatgctgaacaccggcgacaagccgatcgaatcgtccaacaacttgctgaccaccatcgcctggaaggtggacggcaaggtgcagtacgcgctggaaggctcgatcttcatcggcggcgcggtggtgaaatggctgcgcgacggcctcggcatcatccgccattcggccgacgtcggcccgctggcgcaggaagtgaagaacagcgacggcgtctacctggtgccggccttcgccggcctgggcgcgccgcactggaacgccagcgcccgcggcaccatcgtcggcgccacgctgggcaccaaggccgcccacatcgcccgcgccgcgctggacagcatcgcctaccagacccgcgacgtgctgaaggcgatggaagccgacgccgggatgagcatcgccgagctgcgcgtcgatggcggcgccaccgtcaacgaactgctgatgcagttccagtccgacatcctggccgtggacgtggtgcgtcccaagatcaccgaaaccaccgcgctgggcgccgcctacctggctggcctcgccgtcggctactggaagagcgtcgacgacatccagggccaatggcagctggaccgccgcttccagccggcgatggccgccgacgaagtgctggccaacgtcaagggctggcagcgcgcggtgaacgccgccaaggtatgggccgacgaccaggcctga

SEQ ID NO: 69717 - protein, 500 aa, Chromobacterium violaceum
MTDQYVLALDQGTTSSRAILFNRSGDIVSLAQKEFRQIYPQPGWVEHDPQEIWGGQVGVAAEAVAKAGIDGRSIAAIGITNQRETTIVWDRETGQPVYNAIVWQDRRTAEFCDELKARGLGELIRSKTGLLVDAYFSGSKIKWILDNVPGARDRAREGKLAFGTVDSWLIWNFTHGKVHVTDVSNASRTMLYNIHTLQWDAELLDIMGIPASMLPEVKSSSEVYGHTHAAHLGVEIPIAGVAGDQQAALFGQQCTTPGMVKNTYGTGCFMMLNTGDKPIESSNNLLTTIAWKVDGKVQYALEGSIFIGGAVVKWLRDGLGIIRHSADVGPLAQEVKNSDGVYLVPAFAGLGAPHWNASARGTIVGATLGTKAAHIARAALDSIAYQTRDVLKAMEADAGMSIAELRVDGGATVNELLMQFQSDILAVDVVRPKITETTALGAAYLAGLAVGYWKSVDDIQGQWQLDRRFQPAMAADEVLANVKGWQRAVNAAKVWADDQA

SEQ ID NO: 69718 - DNA, 1503 bp, Clostridium perfringens
  CDS (1)..(1503)
atgaaaaaatatatagtagcattagatcaaggaacaacaagctctagagcaataatttttgataaagaacaaaatattattggggtaagccaaaaggaatttaatcaaatttatcctagagaaggatgggttgagcatgatccaatggaaatatgggcaactcaatatagtgtacttcaagaagttatggctaaatgtaatataactcaagaaaatatagcagccattggaataactaaccaaagagaaactacaatagtttgggacaaaaatacaggggttccaatatacaatgcaattgtttggcaatgtagaagaactgctgatatatgcgatgagttaaaagaaagagatggacttgtagactatattagagaaaatacaggacttgtacttgatgcatatttttcaggaacaaaaataaaatggatattagataatgttgaaggtgcaagagaaaaagctgaaaagggtgagcttttatttggtacagtagatagttggcttgtttggaagcttacaaatggaaaagttcatgtaactgattatactaatgcatctagaactatgatatttaacataaagaaccttcaatgggatgaaagaatgttaaaggaactagacattcctagaagtatgttaccagaagtaaaaaattcatctgaaatttacggatatgcaaaccttggagcaaaaggtggaataagagttcctatagctggaatagctggggaccaacaagctgctttatttggacaagctgcatttaataaaggtgacgtaaaaaatacttatggaacaggatgtttcttattaatgaacacaggagaagaacttgttaaaagtaaatcaggacttttaacaacaatagctattggattacacggaaaagttcaatatgctttagaaggatcagtatttgttggaggagctgttatccaatggcttagagatgaattaagaataataagtgattctagtgatactgaatactttgctacaaaggtagaagataatggtggagtatatgttgttcctgccttcgttggattaggagctccttattgggatatgtatgctcgtggaactatagtaggattaacacgtggaactaatagaaatcatataataagagcagcacttgaatcaattgcatatcaaacaagagatgtgcttgaagctatgataaacgatgttggatatgatataaattgtataaaagtagatggaggagcaagtagaaataatttcttaatgcaattccaatcagatttagttggtaaaaaggtaattaagcctataattacagaaacaacagctttaggagctgcttaccttgcaggactagcagttggttactggagtgataaagaagaaatagctaagttatggtttgcaagtgaagaatttgagccaactatttctgaagagagaagaaataaatatcataagaaatggaaaaaggctgttgaaagatcaaagggatgggcacttgaagattaa

SEQ ID NO: 69719 - protein, 500 aa, Clostridium perfringens
MKKYIVALDQGTTSSRAIIFDKEQNIIGVSQKEFNQIYPREGWVEHDPMEIWATQYSVLQEVMAKCNITQENIAAIGITNQRETTIVWDKNTGVPIYNAIVWQCRRTADICDELKERDGLVDYIRENTGLVLDAYFSGTKIKWILDNVEGAREKAEKGELLFGTVDSWLVWKLTNGKVHVTDYTNASRTMIFNIKNLQWDERMLKELDIPRSMLPEVKNSSEIYGYANLGAKGGIRVPIAGIAGDQQAALFGQAAFNKGDVKNTYGTGCFLLMNTGEELVKSKSGLLTTIAIGLHGKVQYALEGSVFVGGAVIQWLRDELRIISDSSDTEYFATKVEDNGGVYVVPAFVGLGAPYWDMYARGTIVGLTRGTNRNHIIRAALESIAYQTRDVLEAMINDVGYDINCIKVDGGASRNNFLMQFQSDLVGKKVIKPIITETTALGAAYLAGLAVGYWSDKEEIAKLWFASEEFEPTISEERRNKYHKKWKKAVERSKGWALED

SEQ ID NO: 69720 - DNA, 1527 bp, Corynebacterium efficiens
  CDS (1)..(1527)
atgagagcatcgaaagccaatgcatatgtggcagctatcgaccagggcaccacatccacccgctgcatcatcattgatgacacgggcgctgtggtctcggtagccgcgaaggaacacgaacagatcctcccccagcagggatgggtggaacatgatcccgtggaaatctgggacaatgtccgagccgtggtcagccaggccatggtcgccatcgacatcaccccgtacgagatctcctccgtcggtgtgaccaaccagcgcgaaaccacggtgatctgggaccccgccaccggggaacccgtctacaacgccatcgtctggcaggacacccgcaccaatgagatctgccgggaactggccggtgaggagggacagcagaagtggctggaccgcaccggcctgctcatcaactcctacccggccggaccgaagatcaagtggatcctggacaatgtcgagggggtgcgtgaacgcgccgagaagggggaactctacttcggcaccatggacacctggctgctgtggaacctcaccggtggtatccgcggtgatgacggcgaggaagctctccacgtcaccgacgtgaccaacgcatcgcgtaccctcctgatggacatccacacccagcagtgggacccggagctgtgcgaggcactggatatccccatgtccctgctcccggagatcaaaccctccataggcgattaccgctccgtgcgtcaccgtggcatccttgccgatgtgcccatcaccggagtcctcggtgaccagcaggccgcactcttcggccagggtggtttcaaagagggtgacaccaagaacacctacggcaccggtctcttcctggtgatgaacaccggccccgaactgaagatctccgagcacggcctgctgtccaccatcgcctaccagatcgagggacaggacccggtctacgctctcgaggggtctgtctccatgggtggctccctggtgcagtggctgcgtgactccctccagatgatccccaccgcccccgccatcgaggagttcgcccgccaggttcccgacaacggtggagtccacatcgtcccggcgttctccggtctgttcgcaccacgctggcaccctgaggcacgcggtgtgatcacgggcctgaccaggttcgccaaccgcaaccacatctgtcgtgccgtcctggaggccaccgccttccagacccgcgaggtcgtggacgccatggcccgggatgccggtaaggaactggaatccctgcgcgtcgacggtgccatggtccagaatgaactgctcatgcagatgcaggccgatatcctcggcatcgatgtcatccgccccggtgatatcgagaccaccgccctcggtacggccttcgccgcgggtctggggtccggcttcttcaaggacttcgaccagatcatcgagctgatctccatccgccagacctggacgccggagatgaccgaggcggagcgcgaacgcgcctacgatgcctggaatgaggccgtcacgcacgcctacccgcgttag

SEQ ID NO: 69721 - protein, 508 aa, Corynebacterium efficiens
MRASKANAYVAAIDQGTTSTRCIIIDDTGAVVSVAAKEHEQILPQQGWVEHDPVEIWDNVRAVVSQAMVAIDITPYEISSVGVTNQRETTVIWDPATGEPVYNAIVWQDTRTNEICRELAGEEGQQKWLDRTGLLINSYPAGPKIKWILDNVEGVRERAEKGELYFGTMDTWLLWNLTGGIRGDDGEEALHVTDVTNASRTLLMDIHTQQWDPELCEALDIPMSLLPEIKPSIGDYRSVRHRGILADVPITGVLGDQQAALFGQGGFKEGDTKNTYGTGLFLVMNTGPELKISEHGLLSTIAYQIEGQDPVYALEGSVSMGGSLVQWLRDSLQMIPTAPAIEEFARQVPDNGGVHIVPAFSGLFAPRWHPEARGVITGLTRFANRNHICRAVLEATAFQTREVVDAMARDAGKELESLRVDGAMVQNELLMQMQADILGIDVIRPGDIETTALGTAFAAGLGSGFFKDFDQIIELISIRQTWTPEMTEAERERAYDAWNEAVTHAYPR

SEQ ID NO: 69722 - DNA, 1530 bp, Corynebacterium glutamicum
  CDS (1)..(1530): transl_table=11
atgagaatctcaaaggccaatgcgtatgttgcagcgattgaccaaggcaccacttccactcggtgcatcttcattgatgcccaaggaaaagtggtgtcttctgcttccaaggagcaccgccaaatcttcccacaacagggctgggtagagcacgatcctgaagaaatttgggacaacatccgatctgtcgtcagccaggcgatggtctccattgacatcaccccacacgaggttgcatcgctgggagtcaccaaccagcgcgaaaccaccgtggtgtgggacaagcacaccggcgaacctgtctacaacgcaatcgtgtggcaagacacccgcacctctgacatttgcctagagatcgcgggcgaagaaggccaggaaaagtggcttgaccgcaccggcctgctgatcaactcctacccatcggggcccaaaatcaagtggattctcgacaacgttgagggagctcgcgaacgcgccgaaaagggcgaccttttgtttggcaccatggatacctgggtgctgtggaacctgaccggcggtgtccgcggcgacgacggtgatgatgccatccacgtcaccgatgtcaccaacgcatcccgcacactattgatggatctccgcacgcaacagtgggatccagaactatgcgaagccctagacattccgatgtccatgctccctgagattcgtccctccgtcggagaattccgctccgtgcgccaccgcggaaccctagccgacgtcccgattactggcgtgctcggcgaccagcaagcggccctttttggtcagggcggattccacgaaggtgctgctaaaaatacctacggcaccggcctcttcctgctgatgaacaccggcacctcgttgaagatttccgagcacggcctgctgtccaccatcgcctatcaacgggaaggatccgctccggtctacgcgctggaaggttccgtatccatgggcggttccttggtgcagtggctgcgcgacaacctacagctaatccccaacgcaccagcgattgaaaacctcgcccgagaagtcgaagacaacggtggcgttcatgttgtcccagcattcaccggactgttcgcaccacgttggcgccccgatgctcgtggcgtcattacaggcctcacccgttttgccaaccgcaaacacatcgcccgcgcagtccttgaagccaacgccttccaaacccgcgaagttgtggacgccatggccaaagacgcaggcaaagccctcgaatccctccgcgtcgacggtgcgatggtggaaaatgacctcctcatgcaaatgcaagccgacttcctcggcatcgacgtccaacgtctcgaggacgtagaaaccaccgccgtcggcgtcgcattcgctgcaggtctcggctctggattcttcaaaacaactgacgagatcgaaaaacttattgcagtgaagaaagtctggaaccctgacatgagcgaagaagagcgcgaacgtcgctatgccgaatggaatagggcagtggagcattcttatgaccaggcctag

SEQ ID NO: 69723 - protein, 509 aa, Corynebacterium glutamicum
MRISKANAYVAAIDQGTTSTRCIFIDAQGKVVSSASKEHRQIFPQQGWVEHDPEEIWDNIRSVVSQAMVSIDITPHEVASLGVTNQRETTVVWDKHTGEPVYNAIVWQDTRTSDICLEIAGEEGQEKWLDRTGLLINSYPSGPKIKWILDNVEGARERAEKGDLLFGTMDTWVLWNLTGGVRGDDGDDAIHVTDVTNASRTLLMDLRTQQWDPELCEALDIPMSMLPEIRPSVGEFRSVRHRGTLADVPITGVLGDQQAALFGQGGFHEGAAKNTYGTGLFLLMNTGTSLKISEHGLLSTIAYQREGSAPVYALEGSVSMGGSLVQWLRDNLQLIPNAPAIENLAREVEDNGGVHVVPAFTGLFAPRWRPDARGVITGLTRFANRKHIARAVLEANAFQTREVVDAMAKDAGKALESLRVDGAMVENDLLMQMQADFLGIDVQRLEDVETTAVGVAFAAGLGSGFFKTTDEIEKLIAVKKVWNPDMSEEERERRYAEWNRAVEHSYDQA

SEQ ID NO: 69724 - DNA, 1506 bp, Coxiella burnetii
  CDS (1)..(1506): transl_table=11
atgagtagttttattttagcgattgatcaaggtacaacaagcactcgcgctattctttttaacgaagaggccaagcttgttcattatcaccacgttgaaattactcaatatttcccgcaaggcggctgggtggagcatgatcccgaagaaatctgggactcgaccctcctttgttgccgtaacgtacttgaagaagcttctttgcgtgctgccgatattgcagccctaggcatttctaaccaacgcgaaacgactattttgtgggaccgccacactggccagccactttatcgtgctatcggctggcaagatcgtcgaaccgtaaacttttgcgagcaattggcttctcaagccggggttctggctaagttcgttgaaaaaacaggattaattctagatccttacttttcttgttctaaaattaaatggatactagacaatattaaaggtgcttatgaaaaagcaaaacgcggtgagcttgcttttggcaccgtagattcttatctcttatggaaatttactggcgggaaatgccacgcgacagatgccactaacgcgtcacgaacggggctatttaatattaaccaacaacgatgggatgatgaattattaacgctttttgacattcctaaatcgctactccccaccgtacttgataattgcgctcaatttggcttcaccgatctcgatcttttaggtcataaaattccaataaccgcaatgattggcgatcagcaagcggctgcggttggccaagcttgtattaaaccaggaatggtaaaaagtacttatgggacgggttgctttatgctgctcaatacaggcgatcaaattattcattcaagaaatcgactgttagctaccattgcttaccgtcttaatgacacagtgacttatgggctcgaaggcagcattttcattgcaggtgccgcagtaaaatggctgcgagatccgcttcacctcattgagaaagcgaacgatagtgaaagtatggcctccagtgttgaggataccggcggggtttatttagtgcctgcgttcaccggtttgggagcaccttactgggaccccaacgcgcggggcgctttattcggtctgacgcgcaacacccaacgagagcatattgttcgcgcggctctagaagccgtgtgttaccagagcaaagacctcgttcgagcgatattaaatgacggcgcgaatttaactacgcttcgcgttgatggcggcatggcggccaataattggttattacaatttttgtctgatattctgggcgttaatgtggatcgttcgaggtgcattgaaagcagtgcgttagggacagcctttctagctggcttaggtgcgggtctttttgactcattagaagagatgacgggtttatggcaagccgatcgtcattttatccctcaaatggaccctaaaaaacgggaagaattatacgatgggtggcaaaaagccgttgaaaagacccttactcccgcagccccactcctttttccataa

SEQ ID NO: 69725 - protein, 501 aa, Coxiella burnetii
MSSFILAIDQGTTSTRAILFNEEAKLVHYHHVEITQYFPQGGWVEHDPEEIWDSTLLCCRNVLEEASLRAADIAALGISNQRETTILWDRHTGQPLYRAIGWQDRRTVNFCEQLASQAGVLAKFVEKTGLILDPYFSCSKIKWILDNIKGAYEKAKRGELAFGTVDSYLLWKFTGGKCHATDATNASRTGLFNINQQRWDDELLTLFDIPKSLLPTVLDNCAQFGFTDLDLLGHKIPITAMIGDQQAAAVGQACIKPGMVKSTYGTGCFMLLNTGDQIIHSRNRLLATIAYRLNDTVTYGLEGSIFIAGAAVKWLRDPLHLIEKANDSESMASSVEDTGGVYLVPAFTGLGAPYWDPNARGALFGLTRNTQREHIVRAALEAVCYQSKDLVRAILNDGANLTTLRVDGGMAANNWLLQFLSDILGVNVDRSRCIESSALGTAFLAGLGAGLFDSLEEMTGLWQADRHFIPQMDPKKREELYDGWQKAVEKTLTPAAPLLFP

SEQ ID NO: 69726 - DNA, 1506 bp, Deinococcus radiodurans
  CDS (1)..(1506): transl_table=11
atgtctgagcatcagtacatcctggccctcgaccagggcaccaccagcagccgcgccatcgtcttcgaccaccagggcaacatgaagggcgtcggccagcaggaattccggcagcactttcccaagcccggctgggtggagcacgacgcgaacgaaatctggagcacccagatcggcgtggcgcagcaggccctgagcaacgcgggcatccgcgcctccgacctcgccgccatcggcatcaccaaccagcgcgaaacgaccctcatctgggaccgcgcgaccggcaagcccattcaccacgcgattgtttggcaagaccgccgcaccgcgccctactgcgactctatccgcgctcagcacgaaaagaccttgcaggacaagaccgggctggtgctcgacgcctacttctccggcaccaaggtcaagtggctgctcgacaacgtgcccggcgcccgcgaacgcgccgagaagggcgaactcgctttcggcaccatcgactcctggctggtctacaacctgaccggcggcgaactgcacatcaccgacgccaccaacgccagccgcacgctgctctacaacatccacaccggcgagtgggacgacgaactgctgcgcatcctcgacgtgccgcgcagcgtgctgcccgaggtccgcaactcctccgaggtgtacggcaagacggcggcggggttgctcggcgcgcaggtgccgattgcgggcatcggcggtgaccagcaggcggcgaccttcgggcaggcctgccttgagaggggcatggcgaaaaatacctacggcaccggctgcttcatgctgatgaataccgagggcgaggcggtcccgagccagaacaaactgctgaccacggtggcgtggcagctggacggcgagcggacctacgcgctcgaaggctcggtgtttatcggcggcgcggtggtgcagtggctgcgcgacggcctgaacatcatccgctccagcaccgagatcgaggcgctcgcccgcacggtggacagcagcgaaggcgtgatgctggtgcccgcgttcgtcggcctcggcgcgccctactgggacgcctacgcccgtggcacgatggtcggcatcacccgtggcaccaccaaggcgcacatcgcccgcgccgcgctcgaagcggtggcctaccagtccgccgagctgctcgaagccatgcaaaaggactcgggcgtggagctcaaggaactgcgcgtggacggcggcgccagcaccaacgacctgatgatgcagttccaggccgacatcctcggcgtgccggtcatccggcccaaagtcaccgaaaccaccgcgctcggcgccgcttacctcgcgggcctcgccgtgggctactggaagtccaccgacgacatcgcccaccagtggcaggaagacaagcgcttcgagccccagatgagcgaagaggagcgcagcaagctgatgcgccgctggaaaaaggccgtggcccgcgcccgcgactgggaagacgacagcgaagcgtaa

SEQ ID NO: 69727 - protein, 501 aa, Deinococcus radiodurans
MSEHQYILALDQGTTSSRAIVFDHQGNMKGVGQQEFRQHFPKPGWVEHDANEIWSTQIGVAQQALSNAGIRASDLAAIGITNQRETTLIWDRATGKPIHHAIVWQDRRTAPYCDSIRAQHEKTLQDKTGLVLDAYFSGTKVKWLLDNVPGARERAEKGELAFGTIDSWLVYNLTGGELHITDATNASRTLLYNIHTGEWDDELLRILDVPRSVLPEVRNSSEVYGKTAAGLLGAQVPIAGIGGDQQAATFGQACLERGMAKNTYGTGCFMLMNTEGEAVPSQNKLLTTVAWQLDGERTYALEGSVFIGGAVVQWLRDGLNIIRSSTEIEALARTVDSSEGVMLVPAFVGLGAPYWDAYARGTMVGITRGTTKAHIARAALEAVAYQSAELLEAMQKDSGVELKELRVDGGASTNDLMMQFQADILGVPVIRPKVTETTALGAAYLAGLAVGYWKSTDDIAHQWQEDKRFEPQMSEEERSKLMRRWKKAVARARDWEDDSEA

SEQ ID NO: 69728 - DNA, 1521 bp, Enterococcus casseliflavus
  CDS (1)..(1521)
atggcagaaaaaaattatgtaatggcgatcgaccaaggaaccactagttcaagagcaattatttttgatcgtaacgggaaaaaaatcggcagttcacaaaaagagtttccgcaatactttccaaaatcaggttgggtagaacacaacgccaacgaaatttggaactctgtccaatcagtcatcgcaggggcatttattgaatcaggtatccgaccagaagcaatcgccggcattggtatcaccaaccagcgtgaaacgacagtggtttgggataaaacgacagggcagccaatcgcgaatgcgatcgtttggcaatcccgtcaatcttcaccgatcgctgaccaattaaaagtagatggccatacagagatgatccatgaaaaaactgggttagtcattgatgcgtatttctcagcgaccaaggtgcgttggcttttagacaatatcgaaggggcacaagaaaaggcggataatggtgagctactcttcggaacgatcgattcatggcttgtgtggaaactgacagatggtcaagtccatgtcaccgactactccaatgctagtcggacgatgctttacaacattcataaattagagtgggatcaagaaattttggatcttttgaacattccaagctcgatgctaccagaagtcaaaagcaactcagaagtctatggtcacacccgcagctaccatttttacggcagtgaagtaccaatcgctggaatggctggagaccaacaagccgctctctttggacaaatggcctttgaaaaaggtatgatcaaaaatacttacggcactggggcatttattgtcatgaatacgggtgaagaaccacaattgtctgacaatgacctactgacgactatcgggtatggcatcaacggcaaagtctattatgccttagaaggaagtatcttcgttgctggatcagcgatccaatggctgcgggatggtctacgcatgatcgagacatcgccacaatcagaagaactagctgccaaagcaaaaggtgataatgaagtctatgtggtacctgcctttactggattaggtgcgccttactgggattcagaagcaagaggagcagtcttcggcttgactcgtgggacgacgaaggaagattttgttcgggcaacattgcaagctgttgcgtatcaatcaaaagacgtcatcgatacgatgaaaaaagattccggtatcgatatcccattgctgaaagtcgatggaggggcagccaaaaacgatttattgatgcagttccaagcggacattttagacattgacgtgcaacgagcagcgaatctggaaacaaccgcattaggtgcagcttacttggcagggctagcggttggcttctggaaagacttggatgaattgaaatcaatggcagaagaagggcaaatgtttacaccagaaatgccagcagaagaaagagacaatttgtacgaaggctggaaacaagcggtagcggctactcagaccttcaaattcaaagcgaagaaagaaggcgagtaa

SEQ ID NO: 69729 - protein, 506 aa, Enterococcus casseliflavus
MAEKNYVMAIDQGTTSSRAIIFDRNGKKIGSSQKEFPQYFPKSGWVEHNANEIWNSVQSVIAGAFIESGIRPEAIAGIGITNQRETTVVWDKTTGQPIANAIVWQSRQSSPIADQLKVDGHTEMIHEKTGLVIDAYFSATKVRWLLDNIEGAQEKADNGELLFGTIDSWLVWKLTDGQVHVTDYSNASRTMLYNIHKLEWDQEILDLLNIPSSMLPEVKSNSEVYGHTRSYHFYGSEVPIAGMAGDQQAALFGQMAFEKGMIKNTYGTGAFIVMNTGEEPQLSDNDLLTTIGYGINGKVYYALEGSIFVAGSAIQWLRDGLRMIETSPQSEELAAKAKGDNEVYVVPAFTGLGAPYWDSEARGAVFGLTRGTTKEDFVRATLQAVAYQSKDVIDTMKKDSGIDIPLLKVDGGAAKNDLLMQFQADILDIDVQRAANLETTALGAAYLAGLAVGFWKDLDELKSMAEEGQMFTPEMPAEERDNLYEGWKQAVAATQTFKFKAKKEGE

SEQ ID NO: 69730 - DNA, 1533 bp, Halobacterium sp
  CDS (1)..(1533): transl_table=11
atgacagacgcatacgtcggcgcgatcgaccaagggacgacaggcacgcggttcatcgtattcgaccaacacggcgacgtggtcgcgaacacctacgagaaacacgaacagcactaccccgaacccggctgggtcgaacacgaccccctggagatctgggagaacacgaaaagcgtcgtcacggcggggctctcggccgccgggctggacgccgatgacctcgccgcgatcggcatcacgaaccagcgcgagaccaccgtagtctgggacgccgcaagcggccgcccgatccacaacgccctcgtctggcaggaccgacgcaccaccagccgcgtcgaatccctggaggaaaacggcaagatcgagcgcatccgcgagaaaaccggcctggaggcggacgcctacttctcggccacgaaaaccgagtggctgctcgacgaagccgagccgctgaagctctcctcggcgcgcgccagcagcctccgggatcgcgcccgcgacggcgagttgctcatgggcaccatcgactcctggctcatctacaacctcaccggcgaacacatcacggacgtgtcgaacgcctcccggacgatgttgtacaacatcaccgacctggagtgggacgactggctgctggaggagttcgacatcccccgggagatgctgccggaagtacggccgtcctctgacgaggccgtctacgggcacaccgaccccgacggcttcctcggcgcggcagttcccgtcacggccgcgctgggcgaccagcaggcggccctcttcgggcagacgtgtttcgacgccggcgacgccaagaacacgtacggcaccggctcgttctacctcatgaacaccggcgaggacgccgtctcctccgagcacggcctgctcacgacgatcgggttccagctctccggggagcccgtccagtacgccctcgaggggtcgatcttcgtcacgggcgcggcgatcgagtggctcgaagacgtcgacctcatcaacaacgccgcccagaccgcggaactcgccagctccgtcgacaccaccgacggcgtctacatggtgcccgcgttcaccgggctgggcgcgccacactgggacggccgcgcccgcggcaccctcgtcggcatgacgcggggcacgcggaaagcccacatcgttcgggcgaccctcgaatcgatcgcctaccagacccgcgacatcgcggcggcgatggaggccgactccggggtgtccaccacgacgctgcgcgtcgacggcggcgcggtcaagaacaacttcctctgccagctgcagtcggacatcatccagaccgacctcgcgcgcccggaggtcgacgagaccaccgcgctcggggcggcctacgcggccggcctggcggtcggctactgggacagcctggacgacctccgggagaactggcgtgtcgaccggtcgttcgagccggagatggaccccagcgaggccgacagcaagtacggccgctgggaggacgccgttgatcgctcgctggcgtgggccacggaggactga

SEQ ID NO: 69731 - protein, 510 aa, Halobacterium sp
MTDAYVGAIDQGTTGTRFIVFDQHGDVVANTYEKHEQHYPEPGWVEHDPLEIWENTKSVVTAGLSAAGLDADDLAAIGITNQRETTVVWDAASGRPIHNALVWQDRRTTSRVESLEENGKIERIREKTGLEADAYFSATKTEWLLDEAEPLKLSSARASSLRDRARDGELLMGTIDSWLIYNLTGEHITDVSNASRTMLYNITDLEWDDWLLEEFDIPREMLPEVRPSSDEAVYGHTDPDGFLGAAVPVTAALGDQQAALFGQTCFDAGDAKNTYGTGSFYLMNTGEDAVSSEHGLLTTIGFQLSGEPVQYALEGSIFVTGAAIEWLEDVDLINNAAQTAELASSVDTTDGVYMVPAFTGLGAPHWDGRARGTLVGMTRGTRKAHIVRATLESIAYQTRDIAAAMEADSGVSTTTLRVDGGAVKNNFLCQLQSDIIQTDLARPEVDETTALGAAYAAGLAVGYWDSLDDLRENWRVDRSFEPEMDPSEADSKYGRWEDAVDRSLAWATED

SEQ ID NO: 69732 - DNA, 1497 bp, Lactococcus lactis
  CDS (1)..(1497): transl_table=11
atgacagaaacttcttacattatggcaattgaccaaggtacaacaagctcaagagctattatatttgataaacatggtaaacatatcggcagctcccaaaaggaatttacacagtactttcctaaagaaggttgggtggaacatgatgccaacgaaatttggaactctgttcagtctgttatcgcaggggcttttatcgagtcggggattaagcctgtacaggttgcgggtatcggtattactaaccaacgtgaaactaccattatatgggacaagaaaacaggaaaaccaatctatcatgctattgtttggcaatctcgtcaatctgccgatattgccaatggtcttaaagaagcaggacatgaggaactcttccataaaaagacaggacttattgtcgattcatatttttcagccacaaaaattcgttggatccttgaccatgtcgaaggagcacaagagcgtgcagaacgcggagagctcctctttggaaccatcgatacatggctcttgtggaagttgacagatggtgatgcacactatactgactattctaatgccagccgtaccatgctctacaacattcatgagttgaaatgggacgaagaaatcctgaaaattcttaatatcccagcttcaatgcttccagaagtcaagtccaactcagaagtttacggcgtgactaaaggtttccatttctttggctctgaagtgccaatctcaggtatggcaggggaccagcaagctgcattatttggtcaaatggcctttgaacctggaatgattaaaaatacctatggtacaggttcgtttatcgtcatgaacacaggtgagaaaccacatatttcgaaaaataatatgcttacaacgattggttatggcattaatggaaaagtttattacgccttagaaggaagcatctttgttgcggggtcctctatccaatggttacgtgatggtttgaaaatgttggaacgtgccagtgattccgaagaagtggcactccagtctaggagtcaagatgaagtttatgtggtgccagcttttgtcggccttggtgctccgtattgggaccaagaggcgcgtggtgcgatgtttggcttgacacgtggaacaacaaaagaagatattgtgaaagcaaccttacaagggatagcttatcaagttcgtgatgtagtcagcaccatgaaagaagatacaggaattgatatgtctgtgctcaaggtagacggtggcgctgcaaacaatgaatatttgatgcagttccaagctgatatcttgaatatcccaatccaacgtgcgggagatttggaaacgacagcacttggtgcagccttccttgcaggacttgccgttggtttctggaaagacttagaagagcttaaagaatcctatgaaccgggcaaaattttccaaactcagatgcaagaagaacgtagagaagaactctatgccggttggaaaaaagccgtgaatgcgacacgtgctttcaaataa

SEQ ID NO: 69733 - protein, 498 aa, Lactococcus lactis
MTETSYIMAIDQGTTSSRAIIFDKHGKHIGSSQKEFTQYFPKEGWVEHDANEIWNSVQSVIAGAFIESGIKPVQVAGIGITNQRETTIIWDKKTGKPIYHAIVWQSRQSADIANGLKEAGHEELFHKKTGLIVDSYFSATKIRWILDHVEGAQERAERGELLFGTIDTWLLWKLTDGDAHYTDYSNASRTMLYNIHELKWDEEILKILNIPASMLPEVKSNSEVYGVTKGFHFFGSEVPISGMAGDQQAALFGQMAFEPGMIKNTYGTGSFIVMNTGEKPHISKNNMLTTIGYGINGKVYYALEGSIFVAGSSIQWLRDGLKMLERASDSEEVALQSRSQDEVYVVPAFVGLGAPYWDQEARGAMFGLTRGTTKEDIVKATLQGIAYQVRDVVSTMKEDTGIDMSVLKVDGGAANNEYLMQFQADILNIPIQRAGDLETTALGAAFLAGLAVGFWKDLEELKESYEPGKIFQTQMQEERREELYAGWKKAVNATRAFK

SEQ ID NO: 69734 - DNA, 1494 bp, Listeria innocua
  CDS (1)..(1494): transl_table=11
atggaaaagaaatatattttagcactggatcaaggaacaacaagttcaagagcgatgattattgacgaagaaggagaagttattggcgttgcgcaagaagaatttgatcaaatttttcctaagccaggttgggttgaacatagtgccaatgaaatctgggcttcgattttagcagtaattgcaggcgtattactcaaaacaaatatttcttctaaagaaattgctgggattggtattacaaaccaacgtgaaactactgttatttgggataaagaaagcggaaatccaatttataatgcgattgtttggcaatctcgtcaaactgaagatatttgtaagcaacttcgtaaagatggttacgaagatacgattagatcaaaaactggtcttttgattgatccatactttgcaggtacaaaagctcgctggattcttgatcatgtagatggcgcacaagaacgtgctgaaaaaggagaacttcttttcggtacaattgatacttggttagtttggaaattaactggtggtcgtgctcatattaccgattattccaatgcttcccggacacttctttataatatttatgatttagaatgggatgatgagcttctaaaaatgcttaatatcccaagagcaatgttacctgaagttcgtccttcctctgaagtatacgcggacacagtgccttatcacttctttggtgaagaagttcctgttgcaggtattgccggtgaccaacaagccgcattatttggtcaaggttgttttgaaaaaggtatggcgaaaaacacttacggaactggttgtttcttactaatgaacacaggcgaaaaagcagtacgttctgaaaatggactattaactacgctagcttggggactcgatggtaaagtggaatatgcgcttgaaggtagtattttcgttgctggttccgctattcagtggttacgtgatggcttacgtatggttcgtcaatcaagtgattctgaaaactatgcgagccggattgaatctagtgatggtgtatatgttgtaccagcattcgttggtttaggcgcaccttactgggattccgacgttcgtggtgctgtctttggattaactcgcggtactgaaaaagaacaatttatccgtgcgacattggaatctcttgcttatcaaactcgtgatgtactgtatgcaatggaacaagattctggtattagcttaaaaacgttacgtgtggatggcggggcttctgctaataacttcttaatgcaattccaatccgatattctaggagttcctgtagaacgtccagaaaacaaagaaacaactgttcttggagcagctttcttagcaggacttgcagtaggcgtttggaaagataaaaacgaaattaaaaaacattggaaactagacaaacgttttgaagtagaaatgaaagatgatcaaagagaagatttatatgaaggttggcataaagcagtcaaagctgcacaagctttcaaataa

SEQ ID NO: 69735 - protein, 497 aa, Listeria innocua
MEKKYILALDQGTTSSRAMIIDEEGEVIGVAQEEFDQIFPKPGWVEHSANEIWASILAVIAGVLLKTNISSKEIAGIGITNQRETTVIWDKESGNPIYNAIVWQSRQTEDICKQLRKDGYEDTIRSKTGLLIDPYFAGTKARWILDHVDGAQERAEKGELLFGTIDTWLVWKLTGGRAHITDYSNASRTLLYNIYDLEWDDELLKMLNIPRAMLPEVRPSSEVYADTVPYHFFGEEVPVAGIAGDQQAALFGQGCFEKGMAKNTYGTGCFLLMNTGEKAVRSENGLLTTLAWGLDGKVEYALEGSIFVAGSAIQWLRDGLRMVRQSSDSENYASRIESSDGVYVVPAFVGLGAPYWDSDVRGAVFGLTRGTEKEQFIRATLESLAYQTRDVLYAMEQDSGISLKTLRVDGGASANNFLMQFQSDILGVPVERPENKETTVLGAAFLAGLAVGVWKDKNEIKKHWKLDKRFEVEMKDDQREDLYEGWHKAVKAAQAFK

SEQ ID NO: 69736 - DNA, 1542 bp, Mycoplasma gallisepticum
  CDS (1)..(1542): transl_table=4
ttaaaaaaacaaattatggacaagaagaaatacattattacattagacgaaggaactacatcttgtcgttcaatcgtttttgataaacaagctaagatcgtaagtgttgcacaaaacgaatttacgcaatactttccacaaagtggatgagttgagcatgatccattagaaatttggaatacccaactatctacaatgcaatcggttaaaaacaaagctcaaattaaatcagtaaacgttgaggctgttggtattactaatcaacgtgaaactgttgttttatgaaataaagaaacggggcttccggtttataatgcaattgtatgacaagaccgtagaacaagtgaatattgcgaaaccctaactaaacacgttgataaagttagagaaaaaactggtttaatcattaatccttatttctcaggtactaagattcgttgaatcttaaaaaatgttcctttagcgcaaaaaactttaaaagctggcaagttactagcaggaacaattgattcatgattaatttgaaaactaactggtggtaaggtacacgcaactgatgtctcaaacgcatcaagaacattattatttaatattcacaccatggattgggatcaagaattattagatttatttgaaatccctcggtcgattcttccagaagttaaatcttcttctgaagtttatggttatgtagaacctagtttgtgatctcaacgagctactgctaaagttccgattacaggtgttgctggtgaccaacaatctgctttatttggtcagttgtgtcttaaacctggaatggttaaaaacacctatggaacaggttgcttcaccttaatgaacattggtgaaaaaccaattatgtctaagaacaaactgttaacaacagttgcttggaaactaggtaagaaaaaaccagtttatgcccttgaaggttctgtgtttattgctggagctgctgtccaatgaatacgtgacggactaagattaatttatgatgcagctgaatctgatttttatgctaatttagcttctaaacaagatactcaccaagtttatttagttccttcatttactggattaggtgctccttattgggactcttattcacgtggagcaatctttggtcttgaacgtggaactaaaaaagaacatattattaaagcaacacttgaatcgatcgtgttccaaactaatgatctgattaaagctatgtcttctgatgttggtaaaaagatcgaagttgttaaagttgatggtggtgcaactagatctgaatacatcatgcagttccaatcatcaatctcaggggttaatgtaattagacctaagaatattgaatcaaccgcattaggggcaaccttcttagctggtttagctgttggttattgaaaagatctaaaagagcttgaaaaactagttaaagtcgataaagagttcaaaccaaaactagataaagaaaaagtcgaaaaattagttcatggctgaaatgttgcggtaaaaagaacatttaattgaatgaaagaggtggatcttaaataa

SEQ ID NO: 69737 - protein, 513 aa, Mycoplasma gallisepticum
MKKQIMDKKKYIITLDEGTTSCRSIVFDKQAKIVSVAQNEFTQYFPQSGWVEHDPLEIWNTQLSTMQSVKNKAQIKSVNVEAVGITNQRETVVLWNKETGLPVYNAIVWQDRRTSEYCETLTKHVDKVREKTGLIINPYFSGTKIRWILKNVPLAQKTLKAGKLLAGTIDSWLIWKLTGGKVHATDVSNASRTLLFNIHTMDWDQELLDLFEIPRSILPEVKSSSEVYGYVEPSLWSQRATAKVPITGVAGDQQSALFGQLCLKPGMVKNTYGTGCFTLMNIGEKPIMSKNKLLTTVAWKLGKKKPVYALEGSVFIAGAAVQWIRDGLRLIYDAAESDFYANLASKQDTHQVYLVPSFTGLGAPYWDSYSRGAIFGLERGTKKEHIIKATLESIVFQTNDLIKAMSSDVGKKIEVVKVDGGATRSEYIMQFQSSISGVNVIRPKNIESTALGATFLAGLAVGYWKDLKELEKLVKVDKEFKPKLDKEKVEKLVHGWNVAVKRTFNWMKEVDLK

SEQ ID NO: 69738 - DNA, 1527 bp, Mycoplasma genitalium
  CDS (1)..(1527): transl_table=4
atggatctaaaaaaacaatacattattgccttagatgaaggtactagttcttgtcgatcaattgtttttgatcacaatcttaaccaaatagcaatagcacaaaacgaatttaacactttttttcctaatagtggttgagttgaacaagatccactagaaatttgatcagcccaactagctaccatgcaaagtgctaaaaataaagcacaaatcaaatctcatgaagtgattgcagttggtattaccaatcaaagagaaacaatagttttatgaaataaagaaaatggtttgcctgtttataatgccatcgtttgacaggatcaaagaactgcagcactatgtcaaaaattcaatgaggataagttaatccaaaccaaagtaaaacaaaaaactggattacctattaacccctattttagtgctactaagatagcttgaatcttaaaaaatgttcctttagcaaagaaactaatggagcaaaaaaagttgttatttggcaccattgatagctgattaatctgaaaactaactaatggaaaaatgcatgttacagatgtttcaaatgcttcaagaactcttttatttgacattgtcaaaatggagtgatccaaagagttatgtgatttatttgaagtaccagtttcaatcttacctaaagttctgagttccaatgcttactttggtgatattgaaactaatcactgatctagtaatgctaaaggtattgtaccaattagagcagttttaggagaccagcaagcagctttgtttggtcaactctgtactgaacctggaatggtaaaaaatacctatggtactggatgttttgtactcatgaacattggtgataaaccaacactctcaaagcacaatctgctcacaacagtagcatggcaactagaaaatcatccacctgtatatgcattggaaggtagtgtgtttgtagcgggtgcggctataaaatggttaagggatgcattaaaaattatctattcagaaaaggaaagtgatttttatgcagaacttgcaaaagaaaatgaacaaaacctagtttttgtaccagctttcagtggacttggagctccttgatgagatgctagtgctaggggtattatcttaggaattgaagcaagcactaaaagagagcacatagtaaaagctagcttagagtcaattgcttttcaaactaatgatttattaaatgcaatggcaagtgatctaggctataagattactagcattaaagctgatggggggattgttaaatcaaactatttaatgcagtttcaagctgatattgcagatgtaattgtttctatccctaaaaataaagaaaccactgcagttggtgtttgttttttagctggacttgcttgtggattttgaaaagacattcatcaacttgaaaaactcactactcttgataaaaagttcaaaagcactatggacccaaacataagaaaaaccaaaattaacagttgacataaagcagttgaacgtgctttaaaatggaaagaaattgattaa

SEQ ID NO: 69739 - protein, 508 aa, Mycoplasma genitalium
MDLKKQYIIALDEGTSSCRSIVFDHNLNQIAIAQNEFNTFFPNSGWVEQDPLEIWSAQLATMQSAKNKAQIKSHEVIAVGITNQRETIVLWNKENGLPVYNAIVWQDQRTAALCQKFNEDKLIQTKVKQKTGLPINPYFSATKIAWILKNVPLAKKLMEQKKLLFGTIDSWLIWKLTNGKMHVTDVSNASRTLLFDIVKMEWSKELCDLFEVPVSILPKVLSSNAYFGDIETNHWSSNAKGIVPIRAVLGDQQAALFGQLCTEPGMVKNTYGTGCFVLMNIGDKPTLSKHNLLTTVAWQLENHPPVYALEGSVFVAGAAIKWLRDALKIIYSEKESDFYAELAKENEQNLVFVPAFSGLGAPWWDASARGIILGIEASTKREHIVKASLESIAFQTNDLLNAMASDLGYKITSIKADGGIVKSNYLMQFQADIADVIVSIPKNKETTAVGVCFLAGLACGFWKDIHQLEKLTTLDKKFKSTMDPNIRKTKINSWHKAVERALKWKEID

SEQ ID NO: 69740 - DNA, 1527 bp, Mycobacterium leprae
  CDS (1)..(1527): transl_table=11
ttggccgagttcgctgaattcatagccgccatcgaccagggcaccaccagcacccgctgcgtgattttcgatcataatggtgctgaggtggcccgccaccagcttgagcacgagcaaatcttgccccgctccggctgggtcgaacataatcccgttgagatttgggaacgcaccgcgtcagtgctgatgtcggtgctgaacgccactaatttgtcagctaaagatattgcagcgcttggaattactaaccaacgtgagactaccctggtgtggaatcggaacaccggaaggccgtattgcaatgcgatcgtttggcaagacacccgcactgaccgtatcgcggtcgcgcttgaccgagatggccgcggagaggtgatccgccgcaaagccgggttgccgccggcgacctatttttccggcgggaaattgcaatggatcttagagaacgtcgacggggtaggcgccgctgctgaaaacggtgaagcactcttcggcacccccgatacctggttattgtggaatctgaccggtggtccgcggggtggcgtacacgtcaccgatgtgaccaacgctagccggaccatgctgatggacttagagaagctggattgggacgacgagctgttgtcgtttttttccatccctcgggcgatgttgccggcgatcgcgtcgtcttcaccgctgcagccctacggtgtcactttagcggacggacccgtcggtggtgaagtgccgatcacaggagtcttgggcgatcagcatgcggcgatggttggtcaggtgtgtctagacgcgggggaagcgaaaaacacttacggcaccggcaattttttgctgcttaacaccggtgaggctatcgtgagatccggtaacggcctgttgaccaccgtttgctatcagttcggggatgccaaacccgtctacgcgcttgaaggttcgatcgcggtgactggctcagcggtgcagtggttacgtgatcagttgggcatcatcagcggcgctgctcaaagcgaatcgctggcccgtcaggtcgttgacaatggcggggtgtacttcgtaccggcattttccgggttgttttccccgtattggcggtccgatgcacgaggcgcaattgtggggctatcacggttcaacaccaacgcgcatctggcccgcgcgacgttggaagctatctgttatcagagtcgggacgtggtggacgcgatggcagcagattctggtgtgcgccttgatgtcttgaaggtcgatggtggtatcaccagtaatgacttgtgcatgcagattcaggccgacgtgctgggcgtggacgtggtacgctcggtagttgctgagactactgcgctgggctctgcctatgcggcgggtctagcggtcgggttttgggctggtccgtcagatctacgggccaattggcaagaggataagcgttggacgccgacgtggggcgaggaccagcgtgccgcggcgtatgcgggttggcgtaaagccgtgcagcggacgttggattgggtcgatgtgtcctga

SEQ ID NO: 69741 - protein, 508 aa, Mycobacterium leprae
MAEFAEFIAAIDQGTTSTRCVIFDHNGAEVARHQLEHEQILPRSGWVEHNPVEIWERTASVLMSVLNATNLSAKDIAALGITNQRETTLVWNRNTGRPYCNAIVWQDTRTDRIAVALDRDGRGEVIRRKAGLPPATYFSGGKLQWILENVDGVGAAAENGEALFGTPDTWLLWNLTGGPRGGVHVTDVTNASRTMLMDLEKLDWDDELLSFFSIPRAMLPAIASSSPLQPYGVTLADGPVGGEVPITGVLGDQHAAMVGQVCLDAGEAKNTYGTGNFLLLNTGEAIVRSGNGLLTTVCYQFGDAKPVYALEGSIAVTGSAVQWLRDQLGIISGAAQSESLARQVVDNGGVYFVPAFSGLFSPYWRSDARGAIVGLSRFNTNAHLARATLEAICYQSRDVVDAMAADSGVRLDVLKVDGGITSNDLCMQIQADVLGVDVVRSVVAETTALGSAYAAGLAVGFWAGPSDLRANWQEDKRWTPTWGEDQRAAAYAGWRKAVQRTLDWVDVS

SEQ ID NO: 69742 - DNA, 1524 bp, Mycoplasma pulmonis
  CDS (1)..(1524): transl_table=4
atggaaaataacgaaaaatatattattacattggattcaggaactacatcgtgtcgttcattaattgttaataaaaaaggtgaaattattgccattgctcaaaatgaatttagtcaatattttcctaaatcaggttgagttgaacatgaccctttagaaatttgaaatactcaactttcaactatgcaaagtgtaaaaaacaaagcccaaattaaatcaagtgatattgtggctttaggtattaccaaccaaagagaaactattgttgtttgagataaagacacaggcttgcctgtttataatgccatagtttgacaagatgtaagaacttcaagcttttgtgatcagatgatagctgaaaataaaactgagttttttagagaaaaaacaggactaattattaatccatattttagtgctactaaattaaaatgaattttagaaaacgttcctttagccaaagaaaaattggctaaaggaaaacttttagcaggaacaattgatacttggttgatttggaaattaactggtggaaaagttcatgctagcgatgtttcaaatgcttcaagaactatgctttttaacatccatagccttgattgagatcaagagattctagattatttaaaaattccaagaagcatcttacctaaagttcaggcctcttctgaattttatggctttgttcaaagcagtctgtggtcaaataaagccaaggggaaagttccaattactggagtagcaggagatcaacaatcagctttatttggtcaaatgtgcactgaagtaggaatggtaaaaaacacttatggaacaggatgttttactttggttaacactggtcaaaaaccagttaattctaaaaatagacttttaacaacaatagcttgaaaattaggtaatgaaaaaacaatttatgccttagaaggttcagtttttgtagcaggagctgctattcaatgactaagagattcactaaggattttatataatgcagctttaagtgatttttatagctccttggtaaaagataaccaaagagtctatgttgttccagcttttactggactaggagctccatattgagattcttatgctaaaggagcaatttttggccttgaaagaggaactaaaaatgaacatattattaaagctactttagagtcaatagcttatcaaagtaatgacttaattaaagctatggaaaaagacttaggtcaaaaaataactttacttaaagtagatggaggagctagcaagtctgattatttaatgaactttcaagcatctatttcaaatttagatgttcatagaccagccaatgtagaaactactgccctaggagctgcttatttagctggattggccgttggtttttgaaaagatataaaagaaattcaaaaaatgatcaaaattgatcatcagttcaaaccttctgttgatcaaaaagaagttgatgttttattaaaaggatgaaatgaagctgtaaaaagagttttaaactgacaaaaggacattgaataa

SEQ ID NO: 69743 - protein, 507 aa, Mycoplasma pulmonis
MENNEKYIITLDSGTTSCRSLIVNKKGEIIAIAQNEFSQYFPKSGWVEHDPLEIWNTQLSTMQSVKNKAQIKSSDIVALGITNQRETIVVWDKDTGLPVYNAIVWQDVRTSSFCDQMIAENKTEFFREKTGLIINPYFSATKLKWILENVPLAKEKLAKGKLLAGTIDTWLIWKLTGGKVHASDVSNASRTMLFNIHSLDWDQEILDYLKIPRSILPKVQASSEFYGFVQSSLWSNKAKGKVPITGVAGDQQSALFGQMCTEVGMVKNTYGTGCFTLVNTGQKPVNSKNRLLTTIAWKLGNEKTIYALEGSVFVAGAAIQWLRDSLRILYNAALSDFYSSLVKDNQRVYVVPAFTGLGAPYWDSYAKGAIFGLERGTKNEHIIKATLESIAYQSNDLIKAMEKDLGQKITLLKVDGGASKSDYLMNFQASISNLDVHRPANVETTALGAAYLAGLAVGFWKDIKEIQKMIKIDHQFKPSVDQKEVDVLLKGWNEAVKRVLNWQKDIE

SEQ ID NO: 69744 - DNA, 1554 bp, Mycobacterium tuberculosis
  CDS (1)..(1554): transl_table=11
gtgtccgacgccatcctaggagagcaattggccgagtcctcggatttcatagccgccatcgaccagggcaccaccagcacccgctgcatgatcttcgatcaccacggtgccgaggtggcccgccaccagctcgagcacgagcagatcctgccccgggccggctgggtggagcacaacccggtcgagatctgggagcgcaccgcgtcggtgttgatctcggtgctcaacgccaccaacctatcgccgaaagatattgccgcgttggggattaccaaccaacgtgagacgacgctggtatggaatcggcacaccggacggccctactacaacgcgattgtatggcaggatacccgcaccgaccgcatcgcgtcggcgctggatcgagacggtcgtggaaacctgatccgccgcaaggcgggcctgccgccggcaacttatttctctggcggcaagctgcagtggatcctggaaaatgtcgatggagtccgcgcggccgccgagaacggcgacgcattgttcggcacaccggacacctgggtgttgtggaatctgaccggcgggccgcgggggggtgtgcatgtcaccgatgtaaccaacgccagccggaccatgttgatggatctagagacgctggactgggacgacgagctgttgtcgttgttttcgatacctcgggccatgctgcccgagatcgcatcgtcggcgccgtcggagccttacggtgtcacgctggcgaccgggcctgtcggcggtgaggtgccgatcaccggagttctcggtgatcagcatgcggccatggtcggtcaagtctgtctggccccaggggaggcgaaaaacacctatgggaccggcaattttctgctgctgaacaccggtgaaacgatcgtgcgatcgaataacggcctgctaaccacggtgtgctaccaattcgggaacgctaaacccgtgtacgcgcttgaaggttcgatcgcggtgaccggctcggcggtgcagtggctacgcgatcagctgggcatcatcagcggcgccgcacagagtgaggcgctggcccgccaggtccccgacaacggcggcatgtatttcgtgccggcgttttccgggctgttcgcgccatactggcggtccgatgcgcgcggcgcgatcgtcgggttgtcgcggttcaacaccaacgcgcacctggcgcgcgcaacgctggaggcgatctgctaccagagccgcgatgtggtggacgccatggaagcagactccggtgttcgcctgcaggtgttgaaggtggatggcgggatcaccggcaacgacctgtgtatgcagatccaggccgacgtgttgggtgtggatgtggtgcggccggtggtcgccgagaccaccgcactaggtgtggcctacgcggcgggcttggcggtcgggttctgggcggctccgtccgatctgcgggccaactggcgagaggacaagcggtggacaccgacgtgggacgacgacgagcgtgccgcgggttatgccggctggcgcaaggcggtgcagcggaccctggattgggttgacgtgtcctag

SEQ ID NO: 69745 - protein, 517 aa, Mycobacterium tuberculosis
MSDAILGEQLAESSDFIAAIDQGTTSTRCMIFDHHGAEVARHQLEHEQILPRAGWVEHNPVEIWERTASVLISVLNATNLSPKDIAALGITNQRETTLVWNRHTGRPYYNAIVWQDTRTDRIASALDRDGRGNLIRRKAGLPPATYFSGGKLQWILENVDGVRAAAENGDALFGTPDTWVLWNLTGGPRGGVHVTDVTNASRTMLMDLETLDWDDELLSLFSIPRAMLPEIASSAPSEPYGVTLATGPVGGEVPITGVLGDQHAAMVGQVCLAPGEAKNTYGTGNFLLLNTGETIVRSNNGLLTTVCYQFGNAKPVYALEGSIAVTGSAVQWLRDQLGIISGAAQSEALARQVPDNGGMYFVPAFSGLFAPYWRSDARGAIVGLSRFNTNAHLARATLEAICYQSRDVVDAMEADSGVRLQVLKVDGGITGNDLCMQIQADVLGVDVVRPVVAETTALGVAYAAGLAVGFWAAPSDLRANWREDKRWTPTWDDDERAAGYAGWRKAVQRTLDWVDVS

SEQ ID NO: 69746 - DNA, 1503 bp, Oceanobacillus iheyensis
  CDS (1)..(1503)
atgtcagaaaaatttattttgtccattgatcaaggaacaacaagctctcgagcaatactttttaatcataagggtgagatcgttgaatctgctcagaaggaatttgagcaattcttcccaaaaccaggttgggtggaacacgatgcaaatgaaatttggacgtctgtattagcttgtattgctgatgttttaagaaaagcagatatagaagctaaccaaattgaaggcattggaatcaccaatcaacgtgaaacaacggtagtttgggataaaaatacgggtagaccaatttataaggccattgtttggcaatctcgtcaaacggaaggcatttgtaaggaactaaaagaacaaggacatgaagatacgattcgtcataagacaggtttactaatcgatccttatttctctggtacaaaagtaaaatggattttagataatgtagacggagcaagagaaaaagcagaagctggagaattatcatttggaacgatagatagttggttaatttatcgattatctggtggtaaaacacatgtaacagattattccaatgcttctcgtacattaatgtttaatatttatgatcttaaatgggatgatgagttattagaaatattggatgtaccgaaaagtatgcttcctgaagtaaaaccttcttctgaagtatacgcaaatactgtttcttatcatttctttggtgaagaagtacctattgcaggtgttgctggagaccaacaagctgctttatttggtcaagcttgtttcgatcagggaatggctaaaaacacgtatggtactggttgtttcttactaatgaatacaggtgaagaaccagtacgctctaagcatggtctactcactacgattgcttggggagtagatggtaaagttgagtatgcacttgaaggtagtattttcgttgctggatctgctattcagtggcttagagatggattaagacttattgaatcaagtccacaaagtgaagcattagcatcgcaagtcgagacaacagatggcgtgtatttggtgccagcatttgttggtcttggaacaccttactgggatagtgatgctcgaggagctgtatttggcttaactcgtggtacaacgaaggaacactttgttcgtgcaacattagaatctttagcatatcaaacaaaagatgttatggatgcaatgttagcggattctgacattgatttgaagaaattacgtgttgatggtggtgcagtaaaaaataatttactgatgcagttccaaagtgatattctgggagtaaccgttgaacgacctgtcgttcaagaaacaactgcactaggatcggcttatttagctggtttagctgtagggttctggaaagataaagaggaaattgcaaaacaatggttaaatgagaaaacatttgagaatgaaatgagtgaagaggaaagttcatacctctataaaggttggcaaaaagctgttgaagcaactcgttcatttaaatttgaatcataa

SEQ ID NO: 69747 - protein, 500 aa, Oceanobacillus iheyensis
MSEKFILSIDQGTTSSRAILFNHKGEIVESAQKEFEQFFPKPGWVEHDANEIWTSVLACIADVLRKADIEANQIEGIGITNQRETTVVWDKNTGRPIYKAIVWQSRQTEGICKELKEQGHEDTIRHKTGLLIDPYFSGTKVKWILDNVDGAREKAEAGELSFGTIDSWLIYRLSGGKTHVTDYSNASRTLMFNIYDLKWDDELLEILDVPKSMLPEVKPSSEVYANTVSYHFFGEEVPIAGVAGDQQAALFGQACFDQGMAKNTYGTGCFLLMNTGEEPVRSKHGLLTTIAWGVDGKVEYALEGSIFVAGSAIQWLRDGLRLIESSPQSEALASQVETTDGVYLVPAFVGLGTPYWDSDARGAVFGLTRGTTKEHFVRATLESLAYQTKDVMDAMLADSDIDLKKLRVDGGAVKNNLLMQFQSDILGVTVERPVVQETTALGSAYLAGLAVGFWKDKEEIAKQWLNEKTFENEMSEEESSYLYKGWQKAVEATRSFKFES

SEQ ID NO: 69748 - DNA, 1509 bp, Pasteurella multocida
  CDS (1)..(1509): transl_table=11
atgacggataaaaaatatatcattgccctagatcaaggtacaacaagttcaagagcggttcttcttgatcacgatgccaatattgttgaaattgcccaacgtgaatttacgcaaatttatccacaggctggctgggttgaacataatcccatggagatttgggcaacacaaagttccaccttaaatgaagtggtcgcgaaagccggtatcactgctgatcaaatcgcggcaattgggatcactaatcagcgtgaaaccacgattgtatgggaaaaagaaaccggtaagccaatttacaatgcgattgtgtggcaatgccggcgtacgactgagataaccgataaactgaaagcagatggtcacgaagactatatacgtcaaacgacaggcttagtggtagatccttacttctctggaaccaaaattaaatggattttggataacgtggaaggggcacgggaacaagcagaacgtggcgaattactctttggtacggtggatacttggctagtatggaaattaactcaagggcgtgcacatgtcaccgattacactaacgcctcgcggacgatgttatttaatattcatactctgcaatgggacgataacatgctggcgattttaggtatcccacgtgctatgttgcctgaggtgcgtaattcttctgaaatatatggtcaaaccaatatcggtggcaaaggtggcgtacgtattcctgtagccggtatggcaggagatcaacaagcggccttatatggtcatctttgtgttaatgcgggacaagcgaaaaacacttatggtaccggttgtttcatgttaatgcatacgggcgacaacgccgtacaatcacaaaatggcttattaaccaccattgcctgtaatgccaaaggtgagcctgcatatgctctcgaaggctccatcttcatgggcggggcatccattcaatggctacgcgatgaactcaaaattgtgcatgatagctatgactcagaatattttgctacccgagtacctgattgtaatggtgtctatgtggtacctgcctttactggattaggtgccccttattgggatccctatgcacgcggtgccatttttgggctctcacgtggtgcaaatcgcaaccacattgtgcgcgctaccttagaatccattgcataccaaactcgcgatgtgctagaggcgatgcaatctgactcaggacaaacactgcaagcgctccgcgtggacggtggagcaacggaaaataatttcttaatgcagttccaagcggatatcctcgccaccaaagtagaaagaccaaaagtgaaagaagtcacggcattaggcgccgcctatcttgcaggtcttgcgacgggtttctggaaagatctcagtgaattgcgtgataaagccagcatcgagaaaacttttgttcccgatggagatgaagccaaacgcactcgccgttataaaggctggaaaaaagcagtcaaacgtgcgctcgaatgggaaaaagaggaagagtag

SEQ ID NO: 69749 - protein, 502 aa, Pasteurella multocida
MTDKKYIIALDQGTTSSRAVLLDHDANIVEIAQREFTQIYPQAGWVEHNPMEIWATQSSTLNEVVAKAGITADQIAAIGITNQRETTIVWEKETGKPIYNAIVWQCRRTTEITDKLKADGHEDYIRQTTGLVVDPYFSGTKIKWILDNVEGAREQAERGELLFGTVDTWLVWKLTQGRAHVTDYTNASRTMLFNIHTLQWDDNMLAILGIPRAMLPEVRNSSEIYGQTNIGGKGGVRIPVAGMAGDQQAALYGHLCVNAGQAKNTYGTGCFMLMHTGDNAVQSQNGLLTTIACNAKGEPAYALEGSIFMGGASIQWLRDELKIVHDSYDSEYFATRVPDCNGVYVVPAFTGLGAPYWDPYARGAIFGLSRGANRNHIVRATLESIAYQTRDVLEAMQSDSGQTLQALRVDGGATENNFLMQFQADILATKVERPKVKEVTALGAAYLAGLATGFWKDLSELRDKASIEKTFVPDGDEAKRTRRYKGWKKAVKRALEWEKEEE

SEQ ID NO: 69750 - DNA, 1506 bp, Pseudomonas syringae
  CDS (1)..(1506): transl_table=11
atgactgacacacagaacaagaactacatcattgctcttgaccagggcaccaccagctcgcgcgccatcatcttcgaccgcgacgccaatgtggtgagcacggcccaaagcgaattcgtgcagcattatccgcaggcaggctgggtcgagcatgacccgatggaaatcttcgccacgcagacagcgtgcatgaccaaggcgctggcgcaggctgatctgcaccacgatcagatcgccgccatcggtatcaccaaccagcgtgaaaccaccgtcatctgggaacgcgacaccggccgccctatctacaatgcgatcgtctggcagtgccgccgcagcaccgaaatctgtcagcagctcaagcgtgacggccttgaggagtacatcaaggacaccacaggcctggtgcttgatccgtacttctccggctccaaggtcaagtggattctggaccacgtcgaaggcagccgcgagcgcgcgcgtaaaggcgagctgatgttcggcaccatcgatacctggctgatctggaaattcactggcggcaaggttcacgtcaccgactacaccaacgcctcgcggaccatgctgttcaacatccacacgctggaatgggatcagcgcatgcttgatgtgctggacatcccgcgcgagatcctgcctgaggtcaaaagctcttccgaggtctacggtcacagcaagagcggcatcccgattgccggtattgcaggcgaccagcaggcagcgctattcggccagatgtgcgtcgaacccggccaggccaaaaacacctacggcaccggctgcttcctgctgatgaacaccggcaaaaaagccgtgaagtctgcgcatggcatgctgaccacgattggctgcggcccacgcggcgaagtggcttacgcactcgaaggcgccgtattcaacggcggttcgaccgtgcagtggctgcgtgacgaactgaagctgatcaacgacgcgctggacaccgagtacttcgccggcaaggtcaaggacagcaacggcgtgtacctggtgcctgccttcaccggtctcggcgcgccctactgggacccgtatgcccgcggcgcactgttcggcctgacccgtggcgtgaaggttgatcacatcatccgcgcggcgctggaatccatcgcctatcagacccgtgacgtgctcgacgcgatgcagcaggactcgggcgagcgcctcaagtcgctgcgcgtggatggcggcgcggtcgccaacaacttcctgatgcagttccaggcagacattctcggcactcatgtcgagcgcccgcaaatgcgtgaaacaacggcactgggcgcagcgttcctggcaggtctggcgattggtttctggagcagcctggacgagttgcgcaacaaggctgtgatcgagcgcgtgttcgagcctgcttgcgaagaggcgcatcgcgagaagctgtacgcaggctggcaaaaagccgtcgcgcgcacccgtgactgggaaccgcacgaaaacgaagagtga

SEQ ID NO: 69751 - protein, 501 aa, Pseudomonas syringae
MTDTQNKNYIIALDQGTTSSRAIIFDRDANVVSTAQSEFVQHYPQAGWVEHDPMEIFATQTACMTKALAQADLHHDQIAAIGITNQRETTVIWERDTGRPIYNAIVWQCRRSTEICQQLKRDGLEEYIKDTTGLVLDPYFSGSKVKWILDHVEGSRERARKGELMFGTIDTWLIWKFTGGKVHVTDYTNASRTMLFNIHTLEWDQRMLDVLDIPREILPEVKSSSEVYGHSKSGIPIAGIAGDQQAALFGQMCVEPGQAKNTYGTGCFLLMNTGKKAVKSAHGMLTTIGCGPRGEVAYALEGAVFNGGSTVQWLRDELKLINDALDTEYFAGKVKDSNGVYLVPAFTGLGAPYWDPYARGALFGLTRGVKVDHIIRAALESIAYQTRDVLDAMQQDSGERLKSLRVDGGAVANNFLMQFQADILGTHVERPQMRETTALGAAFLAGLAIGFWSSLDELRNKAVIERVFEPACEEAHREKLYAGWQKAVARTRDWEPHENEE

SEQ ID NO: 69752 - DNA, 1512 bp, Pseudomonas tolaasii
  CDS (1)..(1512): transl_table=11
atgaccgacattcagaataagaactacatcattgcccttgaccagggcaccaccagttcgcgggcgatcatctttgatcgggacgccaacgtggtctgcaccgcccagcgtgaattcactcagcactacccgcaagccggttgggtcgagcatgacccgatggaaattttcgccacccagagcgcggtgatggtcgaagcgctggcccaggccggcctgcaccatgatcaggtcgccgccatcggcatcaccaaccagcgtgaaaccacggtggtgtgggacaaggtcaccggccgcccgatctataacgccattgtctggcagtgccgccgcagcaccgagatccagatctgccagcagctcaagcgcgacggccacgaacagtacatcaatgacaccaccggcctggtcaccgacccgtacttctccggcaccaagctcaagtggatcctcgacaacgtcgaaggcagccgcgagcgtgcgcgcaacggcgagctgctgttcggcaccatcgacagctggctgatctggaaatttactggcggcaaaacccacgtcaccgactacaccaacgcctcgcgcaccatgctcttcaacatccacaccctggagtgggatgcgaagatgctggagatcctcgacgtgccgcgcgaaatgctgccggaagtgaagtcatcgtcggaaatctacggccgtaccaaagtggcatcgccatcggcggccattgcgggcgaccagcaagccgcgctcttcggccagatgtgtgtaagaggcggccaggccaagaacacctacggcaccggctgcttcctgttgatgaacaccggcgacaaggcggtgaaatccaagcacggcatgctcaccaccatcgcctgcggcccgcgtggcgaagtggcctacgccctggaaggcgccgtgttcaacggcggttctactgtgcagtggctgcgtgacgagctgaagatcatcgccgacgccaccgacaccgaatacttcgccggcaaggtcaaggacagcaatggcgtatacctggtgccggccttcaccggcctgggcgcgccgtactgggacccgtatgcccgtggcgcgctgttcggcctgacccgcggcgtacgcgtggaccacattattcgtgcagccctggagtcgatcgcctaccagacccgcgacgtactggacgccatgcaacaggactccggcgagcgcctcaaggccctgcgcgtggacggcggcgcggtggcgaacaacttcctgatgcagttccaggccgacatcctcggcacccaggtcgagcgcccgcaaatgcgcgagaccaccgcactcggcgcggcctacctggcaggcctggcgtgcggcttctggggcagcctggaagagttgcgcggcaaggcggtaattgagcgcgaattcgaaccgcagctggacgaagcggccaaggaaaagctctacgccggctggcaaaaagcggtcagccgcacccgcgactgggagccccacgaaggcgccgaataa

SEQ ID NO: 69753 - protein, 503 aa, Pseudomonas tolaasii
MTDIQNKNYIIALDQGTTSSRAIIFDRDANVVCTAQREFTQHYPQAGWVEHDPMEIFATQSAVMVEALAQAGLHHDQVAAIGITNQRETTVVWDKVTGRPIYNAIVWQCRRSTEIQICQQLKRDGHEQYINDTTGLVTDPYFSGTKLKWILDNVEGSRERARNGELLFGTIDSWLIWKFTGGKTHVTDYTNASRTMLFNIHTLEWDAKMLEILDVPREMLPEVKSSSEIYGRTKVASPSAAIAGDQQAALFGQMCVRGGQAKNTYGTGCFLLMNTGDKAVKSKHGMLTTIACGPRGEVAYALEGAVFNGGSTVQWLRDELKIIADATDTEYFAGKVKDSNGVYLVPAFTGLGAPYWDPYARGALFGLTRGVRVDHIIRAALESIAYQTRDVLDAMQQDSGERLKALRVDGGAVANNFLMQFQADILGTQVERPQMRETTALGAAYLAGLACGFWGSLEELRGKAVIEREFEPQLDEAAKEKLYAGWQKAVSRTRDWEPHEGAE

SEQ ID NO: 69754 - DNA, 1485 bp, Pyrococcus abyssi
  CDS (1)..(1485): transl_table=11
gtgagccccgtggaggggtacattttatcgcttgacgaaggtaccacatcggcgagggcgatagtgttcgacagggaggggaacataaagggcatcggtcaatacgagtttccacagtactatccaaagcctggctgggtggagcataacccgatggaaatctgggatgcccaggtgagggcaataaaaactgcaattcaaaaggctaaggttgaaccggcccaaataaaggcgattggaataacgaaccagagggaaactacaatagtttgggataaaaacggcaatcccctttacaatgccatagtttggcagtgtagaaggacggctgaaatggtagaggagataaagagggagtatggagacttaatcaaggagaaaactggattaattccagacgcttacttctctgcaagtaagataagatggctcctggacaatgttcctaggctgagggaaaaagcagagaggggcgaggtcttatttggaaccgttgacagcttcctgatttacaaattgactggagaacacgtcaccgactactcaaatgcatctaggactatgctattcaacataaagaagcttgattgggatgaagagctactcgaaatcttcaagattcccgagggtatattgcctgaggttagggagtccagcgaaatatacggttacactaggattcttgggaatgaaattcctgtgagcggagatgctggagatcagcaagccgcactctttggccaagctggctttgaaactggaatggtgaaggccacgtatggaaccgggaacttcatacttgttaacactggaaagaccgttcgttactctgagaatttgctaactacgatagcttggggcttggatggaaaggtaacctacgccctcgagggaagcatattcatcaccggggcggccgttcagtggctacgcgatgggataaagataattaagcatgcttccgaaactgaggacctcgcagaaaagctggagagcaatgaaggtgtttacttcgttccagcgttcgttggtctaggggctccctactgggatcagtttgccagagggttaataataggtataacgaggggaaccggtagagaacacttagcgagggcaactttagaggccatagcttacctcactagggacgttatagaggagatggagaagttggtcggcataaaggagctccgtgtcgatggaggggcgacagcaaatgacttcttgatgcagttccaagctgatatcctcaataggcgcgttgttaggccagtggttaaggagacaacggctcttggagcggcttaccttgctgggctggcggtagattactgggagagtctagaggaaatagaaagcctctggagggtcgaaaaaatttttgagccaagaatggatgaagaaacgagggaaaagctttaccgtggatggaaggaagctgtgaagagggccatggggtgggcaaaggtcatttcttcataa

SEQ ID NO: 69755 - protein, 494 aa, Pyrococcus abyssi
MSPVEGYILSLDEGTTSARAIVFDREGNIKGIGQYEFPQYYPKPGWVEHNPMEIWDAQVRAIKTAIQKAKVEPAQIKAIGITNQRETTIVWDKNGNPLYNAIVWQCRRTAEMVEEIKREYGDLIKEKTGLIPDAYFSASKIRWLLDNVPRLREKAERGEVLFGTVDSFLIYKLTGEHVTDYSNASRTMLFNIKKLDWDEELLEIFKIPEGILPEVRESSEIYGYTRILGNEIPVSGDAGDQQAALFGQAGFETGMVKATYGTGNFILVNTGKTVRYSENLLTTIAWGLDGKVTYALEGSIFITGAAVQWLRDGIKIIKHASETEDLAEKLESNEGVYFVPAFVGLGAPYWDQFARGLIIGITRGTGREHLARATLEAIAYLTRDVIEEMEKLVGIKELRVDGGATANDFLMQFQADILNRRVVRPVVKETTALGAAYLAGLAVDYWESLEEIESLWRVEKIFEPRMDEETREKLYRGWKEAVKRAMGWAKVISS

SEQ ID NO: 69756 - DNA, 1473 bp, Pyrococcus furiosus
  CDS (1)..(1473): transl_table=11
atggaccgctatatcctctctttagatgagggcacaacttccgccagggcaataatatttgataagaacagcaatgttctaggaattgggcagtatgaattccctcaatactatcccaagccagggtgggtagagcataatccagaggaaatttgggaggctcaagtgaaagcaataaagactgcgatagagaaagccaagatagaggcaaatcaaatagctgctattggagtcacaaaccagcgtgaaactacagttatttggaaaaaagatgggaaacccgtttacaatgccattgtgtggcagtgcagaagaactgctgaaatggttgaggaaattaagagagaatatagtgatgtcattaaagaaaagacaggtcttgttccagatgcctacttttcagcctcaaagatagcatggctcttggacaatgtccctgggcttagagaaaaagcggaaaaaggagaggttatgttcggtacaattgacacctttctaatttacaggcttacgggagagcacgtaacggactattcaaatgcctccagaacaatgttgttcaacattaataagctggagtgggatgaagagcttttagagatctttaagattcccgatggaattttacctgatgtaaaagaatctagtgaaatctatggctatacaaaaattcttggcccagaaattccagttagtggggatgctggagatcaacaggctgctctctttggccaagcagcatttgaagagggaatggtaaaggccacttacgggactggaaacttcatattggcgaatacaggaagaatgcttctttattcagataacctcctcacaacggttgcatgggggattaatgggaaggtaaattatgccctggaaggcagtatcttcatcacgggagcagctgttcagtggttgagagacgggattaagataatcagcaatgccgctgagactgaagaattagctactaagttagagagcaacgagggagtctacttcgttccagcatttgtaggattgggagctccctactgggatcagttcgctagggggttgataattggaataacaaggggaactgggagagaacatcttgcaagggcaaccttagaggccatagcttacctcacaagggatgtaattgaagagatggaaaagctgatacagataaaggagcttcgcgtggatggtggagccactgttaacaacttcctcatgcagttccaggctgatatcctcaataagaaagttattagacctgtagttaaagagaccactgcccttggagctgcctacttagctggtttggccgtagactattgggaaagcatggaggagatatcacaactctggagagctgagagagtatttgaacctcagatggatgaaaaaactagagaaaaactatataggggatggaaagaggccgttaagagagctttaggttgggccaaagttgtgagttga

SEQ ID NO: 69757 - protein, 490 aa, Pyrococcus furiosus
MDRYILSLDEGTTSARAIIFDKNSNVLGIGQYEFPQYYPKPGWVEHNPEEIWEAQVKAIKTAIEKAKIEANQIAAIGVTNQRETTVIWKKDGKPVYNAIVWQCRRTAEMVEEIKREYSDVIKEKTGLVPDAYFSASKIAWLLDNVPGLREKAEKGEVMFGTIDTFLIYRLTGEHVTDYSNASRTMLFNINKLEWDEELLEIFKIPDGILPDVKESSEIYGYTKILGPEIPVSGDAGDQQAALFGQAAFEEGMVKATYGTGNFILANTGRMLLYSDNLLTTVAWGINGKVNYALEGSIFITGAAVQWLRDGIKIISNAAETEELATKLESNEGVYFVPAFVGLGAPYWDQFARGLIIGITRGTGREHLARATLEAIAYLTRDVIEEMEKLIQIKELRVDGGATVNNFLMQFQADILNKKVIRPVVKETTALGAAYLAGLAVDYWESMEEISQLWRAERVFEPQMDEKTREKLYRGWKEAVKRALGWAKVVS

SEQ ID NO: 69758 - DNA, 1494 bp, Pyrococcus kodakaraensis
  CDS (1)..(1494): transl_table=11
atggaaaagttcgttctttctcttgacgagggtacaacttccgccagggcgataatcttcgacagggagagcgacatccacggaataggccagtatgagttcccccagcactatccaaggccgggatgggtcgagcacaatcccgaggagatatgggacgcccagctcagggcgataaaagatgccatccagagcgctagaatagagccgaatcagatagcggcgataggagttaccaaccagcgcgagacgacgcttgtatgggacaaagatggtaagccgctctacaacgcaatagtctggcagtgcagaagaacggctgaaatggttgaggagataaagcgtgagtacgggacgatgataaaggagaagaccggcctcgtccccgatgcctacttttctgcctcgaagctcaagtggctccttgacaacgttccaggtttaagggagaaggccgagaaaggcgaggtgatgttcggaacggtcgataccttcctcatctaccgccttacaggagagcacgttacggactattccaatgcctcaaggacgatgctcttcaacattaagaagctcgactgggacgatgagctccttgagctcttcgacattcctgagagcgttttacctgaggtcagggagtctagtgaagtttacggctacacaaagaaggagcttctcggggctgagattcccgtaagcggcgatgcaggtgaccagcaggcggccctcttcggacaggcggcgttcgaggcgggaatggtgaaggccacctatggtacggggagctttatcctcgtgaacacggacaagatggtgctctattcggacaacctgctcacgacgatagcatggggcctaaatggaagggtcagctacgccctcgaggggagcattttcgtaactggagcggcagtccagtggctcagagacggaataaaaatcataaagcatgcctctgagacagaggaactcgccacaaagcttgagagcaacgaaggcgtttatttcgttcccgccttcgttggtctaggggctccctactgggatcagtttgccaggggcattataatcggcataacgcgcggcacgggcagggagcatctcgcgagggcgacgcttgaggcgatagcataccttaccagggatgttgttgacgagatggaaaagctcgtccagatcaaggagctccgcgtcgatggtggcgccaccgcaaacgactttctcatgcagttccaggcggacatcttgaacagaaaggtgataaggcccgtcgtgaaggagacaacggctcttggcgccgcttacctcgcggggcttgccgttgattattgggcggacacgagagaaatagccgagctgtggaaggctgaaagaattttcgagccgaagatggatgagaaaactagggagagactctacaaaggctggaaagaagcagtaaagagggctatggggtgggcaaaggtcgttgatagtgcaaaatcaaattga

SEQ ID NO: 69759 - protein, 497 aa, Pyrococcus kodakaraensis
MEKFVLSLDEGTTSARAIIFDRESDIHGIGQYEFPQHYPRPGWVEHNPEEIWDAQLRAIKDAIQSARIEPNQIAAIGVTNQRETTLVWDKDGKPLYNAIVWQCRRTAEMVEEIKREYGTMIKEKTGLVPDAYFSASKLKWLLDNVPGLREKAEKGEVMFGTVDTFLIYRLTGEHVTDYSNASRTMLFNIKKLDWDDELLELFDIPESVLPEVRESSEVYGYTKKELLGAEIPVSGDAGDQQAALFGQAAFEAGMVKATYGTGSFILVNTDKMVLYSDNLLTTIAWGLNGRVSYALEGSIFVTGAAVQWLRDGIKIIKHASETEELATKLESNEGVYFVPAFVGLGAPYWDQFARGIIIGITRGTGREHLARATLEAIAYLTRDVVDEMEKLVQIKELRVDGGATANDFLMQFQADILNRKVIRPVVKETTALGAAYLAGLAVDYWADTREIAELWKAERIFEPKMDEKTRERLYKGWKEAVKRAMGWAKVVDSAKSN

SEQ ID NO: 69760 - DNA, 1494 bp, Rhizobium meliloti
  CDS (1)..(1494): transl_table=11
atgggcggatatattctcgcgatcgatcagggcacgacgtccacgcgcgcgatcgttttcgacggcaaccagaaaatcgcgggcgtcgggcagaaagagttcaagcagcactttccgaagtcaggctgggtggagcacgatccggaggagatctggcagacggtcgtcagcacggtcaaggaagcgatcgagaagtccggcatcaccgcgaacgatattgccgcgatcggcatcaccaaccagcgggagacggttgtcgtctgggatcgcgagaccggcaagccgatccacaatgccatcgtctggcaggaccgccgcactgccgccttctgcgacaagctcaagaagaagggactggaaaagaccttcgtgaagaagaccggtctgctgctcgatccctatttttcgggaacgaagctcaactggctgctttccaatgtgaagggcgcgcaggtgcgcgcagccaaaggcgaactctgcttcggcactatcgacaccttcctgatctggcggttgacgggcggcgagtgcttctgcaccgacgcgacgaatgcctcgcgtaccctcttatacaatatcgccgagaatgcctgggacgacgagctcaccgaggtcctgcgcgtgccgaaggagatgctgccggaagtgaaggactgcgcggccgacttcggcgtcacggatccgtctctcttcggcgcggcgatcccgatcctcggcgttgccggcgaccagcaggcggcaacgatcggtcaggcctgtttcaagccgggcatgctgaaatcgacctacggtacgggctgcttcgccttgctcaacaccggcaaggacatggtccgctcgaagaaccgccttctgaccaccatcgcctaccgcctcgacggtgaaacgacctatgcgctcgaaggctcgatcttcgtagccggtgctgccgtgcaatggctgcgcgacgggctcaaggtgatcaaggcggcgcccgatacgggctcgcttgccgagagcgccgatccctcgcaggaggtctatctggtgccggccttcaccggcctcggagcgccccattgggatccggatgcgcggggcgcgatcttcggcatgacgcgcaataccggcccggcagagttcgcacgggcggcactcgaggccgtctgctaccagacccgcgacctgctcgaggccatgcacaaggattggcgccgcaacggcaatgatacggtcctgcgcgtcgatggcggcatggtcgcctccgactggacgatgcagcgcctgtcggacctgctcgacgctccggtcgaccgcccggtcattctcgaaaccaccgcgctcggcgtcgcctggcttgcaggcagccgcgccggcgtctggccaaaccaggaggcgttcgccaagtcctgggcccgcgaccgccgcttcgagccgcatatggacgaggccacgcgcaaggtgaagctcaagggctggcgcagcgcagtcaagcggacgttgattgctgcctga

SEQ ID NO: 69761 - protein, 497 aa, Rhizobium meliloti
MGGYILAIDQGTTSTRAIVFDGNQKIAGVGQKEFKQHFPKSGWVEHDPEEIWQTVVSTVKEAIEKSGITANDIAAIGITNQRETVVVWDRETGKPIHNAIVWQDRRTAAFCDKLKKKGLEKTFVKKTGLLLDPYFSGTKLNWLLSNVKGAQVRAAKGELCFGTIDTFLIWRLTGGECFCTDATNASRTLLYNIAENAWDDELTEVLRVPKEMLPEVKDCAADFGVTDPSLFGAAIPILGVAGDQQAATIGQACFKPGMLKSTYGTGCFALLNTGKDMVRSKNRLLTTIAYRLDGETTYALEGSIFVAGAAVQWLRDGLKVIKAAPDTGSLAESADPSQEVYLVPAFTGLGAPHWDPDARGAIFGMTRNTGPAEFARAALEAVCYQTRDLLEAMHKDWRRNGNDTVLRVDGGMVASDWTMQRLSDLLDAPVDRPVILETTALGVAWLAGSRAGVWPNQEAFAKSWARDRRFEPHMDEATRKVKLKGWRSAVKRTLIAA

SEQ ID NO: 69762 - DNA, 1620 bp, Rhodopirellula baltica
  CDS (1)..(1620): transl_table=11
ttgcatacatggcggtttcggcgaccttttcgagaacctgctatcaaccgcactgatagaatgagggaccacttcagcattgatcacaaacgaacacccaggcggagactttcggtgaaggcaattttggcacttgatcaaggaacaacgagttctcgcgcaatccttttcgctcacgatggatcaatcatcggcgtgtcgcaaaaggaattcacacaacactatccaaaaccaggttgggtggaacacgacgcgaccgaaatttggacgactcagttggcggtcgcgcgcgatgttttgaagcagcacgacatggacgtgtcggacattgaagccatcggcatcaccaatcaacgtgagaccactttggtctgggatcgagcgactggtgagccgattcacaacgcaatcgtctggcaagaccgccggacggcatcggattgtgatgctcttcggaacgctggccattctgattgcgtgcaaaagaagaccggactgatcatcgacgcctatttttgtgcgacgaagctgcgatggattctggacaatgttgcaggagctagagagcgagcggaaaacggcgagttggcatttgggacaatcgacagctggctgttttggaatctcaccggcggcaaacttcatgcgaccgacgtgaccaatgcgtctcgcacgatgctatggaacattcataccgggcagtgggacgacgaattgctggcactttttaaggttccaaaagaagttcttccatcggttcatccatccagtcacatctacggcgagaccgaatcgagcttgttcggaaaatcaattccgttgggcggagccgctggcgaccaacaatcggctttgttcggccagaattgcacgcagcctggtatggccaagaacacttacggaaccggttgcttcatgctgatgaacatcggcgaagaagccgccgcgtcgccttcgcggttgctgaccacggtcgcgtgttgggacggcggcaaacgcgaatacgcgtatgaaggtagcatcttcattgccggagcgattgtgcagtggttgcgagacggtttggggatcatccagtcgtcctcggaagtcgaatcgctcgccgccagcgtcgatgacaccgacggcgtttacctcgtcccggcgttcgcggggttgggtgcaccgcactgggacgcgtacgctcgcgggatactcgtggggctgactcgcggtacgacgaaagcccacatcgcacgggctgctctagaaggcatcgcattccaagtggcggacgtgttggacgcgatgcgaaaagattccggtgtggcgattgaagaactacgcgttgacggcggagcggccgccaatgatctgctgatgcagttccaagccgacatcatcggcgctcgcgtcgtccggccaaaagtcatcgagacgaccgcggcgggtgcggcttacgtcgctgggctggcaacgggattttggaaagacagcgcggacatcgaacgaatttgggaaaccgaccgcgtcttcgaacctcaaatgcccgccgaagaagttgctcgacgcaggcgacgctgggcggcggcgttggaacgatccaagcaatgggtggaacaggaagcttccgctgattga

SEQ ID NO: 69763 - protein, 539 aa, Rhodopirellula baltica
MHTWRFRRPFREPAINRTDRMRDHFSIDHKRTPRRRLSVKAILALDQGTTSSRAILFAHDGSIIGVSQKEFTQHYPKPGWVEHDATEIWTTQLAVARDVLKQHDMDVSDIEAIGITNQRETTLVWDRATGEPIHNAIVWQDRRTASDCDALRNAGHSDCVQKKTGLIIDAYFCATKLRWILDNVAGARERAENGELAFGTIDSWLFWNLTGGKLHATDVTNASRTMLWNIHTGQWDDELLALFKVPKEVLPSVHPSSHIYGETESSLFGKSIPLGGAAGDQQSALFGQNCTQPGMAKNTYGTGCFMLMNIGEEAAASPSRLLTTVACWDGGKREYAYEGSIFIAGAIVQWLRDGLGIIQSSSEVESLAASVDDTDGVYLVPAFAGLGAPHWDAYARGILVGLTRGTTKAHIARAALEGIAFQVADVLDAMRKDSGVAIEELRVDGGAAANDLLMQFQADIIGARVVRPKVIETTAAGAAYVAGLATGFWKDSADIERIWETDRVFEPQMPAEEVARRRRRWAAALERSKQWVEQEASAD

SEQ ID NO: 69764 - DNA, 1485 bp, Shewanella oneidensis
  CDS (1)..(1485): transl_table=11
gtgcaaaagaaatatgtggtggccctagatcaaggtacaaccagctcaagggcgattgtgtttgaccacgatgccaatattgtcagcgtctcccagcgggagtttactcagctttatcccaatcctggctgggttgaacacgatccaatggagatttgggcgagccaaagttcagtgctgattgagtcgctggcccgagcggggattcacagtgatgcagtggcggcgattggcattactaatcagcgggaaaccaccattatttgggaaaaggcgaccggcaaacccgtttacaatgccattgtgtggcagtgtcgccgtagcgctgagatctgtgagcaacttaaggcgcagggcttagaggattatgtgcggcagaataccggccttttactcgacccttatttttcaggcactaagatcaaatggatcttagataatgtgccggatgcacgtgctaaggccaaacgaggtgaactgttattcggcacggtcgacacttggctactgtggaaactcacggaaggcaaagtgcatgtgaccgatcccaccaatgccgctcgcacgttgctgtttaacatccatagcttgagttgggatagcaagctacttgaggcgctcgatattcctgccgccatgttgcctgaagtaaaaccttcctgcagtgtttatggcaccacacgcatcgctggtgagggcagtgaaattccactggcggggattgcgggcgatcaacaggcggcgctctttggccaactctgtgttgagcagggaatggccaaaaacacctatggtacgggctgctttctgctgatgaacactggaagcaaagctgtgcgctcatcccatggtttattaacgacggtggcggttggcgctcaaggcgaagtgaattatgccctcgaaggctctgtctttatgggcggcgcaactattcaatggttacgggacgagttggggcttattcgcgatgccagtgataccgaatattttgcctccaaagtggcggataccaatggcgtgtatttagtccccgcttttgtagggctcggcgcgccctattgggaccccaatgcccgtggcgcattgtttggcctaacccgtggcgccaaccgtaatcatattatccgcgctgcgttggaatcgatagcttatcaaagtaaagacttgttagatgccatgatcaaagacagtggcgtcagccttaagcgtttgaaagtggatggtggcgcagtggcgaatgattttttgatgcaatttcaagcagatattaccgatgttgaagtattaaggcccagtgtatgcgagaccacagcacttggcgctgcctttttagccgggctggccgttggattttggaactcggtaactgagcttgaacataaagcttgtatcgatacgcactttaaaccaagcatcaatgctgattatcggcagcagctatacgctggttggcaagatgcagtagcaagaacccgttcttaa

SEQ ID NO: 69765 - protein, 494 aa, Shewanella oneidensis
MQKKYVVALDQGTTSSRAIVFDHDANIVSVSQREFTQLYPNPGWVEHDPMEIWASQSSVLIESLARAGIHSDAVAAIGITNQRETTIIWEKATGKPVYNAIVWQCRRSAEICEQLKAQGLEDYVRQNTGLLLDPYFSGTKIKWILDNVPDARAKAKRGELLFGTVDTWLLWKLTEGKVHVTDPTNAARTLLFNIHSLSWDSKLLEALDIPAAMLPEVKPSCSVYGTTRIAGEGSEIPLAGIAGDQQAALFGQLCVEQGMAKNTYGTGCFLLMNTGSKAVRSSHGLLTTVAVGAQGEVNYALEGSVFMGGATIQWLRDELGLIRDASDTEYFASKVADTNGVYLVPAFVGLGAPYWDPNARGALFGLTRGANRNHIIRAALESIAYQSKDLLDAMIKDSGVSLKRLKVDGGAVANDFLMQFQADITDVEVLRPSVCETTALGAAFLAGLAVGFWNSVTELEHKACIDTHFKPSINADYRQQLYAGWQDAVARTRS

SEQ ID NO: 69766 - DNA, 1497 bp, Staphylococcus aureus
  CDS (1)..(1497): transl_table=11
atggaaaaatatattttatctatagaccaaggaacaacaagctcaagagcgattttattcaatcaaaaaggggaaattgcaggggtagcacaacgtgagtttaagcaatattttccacaatcaggttgggttgaacatgatgcaaatgaaatttggacatctgtgttagctgtaatgacggaagtaattaatgaaaatgatgttagagctgatcaaattgcaggtatcggtattacaaaccaacgtgaaacaacggttgtttgggacaaacatactggccgcccaatttatcacgcaattgtttggcaatcacgtcaaacacaatcaatttgttcagaattaaaacaacaaggatatgaacaaacatttagagataagacaggattacttttagatccgtattttgcaggtacaaaagttaaatggattctagacaatgttgaaggtgcacgagaaaaagcagaaaatggcgatctattatttggaacgattgatacttggttagtatggaaattatcaggaaaagccgcgcatattactgattattcaaatgcgagtcgtacattaatgtttaatatccatgatttagaatgggacgatgagttattagaactacttacagtacctaaaaatatgttgccagaagttaaaccttcaagtgaagtatatggtaagacaattgattaccacttctatggtcaagaagtaccaattgctggtgtagctggtgatcaacaagcagcattatttggacaagcttgcttcgaacgtggtgacgtgaaaaacacatatggaactggtggcttcatgttaatgaatacaggtgacaaagcggttaaatctgaaagtggtttattaacaacaattgcttatggtattgatggaaaagtaaattatgcgcttgaaggttccatctttgtttcgggttcagcaatccaatggttacgtgatggattaagaatgattaattcagcaccacaatcagaaagttatgcgacacgagttgactctactgagggtgtttatgttgttccagcttttgtaggtttaggaacaccatattgggattctgaagcacgtggtgcgattttcggtttaacacgtggaactgaaaaagagcactttatccgtgcaacattagaatcattatgttaccaaactcgtgacgttatggaagcaatgtcaaaagactctggtatcgatgtccaaagtttacgtgtcgatggtggtgcagttaagaataactttattatgcagttccaagcagacattgttaatacttctgttgaaagacctgaaattcaagaaactacagctttaggtgctgcatatttagcaggtttagcagttggattctgggagagtaaagatgatatcgctaaaaactggaaattagaagaaaaattcgatccgaaaatggatgaaggcgaaagagaaaaattatatagaggttggaaaaaagctgttgaagcaacacaagtttttaaaacagaataa

SEQ ID NO: 69767 - protein, 498 aa, Staphylococcus aureus
MEKYILSIDQGTTSSRAILFNQKGEIAGVAQREFKQYFPQSGWVEHDANEIWTSVLAVMTEVINENDVRADQIAGIGITNQRETTVVWDKHTGRPIYHAIVWQSRQTQSICSELKQQGYEQTFRDKTGLLLDPYFAGTKVKWILDNVEGAREKAENGDLLFGTIDTWLVWKLSGKAAHITDYSNASRTLMFNIHDLEWDDELLELLTVPKNMLPEVKPSSEVYGKTIDYHFYGQEVPIAGVAGDQQAALFGQACFERGDVKNTYGTGGFMLMNTGDKAVKSESGLLTTIAYGIDGKVNYALEGSIFVSGSAIQWLRDGLRMINSAPQSESYATRVDSTEGVYVVPAFVGLGTPYWDSEARGAIFGLTRGTEKEHFIRATLESLCYQTRDVMEAMSKDSGIDVQSLRVDGGAVKNNFIMQFQADIVNTSVERPEIQETTALGAAYLAGLAVGFWESKDDIAKNWKLEEKFDPKMDEGEREKLYRGWKKAVEATQVFKTE

SEQ ID NO: 69768 - DNA, 1509 bp, Streptococcus pneumoniae
  CDS (1)..(1509): transl_table=11
atgtcacaagaaaaatacatcatggccattgaccagggaactacaagttctcgtgccatcattttcaacaaaaaaggggaaaaggttagctcgagtcaaaaagagtttacccagattttccctcaggcaggttgggttgagcacaatgccaatgaaatttggaactctgttcagtcagttattgcgggtgctttcatcgaaagtggtgtcaagccaaatcaaatcgaggcaatcgggattaccaaccaacgtgaaacaacggttgtctgggataagaaaacaggacttcctatctacaatgctatcgtttggcagtcacgccagacagcacctttggctgagcaactaaaaagccaaggttatgtggaaaaattccatgaaaagactggtttgattattgatgcttacttctctgctaccaaggttcgttggattttggatcatgtagaaggtgctcaagagcgagcagaaaaaggggaattgctctttggtactatcgatacttggttggtttggaaattgactgacggtgcggctcacgtgactgactactcaaatgcagctcgtaccatgctttataacattaaagaactcaaatgggatgatgagattttggaaatccttaacattccgaaggctatacttccagaagttcgttctaactccgaaatctacggcaagacagctccattccatttctacggtggagaggtgccaatctcaggtatggctggggaccaacaagcagccctctttggacagttggcttttgagccaggtatggttaagaatacttatggaacaggctctttcatcatcatgaatactggggaagagatgcagttgtctgaaaacaacctcttgacaaccattggttacggaatcaacggtaaggtttattatgccttggaaggttctatcttcatcgcaggaagtgctattcagtggcttcgtgacggtcttcgcatggttgaaaattcaccagaatctgaaaaatacgctcgtgattctcacaacaacgatgaagtttatgtcgttccagcctttacaggtctaggcgctccatactggaaccaaaatgctcgtggttccgtctttggtttgactcgtggaacaagcaaagaagactttatcaaggcgactttgcaatctattgcttatcaagtgcgtgatatcatcgacaccatgcaagtggatactcagaccgccattcaagtactgaaggtggatggtggtgcagccatgaacaacttcctcatgcagttccaggcggatattttaggcattgacattgcacgtgctaaaaacctggaaacaacagctctaggagcggccttcctagcaggtttgtcagtagggtactggaaagacttggacgagttgaaactcttgaacgagacaggagaactctttgagccatctatgaacgaatctcgcaaggaacaactctacaagggctggaagaaggctgtgaaagcaactcaagtctttgcggaagtagacgactaa

SEQ ID NO: 69769 - protein, 502 aa, Streptococcus pneumoniae
MSQEKYIMAIDQGTTSSRAIIFNKKGEKVSSSQKEFTQIFPQAGWVEHNANEIWNSVQSVIAGAFIESGVKPNQIEAIGITNQRETTVVWDKKTGLPIYNAIVWQSRQTAPLAEQLKSQGYVEKFHEKTGLIIDAYFSATKVRWILDHVEGAQERAEKGELLFGTIDTWLVWKLTDGAAHVTDYSNAARTMLYNIKELKWDDEILEILNIPKAILPEVRSNSEIYGKTAPFHFYGGEVPISGMAGDQQAALFGQLAFEPGMVKNTYGTGSFIIMNTGEEMQLSENNLLTTIGYGINGKVYYALEGSIFIAGSAIQWLRDGLRMVENSPESEKYARDSHNNDEVYVVPAFTGLGAPYWNQNARGSVFGLTRGTSKEDFIKATLQSIAYQVRDIIDTMQVDTQTAIQVLKVDGGAAMNNFLMQFQADILGIDIARAKNLETTALGAAFLAGLSVGYWKDLDELKLLNETGELFEPSMNESRKEQLYKGWKKAVKATQVFAEVDD

SEQ ID NO: 69770 - DNA, 1488 bp, Synechocystis sp
  CDS (1)..(1488)
atgacagcaaaacataatcagtatgtaatggccctggatttgggcaccaccggcaatcgagctattttgtttgattacgaaggcaatattgtcgggcaagcttacaaagagttaacccagttctatcccaaggctggctgggtggagcacgatgccctggaaatctggcgggatacgaaaacagtcatgcaggaagtggtgcaaaaaaccgctatccaaccccaacaaattgtggcgatcggtctaacggtgcaacgggaaacgtgtttgctctgggataagaccactggccaacccctccatccggcaattgtctggcaggatcgacgcactgctcacttttgtggagaattaaccgcggcgggctacgtggacgaaatttatgagcgcaccggcctcgtgttagatgcctatttttcgggcaccaaactccattggttattggattgggttaaacagagtaagagtgtcgatccagctaatctgttggcgggcaccattgatagctgggccctctggaacttaactgggggtaaagtacaccgcacggaccacagcaatgctagccgtactatggtgctcaatttagacagcctcatctgggatgaaaagctgttggatttattcaccattcccgcccagattatgccggaggtgcaacctagtttgagttacttcggcgttaccgacccggaaattctgggggtagaaattcccattaccgccatttttggtgaccaacaggcggccctctatgcccacggctgcgatcgcccaggattgctgaaatgtacctacggcacgggggcttttttggtggcgaatacggggcaaacggtaacccgttcccaacatcgcttactttccactgtggcttggacccaaaccaaccgagacaaaagcttgacaagggattacgccttggaaggaagtatgttcactgctggttcctgtgtgcaatggctacgggataagttgggtttaattgaatcagcggcggccagtgaaagcctagcccgcagtgtggatagcaatggcggcgtttactttgtgccggccctaagtggtttgggggctccccattgggacatgaatgcctgtggcgcttttcttggcttaacagcaggggtaactaaagcccatctagtcagatcggttctagaggcgatcgccttccaagcccgggaagtggtggaggccattaaccaggatagtcccgcccccattcaacaactgaaagtagatggaggagcctgtaacaatgactttttgatgcaatgccaagcggatgttttaggcattcccgtagaacggcctgcggtgttggatgccacggcccagggagccgcctttggagccgggctaaaaattgggtggaatcagcttcaaattaggtttttccgaaccttccaccacgggacgataagcttaatttgtcttcaatttctgcccatgcgtattcaggaaggtgtatccgttgaccagtga

SEQ ID NO: 69771 - protein, 495 aa, Synechocystis sp
MTAKHNQYVMALDLGTTGNRAILFDYEGNIVGQAYKELTQFYPKAGWVEHDALEIWRDTKTVMQEVVQKTAIQPQQIVAIGLTVQRETCLLWDKTTGQPLHPAIVWQDRRTAHFCGELTAAGYVDEIYERTGLVLDAYFSGTKLHWLLDWVKQSKSVDPANLLAGTIDSWALWNLTGGKVHRTDHSNASRTMVLNLDSLIWDEKLLDLFTIPAQIMPEVQPSLSYFGVTDPEILGVEIPITAIFGDQQAALYAHGCDRPGLLKCTYGTGAFLVANTGQTVTRSQHRLLSTVAWTQTNRDKSLTRDYALEGSMFTAGSCVQWLRDKLGLIESAAASESLARSVDSNGGVYFVPALSGLGAPHWDMNACGAFLGLTAGVTKAHLVRSVLEAIAFQAREVVEAINQDSPAPIQQLKVDGGACNNDFLMQCQADVLGIPVERPAVLDATAQGAAFGAGLKIGWNQLQIRFFRTFHHGTISLICLQFLPMRIQEGVSVDQ

SEQ ID NO: 69772 - DNA, 1491 bp, Thermus aquaticus
  CDS (1)..(1491): transl_table=11
atgaatcaatacattttagccatcgaccaaggcacaacgagttcgcgcgcgattttgttcaatcaaaagggcgaaatcgtccatatggcgcaaaaagagtttacgcaatattttccgcagcccggctgggtcgagcacaacgccaatgaaatttggggatcggtgcttgcggtcattgccagcgtcttgtccgaggcgcaagtgaagccggaacaagtggcagggatcgggattacgaaccagcgggagacgacggtggtgtgggtgaaagacaccggcaacccgatttacaacgccatcgtctggcagtcgcggcagacggccggcatttgcgatgaactgaaagcgaaagggtatgacccgctattccgcgaaaaaaccggcttgcttattgacgcctatttttccgggacaaaagtgaaatggattttggaccatgtcgagggggcgcgcgaacgggcggagcgaggagagctgctctttggcacgattgatacgtggctcatttggaagctgtccggcggccgcgcccatgtaaccgattactcgaacgcgtcgcgcacattaatgtttaacattcatacgctcgagtgggatgacgagctgcttgcgattttaaacgtgccaaaggcgatgcttcctgaggtgcgcccgtcctcggaagtatacgcgaaaacggttccgcaccatttcttcggcgtggaggtgccgatcgcgggagccgcgggcgaccagcaggcggctttgttcggccaggcgtgctttacggaagggatggcgaaaaatacgtacggcaccggctgctttatgctgatgaatactggggaaaaagcggtgcaatcgaaacacgggctgcttacaacgatcgcctgggggattgacggcaaggtcgaatatgcccttgaaggcagcattttcgtcgccggttcggccattcaatggctgcgcgacggcttgcggatgatcaaaaccgcggctgatagcgaagcatacgccgaaaaagtcgagtcgaccgacggggtgtatgtcgtaccggcgttcgtcggccttggcacgccgtattgggacagcgaggtgcgcggggcggtgtttggcctcacgcgcggcacaacgaaagagcatttcatccgggccaccttggaatcgctcgcttaccagacaaaagatgtgctcgccgccatggaagccgattccggcatctcgctgaccacgttgcgcgttgacggcggggcggtgaaaaacaatttccttatgcagtttcaaagcgatttgcttgccgttccggtcgaacgtccggtcattaatgaaacgacggctttgggtgcgccgtatttggccgggctggcggtcggctactggaacagccgagatgacatcgccgcccaatggcagctcgagcgccggtttgagccgaagatggatgacgacaagcgaacgatgctctacgatggctggaaaaaagcggtgcgggcggcgatggcgtttaaataa

SEQ ID NO: 69773 - protein, 496 aa, Thermus aquaticus
MNQYILAIDQGTTSSRAILFNQKGEIVHMAQKEFTQYFPQPGWVEHNANEIWGSVLAVIASVLSEAQVKPEQVAGIGITNQRETTVVWVKDTGNPIYNAIVWQSRQTAGICDELKAKGYDPLFREKTGLLIDAYFSGTKVKWILDHVEGARERAERGELLFGTIDTWLIWKLSGGRAHVTDYSNASRTLMFNIHTLEWDDELLAILNVPKAMLPEVRPSSEVYAKTVPHHFFGVEVPIAGAAGDQQAALFGQACFTEGMAKNTYGTGCFMLMNTGEKAVQSKHGLLTTIAWGIDGKVEYALEGSIFVAGSAIQWLRDGLRMIKTAADSEAYAEKVESTDGVYVVPAFVGLGTPYWDSEVRGAVFGLTRGTTKEHFIRATLESLAYQTKDVLAAMEADSGISLTTLRVDGGAVKNNFLMQFQSDLLAVPVERPVINETTALGAPYLAGLAVGYWNSRDDIAAQWQLERRFEPKMDDDKRTMLYDGWKKAVRAAMAFK

SEQ ID NO: 69774 - DNA, 1488 bp, Thermus brockianus
  CDS (1)..(1488): transl_table=11
atgaaataccttttagccctagaccaaggcaccacgtccagctgggccattctcttcaccctggagggggaggtggtggccgtggcgcagcgggcctttgcccagcactaccccgagccaggcttggtggagcacgatccttgggagatctgggagagccagctttgggcggccaaggaggccctgcgccgggcgggggtggggccggaggcggtgctggccctgggcatcgccaaccagcgggagaccaccctggtgtgggagagggatacggggcggcccctccaccccgccatcgtctggcaggaccgcaggaccgcttccctttgcgaggccctgcgggagcgggggttggaggggcttttccgggcgcgcacggggctcctgctggacccctacttctccgccaccaagctcctttggcttttggagcgcgtgcctgggctaagggagcgtgcggagaggggagaggtgtgcttcggcaccgtggacacctggctcctttggaacctcacggggggcagggtccacgccaccgaccccaccaacgccagccgcaccctcctcttccacctggaaaccctgacctgggacgaggaactcctccgcgtgctaggtatcccgaaggccctcctccccgaggtgcggccctcggacggggactttggcgagaccctgcccgggcttttgggggcccctattcccatccgaggggtcctgggggaccagcaggcggcccttctggggcaggcggccttgggggcgggggaggggaagtgcacctacggcacgggggcgttcctcctcctaaacacgggggagcggcccgtctgggcggaggggggcctcctcaccaccttggcctggcacctggagggcaaggcggcctacgccctggagggaagcgtcttcgtggcgggggcggcggtggggtggcttagggaggtgggcctccttggggaaagccacgaggtggagagcctagcccggcaggtggaggatgcgggcggggtctacttcgtccccgccttcacggggcttggggccccccactgggacccctacgcccggggggccatcctggggcttacccgggggacaacccgggcccacctggcccgggcggccctggagggggtggccttctccgtgggggaggtggcctgggccatggcgggggcggcggggctagggctcaaggccctgaaggcggacgggggcatggcgcagaacgaccttttcctggagatccaggcggaccttctgggggtgccggtgctgaggccaagggtcacggagaccaccgccctgggggcggcgtgggcgcgcgggatcggggcgggggcgctttccctgggggaccttcccgccctttggcgggaagaggcccggttcctgccccggatgccggaggcgaggcgggaggccctttaccggggctggcgtcgggcggtggaacgggccaagggctgggtccaggaggggtag

SEQ ID NO: 69775 - protein, 495 aa, Thermus brockianus
MKYLLALDQGTTSSWAILFTLEGEVVAVAQRAFAQHYPEPGLVEHDPWEIWESQLWAAKEALRRAGVGPEAVLALGIANQRETTLVWERDTGRPLHPAIVWQDRRTASLCEALRERGLEGLFRARTGLLLDPYFSATKLLWLLERVPGLRERAERGEVCFGTVDTWLLWNLTGGRVHATDPTNASRTLLFHLETLTWDEELLRVLGIPKALLPEVRPSDGDFGETLPGLLGAPIPIRGVLGDQQAALLGQAALGAGEGKCTYGTGAFLLLNTGERPVWAEGGLLTTLAWHLEGKAAYALEGSVFVAGAAVGWLREVGLLGESHEVESLARQVEDAGGVYFVPAFTGLGAPHWDPYARGAILGLTRGTTRAHLARAALEGVAFSVGEVAWAMAGAAGLGLKALKADGGMAQNDLFLEIQADLLGVPVLRPRVTETTALGAAWARGIGAGALSLGDLPALWREEARFLPRMPEARREALYRGWRRAVERAKGWVQEG

SEQ ID NO: 69776 - DNA, 1494 bp, Thermoanaerobacter tengcongensis
  CDS (1)..(1494): transl_table=11
atggcgaaatatgtaatggctttggaccaggggacgacgagttcccgcgctataatttttgaccacagcggtaaaatgattgcttctttaaacaaagagtttaggcagatttatcctaaacccggttgggttgagcatgacccaatggaaatatgggaatcccagatagaagttgcaaaaggagtaatagagaaggcagggattaaaccagaggatattgcggcaataggaattacaaaccagagggagacaacagtcgtatgggacaaaaacacagggaaacctatttacaatgcaatagtgtggcagtgcaggaggacagctcctatatgcgatgaccttaagaacaaaggctttgataagaaaataagagaaaagactggccttgttgtagatgcttatttctcgggtaccaaagtgaagtggattttggacaatgttgaaggagctcgtgaaaaagcagaaagaggagaattgctttttggaaatattgacacatggcttatctggaatttgacaaggggcaaagtgcatgtgactgactattcaaatgcttcaaggacaatgcttttcaacatacacgaattgaagtgggataaggagatattagaagagctcaatgtgccagagaacatgcttccagaagtaaagccatcaagccatgtctatggctatacggataaatcgatctttggagtagaaatacctattgcaggagatgcaggagaccagcaggctgctttatttggccaggcttgctttaaacccggaatggcaaagaacacttacggtacagggtgctttatgctgatgaacacaggcgaaaaagctgttccctccaagaccgggcttttgaccacaatagcttggggtattgatggaaaagtagagtatgccttagaaggaagtattttcataacaggtgcagctattcagtggttgagggatgagctcagaataattgacaatgcacctcaaagtgaggaatacgccttaaaggttgaagatacaaatggagtgtacgtagttcctgcttttgtgggtctaggtgctccttactgggatatgtacgctagaggtgttatagttggccttacaaggggagcaaagagagagcacataataagggcaacattggagtctattgcttaccagacgagagacgttctagaagcaatgcaggaggattccggaataaagcttcaggctttgaaggttgatggaggagcaagtgcaaataacttcttaatgcagttccaggcagacattttaggcgttccggtagataggcctcaggtgatagagactactgcattaggtgctgcataccttgcagggctggcggtgggcttctggaacagcagagaagaaatagagaaaaattggaatatagacaggcgctttgaacctgccatggaggaagaaaagagggagaaactttacagaggctggaaaaaagcggttgaaagagctatgaagtgggctgaagaataa

SEQ ID NO: 69777 - protein, 497 aa, Thermoanaerobacter tengcongensis
MAKYVMALDQGTTSSRAIIFDHSGKMIASLNKEFRQIYPKPGWVEHDPMEIWESQIEVAKGVIEKAGIKPEDIAAIGITNQRETTVVWDKNTGKPIYNAIVWQCRRTAPICDDLKNKGFDKKIREKTGLVVDAYFSGTKVKWILDNVEGAREKAERGELLFGNIDTWLIWNLTRGKVHVTDYSNASRTMLFNIHELKWDKEILEELNVPENMLPEVKPSSHVYGYTDKSIFGVEIPIAGDAGDQQAALFGQACFKPGMAKNTYGTGCFMLMNTGEKAVPSKTGLLTTIAWGIDGKVEYALEGSIFITGAAIQWLRDELRIIDNAPQSEEYALKVEDTNGVYVVPAFVGLGAPYWDMYARGVIVGLTRGAKREHIIRATLESIAYQTRDVLEAMQEDSGIKLQALKVDGGASANNFLMQFQADILGVPVDRPQVIETTALGAAYLAGLAVGFWNSREEIEKNWNIDRRFEPAMEEEKREKLYRGWKKAVERAMKWAEE

SEQ ID NO: 69778 - DNA, 1539 bp, Trypanosoma brucei brucei
  CDS (1)..(1539)
atgaagtacgtcggatccattgaccagggaacaaccagcacccgcttcatcatcttcgatgagcggcagcgccccgtctcggtgcaccaggttccccatacccagcacacaccccaccccggctggttggagcatgacccgatggagattttccgctccgcatgcaagtgcatgtccgttgccatcgcaaagctgaggcaaaaggacgcctctttccgcaagattgaggcgattggaatcacgaaccaacgtgagacaacggtggcgtgggatcgcgttaccaaggaaccgctgtgctacgcccctgtttggaatgacctgcgcacgtacgacatcaccaagaaggtgactgcggagctcggtggtggggattccatgttcgcatccaaaattactggcttgcctgtaagcacgtatttcgctgcgttcaagatgcggtggatgctcgagaatgttccagctgttgctgacgcatgccgtcgtgggacgctttgcttcggcacgatcgacacatggctcatgtacaagctgagtggtggcaaggcgtttgtgacagacgtgacgaacgcgtcacgcaccttccttatggatttgcgcacgcggaaatggtctcctgaattgtgcgagaaactgaagatcccgatggaaacgctccccgagattcgcagtaacagtgaactcttcggatatgtggagacggacgaatgcggtgttgcagctgccctcaacgagaggacgcctattatgggcagtattggtgatcagcagtctgcgcttttcggaaatatgtgcttcgagaagggtgaggccaagaacacatacggcaccggctgcttcctgttgatgaacgtgggagaggaggcccgtttctcgaagcacggtttactttcgacagtgggcttccaggtgggccgcgatggaccatgctactatgcactggaaggcgcgatcgcgtgcgctggtgctacggtggagtggatgagaaggaacatgaacctcttcagtcatatcacagagtgtgagaagttggcccgcagtgtccccgggacgcaaggtattgtctttgtgcccgccttctctggactgttggcgccctattgggatccatcggcccgtggtaccatcgtgggcatgacactcaagacgactcgcgcgcacgtcatccgcgctgcgctgcaggccattgctctccagttgaacgatgttgttggttcgatgaaacgtgacgctgggcttaatctgagctccctccgtgttgacggtgggttgtctaagaacggtctgctcatggagattcaagcaagtttgttgggcgtggacatcttagtgccatcaatgcatgagacaactgcactcggtgcggcactgtgtgcaggacttgcggctggtgtatggacttcactggaagaagttaaggccgtgtcgcgacgcgagaattcgtggaagactgtcagccccagcggctctgccatggagcgtgaggcaatgatcgcagagtggcgcgaggcgctcaagaggacgaagtgggcaaagttgtag

SEQ ID NO: 69779 - protein, 512 aa, Trypanosoma brucei brucei
MKYVGSIDQGTTSTRFIIFDERQRPVSVHQVPHTQHTPHPGWLEHDPMEIFRSACKCMSVAIAKLRQKDASFRKIEAIGITNQRETTVAWDRVTKEPLCYAPVWNDLRTYDITKKVTAELGGGDSMFASKITGLPVSTYFAAFKMRWMLENVPAVADACRRGTLCFGTIDTWLMYKLSGGKAFVTDVTNASRTFLMDLRTRKWSPELCEKLKIPMETLPEIRSNSELFGYVETDECGVAAALNERTPIMGSIGDQQSALFGNMCFEKGEAKNTYGTGCFLLMNVGEEARFSKHGLLSTVGFQVGRDGPCYYALEGAIACAGATVEWMRRNMNLFSHITECEKLARSVPGTQGIVFVPAFSGLLAPYWDPSARGTIVGMTLKTTRAHVIRAALQAIALQLNDVVGSMKRDAGLNLSSLRVDGGLSKNGLLMEIQASLLGVDILVPSMHETTALGAALCAGLAAGVWTSLEEVKAVSRRENSWKTVSPSGSAMEREAMIAEWREALKRTKWAKL

SEQ ID NO: 69780 - DNA, 1518 bp, Vibrio cholerae
  CDS (1)..(1518): transl_table=11
atgactgagcaaaaatacgtcgtcgctctcgatcaaggtactaccagctctcgcgccgtggtgttagaccatgatgcgaatatcgtgagcgtttctcagcgtgagtttacccaaatctacccacaagccgggtgggtggaacacgatccaatggaaatctacgctacgcaaagctcaacattggttgaagcgctaggtaaagcgggcattcgcagtgatgaagttgcggccatcggtattaccaaccaacgtgaaaccacggtggtgtggaataaagagacgggtaagcctgtctacaatgcgattgtttggcaatgtcgccgtactgctgccatttgtgaagagctgaaagagcgcggtttagaaagttacattcgtgacaataccggtttggtgctcgacccttacttctcaggtaccaaaattaaatggattctggacaatgtagaaggcgcacgcgagcaagctgaagcaggacaactgctgtttggtacggttgatacatggctagtgtggaaaatgacacaaggccgtgtgcatgtgaccgattacaccaacgcatcccgtactatgctgttcaacatcaacaccttgcagtgggatgaaaagatcctcgccgaatttaatatcccgctctccatgatgccggaagtgaaaaaatcgtctgaagtgtacggtcaaaccaacatcggtggtaaaggcggtacgcgtattccaatcgcggggattgccggtgaccaacaagcggcgctgtacggccaaatgtgtgtgcaagcgggacaagcgaaaaacacctacggtacgggttgcttcttgctgatgaacacgggacaggaaaaagtgacctcgcacaacggcttgctgaccacgctagcgtgtggcccacgcggtgaaccagcttatgcactggaaggggcggtgtttatgggcggtgcatccattcaatggctgcgtgatgagctgaaactgatttccgatgctcgcgactcagagtacttcgccaccaaagtggatacctccaatggggtgtatgtggtgccagcctttacgggtttaggcgctccgtactgggatgcgtatgcgcgtggcacaattgtcggcttaacccgtggtgtgaactcaaaccacattattcgcgcaacgctggaaagtatcgcttaccaaacgcgtgatgtgttggatgcgatgcaagccgattctggcatcaagctttctgcgctgcgtgtcgatggtggtgcggtcgccaacaacttcctgatgcagttccaagcagatgtattggataccgaagtgcatcgtccgaaagtcacggaagtcaccgcgttaggcgccgcttacctcgccggtctggccgttggtttctgggatggtttggaagagctgcaaggcaaagcggaaatcgatcgcagctttaaaccgcatcatgatgaagagaagcgtcaacgccgttataaaggttggaagcgtgcggtgaaatgtgcccaagcgtgggcagtactgcacaacgaagaagagtaa

SEQ ID NO: 69781 - protein, 505 aa, Vibrio cholerae
MTEQKYVVALDQGTTSSRAVVLDHDANIVSVSQREFTQIYPQAGWVEHDPMEIYATQSSTLVEALGKAGIRSDEVAAIGITNQRETTVVWNKETGKPVYNAIVWQCRRTAAICEELKERGLESYIRDNTGLVLDPYFSGTKIKWILDNVEGAREQAEAGQLLFGTVDTWLVWKMTQGRVHVTDYTNASRTMLFNINTLQWDEKILAEFNIPLSMMPEVKKSSEVYGQTNIGGKGGTRIPIAGIAGDQQAALYGQMCVQAGQAKNTYGTGCFLLMNTGQEKVTSHNGLLTTLACGPRGEPAYALEGAVFMGGASIQWLRDELKLISDARDSEYFATKVDTSNGVYVVPAFTGLGAPYWDAYARGTIVGLTRGVNSNHIIRATLESIAYQTRDVLDAMQADSGIKLSALRVDGGAVANNFLMQFQADVLDTEVHRPKVTEVTALGAAYLAGLAVGFWDGLEELQGKAEIDRSFKPHHDEEKRQRRYKGWKRAVKCAQAWAVLHNEEE

SEQ ID NO: 69782 - DNA, 1518 bp, Vibrio parahaemolyticus
  CDS (1)..(1518)
atgactgagcaaaaatacattgttgccctcgaccaaggtacgacaagctctcgcgctgttattcttgatcacgacgccaatatcgtaagcgtcgctcagcgagagtttactcagatttatccacaagcaggttgggttgagcacgatccaatggaaatctgggcaacacaaagctctacattagttgaagctttggctaagtcaggcatccgaagcgaccaattagctgctattggtattacgaaccaacgtgaaaccaccatcgtctggaacaaagaaacaggcaaacccgtctacaacgcaatcgtatggcaatgtcgtcgcaccgcagacatttgtgaagacctaaaaagccgcggcttagaagattacgttcgcgacaacaccggcttggtgcttgacccttacttctctggcactaaagtgaagtggattctggataacgtagaaggcgcacgcgaagatgcagaagcaggtaaactgctgtttggtaccgtcgatacgtggttagtatggaagatgactcaaggccgcgttcacgttactgactacaccaacgcatcacgtaccatgctatttaacatcaacgacctatgttgggaccaaaagctgttggatgagatgggcattccggcgtcaatgatgccagaagtaaaacgctcttcggaaatttacggcaaaacgaacatcggtggtaaaggcggtactcgaattcctatcgcaggtattgcaggtgaccaacaagcggcgctatacggccaaatgtgtgtggaagctggccaagcgaaaaacacatacggcacaggttgtttcttgctgatgaacactggccaagagaaagtcacctcgaagaatggtctgcttaccactctagcttgtggtccgaaaggcgagccagcttacgcacttgaaggtgctgtgttcatgggtggtgcctctatccagtggctgcgtgacgaactgaaaatcctaaacggtgcagaagattctgaatacttcgcaacaaaagtggacacatcgaacggcgtttatgtagtaccagcctttactggccttggcgccccatactgggatgcttacgcacgtggcaccattgttggccttactcgcggtgtgaactcaaaccacattatccgcgcgactctggaaggcatcgcttaccaaactcgtgacgtattggatgcgatgcaagctgactccggcatcaagctcgcaaacttgcgtgttgatggtggtgcggtagcaaacaacttcctaatgcaattccaatcggatgtattaaacacagaagtgcaccgtccacaagtgactgaagtaacggctcttggtgctgcatacctggcaggtttagcggttggttactggaacagcattgatgaactgcaagataaagcagtgcttgatcgtacgtttgaaccgcatgatgacgaagaaaaacgcaaccgtcgttacaaaggttggaaacgcgctgtgaaatgtgcgcaaacttggtctgaactgcacgacgaagacgattaa

SEQ ID NO: 69783 - protein, 505 aa, Vibrio parahaemolyticus
MTEQKYIVALDQGTTSSRAVILDHDANIVSVAQREFTQIYPQAGWVEHDPMEIWATQSSTLVEALAKSGIRSDQLAAIGITNQRETTIVWNKETGKPVYNAIVWQCRRTADICEDLKSRGLEDYVRDNTGLVLDPYFSGTKVKWILDNVEGAREDAEAGKLLFGTVDTWLVWKMTQGRVHVTDYTNASRTMLFNINDLCWDQKLLDEMGIPASMMPEVKRSSEIYGKTNIGGKGGTRIPIAGIAGDQQAALYGQMCVEAGQAKNTYGTGCFLLMNTGQEKVTSKNGLLTTLACGPKGEPAYALEGAVFMGGASIQWLRDELKILNGAEDSEYFATKVDTSNGVYVVPAFTGLGAPYWDAYARGTIVGLTRGVNSNHIIRATLEGIAYQTRDVLDAMQADSGIKLANLRVDGGAVANNFLMQFQSDVLNTEVHRPQVTEVTALGAAYLAGLAVGYWNSIDELQDKAVLDRTFEPHDDEEKRNRRYKGWKRAVKCAQTWSELHDEDD

SEQ ID NO: 69784 - DNA, 1500 bp, Xanthomonas campestris
  CDS (1)..(1500): transl_table=11
atggaaaagaaatacgtccttgcgatcgaccagggcaccaccagctcgcgcgcgatgttgttcgatcgccagggcaaggtggccggcgtggcgcagcgcgaattcggccagatctttccgcagccgggctgggtggaacacaacccacgcgagatcatgaccagcgtctacaccaccattaccgagctgctcaacaacgcgcagatcgacgcgcgcgagatctcaggcatcggcatcaccaaccagcgcgagaccgcggtggtatgggacaaggccaccggccaaccgatctacaacgccatcgtctggcaatcgcggcagaccaaggacatctgcacccagctcaaagaggccggccatgagcagatggtgcgcgacaagaccgggctgctgatcgatgcgtatttttccggcaccaaggtcaagtggattctcgaccacgtggacggcgcacgtgaacgcgcacgcaagggcgagctcgccttcggcaccatcgatagctggctgatctggaacctcaccggcggcaaggtgcacgtgaccgactacaccaatgcctcgcgcaccatgatgtacaacatccacaccctggagtgggatgccgagctgctggagatgctggacgtgcccgcgcagatgctgccggaagtgcgctcgtccagcgaggtctatggcatgacccagacccagtatttctacggggaacaggtgcccattgccggcattgccggcgaccagcaggccgcattgttcgggcaagcgtgctttgaaccgggcatggcgaagaacacctatggcaccggctgtttcatgctgatgaataccggcgacaaggccgtggcctccaaggccggcttgctgaccaccatcgcctggggcatcgacggcaaggtggaatacgcactggaaggcgccatcttcgtggctggctcggtggtgcagtggctgcgcgatgggctgcgcatgttcggcaaggcgagcgattcgcaagcctatgcggagcgtgccggcgacaacgacggcgtgtatttcgtcccggccttcgtgggcctgggcgcaccgtactggcgcagcgatatccgcggtgcggtgttcggcctgacccgcggcaccagcaaggaacacttcgtgcgcgcggcggtggaatcgatggcgtatcagacccgcgatgtgctcaccgcgatgcagagcgattcggggatcgaactgaaggagctgcgcgccgacggtggcgcgatcgccaacgacttcatggcgcaattccagagcgacattctcaacgtgccggtgctgcgtccggaggtggccgaaaccaccgcgctgggcgcggcctacctggcgggcctggccaccgggttctggagcagccgcgaagagatcgccaaacaatgggcggtggatcgccgcttcgagccgaacatgcccgaagagcggcgcgaacagttgtatgccggctggcagcaggcagtggaagccaccatgggcttccgcatcagctaa

SEQ ID NO: 69785 - protein, 499 aa, Xanthomonas campestris
MEKKYVLAIDQGTTSSRAMLFDRQGKVAGVAQREFGQIFPQPGWVEHNPREIMTSVYTTITELLNNAQIDAREISGIGITNQRETAVVWDKATGQPIYNAIVWQSRQTKDICTQLKEAGHEQMVRDKTGLLIDAYFSGTKVKWILDHVDGARERARKGELAFGTIDSWLIWNLTGGKVHVTDYTNASRTMMYNIHTLEWDAELLEMLDVPAQMLPEVRSSSEVYGMTQTQYFYGEQVPIAGIAGDQQAALFGQACFEPGMAKNTYGTGCFMLMNTGDKAVASKAGLLTTIAWGIDGKVEYALEGAIFVAGSVVQWLRDGLRMFGKASDSQAYAERAGDNDGVYFVPAFVGLGAPYWRSDIRGAVFGLTRGTSKEHFVRAAVESMAYQTRDVLTAMQSDSGIELKELRADGGAIANDFMAQFQSDILNVPVLRPEVAETTALGAAYLAGLATGFWSSREEIAKQWAVDRRFEPNMPEERREQLYAGWQQAVEATMGFRIS

SEQ ID NO: 69786 - DNA, 2130 bp, Saccharomyces cerevisiae
  CDS (1)..(2130)
atgtttccctctctcttccgacttgtagtattctccaaacgttacatattccgatcaagccagcgcctttacactagtttaaaacaagaacagagccgtatgtccaaaataatggaagatttacgaagtgactacgtcccgcttatcgccagtattgatgtaggaacgacctcatccagatgcattctgttcaacagatggggccaggacgtttcaaaacaccaaattgaatattcaacttcagcatcgaagggcaagattggggtgtctggcctaaggagaccctctacagccccagctcgtgaaacaccaaacgccggtgacatcaaaaccagcggaaagcccatcttttctgcagaaggctatgccattcaagaaaccaaattcctaaaaatcgaggaattggacttggacttccataacgaacccacgttgaagttccccaaaccgggttgggttgagtgccatccgcagaaattactggtgaacgtcgtccaatgccttgcctcaagtttgctctctctgcagactatcaacagcgaacgtgtagcaaacggtctcccaccttacaaggtaatatgcatgggtatagcaaacatgagagaaaccacaattctgtggtcccgccgcacaggaaaaccaattgttaactacggtattgtttggaacgacaccagaacgatcaaaatcgttagagacaaatggcaaaacactagcgtcgataggcaactgcagcttagacagaagactggattgccattgctctccacgtatttctcctgttccaagctgcgctggttcctcgacaatgagcctctgtgtaccaaggcgtatgaggagaacgacctgatgttcggcactgtggacacatggctgatttaccaattaactaaacaaaaggcgttcgtttctgacgtaaccaacgcttccagaactggatttatgaacctctccactttaaagtacgacaacgagttgctggaattttggggtattgacaagaacctgattcacatgcccgaaattgtgtcctcatctcaatactacggtgactttggcattcctgattggataatggaaaagctacacgattcgccaaaaacagtactgcgagatctagtcaagagaaacctgcccatacagggctgtctgggcgaccaaagcgcatccatggtggggcaactcgcttacaaacccggtgctgcaaaatgtacttatggtaccggttgctttttactgtacaatacggggaccaaaaaattgatctcccaacatggcgcactgacgactctagcattttggttcccacatttgcaagagtacggtggccaaaaaccagaattgagcaagccacattttgcattagagggttccgtcgctgtggctggtgctgtggtccaatggctacgtgataatttacgattgatcgataaatcagaggatgtcggaccgattgcatctacggttcctgattctggtggcgtagttttcgtccccgcatttagtggcctattcgctccctattgggacccagatgccagagccaccataatggggatgtctcaattcactactgcctcccacatcgccagagctgccgtggaaggtgtttgctttcaagccagggctatcttgaaggcaatgagttctgacgcgtttggtgaaggttccaaagacagggactttttagaggaaatttccgacgtcacatatgaaaagtcgcccctgtcggttctggcagtggatggcgggatgtcgaggtctaatgaagtcatgcaaattcaagccgatatcttaggtccctgtgtcaaagtcagaaggtctccgacagcggaatgtaccgcattgggggcagccattgcagccaatatggctttcaaggatgtgaacgagcgcccattatggaaggacctacacgatgttaagaaatgggtcttttacaatggaatggagaaaaacgaacaaatatcaccagaggctcatccaaaccttaagatattcagaagtgaatccgacgatgctgaaaggagaaagcattggaagtattgggaagttgccgtggaaagatccaaaggttggctgaaggacatagaaggtgaacacgaacaggttctagaaaacttccaataa

SEQ ID NO: 69787 - protein, 709 aa, Saccharomyces cerevisiae
MFPSLFRLVVFSKRYIFRSSQRLYTSLKQEQSRMSKIMEDLRSDYVPLIASIDVGTTSSRCILFNRWGQDVSKHQIEYSTSASKGKIGVSGLRRPSTAPARETPNAGDIKTSGKPIFSAEGYAIQETKFLKIEELDLDFHNEPTLKFPKPGWVECHPQKLLVNVVQCLASSLLSLQTINSERVANGLPPYKVICMGIANMRETTILWSRRTGKPIVNYGIVWNDTRTIKIVRDKWQNTSVDRQLQLRQKTGLPLLSTYFSCSKLRWFLDNEPLCTKAYEENDLMFGTVDTWLIYQLTKQKAFVSDVTNASRTGFMNLSTLKYDNELLEFWGIDKNLIHMPEIVSSSQYYGDFGIPDWIMEKLHDSPKTVLRDLVKRNLPIQGCLGDQSASMVGQLAYKPGAAKCTYGTGCFLLYNTGTKKLISQHGALTTLAFWFPHLQEYGGQKPELSKPHFALEGSVAVAGAVVQWLRDNLRLIDKSEDVGPIASTVPDSGGVVFVPAFSGLFAPYWDPDARATIMGMSQFTTASHIARAAVEGVCFQARAILKAMSSDAFGEGSKDRDFLEEISDVTYEKSPLSVLAVDGGMSRSNEVMQIQADILGPCVKVRRSPTAECTALGAAIAANMAFKDVNERPLWKDLHDVKKWVFYNGMEKNEQISPEAHPNLKIFRSESDDAERRKHWKYWEVAVERSKGWLKDIEGEHEQVLENFQ

SEQ ID NO: 69788 - DNA, 1479 bp, Archaeoglobus fulgidus
  CDS (1)..(1479): transl_table=11
atgattggggtaatcgatgcgggaacaacaacgataaagcttgccgtttacgatgaggataaacttgtagcgatcaaaaaggagccggttgtcaagcacaatccaaagccgggatgggttgagatcgatgcagaggatttagcgaggaagtgtgtgagcttcgctgacacagccattgacgagtatggtgttgaggtaattgccataaccaaccagcgaaccaccgcagttctgtgggatggtaaaacgggcaggccagtcttcaatgcccttggatggcaggacatgagggccaacgctcttgctgaggagatgaacagagactctaccatcaggatggcaaggactgctggaatgattgcgagaggggtggtgaagctgcttccaacgctgaaaaacaagagaagggttaagtggctcatcacactctcccgcctctcaatccgccccaaccacaccagcgtgaagctctgctggatgctgagggagcttggagagaaaaaggagaagtatgatctgaaagctggaaccgttgacagctggcttgtatacaggctgacaggtgagcatcttacagattactccaatgctgctgctacaggcctctacgactcctactacctgcggtggagcgagcccattctaaaaattgttggagcagatgaggaaatgcttccgaaaaccctcgaaagcgacagaatctttggagagtacagaaatgtgccagtcactggagtcatcgccgaccaatccgcctccctctacgccctcggatgctgggaggagggagacatcaaggccaccaacggaaccggaaccttcgtcgacctcaatgttggagaagagccccaagcctctcccggaggtttgcttcccctcatagcgtggaagctgaagtcggaaatgagatacatgatggaggggatgctcttctacagcggttctgccgtggagaagctgaaggaaatcggcatctacgatgatgtttctaaaacttcagaaatggccttcaggtcgaagaatgacgacatgctgctcatcccctccttcaccggcctcgcaactccccactacgtctcggttcccggcttgctttacgggatatccaacgccatgacgagggaggatatagtgaaagccctgctcgaatccatagccttcagaatagccgaaatcgtcgagattatgcggaaggagtttccctacgaaactgacagaatcagatgcgacggagagatgtcctccaacgacttcttcctgcagagaattgccgacgttacaggcttgaaagttgagaggggggcagtgctttcgggaacttctttcggggcgcacctcgttgctgggagggctttgggcaagtggaaaaaggacttctgcatgcccttcgataaagttttcgaaccctctttggatttatcggagaagtacagaaggtggaagaggctgcttgaaatatcgaaaaagcttaaggtgtga

SEQ ID NO: 69789 - protein, 492 aa, Archaeoglobus fulgidus
MIGVIDAGTTTIKLAVYDEDKLVAIKKEPVVKHNPKPGWVEIDAEDLARKCVSFADTAIDEYGVEVIAITNQRTTAVLWDGKTGRPVFNALGWQDMRANALAEEMNRDSTIRMARTAGMIARGVVKLLPTLKNKRRVKWLITLSRLSIRPNHTSVKLCWMLRELGEKKEKYDLKAGTVDSWLVYRLTGEHLTDYSNAAATGLYDSYYLRWSEPILKIVGADEEMLPKTLESDRIFGEYRNVPVTGVIADQSASLYALGCWEEGDIKATNGTGTFVDLNVGEEPQASPGGLLPLIAWKLKSEMRYMMEGMLFYSGSAVEKLKEIGIYDDVSKTSEMAFRSKNDDMLLIPSFTGLATPHYVSVPGLLYGISNAMTREDIVKALLESIAFRIAEIVEIMRKEFPYETDRIRCDGEMSSNDFFLQRIADVTGLKVERGAVLSGTSFGAHLVAGRALGKWKKDFCMPFDKVFEPSLDLSEKYRRWKRLLEISKKLKV

SEQ ID NO: 69790 - DNA, 26 bp, Primer
atgactgaaaaaaaatatatcgttgc

SEQ ID NO: 69791 - DNA, 23 bp, Primer
ttattcgtcgtgttcttcccacg

SEQ ID NO: 69792 - protein, 799 aa, consensus
  MISC_FEATURE (1)..(799): consensus for the disclosure of xaa see table XV
DXGTXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXGWVEXXXXXIXXXXXXXXXXXXXXXXXXXXXXXXXXXXXXXXXXXGXTNQRETXXXWXXXTGXPXXXAXIVWXXXRTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTGLXXXXXYFSXXKXXWXLXXXXXXXXXXXXXXXXXXXXXXGXXXFGTXDXWLXXXLTXXXXXXXXXXXXXXXXHXTDXXNASRTXXXXXXXXXWDXXXXXXXXXPXXXXXLPXXXXXXXXXXXGXXXXXXXXXXXXXXXXXXXXXXXXXXXXXXPIXXXXGDQXAAXXGQXXXXXXXXXGXXKXTYGTGXFXXXNTGXXXXXXXXXXXXXSXXXXLLXTXXXXXXXXXXXXXXXXXXXXXXXXXXXXXXXXXXXXYALEGXXXXXGXXXXWLXDXXXXXXXXXXXXXXAXXXXXXXXXXXXXXXXXXXXXXXXXXXXXXXXXXXXXXXXXXXVXXVPAFXGLXAPXWXXXARGXXXGXXXXXXXXXXXRAXLEXXXXQXXXXXXXMXXXXXXXXXXXXXXXXXXXXXXXXXXXXXXXLXVDGGXXXXXXXMQXXXDXXXXXVXXXXXXXXEXTAXGXAXXAGXXXGXXXXXXXXXXXXXXXXXXXXXXXXXXXXXXXXXXXXXXXXXXXPXXXXXXXXXXXXXWXXA

SEQ ID NO: 69793 - protein, 175 aa, consensus
  MISC_FEATURE (1)..(175): consensus for the disclosure of xaa see table XV
XXXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXGXXEXXXXXXXXXXXXXXXXXXXXXXXXXXXXXXXXXXXXXXXXXXXXXXRXXXXXWXXXXGXXXXXXXXW

SEQ ID NO: 69794 - protein, 94 aa, consensus
  MISC_FEATURE (1)..(94): consensus for the disclosure of xaa see table XV
XLXXXXXXXXXXXXXWXXXXXXXXXXXXXXXXXXXXXXXXXXXXXGXXXXXXXXXXXXXXXXXXXXXXXXXXXXXXXXXXAXXXXXXXXXXXXX

SEQ ID NO: 69795 - protein, 105 aa, consensus
  MISC_FEATURE (1)..(105): consensus for the disclosure of xaa see table XV
XDXXXXXXXXXXXXXGXXKXTXXTXXXXXXXXXXXXXXXXXXXXXXXXXXXXXXXXXXXXXXXXXXXXXXXXXXEGXXXXXXXXXXXXXXXXXXXXXXXXXXXXX

SEQ ID NO: 69796 - protein, 40 aa, consensus
  MISC_FEATURE (1)..(40): consensus for the disclosure of xaa see table XV
XXXXXXXXGXXXPXXXXXXXXXXXGXXXXXXXXXXXXXXX

SEQ ID NO: 69797 - protein, 45 aa, consensus
  MISC_FEATURE (1)..(45): consensus for the disclosure of xaa see table XV
XXXXGXXXXXXXXXXXXXXXXXXXXXXXXXXXXXXXXXGXXXXXX

SEQ ID NO: 69798 - DNA, 1425 bp, Escherichia coli K12; identical to SEQ ID NO: 28717
  CDS (1)..(1425)

SEQ ID NO: 69799 - protein, 474 aa, Escherichia coli K12; identical to SEQ ID NO: 28718

SEQ ID NO: 69800 - DNA, 1401 bp, Haemophilus influenzae; identical to SEQ ID NO: 28719
  CDS (1)..(1401)

SEQ ID NO: 69801 - protein, 466 aa, Haemophilus influenzae; identical to SEQ ID NO: 28720

SEQ ID NO: 69802 - DNA, 1350 bp, Bacillus subtilis; identical to SEQ ID NO: 28721
  CDS (1)..(1350)

SEQ ID NO: 69803 - protein, 449 aa, Bacillus subtilis; identical to SEQ ID NO: 28722

SEQ ID NO: 69804 - DNA, 1545 bp, Xylella fastidiosa; identical to SEQ ID NO: 28723
  CDS (1)..(1545)

SEQ ID NO: 69805 - protein, 514 aa, Xylella fastidiosa; identical to SEQ ID NO: 28724

SEQ ID NO: 69806 - DNA, 1251 bp, Nostoc sp. PCC 7120; identical to SEQ ID NO: 28725
  CDS (1)..(1251)

SEQ ID NO: 69807 - protein, 416 aa, Nostoc sp. PCC 7120; identical to SEQ ID NO: 28726

SEQ ID NO: 69808 - DNA, 1428 bp, Salmonella enterica subsp. enterica serovar Typhi; identical to SEQ ID NO: 28727
  CDS (1)..(1428)

SEQ ID NO: 69809 - protein, 475 aa, Salmonella enterica subsp. enterica serovar Typhi; identical to SEQ ID NO: 28728

SEQ ID NO: 69810 - DNA, 1290 bp, Nostoc sp. PCC 7120; identical to SEQ ID NO: 28729
  CDS (1)..(1290)

SEQ ID NO: 69811 - protein, 429 aa, Nostoc sp. PCC 7120; identical to SEQ ID NO: 28730

SEQ ID NO: 69812 - DNA, 1206 bp, Nostoc sp. PCC 7120; identical to SEQ ID NO: 28731
  CDS (1)..(1206)

SEQ ID NO: 69813 - protein, 401 aa, Nostoc sp. PCC 7120; identical to SEQ ID NO: 28732

SEQ ID NO: 69814 - DNA, 1545 bp, Agrobacterium tumefaciens; identical to SEQ ID NO: 28733
  CDS (1)..(1545)

SEQ ID NO: 69815 - protein, 514 aa, Agrobacterium tumefaciens; identical to SEQ ID NO: 28734

SEQ ID NO: 69816 - DNA, 1446 bp, Yersinia pestis; identical to SEQ ID NO: 28735
  CDS (1)..(1446)

SEQ ID NO: 69817 - protein, 481 aa, Yersinia pestis; identical to SEQ ID NO: 28736

SEQ ID NO: 69818 - DNA, 1572 bp, Agrobacterium tumefaciens; identical to SEQ ID NO: 28737
  CDS (1)..(1572)

SEQ ID NO: 69819 - protein, 523 aa, Agrobacterium tumefaciens; identical to SEQ ID NO: 28738

SEQ ID NO: 69820 - DNA, 1407 bp, Agrobacterium tumefaciens; identical to SEQ ID NO: 28739
  CDS (1)..(1407)

SEQ ID NO: 69821 - protein, 468 aa, Agrobacterium tumefaciens; identical to SEQ ID NO: 28740

SEQ ID NO: 69822 - DNA, 1425 bp, Brucella melitensis; identical to SEQ ID NO: 28741
  CDS (1)..(1425)

SEQ ID NO: 69823 - protein, 474 aa, Brucella melitensis; identical to SEQ ID NO: 28742

SEQ ID NO: 69824 - DNA, 1362 bp, Aquifex aeolicus; identical to SEQ ID NO: 28743
  CDS (1)..(1362)

SEQ ID NO: 69825 - protein, 453 aa, Aquifex aeolicus; identical to SEQ ID NO: 28744

SEQ ID NO: 69826 - DNA, 1500 bp, Neisseria meningitidis; identical to SEQ ID NO: 28745
  CDS (1)..(1500)

SEQ ID NO: 69827 - protein, 499 aa, Neisseria meningitidis; identical to SEQ ID NO: 28746

SEQ ID NO: 69828 - DNA, 1170 bp, Pseudomonas aeruginosa; identical to SEQ ID NO: 28747
  CDS (1)..(1170)

SEQ ID NO: 69829 - protein, 389 aa, Pseudomonas aeruginosa; identical to SEQ ID NO: 28748

SEQ ID NO: 69830 - DNA, 1407 bp, Sinorhizobium meliloti; identical to SEQ ID NO: 28749
  CDS (1)..(1407)

SEQ ID NO: 69831 - protein, 468 aa, Sinorhizobium meliloti; identical to SEQ ID NO: 28750

SEQ ID NO: 69832 - DNA, 1332 bp, Helicobacter pylori; identical to SEQ ID NO: 28751
  CDS (1)..(1332)

SEQ ID NO: 69833 - protein, 443 aa, Helicobacter pylori; identical to SEQ ID NO: 28752

SEQ ID NO: 69834 - DNA, 1419 bp, Caulobacter crescentus; identical to SEQ ID NO: 28753
  CDS (1)..(1419)

SEQ ID NO: 69835 - protein, 472 aa, Caulobacter crescentus; identical to SEQ ID NO: 28754

SEQ ID NO: 69836 - DNA, 1446 bp, Xylella fastidiosa; identical to SEQ ID NO: 28755
  CDS (1)..(1446)

SEQ ID NO: 69837 - protein, 481 aa, Xylella fastidiosa; identical to SEQ ID NO: 28756

SEQ ID NO: 69838 - DNA, 1458 bp, Treponema pallidum subsp. pallidum (syphilis spirochete); identical to SEQ ID NO: 28757
  CDS (1)..(1458)

SEQ ID NO: 69839 - protein, 485 aa, Treponema pallidum subsp. pallidum (syphilis spirochete); identical to SEQ ID NO: 28758

SEQ ID NO: 69840 - DNA, 1380 bp, Thermotoga maritima; identical to SEQ ID NO: 28759
  CDS (1)..(1380)

SEQ ID NO: 69841 - protein, 459 aa, Thermotoga maritima; identical to SEQ ID NO: 28760

SEQ ID NO: 69842 - DNA, 1371 bp, Vibrio cholerae; identical to SEQ ID NO: 28761
  CDS (1)..(1371)

SEQ ID NO: 69843 - protein, 456 aa, Vibrio cholerae; identical to SEQ ID NO: 28762

SEQ ID NO: 69844 - DNA, 1961 bp, Pseudomonas aeruginosa; identical to SEQ ID NO: 28763
  CDS (496)..(1920)

SEQ ID NO: 69845 - protein, 474 aa, Pseudomonas aeruginosa; identical to SEQ ID NO: 28764

SEQ ID NO: 69846 - DNA, 1593 bp, Caulobacter crescentus; identical to SEQ ID NO: 28765
  CDS (1)..(1593)

SEQ ID NO: 69847 - protein, 530 aa, Caulobacter crescentus; identical to SEQ ID NO: 28766

SEQ ID NO: 69848 - DNA, 1536 bp, Rickettsia conorii; identical to SEQ ID NO: 28767
  CDS (1)..(1536)

SEQ ID NO: 69849 - protein, 511 aa, Rickettsia conorii; identical to SEQ ID NO: 28768

SEQ ID NO: 69850 - DNA, 1452 bp, Borrelia burgdorferi (Lyme disease spirochete); identical to SEQ ID NO: 28769
  CDS (1)..(1452)

SEQ ID NO: 69851 - protein, 483 aa, Borrelia burgdorferi (Lyme disease spirochete); identical to SEQ ID NO: 28770

SEQ ID NO: 69852 - DNA, 1494 bp, Chlamydia trachomatis; identical to SEQ ID NO: 28771
  CDS (1)..(1494)

SEQ ID NO: 69853 - protein, 497 aa, Chlamydia trachomatis; identical to SEQ ID NO: 28772

SEQ ID NO: 69854 - DNA, 1431 bp, Helicobacter pylori; identical to SEQ ID NO: 28773
  CDS (1)..(1431)

SEQ ID NO: 69855 - protein, 476 aa, Helicobacter pylori; identical to SEQ ID NO: 28774

SEQ ID NO: 69856 - DNA, 1302 bp, Clostridium acetobutylicum; identical to SEQ ID NO: 28775
  CDS (1)..(1302)

SEQ ID NO: 69857 - protein, 433 aa, Clostridium acetobutylicum; identical to SEQ ID NO: 28776

SEQ ID NO: 69858 - DNA, 2009 bp, Brucella abortus; identical to SEQ ID NO: 28777
  CDS (275)..(1816)

SEQ ID NO: 69859 - protein, 513 aa, Brucella abortus; identical to SEQ ID NO: 28778

SEQ ID NO: 69860 - DNA, 1185 bp, Synechocystis sp; identical to SEQ ID NO: 28779
  CDS (1)..(1185)

SEQ ID NO: 69861 - protein, 394 aa, Synechocystis sp; identical to SEQ ID NO: 28780

SEQ ID NO: 69862 - DNA, 1251 bp, Synechocystis sp; identical to SEQ ID NO: 28781
  CDS (1)..(1251)

SEQ ID NO: 69863 - protein, 416 aa, Synechocystis sp; identical to SEQ ID NO: 28782

SEQ ID NO: 69864 - DNA, 1359 bp, Synechocystis sp; identical to SEQ ID NO: 28783
  CDS (1)..(1359)

SEQ ID NO: 69865 - protein, 452 aa, Synechocystis sp; identical to SEQ ID NO: 28784

SEQ ID NO: 69866 - DNA, 1740 bp, Lactococcus lactis; identical to SEQ ID NO: 28785
  CDS (230)..(1456)

SEQ ID NO: 69867 - protein, 408 aa, Lactococcus lactis; identical to SEQ ID NO: 28786

SEQ ID NO: 69868 - DNA, 1383 bp, Rhodobacter capsulatus; identical to SEQ ID NO: 28787
  CDS (1)..(1383)

SEQ ID NO: 69869 - protein, 460 aa, Rhodobacter capsulatus; identical to SEQ ID NO: 28788

SEQ ID NO: 69870 - DNA, 1392 bp, Haemophilus influenzae; identical to SEQ ID NO: 28789
  CDS (1)..(1392)

SEQ ID NO: 69871 - protein, 463 aa, Haemophilus influenzae; identical to SEQ ID NO: 28790

SEQ ID NO: 69872 - DNA, 1800 bp, Yersinia enterocolitica; identical to SEQ ID NO: 28791
  CDS (244)..(1680)

SEQ ID NO: 69873 - protein, 478 aa, Yersinia enterocolitica; identical to SEQ ID NO: 28792

SEQ ID NO: 69874 - DNA, 2027 bp, Azotobacter vinelandii; identical to SEQ ID NO: 28793
  CDS (483)..(1904)

SEQ ID NO: 69875 - protein, 473 aa, Azotobacter vinelandii; identical to SEQ ID NO: 28794

SEQ ID NO: 69876 - DNA, 1905 bp, Brucella abortus; identical to SEQ ID NO: 28795
  CDS (333)..(1835)

SEQ ID NO: 69877 - protein, 500 aa, Brucella abortus; identical to SEQ ID NO: 28796

SEQ ID NO: 69878 - DNA, 1466 bp, Campylobacter jejuni; identical to SEQ ID NO: 28797
  CDS (48)..(1466)

SEQ ID NO: 69879 - protein, 472 aa, Campylobacter jejuni; identical to SEQ ID NO: 28798

SEQ ID NO: 69880 - DNA, 1191 bp, Pseudomonas aeruginosa; identical to SEQ ID NO: 28799
  CDS (14)..(1183)

SEQ ID NO: 69881 - protein, 389 aa, Pseudomonas aeruginosa; identical to SEQ ID NO: 28800

SEQ ID NO: 69882 - DNA, 1488 bp, Burkholderia mallei ATCC 23344; identical to SEQ ID NO: 28801
  CDS (1)..(1488)

SEQ ID NO: 69883 - protein, 495 aa, Burkholderia mallei ATCC 23344; identical to SEQ ID NO: 28802

SEQ ID NO: 69884 - DNA, 1209 bp, Burkholderia pseudomallei K96243; identical to SEQ ID NO: 28803
  CDS (1)..(1209)

SEQ ID NO: 69885 - protein, 402 aa, Burkholderia pseudomallei K96243; identical to SEQ ID NO: 28804

SEQ ID NO: 69886 - DNA, 1458 bp, Burkholderia pseudomallei K96243; identical to SEQ ID NO: 28805
  CDS (1)..(1458)

SEQ ID NO: 69887 - protein, 485 aa, Burkholderia pseudomallei K96243; identical to SEQ ID NO: 28806

SEQ ID NO: 69888 - DNA, 1557 bp, Burkholderia pseudomallei K96243; identical to SEQ ID NO: 28807
  CDS (1)..(1557)

SEQ ID NO: 69889 - protein, 518 aa, Burkholderia pseudomallei K96243; identical to SEQ ID NO: 28808

SEQ ID NO: 69890 - DNA, 1419 bp, Burkholderia pseudomallei K96243; identical to SEQ ID NO: 28809
  CDS (1)..(1419)

SEQ ID NO: 69891 - protein, 472 aa, Burkholderia pseudomallei K96243; identical to SEQ ID NO: 28810

SEQ ID NO: 69892 - DNA, 1566 bp, Bacteroides fragilis; identical to SEQ ID NO: 28811
  CDS (19)..(1566)

SEQ ID NO: 69893 - protein, 515 aa, Bacteroides fragilis; identical to SEQ ID NO: 28812

SEQ ID NO: 69894 - DNA, 2358 bp, Bacillus licheniformis DSM 13; identical to SEQ ID NO: 28813
  CDS (501)..(1871)

SEQ ID NO: 69895 - protein, 456 aa, Bacillus licheniformis DSM 13; identical to SEQ ID NO: 28814

SEQ ID NO: 69896 - DNA, 1470 bp, Mannheimia succiniciproducens MBEL55E; identical to SEQ ID NO: 28815
  CDS (1)..(1470)

SEQ ID NO: 69897 - protein, 489 aa, Mannheimia succiniciproducens MBEL55E; identical to SEQ ID NO: 28816

SEQ ID NO: 69898 - DNA, 1425 bp, Borrelia garinii PBi; identical to SEQ ID NO: 28817
  CDS (1)..(1425)

SEQ ID NO: 69899 - protein, 474 aa, Borrelia garinii PBi; identical to SEQ ID NO: 28818

SEQ ID NO: 69900 - DNA, 1224 bp, Lactococcus lactis; identical to SEQ ID NO: 28819
  CDS (1)..(1224)

SEQ ID NO: 69901 - protein, 407 aa, Lactococcus lactis; identical to SEQ ID NO: 28820

SEQ ID NO: 69902 - DNA, 1557 bp, Rickettsia typhi; identical to SEQ ID NO: 28821
  CDS (1)..(1557)

SEQ ID NO: 69903 - protein, 518 aa, Rickettsia typhi; identical to SEQ ID NO: 28822

SEQ ID NO: 69904 - DNA, 1485 bp, Onchocerca volvulus endobacterium; identical to SEQ ID NO: 28823
  CDS (1)..(1485)

SEQ ID NO: 69905 - protein, 494 aa, Onchocerca volvulus endobacterium; identical to SEQ ID NO: 28824

SEQ ID NO: 69906 - DNA, 1455 bp, Desulfotalea psychrophila; identical to SEQ ID NO: 28825
  CDS (1)..(1455)

SEQ ID NO: 69907 - protein, 484 aa, Desulfotalea psychrophila; identical to SEQ ID NO: 28826

SEQ ID NO: 69908 - DNA, 1467 bp, Erwinia carotovora; identical to SEQ ID NO: 28827
  CDS (1)..(1467)

SEQ ID NO: 69909 - protein, 488 aa, Erwinia carotovora; identical to SEQ ID NO: 28828

SEQ ID NO: 69910 - DNA, 1371 bp, Erwinia carotovora; identical to SEQ ID NO: 28829
  CDS (1)..(1371)

SEQ ID NO: 69911 - protein, 456 aa, Erwinia carotovora; identical to SEQ ID NO: 28830

SEQ ID NO: 69912 - DNA, 1404 bp, Acinetobacter sp; identical to SEQ ID NO: 28831
  CDS (1)..(1404)

SEQ ID NO: 69913 - protein, 467 aa, Acinetobacter sp; identical to SEQ ID NO: 28832

SEQ ID NO: 69914 - DNA, 1518 bp, Bartonella quintana; identical to SEQ ID NO: 28833
  CDS (1)..(1518)

SEQ ID NO: 69915 - protein, 505 aa, Bartonella quintana; identical to SEQ ID NO: 28834

SEQ ID NO: 69916 - DNA, 1395 bp, Bartonella quintana; identical to SEQ ID NO: 28835
  CDS (1)..(1395)

SEQ ID NO: 69917 - protein, 464 aa, Bartonella quintana; identical to SEQ ID NO: 28836

SEQ ID NO: 69918 - DNA, 1512 bp, Bartonella quintana; identical to SEQ ID NO: 28837
  CDS (1)..(1512)

SEQ ID NO: 69919 - protein, 503 aa, Bartonella quintana; identical to SEQ ID NO: 28838

SEQ ID NO: 69920 - DNA, 1518 bp, Bartonella henselae; identical to SEQ ID NO: 28839
  CDS (1)..(1518)

SEQ ID NO: 69921 - protein, 505 aa, Bartonella henselae; identical to SEQ ID NO: 28840

SEQ ID NO: 69922 - DNA, 1392 bp, Bartonella henselae; identical to SEQ ID NO: 28841
  CDS (1)..(1392)

SEQ ID NO: 69923 - protein, 463 aa, Bartonella henselae; identical to SEQ ID NO: 28842

SEQ ID NO: 69924 - DNA, 1368 bp, Photobacterium profundum; identical to SEQ ID NO: 28843
  CDS (1)..(1368)

SEQ ID NO: 69925 - protein, 455 aa, Photobacterium profundum; identical to SEQ ID NO: 28844

SEQ ID NO: 69926 - DNA, 1455 bp, Parachlamydia sp; identical to SEQ ID NO: 28845
  CDS (1)..(1455)

SEQ ID NO: 69927 - protein, 484 aa, Parachlamydia sp; identical to SEQ ID NO: 28846

SEQ ID NO: 69928 - DNA, 1563 bp, Rhodopseudomonas palustris; identical to SEQ ID NO: 28847
  CDS (1)..(1563)

SEQ ID NO: 69929 - protein, 520 aa, Rhodopseudomonas palustris; identical to SEQ ID NO: 28848

SEQ ID NO: 69930 - DNA, 1506 bp, Rhodopseudomonas palustris; identical to SEQ ID NO: 28849
  CDS (1)..(1506)

SEQ ID NO: 69931 - protein, 501 aa, Rhodopseudomonas palustris; identical to SEQ ID NO: 28850

SEQ ID NO: 69932 - DNA, 1200 bp, Rhodopseudomonas palustris; identical to SEQ ID NO: 28851
  CDS (1)..(1200)

SEQ ID NO: 69933 - protein, 399 aa, Rhodopseudomonas palustris; identical to SEQ ID NO: 28852

SEQ ID NO: 69934 - DNA, 1392 bp, Rhodopseudomonas palustris; identical to SEQ ID NO: 28853
  CDS (1)..(1392)

SEQ ID NO: 69935 - protein, 463 aa, Rhodopseudomonas palustris; identical to SEQ ID NO: 28854

SEQ ID NO: 69936 - DNA, 1572 bp, Rhodopseudomonas palustris; identical to SEQ ID NO: 28855
  CDS (1)..(1572)

SEQ ID NO: 69937 - protein, 523 aa, Rhodopseudomonas palustris; identical to SEQ ID NO: 28856

SEQ ID NO: 69938 - DNA, 1401 bp, uncultured bacterium 580; identical to SEQ ID NO: 28857
  CDS (1)..(1401)

SEQ ID NO: 69939 - protein, 466 aa, uncultured bacterium 580; identical to SEQ ID NO: 28858

SEQ ID NO: 69940 - DNA, 1476 bp, uncultured bacterium 106; identical to SEQ ID NO: 28859
  CDS (1)..(1476)

SEQ ID NO: 69941 - protein, 491 aa, uncultured bacterium 106; identical to SEQ ID NO: 28860

SEQ ID NO: 69942 - DNA, 1143 bp, uncultured bacterium 105; identical to SEQ ID NO: 28861
  CDS (1)..(1143)

SEQ ID NO: 69943 - protein, 380 aa, uncultured bacterium 105; identical to SEQ ID NO: 28862

SEQ ID NO: 69944 - DNA, 1395 bp, Rhizobium sp; identical to SEQ ID NO: 28863
  CDS (1)..(1395)

SEQ ID NO: 69945 - protein, 464 aa, Rhizobium sp; identical to SEQ ID NO: 28864

SEQ ID NO: 69946 - DNA, 1449 bp, Desulfovibrio vulgaris; identical to SEQ ID NO: 28865
  CDS (1)..(1449)

SEQ ID NO: 69947 - protein, 482 aa, Desulfovibrio vulgaris; identical to SEQ ID NO: 28866

SEQ ID NO: 69948 - DNA, 1167 bp, Leptospira interrogans; identical to SEQ ID NO: 28867
  CDS (1)..(1167)

SEQ ID NO: 69949 - protein, 388 aa, Leptospira interrogans; identical to SEQ ID NO: 28868

SEQ ID NO: 69950 - DNA, 1494 bp, Wolbachia pipientis wMel; identical to SEQ ID NO: 28869
  CDS (1)..(1494)

SEQ ID NO: 69951 - protein, 497 aa, Wolbachia pipientis wMel; identical to SEQ ID NO: 28870

SEQ ID NO: 69952 - DNA, 1482 bp, Treponema denticola; identical to SEQ ID NO: 28871
  CDS (1)..(1482)

SEQ ID NO: 69953 - protein, 493 aa, Treponema denticola; identical to SEQ ID NO: 28872

SEQ ID NO: 69954 - DNA, 1395 bp, Geobacter sulfurreducens; identical to SEQ ID NO: 28873
  CDS (1)..(1395)

SEQ ID NO: 69955 - protein, 464 aa, Geobacter sulfurreducens; identical to SEQ ID NO: 28874

SEQ ID NO: 69956 - DNA, 1416 bp, Geobacter sulfurreducens; identical to SEQ ID NO: 28875
  CDS (1)..(1416)

SEQ ID NO: 69957 - protein, 471 aa, Geobacter sulfurreducens; identical to SEQ ID NO: 28876

SEQ ID NO: 69958 - DNA, 1221 bp, Lactobacillus johnsonii; identical to SEQ ID NO: 28877
  CDS (1)..(1221)

SEQ ID NO: 69959 - protein, 406 aa, Lactobacillus johnsonii; identical to SEQ ID NO: 28878

SEQ ID NO: 69960 - DNA, 1425 bp, Wolinella succinogenes; identical to SEQ ID NO: 28879
  CDS (1)..(1425)

SEQ ID NO: 69961 - protein, 474 aa, Wolinella succinogenes; identical to SEQ ID NO: 28880

SEQ ID NO: 69962 - DNA, 1368 bp, Vibrio vulnificus; identical to SEQ ID NO: 28881
  CDS (1)..(1368)

SEQ ID NO: 69963 - protein, 455 aa, Vibrio vulnificus; identical to SEQ ID NO: 28882

SEQ ID NO: 69964 - DNA, 1497 bp, Porphyromonas gingivalis; identical to SEQ ID NO: 28883
  CDS (1)..(1497)

SEQ ID NO: 69965 - protein, 498 aa, Porphyromonas gingivalis; identical to SEQ ID NO: 28884

SEQ ID NO: 69966 - DNA, 1320 bp, Gloeobacter violaceus; identical to SEQ ID NO: 28885
  CDS (1)..(1320)

SEQ ID NO: 69967 - protein, 439 aa, Gloeobacter violaceus; identical to SEQ ID NO: 28886

SEQ ID NO: 69968 - DNA, 1467 bp, Chromobacterium violaceum; identical to SEQ ID NO: 28887
  CDS (1)..(1467)

SEQ ID NO: 69969 - protein, 488 aa, Chromobacterium violaceum; identical to SEQ ID NO: 28888

SEQ ID NO: 69970 - DNA, 1413 bp, Chromobacterium violaceum; identical to SEQ ID NO: 28889
  CDS (1)..(1413)

SEQ ID NO: 69971 - protein, 470 aa, Chromobacterium violaceum; identical to SEQ ID NO: 28890

SEQ ID NO: 69972 - DNA, 1158 bp, Prochlorococcus marinus; identical to SEQ ID NO: 28891
  CDS (1)..(1158)

SEQ ID NO: 69973 - protein, 385 aa, Prochlorococcus marinus; identical to SEQ ID NO: 28892

SEQ ID NO: 69974 - DNA, 1125 bp, Synechococcus sp; identical to SEQ ID NO: 28893
  CDS (1)..(1125)

SEQ ID NO: 69975 - protein, 374 aa, Synechococcus sp; identical to SEQ ID NO: 28894

SEQ ID NO: 69976 - DNA, 1299 bp, Synechococcus sp; identical to SEQ ID NO: 28895
  CDS (1)..(1299)

SEQ ID NO: 69977 - protein, 432 aa, Synechococcus sp; identical to SEQ ID NO: 28896

SEQ ID NO: 69978 - DNA, 1527 bp, Rhodopirellula baltica; identical to SEQ ID NO: 28897
  CDS (1)..(1527)

SEQ ID NO: 69979 - protein, 508 aa, Rhodopirellula baltica; identical to SEQ ID NO: 28898

SEQ ID NO: 69980 - DNA, 1530 bp, Rhodopirellula baltica; identical to SEQ ID NO: 28899
  CDS (1)..(1530)

SEQ ID NO: 69981 - protein, 509 aa, Rhodopirellula baltica; identical to SEQ ID NO: 28900

SEQ ID NO: 69982 - DNA, 1890 bp, Rhodopirellula baltica; identical to SEQ ID NO: 28901
  CDS (1)..(1890)

SEQ ID NO: 69983 - protein, 629 aa, Rhodopirellula baltica; identical to SEQ ID NO: 28902

SEQ ID NO: 69984 - DNA, 1188 bp, Prochlorococcus marinus; identical to SEQ ID NO: 28903
  CDS (1)..(1188)

SEQ ID NO: 69985 - protein, 395 aa, Prochlorococcus marinus; identical to SEQ ID NO: 28904

SEQ ID NO: 69986 - DNA, 1176 bp, Prochlorococcus marinus; identical to SEQ ID NO: 28905
  CDS (1)..(1176)

SEQ ID NO: 69987 - protein, 391 aa, Prochlorococcus marinus; identical to SEQ ID NO: 28906

SEQ ID NO: 69988 - DNA, 1434 bp, Helicobacter hepaticus; identical to SEQ ID NO: 28907
  CDS (1)..(1434)

SEQ ID NO: 69989 - protein, 477 aa, Helicobacter hepaticus; identical to SEQ ID NO: 28908

SEQ ID NO: 69990 - DNA, 1419 bp, Haemophilus ducreyi; identical to SEQ ID NO: 28909
  CDS (1)..(1419)

SEQ ID NO: 69991 - protein, 472 aa, Haemophilus ducreyi; identical to SEQ ID NO: 28910

SEQ ID NO: 69992 - DNA, 1386 bp, Candidatus Blochmannia floridanus; identical to SEQ ID NO: 28911
  CDS (1)..(1386)

SEQ ID NO: 69993 - protein, 461 aa, Candidatus Blochmannia floridanus; identical to SEQ ID NO: 28912

SEQ ID NO: 69994 - DNA, 1137 bp, Bordetella pertussis; identical to SEQ ID NO: 28913
  CDS (1)..(1137)

SEQ ID NO: 69995 - protein, 378 aa, Bordetella pertussis; identical to SEQ ID NO: 28914

SEQ ID NO: 69996 - DNA, 1116 bp, Bordetella parapertussis; identical to SEQ ID NO: 28915
  CDS (1)..(1116)

SEQ ID NO: 69997 - protein, 371 aa, Bordetella parapertussis; identical to SEQ ID NO: 28916

SEQ ID NO: 69998 - DNA, 1488 bp, Bordetella parapertussis; identical to SEQ ID NO: 28917
  CDS (1)..(1488)

SEQ ID NO: 69999 - protein, 495 aa, Bordetella parapertussis; identical to SEQ ID NO: 28918

SEQ ID NO: 70000 - DNA, 1467 bp, Chlamydophila caviae; identical to SEQ ID NO: 28919
  CDS (1)..(1467)

SEQ ID NO: 70001 - protein, 488 aa, Chlamydophila caviae; identical to SEQ ID NO: 28920

SEQ ID NO: 70002 - DNA, 1419 bp, Streptomyces avermitilis; identical to SEQ ID NO: 28921
  CDS (1)..(1419)

SEQ ID NO: 70003 - protein, 472 aa, Streptomyces avermitilis; identical to SEQ ID NO: 28922

SEQ ID NO: 70004 - DNA, 1491 bp, Nitrosomonas europaea; identical to SEQ ID NO: 28923
  CDS (1)..(1491)

SEQ ID NO: 70005 - protein, 496 aa, Nitrosomonas europaea; identical to SEQ ID NO: 28924

SEQ ID NO: 70006 - DNA, 1323 bp, Enterococcus faecalis; identical to SEQ ID NO: 28925
  CDS (25)..(1323)

SEQ ID NO: 70007 - protein, 432 aa, Enterococcus faecalis; identical to SEQ ID NO: 28926

SEQ ID NO: 70008 - DNA, 1356 bp, Coxiella burnetii; identical to SEQ ID NO: 28927
  CDS (1)..(1356)

SEQ ID NO: 70009 - protein, 451 aa, Coxiella burnetii; identical to SEQ ID NO: 28928

SEQ ID NO: 70010 - DNA, 1368 bp, Enterobacter cloacae; identical to SEQ ID NO: 28929
  CDS (1)..(1368)

SEQ ID NO: 70011 - protein, 455 aa, Enterobacter cloacae; identical to SEQ ID NO: 28930

SEQ ID NO: 70012 - DNA, 1545 bp, Xylella fastidiosa; identical to SEQ ID NO: 28931
  CDS (1)..(1545)

SEQ ID NO: 70013 - protein, 514 aa, Xylella fastidiosa; identical to SEQ ID NO: 28932

SEQ ID NO: 70014 - DNA, 1377 bp, Xylella fastidiosa; identical to SEQ ID NO: 28933
  CDS (1)..(1377)

SEQ ID NO: 70015 - protein, 458 aa, Xylella fastidiosa; identical to SEQ ID NO: 28934

SEQ ID NO: 70016 - DNA, 1368 bp, Vibrio parahaemolyticus; identical to SEQ ID NO: 28935
  CDS (1)..(1368)

SEQ ID NO: 70017 - protein, 455 aa, Vibrio parahaemolyticus; identical to SEQ ID NO: 28936

SEQ ID NO: 70018 - DNA, 1161 bp, Pseudomonas syringae; identical to SEQ ID NO: 28937
  CDS (1)..(1161)

SEQ ID NO: 70019 - protein, 386 aa, Pseudomonas syringae; identical to SEQ ID NO: 28938

SEQ ID NO: 70020 - DNA, 1440 bp, Pseudomonas syringae; identical to SEQ ID NO: 28939
  CDS (1)..(1440)

SEQ ID NO: 70021 - protein, 479 aa, Pseudomonas syringae; identical to SEQ ID NO: 28940

SEQ ID NO: 70022 - DNA, 1479 bp, Pseudomonas putida; identical to SEQ ID NO: 28941
  CDS (1)..(1479)

SEQ ID NO: 70023 - protein, 492 aa, Pseudomonas putida; identical to SEQ ID NO: 28942

SEQ ID NO: 70024 - DNA, 1524 bp, Bradyrhizobium japonicum; identical to SEQ ID NO: 28943
  CDS (1)..(1524)

SEQ ID NO: 70025 - protein, 507 aa, Bradyrhizobium japonicum; identical to SEQ ID NO: 28944

SEQ ID NO: 70026 - DNA, 1272 bp, Bradyrhizobium japonicum; identical to SEQ ID NO: 28945
  CDS (1)..(1272)

SEQ ID NO: 70027 - protein, 423 aa, Bradyrhizobium japonicum; identical to SEQ ID NO: 28946

SEQ ID NO: 70028 - DNA, 1578 bp, Bradyrhizobium japonicum; identical to SEQ ID NO: 28947
  CDS (1)..(1578)

SEQ ID NO: 70029 - protein, 525 aa, Bradyrhizobium japonicum; identical to SEQ ID NO: 28948

SEQ ID NO: 70030 - DNA, 1587 bp, Bradyrhizobium japonicum; identical to SEQ ID NO: 28949
  CDS (1)..(1587)

SEQ ID NO: 70031 - protein, 528 aa, Bradyrhizobium japonicum; identical to SEQ ID NO: 28950

SEQ ID NO: 70032 - DNA, 1536 bp, Bacteroides thetaiotaomicron; identical to SEQ ID NO: 28951
  CDS (1)..(1536)

SEQ ID NO: 70033 - protein, 511 aa, Bacteroides thetaiotaomicron; identical to SEQ ID NO: 28952

SEQ ID NO: 70034 - DNA, 1410 bp, Escherichia coli O6; identical to SEQ ID NO: 28953
  CDS (1)..(1410)

SEQ ID NO: 70035 - protein, 469 aa, Escherichia coli O6; identical to SEQ ID NO: 28954

SEQ ID NO: 70036 - DNA, 1392 bp, Yersinia pestis; identical to SEQ ID NO: 28955
  CDS (1)..(1392)

SEQ ID NO: 70037 - protein, 463 aa, Yersinia pestis; identical to SEQ ID NO: 28956

SEQ ID NO: 70038 - DNA, 1374 bp, Wigglesworthia glossinidia brevipalpis; identical to SEQ ID NO: 28957
  CDS (1)..(1374)

SEQ ID NO: 70039 - protein, 457 aa, Wigglesworthia glossinidia brevipalpis; identical to SEQ ID NO: 28958

SEQ ID NO: 70040 - DNA, 1128 bp, Synechococcus elongatus; identical to SEQ ID NO: 28959
  CDS (1)..(1128)

SEQ ID NO: 70041 - protein, 375 aa, Synechococcus elongatus; identical to SEQ ID NO: 28960

SEQ ID NO: 70042 - DNA, 1170 bp, Synechococcus elongatus; identical to SEQ ID NO: 28961
  CDS (1)..(1170)

SEQ ID NO: 70043 - protein, 389 aa, Synechococcus elongatus; identical to SEQ ID NO: 28962

SEQ ID NO: 70044 - DNA, 1353 bp, Shewanella oneidensis; identical to SEQ ID NO: 28963
  CDS (1)..(1353)

SEQ ID NO: 70045 - protein, 450 aa, Shewanella oneidensis; identical to SEQ ID NO: 28964

SEQ ID NO: 70046 - DNA, 1518 bp, Chlorobium tepidum; identical to SEQ ID NO: 28965
  CDS (1)..(1518)

SEQ ID NO: 70047 - protein, 505 aa, Chlorobium tepidum; identical to SEQ ID NO: 28966

SEQ ID NO: 70048 - DNA, 1461 bp, Rhizobium etli; identical to SEQ ID NO: 28967
  CDS (1)..(1461)

SEQ ID NO: 70049 - protein, 486 aa, Rhizobium etli; identical to SEQ ID NO: 28968

SEQ ID NO: 70050 - DNA, 1368 bp, Pasteurella piscicida; identical to SEQ ID NO: 28969
  CDS (1)..(1368)

SEQ ID NO: 70051 - protein, 455 aa, Pasteurella piscicida; identical to SEQ ID NO: 28970

SEQ ID NO: 70052 - DNA, 1437 bp, Xanthomonas campestris; identical to SEQ ID NO: 28971
  CDS (1)..(1437)

SEQ ID NO: 70053 - protein, 478 aa, Xanthomonas campestris; identical to SEQ ID NO: 28972

SEQ ID NO: 70054 - DNA, 1437 bp, Xanthomonas axonopodis; identical to SEQ ID NO: 28973
  CDS (1)..(1437)

SEQ ID NO: 70055 - protein, 478 aa, Xanthomonas axonopodis; identical to SEQ ID NO: 28974

SEQ ID NO: 70056 - DNA, 1578 bp, Xanthomonas axonopodis; identical to SEQ ID NO: 28975
  CDS (1)..(1578)

SEQ ID NO: 70057 - protein, 525 aa, Xanthomonas axonopodis; identical to SEQ ID NO: 28976

SEQ ID NO: 70058 - DNA, 2077 bp, Klebsiella pneumoniae; identical to SEQ ID NO: 28977
  CDS (374)..(1807)

SEQ ID NO: 70059 - protein, 477 aa, Klebsiella pneumoniae; identical to SEQ ID NO: 28978

SEQ ID NO: 70060 - DNA, 1536 bp, Xanthomonas campestris; identical to SEQ ID NO: 28979
  CDS (1)..(1536)

SEQ ID NO: 70061 - protein, 511 aa, Xanthomonas campestris; identical to SEQ ID NO: 28980

SEQ ID NO: 70062 - DNA, 1473 bp, Ralstonia solanacearum; identical to SEQ ID NO: 28981
  CDS (1)..(1473)

SEQ ID NO: 70063 - protein, 490 aa, Ralstonia solanacearum; identical to SEQ ID NO: 28982

SEQ ID NO: 70064 - DNA, 1518 bp, Ralstonia solanacearum; identical to SEQ ID NO: 28983
  CDS (1)..(1518)

SEQ ID NO: 70065 - protein, 505 aa, Ralstonia solanacearum; identical to SEQ ID NO: 28984

SEQ ID NO: 70066 - DNA, 1368 bp, Salmonella typhimurium; identical to SEQ ID NO: 28985
  CDS (1)..(1368)

SEQ ID NO: 70067 - protein, 455 aa, Salmonella typhimurium; identical to SEQ ID NO: 28986

SEQ ID NO: 70068 - DNA, 1512 bp, Rhizobium meliloti; identical to SEQ ID NO: 28987
  CDS (1)..(1512)

SEQ ID NO: 70069 - protein, 503 aa, Rhizobium meliloti; identical to SEQ ID NO: 28988

SEQ ID NO: 70070 - DNA, 1398 bp, Rhizobium meliloti; identical to SEQ ID NO: 28989
  CDS (1)..(1398)

SEQ ID NO: 70071 - protein, 465 aa, Rhizobium meliloti; identical to SEQ ID NO: 28990

SEQ ID NO: 70072 - DNA, 1551 bp, Rhizobium loti; identical to SEQ ID NO: 28991
  CDS (1)..(1551)

SEQ ID NO: 70073 - protein, 516 aa, Rhizobium loti; identical to SEQ ID NO: 28992

SEQ ID NO: 70074 - DNA, 1542 bp, Rhizobium loti; identical to SEQ ID NO: 28993
  CDS (1)..(1542)

SEQ ID NO: 70075 - protein, 513 aa, Rhizobium loti; identical to SEQ ID NO: 28994

SEQ ID NO: 70076 - DNA, 1515 bp, Rhizobium loti; identical to SEQ ID NO: 28995
  CDS (1)..(1515)

SEQ ID NO: 70077 - protein, 504 aa, Rhizobium loti; identical to SEQ ID NO: 28996

SEQ ID NO: 70078 - DNA, 1287 bp, Rhizobium loti; identical to SEQ ID NO: 28997
  CDS (1)..(1287)

SEQ ID NO: 70079 - protein, 428 aa, Rhizobium loti; identical to SEQ ID NO: 28998

SEQ ID NO: 70080 - DNA, 1446 bp, Pseudomonas syringae; identical to SEQ ID NO: 28999
  CDS (1)..(1446)

SEQ ID NO: 70081 - protein, 481 aa, Pseudomonas syringae; identical to SEQ ID NO: 29000

SEQ ID NO: 70082 - DNA, 1380 bp, Pasteurella multocida; identical to SEQ ID NO: 29001
  CDS (1)..(1380)

SEQ ID NO: 70083 - protein, 459 aa, Pasteurella multocida; identical to SEQ ID NO: 29002

SEQ ID NO: 70084 - DNA, 1362 bp, Aeromonas hydrophila; identical to SEQ ID NO: 29003
  CDS (1)..(1362)

SEQ ID NO: 70085 - protein, 453 aa, Aeromonas hydrophila; identical to SEQ ID NO: 29004

SEQ ID NO: 70086 - DNA, 1503 bp, Myxococcus xanthus; identical to SEQ ID NO: 29005
  CDS (1)..(1503)

SEQ ID NO: 70087 - protein, 500 aa, Myxococcus xanthus; identical to SEQ ID NO: 29006

SEQ ID NO: 70088 - DNA, 1476 bp, Shigella sonnei; identical to SEQ ID NO: 29007
  CDS (1)..(1476)

SEQ ID NO: 70089 - protein, 491 aa, Shigella sonnei; identical to SEQ ID NO: 29008

SEQ ID NO: 70090 - DNA, 1512 bp, Bartonella henselae; identical to SEQ ID NO: 29009
  CDS (1)..(1512)

SEQ ID NO: 70091 - protein, 503 aa, Bartonella henselae; identical to SEQ ID NO: 29010

SEQ ID NO: 70092 - DNA, 1437 bp, Buchnera aphidicola; identical to SEQ ID NO: 29011
  CDS (1)..(1437)

SEQ ID NO: 70093 - protein, 478 aa, Buchnera aphidicola; identical to SEQ ID NO: 29012

SEQ ID NO: 70094 - DNA, 1515 bp, Rhizobium meliloti; identical to SEQ ID NO: 29013
  CDS (1)..(1515)

SEQ ID NO: 70095 - protein, 504 aa, Rhizobium meliloti; identical to SEQ ID NO: 29014

SEQ ID NO: 70096 - DNA, 1377 bp, Bacillus subtilis; identical to SEQ ID NO: 29015
  CDS (1)..(1377)

SEQ ID NO: 70097 - protein, 458 aa, Bacillus subtilis; identical to SEQ ID NO: 29016

SEQ ID NO: 70098 - DNA, 24 bp, Primer
atgaaaaaaaccacattagcactg

SEQ ID NO: 70099 - DNA, 25 bp, Primer
ttactgcattaacaggtagatggtg

SEQ ID NO: 70100 - protein, 406 aa, consensus; identical to SEQ ID NO: 29019
  MISC_FEATURE (1)..(406): consensus for the disclosure of xaa see table XV

SEQ ID NO: 70101 - protein, 66 aa, consensus; identical to SEQ ID NO: 29020
  MISC_FEATURE (1)..(66): consensus for the disclosure of xaa see table XV

SEQ ID NO: 70102 - protein, 37 aa, consensus; identical to SEQ ID NO: 29021
  MISC_FEATURE (1)..(37): consensus for the disclosure of xaa see table XV

SEQ ID NO: 70103 - protein, 30 aa, consensus; identical to SEQ ID NO: 29022
  MISC_FEATURE (1)..(30): consensus for the disclosure of xaa see table XV

SEQ ID NO: 70104 - protein, 34 aa, consensus; identical to SEQ ID NO: 29023
  MISC_FEATURE (1)..(34): consensus for the disclosure of xaa see table XV

SEQ ID NO: 70105 - protein, 68 aa, consensus; identical to SEQ ID NO: 29024
  MISC_FEATURE (1)..(68): consensus for the disclosure of xaa see table XV

SEQ ID NO: 70106 - DNA, 1259 bp, Escherichia coli K12; identical to SEQ ID NO: 9931
  CDS (190)..(939)

SEQ ID NO: 70107 - protein, 249 aa, Escherichia coli K12; identical to SEQ ID NO: 9932

SEQ ID NO: 70108 - DNA, 798 bp, Neisseria meningitidis; identical to SEQ ID NO: 9933
  CDS (1)..(798)

SEQ ID NO: 70109 - protein, 265 aa, Neisseria meningitidis; identical to SEQ ID NO: 9934

SEQ ID NO: 70110 - DNA, 855 bp, Xylella fastidiosa; identical to SEQ ID NO: 9935
  CDS (1)..(855)

SEQ ID NO: 70111 - protein, 284 aa, Xylella fastidiosa; identical to SEQ ID NO: 9936

SEQ ID NO: 70112 - DNA, 936 bp, Pseudomonas aeruginosa; identical to SEQ ID NO: 9937
  CDS (1)..(936)

SEQ ID NO: 70113 - protein, 311 aa, Pseudomonas aeruginosa; identical to SEQ ID NO: 9938

SEQ ID NO: 70114 - DNA, 1293 bp, Arabidopsis thaliana (mouse-ear cress); identical to SEQ ID NO: 9939
  CDS (1)..(1293)

SEQ ID NO: 70115 - protein, 430 aa, Arabidopsis thaliana (mouse-ear cress); identical to SEQ ID NO: 9940

SEQ ID NO: 70116 - DNA, 828 bp, Caulobacter crescentus; identical to SEQ ID NO: 9941
  CDS (1)..(828)

SEQ ID NO: 70117 - protein, 275 aa, Caulobacter crescentus; identical to SEQ ID NO: 9942

SEQ ID NO: 70118 - DNA, 930 bp, Yersinia pestis; identical to SEQ ID NO: 9943
  CDS (1)..(930)

SEQ ID NO: 70119 - protein, 309 aa, Yersinia pestis; identical to SEQ ID NO: 9944

SEQ ID NO: 70120 - DNA, 834 bp, Agrobacterium tumefaciens; identical to SEQ ID NO: 9945
  CDS (1)..(834)

SEQ ID NO: 70121 - protein, 277 aa, Agrobacterium tumefaciens; identical to SEQ ID NO: 9946

SEQ ID NO: 70122 - DNA, 885 bp, Nostoc sp. PCC 7120; identical to SEQ ID NO: 9947
  CDS (1)..(885)

SEQ ID NO: 70123 - protein, 294 aa, Nostoc sp. PCC 7120; identical to SEQ ID NO: 9948

SEQ ID NO: 70124 - DNA, 858 bp, Salmonella enterica subsp. enterica serovar Typhi; identical to SEQ ID NO: 9949
  CDS (1)..(858)

SEQ ID NO: 70125 - protein, 285 aa, Salmonella enterica subsp. enterica serovar Typhi; identical to SEQ ID NO: 9950

SEQ ID NO: 70126 - DNA, 849 bp, Yersinia pestis; identical to SEQ ID NO: 9951
  CDS (1)..(849)

SEQ ID NO: 70127 - protein, 282 aa, Yersinia pestis; identical to SEQ ID NO: 9952

SEQ ID NO: 70128 - DNA, 855 bp, Deinococcus radiodurans; identical to SEQ ID NO: 9953
  CDS (1)..(855)

SEQ ID NO: 70129 - protein, 284 aa, Deinococcus radiodurans; identical to SEQ ID NO: 9954

SEQ ID NO: 70130 - DNA, 738 bp, Clostridium acetobutylicum; identical to SEQ ID NO: 9955
  CDS (1)..(738)

SEQ ID NO: 70131 - protein, 245 aa, Clostridium acetobutylicum; identical to SEQ ID NO: 9956

SEQ ID NO: 70132 - DNA, 927 bp, Chlamydophila pneumoniae, Chlamydia pneumoniae; identical to SEQ ID NO: 9957
  CDS (1)..(927)

SEQ ID NO: 70133 - protein, 308 aa, Chlamydophila pneumoniae, Chlamydia pneumoniae; identical to SEQ ID NO: 9958

SEQ ID NO: 70134 - DNA, 921 bp, Mycobacterium tuberculosis; identical to SEQ ID NO: 9959
  CDS (1)..(921)

SEQ ID NO: 70135 - protein, 306 aa, Mycobacterium tuberculosis; identical to SEQ ID NO: 9960

SEQ ID NO: 70136 - DNA, 864 bp, Treponema pallidum subsp. pallidum (syphilis spirochete); identical to SEQ ID NO: 9961
  CDS (1)..(864)

SEQ ID NO: 70137 - protein, 287 aa, Treponema pallidum subsp. pallidum (syphilis spirochete); identical to SEQ ID NO: 9962

SEQ ID NO: 70138 - DNA, 918 bp, Chlamydia muridarum, Chlamydia trachomatis MoPn; identical to SEQ ID NO: 9963
  CDS (1)..(918)

SEQ ID NO: 70139 - protein, 305 aa, Chlamydia muridarum, Chlamydia trachomatis MoPn; identical to SEQ ID NO: 9964

SEQ ID NO: 70140 - DNA, 843 bp, Vibrio cholerae; identical to SEQ ID NO: 9965
  CDS (1)..(843)

SEQ ID NO: 70141 - protein, 280 aa, Vibrio cholerae; identical to SEQ ID NO: 9966

SEQ ID NO: 70142 - DNA, 1137 bp, Ureaplasma urealyticum; identical to SEQ ID NO: 9967
  CDS (1)..(1137): transl_table=4

SEQ ID NO: 70143 - protein, 378 aa, Ureaplasma urealyticum; identical to SEQ ID NO: 9968

SEQ ID NO: 70144 - DNA, 693 bp, Rickettsia conorii; identical to SEQ ID NO: 9969
  CDS (1)..(693)

SEQ ID NO: 70145 - protein, 230 aa, Rickettsia conorii; identical to SEQ ID NO: 9970

SEQ ID NO: 70146 - DNA, 918 bp, Chlamydia trachomatis; identical to SEQ ID NO: 9971
  CDS (1)..(918)

SEQ ID NO: 70147 - protein, 305 aa, Chlamydia trachomatis; identical to SEQ ID NO: 9972

SEQ ID NO: 70148 - DNA, 816 bp, Pseudomonas aeruginosa; identical to SEQ ID NO: 9973
  CDS (1)..(816)

SEQ ID NO: 70149 - protein, 271 aa, Pseudomonas aeruginosa; identical to SEQ ID NO: 9974

SEQ ID NO: 70150 - DNA, 795 bp, Bacillus halodurans; identical to SEQ ID NO: 9975
  CDS (1)..(795)

SEQ ID NO: 70151 - protein, 264 aa, Bacillus halodurans; identical to SEQ ID NO: 9976

SEQ ID NO: 70152 - DNA, 867 bp, Haemophilus influenzae; identical to SEQ ID NO: 9977
  CDS (1)..(867)

SEQ ID NO: 70153 - protein, 288 aa, Haemophilus influenzae; identical to SEQ ID NO: 9978

SEQ ID NO: 70154 - DNA, 801 bp, Helicobacter pylori; identical to SEQ ID NO: 9979
  CDS (1)..(801)

SEQ ID NO: 70155 - protein, 266 aa, Helicobacter pylori; identical to SEQ ID NO: 9980

SEQ ID NO: 70156 - DNA, 810 bp, Bacillus subtilis; identical to SEQ ID NO: 9981
  CDS (1)..(810)

SEQ ID NO: 70157 - protein, 269 aa, Bacillus subtilis; identical to SEQ ID NO: 9982

SEQ ID NO: 70158 - DNA, 687 bp, Rickettsia prowazekii; identical to SEQ ID NO: 9983
  CDS (1)..(687)

SEQ ID NO: 70159 - protein, 228 aa, Rickettsia prowazekii; identical to SEQ ID NO: 9984

SEQ ID NO: 70160 - DNA, 939 bp, Mycobacterium leprae; identical to SEQ ID NO: 9985
  CDS (1)..(939)

SEQ ID NO: 70161 - protein, 312 aa, Mycobacterium leprae; identical to SEQ ID NO: 9986

SEQ ID NO: 70162 - DNA, 803 bp, Streptococcus pneumoniae; identical to SEQ ID NO: 9987

SEQ ID NO: 70163 - protein, 267 aa, Streptococcus pneumoniae; identical to SEQ ID NO: 9988

SEQ ID NO: 70164 - DNA, 726 bp, Campylobacter jejuni; identical to SEQ ID NO: 9989
  CDS (1)..(726)

SEQ ID NO: 70165 - protein, 241 aa, Campylobacter jejuni; identical to SEQ ID NO: 9990

SEQ ID NO: 70166 - DNA, 933 bp, Vibrio cholerae; identical to SEQ ID NO: 9991
  CDS (1)..(933)

SEQ ID NO: 70167 - protein, 310 aa, Vibrio cholerae; identical to SEQ ID NO: 9992

SEQ ID NO: 70168 - DNA, 783 bp, Staphylococcus aureus; identical to SEQ ID NO: 9993
  CDS (1)..(783)

SEQ ID NO: 70169 - protein, 260 aa, Staphylococcus aureus; identical to SEQ ID NO: 9994

SEQ ID NO: 70170 - DNA, 882 bp, Synechocystis sp; identical to SEQ ID NO: 9995
  CDS (1)..(882)

SEQ ID NO: 70171 - protein, 293 aa, Synechocystis sp; identical to SEQ ID NO: 9996

SEQ ID NO: 70172 - DNA, 1317 bp, Arabidopsis thaliana (mouse-ear cress); identical to SEQ ID NO: 9997
  CDS (1)..(1317)

SEQ ID NO: 70173 - protein, 438 aa, Arabidopsis thaliana (mouse-ear cress); identical to SEQ ID NO: 9998

SEQ ID NO: 70174 - DNA, 2014 bp, Solanum tuberosum (potato); identical to SEQ ID NO: 9999
  CDS (104)..(1378)

SEQ ID NO: 70175 - protein, 424 aa, Solanum tuberosum (potato); identical to SEQ ID NO: 10000

SEQ ID NO: 70176 - DNA, 1231 bp, Arabidopsis thaliana (mouse-ear cress); identical to SEQ ID NO: 10001
  CDS (1)..(1200)

SEQ ID NO: 70177 - protein, 399 aa, Arabidopsis thaliana (mouse-ear cress); identical to SEQ ID NO: 10002

SEQ ID NO: 70178 - DNA, 978 bp, Corynebacterium glutamicum; identical to SEQ ID NO: 10003
  CDS (65)..(958)

SEQ ID NO: 70179 - protein, 297 aa, Corynebacterium glutamicum; identical to SEQ ID NO: 10004

SEQ ID NO: 70180 - DNA, 765 bp, Wolinella succinogenes; identical to SEQ ID NO: 10005
  CDS (1)..(765)

SEQ ID NO: 70181 - protein, 254 aa, Wolinella succinogenes; identical to SEQ ID NO: 10006

SEQ ID NO: 70182 - DNA, 855 bp, Porphyromonas gingivalis; identical to SEQ ID NO: 10007
  CDS (1)..(855)

SEQ ID NO: 70183 - protein, 284 aa, Porphyromonas gingivalis; identical to SEQ ID NO: 10008

SEQ ID NO: 70184 - DNA, 945 bp, Photorhabdus luminescens; identical to SEQ ID NO: 10009
  CDS (1)..(945)

SEQ ID NO: 70185 - protein, 314 aa, Photorhabdus luminescens; identical to SEQ ID NO: 10010

SEQ ID NO: 70186 - DNA, 849 bp, Photorhabdus luminescens; identical to SEQ ID NO: 10011
  CDS (1)..(849)

SEQ ID NO: 70187 - protein, 282 aa, Photorhabdus luminescens; identical to SEQ ID NO: 10012

SEQ ID NO: 70188 - DNA, 1131 bp, Mycoplasma gallisepticum; identical to SEQ ID NO: 10013
  CDS (433)..(1131)

SEQ ID NO: 70189 - protein, 232 aa, Mycoplasma gallisepticum; identical to SEQ ID NO: 10014

SEQ ID NO: 70190 - DNA, 804 bp, Gloeobacter violaceus; identical to SEQ ID NO: 10015
  CDS (1)..(804)

SEQ ID NO: 70191 - protein, 267 aa, Gloeobacter violaceus; identical to SEQ ID NO: 10016

SEQ ID NO: 70192 - DNA, 807 bp, Chromobacterium violaceum; identical to SEQ ID NO: 10017
  CDS (1)..(807)

SEQ ID NO: 70193 - protein, 268 aa, Chromobacterium violaceum; identical to SEQ ID NO: 10018

SEQ ID NO: 70194 - DNA, 858 bp, Prochlorococcus marinus subsp; identical to SEQ ID NO: 10019
  CDS (1)..(858)

SEQ ID NO: 70195 - protein, 285 aa, Prochlorococcus marinus subsp; identical to SEQ ID NO: 10020

SEQ ID NO: 70196 - DNA, 915 bp, Prochlorococcus marinus; identical to SEQ ID NO: 10021
  CDS (1)..(915)

SEQ ID NO: 70197 - protein, 304 aa, Prochlorococcus marinus; identical to SEQ ID NO: 10022

SEQ ID NO: 70198 - DNA, 897 bp, Synechococcus sp; identical to SEQ ID NO: 10023
  CDS (1)..(897)

SEQ ID NO: 70199 - protein, 298 aa, Synechococcus sp; identical to SEQ ID NO: 10024

SEQ ID NO: 70200 - DNA, 963 bp, Rhodopirellula baltica; identical to SEQ ID NO: 10025
  CDS (1)..(963)

SEQ ID NO: 70201 - protein, 320 aa, Rhodopirellula baltica; identical to SEQ ID NO: 10026

SEQ ID NO: 70202 - DNA, 1047 bp, Rhodopirellula baltica; identical to SEQ ID NO: 10027
  CDS (1)..(1047)

SEQ ID NO: 70203 - protein, 348 aa, Rhodopirellula baltica; identical to SEQ ID NO: 10028

SEQ ID NO: 70204 - DNA, 891 bp, Prochlorococcus marinus; identical to SEQ ID NO: 10029
  CDS (1)..(891)

SEQ ID NO: 70205 - protein, 296 aa, Prochlorococcus marinus; identical to SEQ ID NO: 10030

SEQ ID NO: 70206 - DNA, 855 bp, Helicobacter hepaticus; identical to SEQ ID NO: 10031
  CDS (1)..(855)

SEQ ID NO: 70207 - protein, 284 aa, Helicobacter hepaticus; identical to SEQ ID NO: 10032

SEQ ID NO: 70208 - DNA, 870 bp, Haemophilus ducreyi; identical to SEQ ID NO: 10033
  CDS (1)..(870)

SEQ ID NO: 70209 - protein, 289 aa, Haemophilus ducreyi; identical to SEQ ID NO: 10034

SEQ ID NO: 70210 - DNA, 867 bp, Candidatus Blochmannia floridanus; identical to SEQ ID NO: 10035
  CDS (1)..(867)

SEQ ID NO: 70211 - protein, 288 aa, Candidatus Blochmannia floridanus; identical to SEQ ID NO: 10036

SEQ ID NO: 70212 - DNA, 858 bp, Bordetella pertussis; identical to SEQ ID NO: 10037
  CDS (1)..(858)

SEQ ID NO: 70213 - protein, 285 aa, Bordetella pertussis; identical to SEQ ID NO: 10038

SEQ ID NO: 70214 - DNA, 921 bp, Chlamydophila caviae; identical to SEQ ID NO: 10039
  CDS (1)..(921)

SEQ ID NO: 70215 - protein, 306 aa, Chlamydophila caviae; identical to SEQ ID NO: 10040

SEQ ID NO: 70216 - DNA, 1179 bp, Streptomyces avermitilis; identical to SEQ ID NO: 10041
  CDS (1)..(1179)

SEQ ID NO: 70217 - protein, 392 aa, Streptomyces avermitilis; identical to SEQ ID NO: 10042

SEQ ID NO: 70218 - DNA, 828 bp, Nitrosomonas europaea; identical to SEQ ID NO: 10043
  CDS (1)..(828)

SEQ ID NO: 70219 - protein, 275 aa, Nitrosomonas europaea; identical to SEQ ID NO: 10044

SEQ ID NO: 70220 - DNA, 801 bp, Enterococcus faecalis; identical to SEQ ID NO: 10045
  CDS (1)..(801)

SEQ ID NO: 70221 - protein, 266 aa, Enterococcus faecalis; identical to SEQ ID NO: 10046

SEQ ID NO: 70222 - DNA, 819 bp, Coxiella burnetii; identical to SEQ ID NO: 10047
  CDS (1)..(819)

SEQ ID NO: 70223 - protein, 272 aa, Coxiella burnetii; identical to SEQ ID NO: 10048

SEQ ID NO: 70224 - DNA, 744 bp, Shigella flexneri; identical to SEQ ID NO: 10049
  CDS (1)..(744)

SEQ ID NO: 70225 - protein, 247 aa, Shigella flexneri; identical to SEQ ID NO: 10050

SEQ ID NO: 70226 - DNA, 810 bp, Tropheryma whipplei; identical to SEQ ID NO: 10051
  CDS (1)..(810)

SEQ ID NO: 70227 - protein, 269 aa, Tropheryma whipplei; identical to SEQ ID NO: 10052

SEQ ID NO: 70228 - DNA, 843 bp, Vibrio parahaemolyticus; identical to SEQ ID NO: 10053
  CDS (1)..(843)

SEQ ID NO: 70229 - protein, 280 aa, Vibrio parahaemolyticus; identical to SEQ ID NO: 10054

SEQ ID NO: 70230 - DNA, 816 bp, Pseudomonas syringae; identical to SEQ ID NO: 10055
  CDS (1)..(816)

SEQ ID NO: 70231 - protein, 271 aa, Pseudomonas syringae; identical to SEQ ID NO: 10056

SEQ ID NO: 70232 - DNA, 816 bp, Pseudomonas putida; identical to SEQ ID NO: 10057
  CDS (1)..(816)

SEQ ID NO: 70233 - protein, 271 aa, Pseudomonas putida; identical to SEQ ID NO: 10058

SEQ ID NO: 70234 - DNA, 786 bp, Lactobacillus plantarum; identical to SEQ ID NO: 10059
  CDS (1)..(786)

SEQ ID NO: 70235 - protein, 261 aa, Lactobacillus plantarum; identical to SEQ ID NO: 10060

SEQ ID NO: 70236 - DNA, 798 bp, Clostridium tetani; identical to SEQ ID NO: 10061
  CDS (1)..(798)

SEQ ID NO: 70237 - protein, 265 aa, Clostridium tetani; identical to SEQ ID NO: 10062

SEQ ID NO: 70238 - DNA, 843 bp, Bradyrhizobium japonicum; identical to SEQ ID NO: 10063
  CDS (1)..(843)

SEQ ID NO: 70239 - protein, 280 aa, Bradyrhizobium japonicum; identical to SEQ ID NO: 10064

SEQ ID NO: 70240 - DNA, 957 bp, Bacteroides thetaiotaomicron; identical to SEQ ID NO: 10065
  CDS (1)..(957)

SEQ ID NO: 70241 - protein, 318 aa, Bacteroides thetaiotaomicron; identical to SEQ ID NO: 10066

SEQ ID NO: 70242 - DNA, 843 bp, Bacteroides thetaiotaomicron; identical to SEQ ID NO: 10067
  CDS (1)..(843)

SEQ ID NO: 70243 - protein, 280 aa, Bacteroides thetaiotaomicron; identical to SEQ ID NO: 10068

SEQ ID NO: 70244 - DNA, 1386 bp, Mus musculus; identical to SEQ ID NO: 10069
  CDS (1)..(1386)

SEQ ID NO: 70245 - protein, 461 aa, Mus musculus; identical to SEQ ID NO: 10070

SEQ ID NO: 70246 - DNA, 795 bp, Streptococcus mutans; identical to SEQ ID NO: 10071
  CDS (1)..(795)

SEQ ID NO: 70247 - protein, 264 aa, Streptococcus mutans; identical to SEQ ID NO: 10072

SEQ ID NO: 70248 - DNA, 870 bp, Wigglesworthia glossinidia brevipalpis; identical to SEQ ID NO: 10073
  CDS (1)..(870)

SEQ ID NO: 70249 - protein, 289 aa, Wigglesworthia glossinidia brevipalpis; identical to SEQ ID NO: 10074

SEQ ID NO: 70250 - DNA, 849 bp, Vibrio vulnificus; identical to SEQ ID NO: 10075
  CDS (1)..(849)

SEQ ID NO: 70251 - protein, 282 aa, Vibrio vulnificus; identical to SEQ ID NO: 10076

SEQ ID NO: 70252 - DNA, 876 bp, Synechococcus elongatus; identical to SEQ ID NO: 10077
  CDS (1)..(876)

SEQ ID NO: 70253 - protein, 291 aa, Synechococcus elongatus; identical to SEQ ID NO: 10078

SEQ ID NO: 70254 - DNA, 765 bp, Shewanella oneidensis; identical to SEQ ID NO: 10079
  CDS (1)..(765)

SEQ ID NO: 70255 - protein, 254 aa, Shewanella oneidensis; identical to SEQ ID NO: 10080

SEQ ID NO: 70256 - DNA, 789 bp, Oceanobacillus iheyensis; identical to SEQ ID NO: 10081
  CDS (1)..(789)

SEQ ID NO: 70257 - protein, 262 aa, Oceanobacillus iheyensis; identical to SEQ ID NO: 10082

SEQ ID NO: 70258 - DNA, 1164 bp, Mycoplasma penetrans; identical to SEQ ID NO: 10083
  CDS (1)..(1164): transl_table=4

SEQ ID NO: 70259 - protein, 387 aa, Mycoplasma penetrans; identical to SEQ ID NO: 10084

SEQ ID NO: 70260 - DNA, 897 bp, Escherichia coli O6; identical to SEQ ID NO: 10085
  CDS (1)..(897)

SEQ ID NO: 70261 - protein, 298 aa, Escherichia coli O6; identical to SEQ ID NO: 10086

SEQ ID NO: 70262 - DNA, 894 bp, Corynebacterium efficiens; identical to SEQ ID NO: 10087
  CDS (1)..(894)

SEQ ID NO: 70263 - protein, 297 aa, Corynebacterium efficiens; identical to SEQ ID NO: 10088

SEQ ID NO: 70264 - DNA, 708 bp, Aquifex pyrophilus; identical to SEQ ID NO: 10089
  CDS (1)..(708): n means a or g or c or t/u

SEQ ID NO: 70265 - protein, 235 aa, Aquifex pyrophilus; identical to SEQ ID NO: 10090

SEQ ID NO: 70266 - DNA, 822 bp, Chlorobium tepidum; identical to SEQ ID NO: 10091
  CDS (1)..(822)

SEQ ID NO: 70267 - protein, 273 aa, Chlorobium tepidum; identical to SEQ ID NO: 10092

SEQ ID NO: 70268 - DNA, 828 bp, Xanthomonas campestris; identical to SEQ ID NO: 10093
  CDS (1)..(828)

SEQ ID NO: 70269 - protein, 275 aa, Xanthomonas campestris; identical to SEQ ID NO: 10094

SEQ ID NO: 70270 - DNA, 933 bp, Xanthomonas axonopodis; identical to SEQ ID NO: 10095
  CDS (1)..(933)

SEQ ID NO: 70271 - protein, 310 aa, Xanthomonas axonopodis; identical to SEQ ID NO: 10096

SEQ ID NO: 70272 - DNA, 786 bp, Thermoanaerobacter tengcongensis; identical to SEQ ID NO: 10097
  CDS (1)..(786)

SEQ ID NO: 70273 - protein, 261 aa, Thermoanaerobacter tengcongensis; identical to SEQ ID NO: 10098

SEQ ID NO: 70274 - DNA, 885 bp, Fusobacterium nucleatum; identical to SEQ ID NO: 10099
  CDS (1)..(885)

SEQ ID NO: 70275 - protein, 294 aa, Fusobacterium nucleatum; identical to SEQ ID NO: 10100

SEQ ID NO: 70276 - DNA, 795 bp, Clostridium perfringens; identical to SEQ ID NO: 10101
  CDS (1)..(795)

SEQ ID NO: 70277 - protein, 264 aa, Clostridium perfringens; identical to SEQ ID NO: 10102

SEQ ID NO: 70278 - DNA, 816 bp, Ralstonia solanacearum; identical to SEQ ID NO: 10103
  CDS (1)..(816)

SEQ ID NO: 70279 - protein, 271 aa, Ralstonia solanacearum; identical to SEQ ID NO: 10104

SEQ ID NO: 70280 - DNA, 834 bp, Rhizobium meliloti; identical to SEQ ID NO: 10105
  CDS (1)..(834)

SEQ ID NO: 70281 - protein, 277 aa, Rhizobium meliloti; identical to SEQ ID NO: 10106

SEQ ID NO: 70282 - DNA, 942 bp, Rhizobium meliloti; identical to SEQ ID NO: 10107
  CDS (1)..(942)

SEQ ID NO: 70283 - protein, 313 aa, Rhizobium meliloti; identical to SEQ ID NO: 10108

SEQ ID NO: 70284 - DNA, 816 bp, Rhizobium loti; identical to SEQ ID NO: 10109
  CDS (1)..(816)

SEQ ID NO: 70285 - protein, 271 aa, Rhizobium loti; identical to SEQ ID NO: 10110

SEQ ID NO: 70286 - DNA, 795 bp, Streptococcus pyogenes; identical to SEQ ID NO: 10111
  CDS (1)..(795)

SEQ ID NO: 70287 - protein, 264 aa, Streptococcus pyogenes; identical to SEQ ID NO: 10112

SEQ ID NO: 70288 - DNA, 870 bp, Pasteurella multocida; identical to SEQ ID NO: 10113
  CDS (1)..(870)

SEQ ID NO: 70289 - protein, 289 aa, Pasteurella multocida; identical to SEQ ID NO: 10114

SEQ ID NO: 70290 - DNA, 1839 bp, Arabidopsis thaliana; identical to SEQ ID NO: 10115
  CDS (241)..(1506)

SEQ ID NO: 70291 - protein, 421 aa, Arabidopsis thaliana; identical to SEQ ID NO: 10116

SEQ ID NO: 70292 - DNA, 813 bp, Brucella suis; identical to SEQ ID NO: 10117
  CDS (1)..(813)

SEQ ID NO: 70293 - protein, 270 aa, Brucella suis; identical to SEQ ID NO: 10118

SEQ ID NO: 70294 - DNA, 702 bp, Geobacter sulfurreducens; identical to SEQ ID NO: 10119
  CDS (1)..(702)

SEQ ID NO: 70295 - protein, 233 aa, Geobacter sulfurreducens; identical to SEQ ID NO: 10120

SEQ ID NO: 70296 - DNA, 936 bp, Mycobacterium paratuberculosis; identical to SEQ ID NO: 10121
  CDS (1)..(936)

SEQ ID NO: 70297 - protein, 311 aa, Mycobacterium paratuberculosis; identical to SEQ ID NO: 10122

SEQ ID NO: 70298 - DNA, 792 bp, Lactobacillus johnsonii; identical to SEQ ID NO: 10123
  CDS (1)..(792)

SEQ ID NO: 70299 - protein, 263 aa, Lactobacillus johnsonii; identical to SEQ ID NO: 10124

SEQ ID NO: 70300 - DNA, 858 bp, Treponema denticola; identical to SEQ ID NO: 10125
  CDS (1)..(858)

SEQ ID NO: 70301 - protein, 285 aa, Treponema denticola; identical to SEQ ID NO: 10126

SEQ ID NO: 70302 - DNA, 627 bp, Wolbachia pipientis wMel; identical to SEQ ID NO: 10127
  CDS (1)..(627)

SEQ ID NO: 70303 - protein, 208 aa, Wolbachia pipientis wMel; identical to SEQ ID NO: 10128

SEQ ID NO: 70304 - DNA, 792 bp, Bacillus cereus; identical to SEQ ID NO: 10129
  CDS (1)..(792)

SEQ ID NO: 70305 - protein, 263 aa, Bacillus cereus; identical to SEQ ID NO: 10130

SEQ ID NO: 70306 - DNA, 909 bp, Leptospira interrogans; identical to SEQ ID NO: 10131
  CDS (1)..(909)

SEQ ID NO: 70307 - protein, 302 aa, Leptospira interrogans; identical to SEQ ID NO: 10132

SEQ ID NO: 70308 - DNA, 657 bp, uncultured marine gamma proteobacterium EBAC20E09; identical to SEQ ID NO: 10133
  CDS (1)..(657)

SEQ ID NO: 70309 - protein, 218 aa, uncultured marine gamma proteobacterium EBAC20E09; identical to SEQ ID NO: 10134

SEQ ID NO: 70310 - DNA, 825 bp, Thermus thermophilus; identical to SEQ ID NO: 10135
  CDS (1)..(825)

SEQ ID NO: 70311 - protein, 274 aa, Thermus thermophilus; identical to SEQ ID NO: 10136

SEQ ID NO: 70312 - DNA, 807 bp, Desulfovibrio vulgaris; identical to SEQ ID NO: 10137
  CDS (1)..(807)

SEQ ID NO: 70313 - protein, 268 aa, Desulfovibrio vulgaris; identical to SEQ ID NO: 10138

SEQ ID NO: 70314 - DNA, 789 bp, Listeria monocytogenes str; identical to SEQ ID NO: 10139
  CDS (1)..(789)

SEQ ID NO: 70315 - protein, 262 aa, Listeria monocytogenes str; identical to SEQ ID NO: 10140

SEQ ID NO: 70316 - DNA, 1014 bp, Mycoplasma mobile 163K; identical to SEQ ID NO: 10141
  CDS (1)..(1014): transl_table=4

SEQ ID NO: 70317 - protein, 337 aa, Mycoplasma mobile 163K; identical to SEQ ID NO: 10142

SEQ ID NO: 70318 - DNA, 918 bp, Onion yellows phytoplasma; identical to SEQ ID NO: 10143
  CDS (1)..(918)

SEQ ID NO: 70319 - protein, 305 aa, Onion yellows phytoplasma; identical to SEQ ID NO: 10144

SEQ ID NO: 70320 - DNA, 1089 bp, Oryza sativa; identical to SEQ ID NO: 10145
  CDS (1)..(1089)

SEQ ID NO: 70321 - protein, 362 aa, Oryza sativa; identical to SEQ ID NO: 10146

SEQ ID NO: 70322 - DNA, 849 bp, Rhodopseudomonas palustris; identical to SEQ ID NO: 10147
  CDS (1)..(849)

SEQ ID NO: 70323 - protein, 282 aa, Rhodopseudomonas palustris; identical to SEQ ID NO: 10148

SEQ ID NO: 70324 - DNA, 879 bp, Corynebacterium diphtheriae; identical to SEQ ID NO: 10149
  CDS (1)..(879)

SEQ ID NO: 70325 - protein, 292 aa, Corynebacterium diphtheriae; identical to SEQ ID NO: 10150

SEQ ID NO: 70326 - DNA, 1026 bp, Mycoplasma mycoides; identical to SEQ ID NO: 10151
  CDS (1)..(1026): transl_table=4

SEQ ID NO: 70327 - protein, 341 aa, Mycoplasma mycoides; identical to SEQ ID NO: 10152

SEQ ID NO: 70328 - DNA, 837 bp, Bdellovibrio bacteriovorus; identical to SEQ ID NO: 10153
  CDS (1)..(837)

SEQ ID NO: 70329 - protein, 278 aa, Bdellovibrio bacteriovorus; identical to SEQ ID NO: 10154

SEQ ID NO: 70330 - DNA, 939 bp, Parachlamydia sp; identical to SEQ ID NO: 10155
  CDS (1)..(939)

SEQ ID NO: 70331 - protein, 312 aa, Parachlamydia sp; identical to SEQ ID NO: 10156

SEQ ID NO: 70332 - DNA, 849 bp, Photobacterium profundum; identical to SEQ ID NO: 10157
  CDS (1)..(849)

SEQ ID NO: 70333 - protein, 282 aa, Photobacterium profundum; identical to SEQ ID NO: 10158

SEQ ID NO: 70334 - DNA, 20 bp, Primer
atgctggcagcgtgggaatg

SEQ ID NO: 70335 - DNA, 25 bp, Primer
ttaaagcgtcctgaataccagtaac

SEQ ID NO: 70336 - protein, 337 aa, consensus; identical to SEQ ID NO: 10210
  MISC_FEATURE (1)..(337): consensus for the disclosure of xaa see table XV

SEQ ID NO: 70337 - protein, 37 aa, consensus; identical to SEQ ID NO: 10208
  MISC_FEATURE (1)..(37): consensus for the disclosure of xaa see table XV

SEQ ID NO: 70338 - protein, 32 aa, consensus; identical to SEQ ID NO: 10209
  MISC_FEATURE (1)..(32): consensus for the disclosure of xaa see table XV

SEQ ID NO: 70339 - DNA, 453 bp, Escherichia coli
  CDS (1)..(453)
atggcagaaaccaaaattgttgttggtccgcagccgttcagcgtaggagaagagtacccgtggctggcggagcgtgacgaagacggtgcggtagtcacctttactggtaaggtgcgcaaccataacctgggcgacagcgtcaacgcattaaccctcgaacactatccggggatgactgaaaaagcactggcagaaattgttgatgaagcgcgtaaccgctggccgctggggcgcgtcactgtgattcaccgcatcggggaattatggccgggcgatgaaatcgtttttgtcggtgtcaccagtgcgcatcgcagcagtgcgtttgaagccgggcagtttattatggattatctcaaaacccgcgcaccgttctggaagcgcgaagccacgccggaaggcgaccgctgggttgaagctcgggagagcgatcagcaggcggcaaaacgctggtag

SEQ ID NO: 70340 - protein, 150 aa, Escherichia coli
MAETKIVVGPQPFSVGEEYPWLAERDEDGAVVTFTGKVRNHNLGDSVNALTLEHYPGMTEKALAEIVDEARNRWPLGRVTVIHRIGELWPGDEIVFVGVTSAHRSSAFEAGQFIMDYLKTRAPFWKREATPEGDRWVEARESDQQAAKRW

SEQ ID NO: 70341 - DNA, 720 bp, Archaeoglobus fulgidus DSM 4304
  CDS (1)..(720): transl_table=11
gtgtggatgaaggttttcgttcccgagaactgggatgagctgaagggaaagctggctgagaggggaagagttgtagaggtgaggaagggagatggagaggaggagtgctgcgccttcattggaaagtccctcaggatgacagcaggccctaagaacatgagggaggcgctggaaaccctcgcagatctggggtttgattatgctgctatcattggtttcgagctggagcttgaggggcttgaaaagggcctcggattcaagattccaaaggtaaagagcgtggaggaggttgagagggctcctgaagtggagtccctaaaatccatcgttctcaaaacaaagtgcgttgaaggagtggagaaatgcggagcaattggcattttcataggctttgtgcggaaggagtctgacgggaagacggtaagcaggcttgagtatgaggcttatgatgaaatgctgaacgagaaggcgagggagattgaggagagagtaaagcagatgcccggaattgtaaatgccagagtttaccacaagagggggattctgctgccgggggaggacatagtttacatcaccgttatgggagagcacaggaaggacatctgggagcctttgaaggaggcagtggagttgatgaaaaaggagcttccaatctggaagaaggaggtttacgaggatggagaggtttgggtgcacgatgccgagagaactaaatcatga

SEQ ID NO: 70342 - protein, 239 aa, Archaeoglobus fulgidus DSM 4304
MWMKVFVPENWDELKGKLAERGRVVEVRKGDGEEECCAFIGKSLRMTAGPKNMREALETLADLGFDYAAIIGFELELEGLEKGLGFKIPKVKSVEEVERAPEVESLKSIVLKTKCVEGVEKCGAIGIFIGFVRKESDGKTVSRLEYEAYDEMLNEKAREIEERVKQMPGIVNARVYHKRGILLPGEDIVYITVMGEHRKDIWEPLKEAVELMKKELPIWKKEVYEDGEVWVHDAERTKS

SEQ ID NO: 70343 - DNA, 450 bp, Pyrococcus horikoshii OT3
  CDS (1)..(450): transl_table=11
atggaagattcaaagattgcccttatcaagaaaccagcggattttgatattgctagggccatttcgttgatttcatctagttcaactggagggatcgtgatattcctgggaaaagttagggatgaaaactttggtagaagggtaaagaggcttatatatgaagcctacgaggagatggccctcaaggaaatggagaaaattaggaaggaagcgttaagtaagttcccaattatagacgctttgatatggcatagggtcggagaattggaaataggcgagaatactattcttgtcattgcatcttctaagcatagaagggaagcttttgaagcctgtatttggatggttgatgaggttaagaagcgtgttcctatctggaagagggaaataacggaggaaggagaatattggatcgagggagataaagcagttcctgccggaaaaatatag

SEQ ID NO: 70344 - protein, 149 aa, Pyrococcus horikoshii OT3
MEDSKIALIKKPADFDIARAISLISSSSTGGIVIFLGKVRDENFGRRVKRLIYEAYEEMALKEMEKIRKEALSKFPIIDALIWHRVGELEIGENTILVIASSKHRREAFEACIWMVDEVKKRVPIWKREITEEGEYWIEGDKAVPAGKI

SEQ ID NO: 70345 - DNA, 750 bp, Aeropyrum pernix K1
  CDS (1)..(750): transl_table=11
atgagtagtgggtgggtcgagcttaggctctacactatactcaaggacgccgcgggggctgagacggtcagggtgccctgcccccccggcggcgtcaccctcggggaggccctgagggaggcggcgaggacctcaggcgggcttgagagggccctcgacgcagtatcatgggaggtctacgggctcctggacgacgggtctaggctcgcactggaggatagggtggcctgcggctccagggtccacgttataccccctccgagcggcggcggcgtggtggtggaggctaggcttcttaagccgggggaacccgtggatatagccagcctggttgctagggcggcctccgcctcgccagccaacggtgctgtggccgttttcgtgggcaccgtcaagtctgtagtggggggtgtgagggttgagaagctcttctacgaggccgcctggggtgttgcagagagggttatagagtctatattgagggaggaggctggggccaacgggctctcagcggctatagtctaccactacaccggcgagaggaggccgggggagacgactatagtggctgtggtggcgggggcttcccggggcaacgtctaccccgggctgcagagggttgtggacagggttaagagggaggcgcccatatggaaggtggagtatagggagggaggggttaaagcctacatactgggcgatagggtcgtcaccctcgtgcacccgggccgccggcctcgagcatcctag

SEQ ID NO: 70346 - protein, 249 aa, Aeropyrum pernix K1
MSSGWVELRLYTILKDAAGAETVRVPCPPGGVTLGEALREAARTSGGLERALDAVSWEVYGLLDDGSRLALEDRVACGSRVHVIPPPSGGGVVVEARLLKPGEPVDIASLVARAASASPANGAVAVFVGTVKSVVGGVRVEKLFYEAAWGVAERVIESILREEAGANGLSAAIVYHYTGERRPGETTIVAVVAGASRGNVYPGLQRVVDRVKREAPIWKVEYREGGVKAYILGDRVVTLVHPGRRPRAS

SEQ ID NO: 70347 - DNA, 597 bp, Arabidopsis thaliana
  CDS (1)..(597)
atgtctgcagaggagaagaaccttatagagatcttggaggaaggtcacaaagtcgatgttgttaagtacattgattatgtcagtgcccctcaagctggtgctattgcgacattctcaggcactacaagagacatgttcgagggcaagacagtgttggagttaaggtatgaagcatatgtgccaatggccacacgatgcctcagctcgatctgtacaactgctagatcaacttgggatatccacaagattgctgttgctcaccgtcttggaccagttcctgttggagaaactagcgtgctcattgcggtctcatctgttcaccgtgcagatggtttagatgcttgcaagttcttgatcgacgagttgaaggcatcggttccgatatggaagaaagaggtttacactaatggagagatttggaaggagaattctgagtttatggagaaaagattggagcttgcagagaaaagagacagcattgtaaaaaaaactgtggttgaagaacatagaagaagaggttgctgtggaagcaaagttagagtagaagaagatgaagagcataaagatattacaggagataacaaatcttcttcttga

SEQ ID NO: 70348 - protein, 198 aa, Arabidopsis thaliana
MSAEEKNLIEILEEGHKVDVVKYIDYVSAPQAGAIATFSGTTRDMFEGKTVLELRYEAYVPMATRCLSSICTTARSTWDIHKIAVAHRLGPVPVGETSVLIAVSSVHRADGLDACKFLIDELKASVPIWKKEVYTNGEIWKENSEFMEKRLELAEKRDSIVKKTVVEEHRRRGCCGSKVRVEEDEEHKDITGDNKSSS

SEQ ID NO: 70349 - DNA, 432 bp, Methanothermobacter thermautotrophicus str. Delta H
  CDS (1)..(432): transl_table=11
atgattgtacgggtaaccgatgagaaggaggcctaccggatggaggacctcatagaaaacctcaagaaaagcccataccttgatgaatgcggggccatattcaccttcgagggtattgttcgtggtgtggatgataagaggatagataagctggtactcacaacacccgacactgagagggctcagattgagcttgagggtattgtggaggatgtcaggaggaagtacccggtaagggacgttgccgtggtccactatctcggtgagttctacacctcagagacactcttcatggtggctgtggccggtccgcatcgtgaggagacactgaaggccctcagtgagataattgagaggacaaagcatgaaattgaatttaagaaggaggagtacaccgacagcggtaagaatatcataatgtcaggcggctga

SEQ ID NO: 70350 - protein, 143 aa, Methanothermobacter thermautotrophicus str. Delta H
MIVRVTDEKEAYRMEDLIENLKKSPYLDECGAIFTFEGIVRGVDDKRIDKLVLTTPDTERAQIELEGIVEDVRRKYPVRDVAVVHYLGEFYTSETLFMVAVAGPHREETLKALSEIIERTKHEIEFKKEEYTDSGKNIIMSGG

SEQ ID NO: 70351 - DNA, 894 bp, Halobacterium salinarum NRC-1
  CDS (1)..(894): transl_table=11
atgctcccggtcgtggcgcgttgctggtcccgtgccggcggccccgtggtccctacggcccaacgggcgacccttatcacccccgcccgccaacgcacgcgcatgaaggctctctcggtcgtcggccccgctgccgacacggacgcggccgccgccgcagtcgccgctgcactccggccacgcgggcgagtcgcgacggtccgacgggacgacacagtcaccacgcccgcgtcgaccgcgcgctcggtttcgctcagcgaccacggcgcgtgggcggccagcggcgcggatcgcacgctcgacgacgtgcttgcggacctcgcgcccgcgttcgactacgtcatcgttgaggggttcccggacgccgccctcccgacggttgcgctcggcgaccacgacgtccccgaccccgacgtgaccgcccccaacgccgacgccctcgacaccgaagcggtcctcgcggccgtcgaggacgcccccgtgcgggagacgctcgactcgttggttgcgagcctcaaatcccacgaggacagcgagttcgccggcgcgatcgcgacgttcacggggcgcgtgcgcgaacgcgacgaccccgacgacacgccgacacaacacctggagttcgagcgctacgacaccgtcgccgagcagcgcatggccactatccgcgagcagctctgcgagcgcgacggcgtctacgacgttcgcatgcaccaccgcacgggcgtcgtgcccgcgggcgacgacgtggtccacgtggtggtgcttgccgggcatcgtggcgacgcgttccgagcggtctcggacgggatcgaccgcctcaaagacgaggtcccgctgttcaaaaaagaggtcaccgtcgatgacgccttttggcgccacgacatccccgagtag

SEQ ID NO: 70352 - protein, 297 aa, Halobacterium salinarum NRC-1
MLPVVARCWSRAGGPVVPTAQRATLITPARQRTRMKALSVVGPAADTDAAAAAVAAALRPRGRVATVRRDDTVTTPASTARSVSLSDHGAWAASGADRTLDDVLADLAPAFDYVIVEGFPDAALPTVALGDHDVPDPDVTAPNADALDTEAVLAAVEDAPVRETLDSLVASLKSHEDSEFAGAIATFTGRVRERDDPDDTPTQHLEFERYDTVAEQRMATIREQLCERDGVYDVRMHHRTGVVPAGDDVVHVVVLAGHRGDAFRAVSDGIDRLKDEVPLFKKEVTVDDAFWRHDIPE

SEQ ID NO: 70353 - DNA, 690 bp, Deinococcus radiodurans R1
  CDS (1)..(690): transl_table=11
atgcaggtgcgcgccgtgttttttgcccgcctgcgccgtgaggtgggcctggaagaactgaccctcgacgtgccggacggcgccgacgtgagggcggtggccgagcacctcgaacaagagcgcggcgtgagcctgcgcggctgcatggtggcggtgaacgagacctacgccagccctgagcaccttctccgcgagggcgacgaggtggccttcctgcccccggtggcgggcggtgcccccgaggacgaggccgacgcggacacccactgccgcgtgaccgccgacccactgagcctcagcgaggccgacgctttcctggtgaagcccgagtacggcgcccaggcctacttcatgggcacggtgcgctcgcccaaccaggggcaggtcgtcgagtacatcgactacgaagcctttgccccgatggccgaaaaggtcatgcgcgaagccgccgccctcgcccgcgagcgtcacggcgagctgcgggtctggattgagcaccgcacaggtcgcctcacccccgccgtcgccagcatcgtcatcggtgtcgcaagcccccaccgccgcccggcgctcgaagcctgcgatttcctgatcgagcacctcaaaatcgagcttccgatctggaaacacgaggcggatgggcgcggggaacactgggtgaagggcacgaccggccacgacacgctgtga

SEQ ID NO: 70354 - protein, 229 aa, Deinococcus radiodurans R1
MQVRAVFFARLRREVGLEELTLDVPDGADVRAVAEHLEQERGVSLRGCMVAVNETYASPEHLLREGDEVAFLPPVAGGAPEDEADADTHCRVTADPLSLSEADAFLVKPEYGAQAYFMGTVRSPNQGQVVEYIDYEAFAPMAEKVMREAAALARERHGELRVWIEHRTGRLTPAVASIVIGVASPHRRPALEACDFLIEHLKIELPIWKHEADGRGEHWVKGTTGHDTL

SEQ ID NO: 70355 - DNA, 666 bp, Mycobacterium tuberculosis CDC1551
  CDS (1)..(666): transl_table=11
atgattactgtcaatgtgctctactttggcgcggttcgcgaagcgtgcaaggtcgctcacgagaagatctcactcgaaagcggcaccaccgtcgacggcttagtcgaccaattgcaaatcgactatccgccacttgctgattttcgcaagcgagtgcggatggccgttaacgaatccatagcgccagcatcaacgattctcgacgatggcgacacggtggcgttcataccgcaggttgccgggggctccgatgtctactgccggctcaccgatgagccgctgagcgtcgatgaagtgctcaacgcgatatctggaccttcccagggcggcgccgtcatcttcgtgggtaccgtgcgtaacaacaacaacggccacgaagtgaccaagttgtactacgaggcctatccggccatggtgcaccgcacgctgatggacatcatcgaagagtgtgaacgacaggccgacggtgtgcgagttgccgtggcacaccggaccggtgaattgcgcatcggtgatgcggcggttgtcatcggtgcttcggctcctcaccgcgcggccgcgttcgacgccgctcgcatgtgcatcgagcggctcaaacaggatgtgccgatatggaagaaggagttcgcactcgacggtgttgagtgggtggccaatcggccatga

SEQ ID NO: 70356 - protein, 221 aa, Mycobacterium tuberculosis CDC1551
MITVNVLYFGAVREACKVAHEKISLESGTTVDGLVDQLQIDYPPLADFRKRVRMAVNESIAPASTILDDGDTVAFIPQVAGGSDVYCRLTDEPLSVDEVLNAISGPSQGGAVIFVGTVRNNNNGHEVTKLYYEAYPAMVHRTLMDIIEECERQADGVRVAVAHRTGELRIGDAAVVIGASAPHRAAAFDAARMCIERLKQDVPIWKKEFALDGVEWVANRP

SEQ ID NO: 70357 - DNA, 696 bp, Sulfolobus solfataricus P2
  CDS (1)..(696): transl_table=11
atgaaaaaagtgaaagttctttattttgcattcattaaagacataacccataagtcaaatgaagtattagaaacagaatgcgaaactgtagactgctttattgaacaactgggtaaaatttacggaagcgaattagtaaatttcttgaagagtggaataaatgggataaaggtttcaattttggttaacggttcagcttcaaccaagaatattaaagatggagatgaggtagcgttgttaccaccaccttcgggcggagatttaataatagggaaaaaatttgacttacttgaggaaattagaaaatttagagaaaaagcacccccggaagcgggttctttagtagtttatgtaggttttgttaaaggtatagtagacaatcatagagtctttgaactgaaatacgaagcctacgaagagtacactagaaaaagatttctagaaataaaagatgaaataaagaagaaatataatgatctgatcgaaatcgagataatacatgtaatagattcaatgaaacccggagagaatgtcttacttataatggctataggtaagggaaggaaggacgctatcgacgcggtaaaagaaacattggaattagttaaacatagcactggaatttggaagttggaaataagagatgacggagaatattgggtagtagcagggaatacgagagtgaaaaaacaatga

SEQ ID NO: 70358 - protein, 231 aa, Sulfolobus solfataricus P2
MKKVKVLYFAFIKDITHKSNEVLETECETVDCFIEQLGKIYGSELVNFLKSGINGIKVSILVNGSASTKNIKDGDEVALLPPPSGGDLIIGKKFDLLEEIRKFREKAPPEAGSLVVYVGFVKGIVDNHRVFELKYEAYEEYTRKRFLEIKDEIKKKYNDLIEIEIIHVIDSMKPGENVLLIMAIGKGRKDAIDAVKETLELVKHSTGIWKLEIRDDGEYWVVAGNTRVKKQ

SEQ ID NO: 70359 - DNA, 711 bp, Sulfolobus tokodaii str. 7
  CDS (1)..(711): transl_table=11
atgaaaatacgtttaagatatttttcatttatccaagactttacaaataagagttctgaggaaatagaaacagaatgtaaaacagtagaatgtttacttgaacagttatcttctttatatggagatgaattcttaagaattatcaaaaatggcttaggtagtgtaagagttactattctagttaatggtaaagctaatgtaaataacattaatgatggagatgaaatagcaattttacctccaccttctggaggagaattatatgtttcaaagagatttgatcttttagaggaaataaaaaaatttagagaaaaagcaccaccagaagctggatcactagtaatttatttaggtttcgtaaagggaatagttgagaatcataaagtttatgaattgaaatatgaagcttacgaggaatatacaaggagaagatttaaggaaataatagatgaagttaagaaaaaatataatgatctagttgatttacaaattattcatgtaatagataacatgaaaccaggtgaagatgtattgttgattatggcattaggaaagggtagaaaagatgctatacatgcagtagaagaaaccttagaattagtgaaacatacgacgggtatttggaaattagaaataagagatgatggagaattttgggtagttgctggaaatactagagtgagaagaaatgaaaaaggtagtagcacttag

SEQ ID NO: 70360 - protein, 236 aa, Sulfolobus tokodaii str. 7
MKIRLRYFSFIQDFTNKSSEEIETECKTVECLLEQLSSLYGDEFLRIIKNGLGSVRVTILVNGKANVNNINDGDEIAILPPPSGGELYVSKRFDLLEEIKKFREKAPPEAGSLVIYLGFVKGIVENHKVYELKYEAYEEYTRRRFKEIIDEVKKKYNDLVDLQIIHVIDNMKPGEDVLLIMALGKGRKDAIHAVEETLELVKHTTGIWKLEIRDDGEFWVVAGNTRVRRNEKGSST

SEQ ID NO: 70361 - DNA, 408 bp, Thermoplasma acidophilum DSM 1728
  CDS (1)..(408): transl_table=11
atgatgtacgtggatataatcgaatccgagataccggtaatggatctaatcgatcggattagaaatccaaaagcaggcgccattgttacgtttgaaggtactgttcgtgaggattccgatggtgttaaggtggatgcactattctatgagagctaccgtgagatggccataagggagatacgcgatatgatagagtactgcataaggcaattcggaataacagacgcggcggttgttcatcgcataggtagagtaaatctcacagaggactccgttgttatagcggtatctgcgcctcatagaggacaggcgtttgacgcatgcagatacataatcgaccagataaaggagagagcgcccatatggaaacgtgacatcgtgcagggatctcctgcgagctggcactga

SEQ ID NO: 70362 - protein, 135 aa, Thermoplasma acidophilum DSM 1728
MMYVDIIESEIPVMDLIDRIRNPKAGAIVTFEGTVREDSDGVKVDALFYESYREMAIREIRDMIEYCIRQFGITDAAVVHRIGRVNLTEDSVVIAVSAPHRGQAFDACRYIIDQIKERAPIWKRDIVQGSPASWH

SEQ ID NO: 70363 - DNA, 423 bp, Listeria innocua Clip11262
  CDS (1)..(423): transl_table=11
atgaaatatgtagctttacaacacgaaaaaattgaaatcggaccactttctgaaaaactaatcaataaaaatcacggcggaattaatctgtttgtcggcacaattcgcgaatggactggcgatattcaaacagaagaaattcgctacactgcttatgaagcaatggcgttaaaagagttaaataaattagccacagaagtagaaactaagtggggtgcagatgtagtcatcgtccaccgattaggacttttagaaataactgatatagcagtgtttatcggcgtatcaacaccacaccgggctgcttgttatgaaggatccagatatattattgaacgtttaaaagaacgagtaccaatatggaaagaagaaaaagatgtcgatcaaataaggtggggtggcatagatgctcacaacggttaa

SEQ ID NO: 70364 - protein, 140 aa, Listeria innocua Clip11262
MKYVALQHEKIEIGPLSEKLINKNHGGINLFVGTIREWTGDIQTEEIRYTAYEAMALKELNKLATEVETKWGADVVIVHRLGLLEITDIAVFIGVSTPHRAACYEGSRYIIERLKERVPIWKEEKDVDQIRWGGIDAHNG

SEQ ID NO: 70365 - DNA, 468 bp, Agrobacterium tumefaciens str. C58
  CDS (1)..(468): transl_table=11
atgcagaaagtcgctcagccgacggttcgcgtgcaggcagaagacttcgacgccgccgacgaaacacgcctgttgacccagggcgacagaagcatcggcgccgtcgtggccttcaccgggctctgccgggacgatggcggcacattgaccgcactggaactcgaacattatcccggcatggcggaagcggaaatcacccgcatcgccaaactggcgatggagcgtttcggcctgcttggcctcaccgccatccaccgccatggcaagatcgccaccggcgaaaacatcgtcctcgtcattgccgcctcatctcatcgacaggccgccttcgatggcgccagtttcgtgatggactatctcaagacatcagccccgttctggaaaaaggaacatggcagggatggcacgacgggcgactgggtggcagcgaaggctaccgacgatacggccagggacaagtggcgatag

SEQ ID NO: 70366 - protein, 155 aa, Agrobacterium tumefaciens str. C58
MQKVAQPTVRVQAEDFDAADETRLLTQGDRSIGAVVAFTGLCRDDGGTLTALELEHYPGMAEAEITRIAKLAMERFGLLGLTAIHRHGKIATGENIVLVIAASSHRQAAFDGASFVMDYLKTSAPFWKKEHGRDGTTGDWVAAKATDDTARDKWR

SEQ ID NO: 70367 - DNA, 690 bp, Pyrobaculum aerophilum str. IM2
  CDS (1)..(690): transl_table=11
gtgaaaatccacatcaagtatttctccgcgctgagagacattacaggcaagacctcagagaccattgaaattcccaacggctatacactgggcgatgttatcaactggtttttcaaaaactatcccaaagccgaagtttttaaagaagagctcttggtattagtaaatggacgctccctagactggtcatatgaattaaaagagggcgacgaagttgcgttaatgcctccggttagtggaggcggcggcgtaattgatcacgccgtagatctcaataaagaggtggaggacattattaaaaacaccgcgcatctgggaggcggtggcgtcgtgattttcgtgggatacgtaaagggaaaagtggacaaagcggcggttaatgttttagaatacgaagcatacgagccatacgcaagctctaaaataaaagaaatcgaggcttgggccagggatcaagccggagtattagacgcgaggatataccacgtcgtgggcgcattaaagccgggcgaccacacactttacgtatttgtatccgcaattaatagagacatagcgtttagtgtggcaagagaggctcttgaaagggtgaaacatgaagtgccgatcttcaagctcgagagacgtagcgatggggagttttgggtcgttggcgacggtaagaggatccctagaaatcctcaaccctaa

SEQ ID NO: 70368 - protein, 229 aa, Pyrobaculum aerophilum str. IM2
MKIHIKYFSALRDITGKTSETIEIPNGYTLGDVINWFFKNYPKAEVFKEELLVLVNGRSLDWSYELKEGDEVALMPPVSGGGGVIDHAVDLNKEVEDIIKNTAHLGGGGVVIFVGYVKGKVDKAAVNVLEYEAYEPYASSKIKEIEAWARDQAGVLDARIYHVVGALKPGDHTLYVFVSAINRDIAFSVAREALERVKHEVPIFKLERRSDGEFWVVGDGKRIPRNPQP

SEQ ID NO: 70369 - DNA, 459 bp, Corynebacterium glutamicum ATCC 13032
  CDS (1)..(459): transl_table=11
atgaacactgaccccgcttacgtcgccgaacaaaccggcaaactcatcgacgctttcctcaccaccgaccccctcgaaccgctgctcgacgccgccaaaaacggcgtctgcacagaggcgatgggcgcgctggtcaccttcgaaggcatcgtccgcgaccacgacggcggcgcccgcgtgacctccctgacctacaccgcgcatcccaccgcgccgcaggtcctttctgctgtcgcggactccatcgttgaaaaacacccgcgcacccgcctctggaccgcgcaccgcaccggcgccttgaaaatcggtgacgccgccttcctcgtcgtcgccgcctccgcccaccgcgccgacgccttcgccgcctgctccgacctcgccgacgccgtcaaagcccaggtcccgatctggaaagagcaaacgcgcctcgacggctccaccgattgggtcggcctgtga

SEQ ID NO: 70370 - protein, 152 aa, Corynebacterium glutamicum ATCC 13032
MNTDPAYVAEQTGKLIDAFLTTDPLEPLLDAAKNGVCTEAMGALVTFEGIVRDHDGGARVTSLTYTAHPTAPQVLSAVADSIVEKHPRTRLWTAHRTGALKIGDAAFLVVAASAHRADAFAACSDLADAVKAQVPIWKEQTRLDGSTDWVGL

SEQ ID NO: 70371 - DNA, 840 bp, Methanosarcina acetivorans C2A
  CDS (1)..(840): transl_table=11
ttgatgaaggtcatttctgttgtagggtataagaaatcgggcaagacagcccttgtttcagctcttgtccggcatctttccggcttcgggacagttggcactgtaaaacacatgggagaacagcgcctcaaccctggagaaacggatacaggcaggcattttgatgcgggagcggatatggtagtagggatcacgggctccgaacttgtcagctttgccagagactccagccttgaaaacgccctcgatatgctctgcgaccgggggcttgattttgctgtagtagaagggtttaaggacagcaatctcccgaaaatcgtgattgaaggccttgagggggtttccaatgtcgttttcagagtacctgctgatattgatcctcatgaggaactcacggcttcccttgtaggcatgacccttgcccagcctgaccgctacacccttgaagcccttataaagaaagcccggaaaaatccggttatccagaaagcaggagcaatcggcactttcactggcatcgtccgcgaacttgcaggagaggaaaagacagcaaggctcgagtttgagaaatacgaacccgaagcctcaaaggtgctggacaaaatcggggaagagattaagcaaaaagaaggaatcctcgaggtcctcctccaccacaaaacaggcgtcatcgaagccggcgaagatatagtctacatcgtgatcgcatccgcccacagggctgaactcttccccgccctcagcgaagccatcgagcggataaaagccgaagccccaatctggaaaaaggaattcacggaaaaagaagagttctgggtccacgacagggaacacgcctga

SEQ ID NO: 70372 - protein, 279 aa, Methanosarcina acetivorans C2A
MMKVISVVGYKKSGKTALVSALVRHLSGFGTVGTVKHMGEQRLNPGETDTGRHFDAGADMVVGITGSELVSFARDSSLENALDMLCDRGLDFAVVEGFKDSNLPKIVIEGLEGVSNVVFRVPADIDPHEELTASLVGMTLAQPDRYTLEALIKKARKNPVIQKAGAIGTFTGIVRELAGEEKTARLEFEKYEPEASKVLDKIGEEIKQKEGILEVLLHHKTGVIEAGEDIVYIVIASAHRAELFPALSEAIERIKAEAPIWKKEFTEKEEFWVHDREHA

SEQ ID NO: 70373 - DNA, 459 bp, Streptomyces coelicolor A3(2)
  CDS (1)..(459)
atggcaaccacgaacgaccaccccggcgagcgggccgcagcggaccccgtgaagctgatcggcatccgtgagacgcccctgtccgtggacgaggtcttcggcgcggtcggggacgacgcgtcgggcggcaccgcgctgttcgtggggaccgtgcgcaaccacgacggcggcaccgacgtcgaccggctcgggtactcgtgccacccgagcgccgaggcggagatgcgccggatcgcggagaaggtcgtcgcggagtaccccgtacgggcgctcgcggcactgcaccgtgtgggtgacctggaggtcggggacctcgcggtggtcgtcgccgtgtcctgtccgcaccggggcgaggccttcgacgcctgccgcaagctgatcgacgacctcaagcacgaggtgcccatctggaagcaccagacgttctccgacggaaccgaggaatgggtgggcgcgtag

SEQ ID NO: 70374 - protein, 152 aa, Streptomyces coelicolor A3(2)
MATTNDHPGERAAADPVKLIGIRETPLSVDEVFGAVGDDASGGTALFVGTVRNHDGGTDVDRLGYSCHPSAEAEMRRIAEKVVAEYPVRALAALHRVGDLEVGDLAVVVAVSCPHRGEAFDACRKLIDDLKHEVPIWKHQTFSDGTEEWVGA

SEQ ID NO: 70375 - DNA, 837 bp, Methanosarcina mazei Go1
  CDS (1)..(837): transl_table=11
atgaaagtcgtttccgttgtcgggtataagaaatcaggaaaaacagcccttgtctcagctcttgtaaggcagctttcagggttcgggacagtgggtactgttaaacacatgggagagcagcgcctgaaccctgcagaaactgatactggaaggcattttgatgcgggagcggatatggtagtggggattacaggcaccgaactcgtcagcttcgccagggactcgggccttgaagatgcccttgatatgctctgtgacagaggccttgatttcgctgtcgtggaagggtttaaggcgagcaaccttccgaaaatagcccttggagacattgaaggcgtttccaacatcattttcagggtaccggaaaacattgaccctcatgaggaacttacagcgtccttagtaggaatcgccctcgcccagccagaccgctataccctggaagcccttgtcaaaaaagtccgcaagaatcctgatataaggaaagcaggagcaataggtacctttactggcattgtacgcgagcttgcgggagaagaaaaaacatcaaggctcgagttcgaaaaatacgaaccggaagcctcaaaagtcctcgaccgtatccgggacgaaataaagaaaaaagaaggtatacttgaagtccttatccaccacaaaacaggcttaatagaagccggagaggacattgtttacattgtgatcgcatccgcccacaggaccgaactcttccctgccctcagtgaagctattgaaaggataaaaacagaagctccgatctggaaaaaggaattcaccgaaaaagagcatttctgggtccatgatagggaacatgcctga

SEQ ID NO: 70376 - protein, 278 aa, Methanosarcina mazei Go1
MKVVSVVGYKKSGKTALVSALVRQLSGFGTVGTVKHMGEQRLNPAETDTGRHFDAGADMVVGITGTELVSFARDSGLEDALDMLCDRGLDFAVVEGFKASNLPKIALGDIEGVSNIIFRVPENIDPHEELTASLVGIALAQPDRYTLEALVKKVRKNPDIRKAGAIGTFTGIVRELAGEEKTSRLEFEKYEPEASKVLDRIRDEIKKKEGILEVLIHHKTGLIEAGEDIVYIVIASAHRTELFPALSEAIERIKTEAPIWKKEFTEKEHFWVHDREHA

SEQ ID NO: 70377 - DNA, 438 bp, Xanthomonas campestris pv. campestris str. ATCC 33913
  CDS (1)..(438): transl_table=11
atgcatgagcagatcaggccgagcttcgcgctgtcagacgcgcccctgcaggtggaagcgttgcggcaggcactggagcacccgcgcgctggtgcgtttgcgagcttcgagggttgggtgcgcaaccataacgatggccgcagcgttgccgggctgcgctacgaagcctatgccgcgctcgctcaggccgaagggcagcgtgtgctagacgaggcgatgacgcggttctccatcctgcaggcgcagtgcgtgcatcgcgtgggcgagctgggcatcggcgaaatggcggtgtgggttggcgtcagcgcggcgcaccgtggcgccgcattcgaggcgtgccgcttcatcatcgacgaggtcaaggcgcgcgtgccgatctggaagcacgagcactacctggaaggcgatgcgggctggctgcatccggagtcgcagtaa

SEQ ID NO: 70378 - protein, 145 aa, Xanthomonas campestris pv. campestris str. ATCC 33913
MHEQIRPSFALSDAPLQVEALRQALEHPRAGAFASFEGWVRNHNDGRSVAGLRYEAYAALAQAEGQRVLDEAMTRFSILQAQCVHRVGELGIGEMAVWVGVSAAHRGAAFEACRFIIDEVKARVPIWKHEHYLEGDAGWLHPESQ

SEQ ID NO: 70379 - DNA, 1104 bp, Drosophila melanogaster
  CDS (1)..(1104)
atggatcacgtgaaattggtaaacgaccccatagatatcgctcatatccatcagttgctggccgatgaaggctgtggagcctcatccgttttcgtgggcactacgcgcgataattttcaagggaaaaaggtgctgtcattggcgtacgaggcctacgatagcatggcactcaaggaaatgaataaaatatgctcagatctccgatctaagtggctcgatctgaagcacatagtcatatatcatcgattgggaacagtgcccgtatgcgaagccagtgtagttatagccgcctcgtcaccacatcgttctgaggccttagaatcagtatcttttgcaatagaccagctaaaaactcgggttcccatctggaaaaaggaaatctacgacggcgataacgacagcgaatggaaggagaacaaggagtccatcaggcctaagaaatcgaaaagtggcttcaactacgccgcttgtccctgcaaagttgaggagtcacatgacgtcccgcgaactctggtgcaaattagagttaatgacgctgagttaaccaagcgtttagaatgttttgtcaacagaaaacgagacgaaataaactcacaaaatgtaattgacttcaaatcgtcttttgtcagctcagaccaaaacttgagcgattcctgcgctcgaacgcagagcacaattattaagcaggagcagtcaaattgccatttaaaagtccgacgagtaaacaaccgatgcggacctcagcaaatggaaatgcgacccaactacgaactcgaactgaataaactaatgggatcgcgtgacggtcaaacggatccaaccaaagaaatgaggaaatcgctacccaattcacgactacaggcaattgaatcgtacatgggtctaaccaccgacaacgaggaaaacattttcagtagaatcaaacgagtggaaaatagactgctgcaactggagtccatttcgcccgagtacagacacttcaccaaacgtgaaccgtcatctatggaagccgcgccgccgaagaagagccgaaagaaatcgtattcggcgcaagaattaagtgcattcattcaaaagattaaggatggcagcgaattaagctaa

SEQ ID NO: 70380 - protein, 367 aa, Drosophila melanogaster
MDHVKLVNDPIDIAHIHQLLADEGCGASSVFVGTTRDNFQGKKVLSLAYEAYDSMALKEMNKICSDLRSKWLDLKHIVIYHRLGTVPVCEASVVIAASSPHRSEALESVSFAIDQLKTRVPIWKKEIYDGDNDSEWKENKESIRPKKSKSGFNYAACPCKVEESHDVPRTLVQIRVNDAELTKRLECFVNRKRDEINSQNVIDFKSSFVSSDQNLSDSCARTQSTIIKQEQSNCHLKVRRVNNRCGPQQMEMRPNYELELNKLMGSRDGQTDPTKEMRKSLPNSRLQAIESYMGLTTDNEENIFSRIKRVENRLLQLESISPEYRHFTKREPSSMEAAPPKKSRKKSYSAQELSAFIQKIKDGSELS

SEQ ID NO: 70381 - DNA, 459 bp, Yersinia pestis KIM
  CDS (1)..(459): transl_table=11
gtgatgatggaaaatacgcgtatccgtgtcggcgcagaagcgttcagtgtgggtgatgaatacacatggctgtcgcagtgcgatgaagacggcgcggtggtgaccttcactggcaaagtccgtaatcataatctgggggccagtgtcagtgcgctaacactggaacactaccccggtatgacagaaaaagcgctgacggagattattgccgacgcacgcagccgttggtcattgcagcgggtatcggtcatccatcgggtcgggccactattccccggagatgaaattgtctttgtgggtgtgaccagcgctcatcgcagtatggcatttgaagcagcagaatttattatggactacctgaaaacacgggcaccattctggaagcgggaagccacggtcgagggtgagcgctgggttgaatcacgggacagcgaccatattgcggctaaacgctggtaa

SEQ ID NO: 70382 - protein, 152 aa, Yersinia pestis KIM
MMMENTRIRVGAEAFSVGDEYTWLSQCDEDGAVVTFTGKVRNHNLGASVSALTLEHYPGMTEKALTEIIADARSRWSLQRVSVIHRVGPLFPGDEIVFVGVTSAHRSMAFEAAEFIMDYLKTRAPFWKREATVEGERWVESRDSDHIAAKRW

SEQ ID NO: 70383 - DNA, 447 bp, Thermosynechococcus elongatus BP-1
  CDS (1)..(447): transl_table=11
atgctgattaaacagttttctctcactcatactcccctagagccagcccagttgtgccagccccttgccagcttcagtgccggcgcctttgttagctttgagggctgggtacgcaatcataatcacggcaagatcgtcactgccctagaatatgaggtctatcccgccttggctctcaaagaaggggagcagattgtggcagaagccattgagaaatttgacttgctgggggcgatcgccagccatcgctatggaagactcactcttggcgagattgctgtctgggtaggggtaacggcacctcatcgcaaacaagcctttgctggtgcggcctacatcattgatgaaatcaaacaccgcctgcccatttggaaaaaggaatactacctagatgaaccagccagctgggtgtattgccgtgagcaccactgtgacagtccgttttag

SEQ ID NO: 70384 - protein, 148 aa, Thermosynechococcus elongatus BP-1
MLIKQFSLTHTPLEPAQLCQPLASFSAGAFVSFEGWVRNHNHGKIVTALEYEVYPALALKEGEQIVAEAIEKFDLLGAIASHRYGRLTLGEIAVWVGVTAPHRKQAFAGAAYIIDEIKHRLPIWKKEYYLDEPASWVYCREHHCDSPF

SEQ ID NO: 70385 - DNA, 468 bp, Shewanella oneidensis MR-1
  CDS (1)..(468): transl_table=11
atgcgtttactgccgaatgtgcgggtgcagaccgtcgattttaatgtggccgacgagtaccaccaattagcccaagacaacagtgatggcgccgttgtgacttttgttggcaaagtgcgtgactttaacgatggctcagtggtgactgacctgactttagagcactaccccggtatgacggagcgcattcttgagcaaatcgttgccgaggcgcgtgagcgttggccgctcaataaagttacggttatccaccgtgtggggactatggcgctgggtgagcaaattgtgtttatcggcgtcaccagtgcccatcgcaaggcggcctttgcggcctgcgaattcttaatcgactttttgaaaacaaaagcccctttctggaaattagaagcaggggataagggtaagaattgggtcgaggccaaggatgccgatgagcaggctgcgcaattgtggcaacacaaaagctag

SEQ ID NO: 70386 - protein, 155 aa, Shewanella oneidensis MR-1
MRLLPNVRVQTVDFNVADEYHQLAQDNSDGAVVTFVGKVRDFNDGSVVTDLTLEHYPGMTERILEQIVAEARERWPLNKVTVIHRVGTMALGEQIVFIGVTSAHRKAAFAACEFLIDFLKTKAPFWKLEAGDKGKNWVEAKDADEQAAQLWQHKS

SEQ ID NO: 70387 - DNA, 459 bp, Corynebacterium efficiens YS-314
  CDS (1)..(459): transl_table=11
atgaccactgatcctgcctatgtcgacgaacagaccggcatcctcatcgacgcgttcatgacggaggactcactgaccgacctgctgcccgcagccaagaccgcgacctgcaccgatgccatgggtgcgctcgtggtcttcgagggtgtggtccgcgaccacgacggtggttcgcgggtgaagtcgctgacctacaccgcgcatcccagcgccggcgcgatgatcaggaaggtggcggagggggtcgtcgcaaagcacccgcgcacgcgcctgtggaccgcgcaccgcaccggcgccctggccatcggggatgtcgcgttcctggtggtcgccgccgccgcccaccgcggggacgccttcgccgcctgcgccgcgcttgccgacgccgtcaaagcccaggtccccatctggaaggaacaggaactggtgaacggcgacaccgagtgggtgggcctgtga

SEQ ID NO: 70388 - protein, 152 aa, Corynebacterium efficiens YS-314
MTTDPAYVDEQTGILIDAFMTEDSLTDLLPAAKTATCTDAMGALVVFEGVVRDHDGGSRVKSLTYTAHPSAGAMIRKVAEGVVAKHPRTRLWTAHRTGALAIGDVAFLVVAAAAHRGDAFAACAALADAVKAQVPIWKEQELVNGDTEWVGL

SEQ ID NO: 70389 - DNA, 447 bp, Pseudomonas putida KT2440
  CDS (1)..(447): transl_table=11
atggctgtgcgagtgcaggaaggcgcgttcgacccgggggctgagaccaatgccatgcatgcagccaatgtgggcgtgggcgcggtggtcggttttgtcggctatgtgcgggatttcaacgatggccgcgaagtggcggggatgttcctcgaacactatccgggcatgaccgaaaaggccctggccaagatcgtggtcgaggccgagcagcgttggccgctattgaaggtggaggtgctgcaccgcatcggtgcgctggaaccgggcgaaccgattgtgttcgtgggggtggccagtgcccatcggcaggcggcgttcgatgcctgcaacttcatcatggactacctgaagacccgggcgccgttctggaagaaggagaatactcaggaagggccaaggtgggtggaggggcggcagagtgaccaggatgcggcggggcgctggtaa

SEQ ID NO: 70390 - protein, 148 aa, Pseudomonas putida KT2440
MAVRVQEGAFDPGAETNAMHAANVGVGAVVGFVGYVRDFNDGREVAGMFLEHYPGMTEKALAKIVVEAEQRWPLLKVEVLHRIGALEPGEPIVFVGVASAHRQAAFDACNFIMDYLKTRAPFWKKENTQEGPRWVEGRQSDQDAAGRW

SEQ ID NO: 70391 - DNA, 456 bp, Vibrio vulnificus CMCP6
  CDS (1)..(456): transl_table=11
gtggataatcgtatctcagttcaagtcgaagatttcgacatcgcagcagaatatgcgtggttgtcacaggggagcgcggcaggcgctgtggtgacttttgttggcaaggtgagagacatgaacttgggcgataatgtcacgggcctaagtttggagcattatccaggtatgacggaaaaagcgctgggtgagatttgtgatcaagccgagcagagatggccgttgctgaatgtccgtgttatccatcgagttggagacctcaatatcggtgatcaaatcgtgtatgttggggtgtcgagtgcacatcgcggtgcggcgtttgaggcttgtgagttcattatggattatctcaagaccaaagcgcctttctggaaaaaagaacgtacaactgaaacgactcgatgggttgagtctagagagtctgatgcccaagcggctgagcgttggcaatcatag

SEQ ID NO: 70392 - protein, 151 aa, Vibrio vulnificus CMCP6
MDNRISVQVEDFDIAAEYAWLSQGSAAGAVVTFVGKVRDMNLGDNVTGLSLEHYPGMTEKALGEICDQAEQRWPLLNVRVIHRVGDLNIGDQIVYVGVSSAHRGAAFEACEFIMDYLKTKAPFWKKERTTETTRWVESRESDAQAAERWQS

SEQ ID NO: 70393 - DNA, 483 bp, Bradyrhizobium japonicum USDA 110
  CDS (1)..(483)
atgacttcccctgcgaccaccggccccgtcaccatccgtattcaagaggacgatttcgacattgcgcgcgagatcgcgctcctgaccaggagccggaccgacatcggcgcggtcgtgagcttctccggcatctgccgcggcgacgaggatagcgcgaagatcgccgcgctgacgctcgaacattatcccggcatggccgaggaagagatcaagcgtcatgtcgacgaggcaaccacgcgctggccgctcaacggcgtcacggtcatccatcgcgtcgggcggttcatgcccggccagaacatcgtgctggtgctgaccgcctcgcagcatcgtcaggccgcattccaggcggccgagttcctgatggactatctcaagaccagcgcgccgttctggaagaaggaagagagcgccaccggcaccggctgggtcgaggcccacgcccgtgatgacgaggccgccgcacgctggacgaaatcctga

SEQ ID NO: 70394 - protein, 160 aa, Bradyrhizobium japonicum USDA 110
MTSPATTGPVTIRIQEDDFDIAREIALLTRSRTDIGAVVSFSGICRGDEDSAKIAALTLEHYPGMAEEEIKRHVDEATTRWPLNGVTVIHRVGRFMPGQNIVLVLTASQHRQAAFQAAEFLMDYLKTSAPFWKKEESATGTGWVEAHARDDEAAARWTKS

SEQ ID NO: 70395 - DNA, 402 bp, Lactobacillus plantarum WCFS1
  CDS (1)..(402): transl_table=11
atggcgatgatcaaattgtctgcgacgccattggatgtgaatgcgttgtatcaagtattgaaggcaccggaatatggcggcattgtcacgtttgtaggcactgttcgccagtggacgggcccaatcgaaacgcaatcaatcgattattcggcgtatgcggagatggccatcagtcaacttaacaaattagcagcgcccattgaagctaaaggcgcccgcgtggtgatcgtgcaccgaattgggcatctggatctgatggatgaagcggtctttgttggtgtcgcggcagcgcaccgtgctgaggccttcgaatggtgccaatacttaattgatacactgaaaaaggaagtcccgatttggaagaaagaatttgataccgacaaggttcgttggggggattaa

SEQ ID NO: 70396 - protein, 133 aa, Lactobacillus plantarum WCFS1
MAMIKLSATPLDVNALYQVLKAPEYGGIVTFVGTVRQWTGPIETQSIDYSAYAEMAISQLNKLAAPIEAKGARVVIVHRIGHLDLMDEAVFVGVAAAHRAEAFEWCQYLIDTLKKEVPIWKKEFDTDKVRWGD

SEQ ID NO: 70397 - DNA, 456 bp, Vibrio parahaemolyticus RIMD 2210633
  CDS (1)..(456): transl_table=11
atggatcctcgtgtttctgtacaagttgaagacttttctgttgatcaagaatatcaacgcttgtcggaaggcactgcttctggtgcggtcgtgacctttatcggtaaagtcagagatatgaaccttggtgacaacgtgattggcctgcatctagagcattatccgggcatgacggaaaagagcttgagcgatatttgtgatgaagctgaagctcgctggcctctgcttggcgtgcgcgtgattcatcgtgtgggtgatatggacagcggcgaccaaattgtatttgtgggcgtttctagtgcgcaccgcggcgcggcatttgatgcgtgcgagttcattatggactatctgaaaaccaaagcaccgttttggaaaaaagagcgcacaactaacgaagatcgttggattgaatcgcgcgacaccgatcatcaagcagcgcggcgctgggaaaaatag

SEQ ID NO: 70398 - protein, 151 aa, Vibrio parahaemolyticus RIMD 2210633
MDPRVSVQVEDFSVDQEYQRLSEGTASGAVVTFIGKVRDMNLGDNVIGLHLEHYPGMTEKSLSDICDEAEARWPLLGVRVIHRVGDMDSGDQIVFVGVSSAHRGAAFDACEFIMDYLKTKAPFWKKERTTNEDRWIESRDTDHQAARRWEK

SEQ ID NO: 70399 - DNA, 471 bp, Bacillus anthracis str. Ames
  CDS (1)..(471): transl_table=11
atgacacatacgtattatgaagtaattgatacacctatatcaattgaagaagtgacaaacaaagtaattcggcgtgagtgtggtgcggttactacttttattggcactgttagagaatttacgaaaggccgacgtacgctttatttagagtatgtagcttataagacgatggcggagaaacagcttgagagaattggtaccgaagtaggggagaaatggcctggaacatatgtgacaattacacatcgcattggtacgttacaaatttcggatctttctgttgttgtcgctgttgctacaccacatcggaaagcggcctatgaagcaaatgaatatattatggagcgtataaaacaaattgttccaatttggaagaaagagtattgggaagatggtgagtcatggataggtgatcagttagagcgggtaacatatgcaaatggtgagcctagaaaggagatgagaatatga

SEQ ID NO: 70400 - protein, 156 aa, Bacillus anthracis str. Ames
MTHTYYEVIDTPISIEEVTNKVIRRECGAVTTFIGTVREFTKGRRTLYLEYVAYKTMAEKQLERIGTEVGEKWPGTYVTITHRIGTLQISDLSVVVAVATPHRKAAYEANEYIMERIKQIVPIWKKEYWEDGESWIGDQLERVTYANGEPRKEMRI

SEQ ID NO: 70401 - DNA, 465 bp, Bacillus anthracis str. Ames
  CDS (1)..(465): transl_table=11
atgacaaatacgtattatgaagtaattgatacagaaatctcaattgaagaggtagcgaagagagtaattcgccgcgaatgtggtgctgttacaacatttattggaacggttagagagtttacgaaagggcgtcgtacattatacttagaatatgtcgcttataaaacgatggcagaaaagatgctagagaaaatcggatcagaagtgaaagagaaatggccaggtacacacgttgcgattacacaccgcgtcggtacactacaaatttctgatatagcggttgttgtggctgtttcaacgccgcatcgtaaagcggcttatgaagcaaatgaatatattatggaacgcataaaacaaattgttccgatttggaaaaaggagttttgggaagatggagactcttggattggcgatcaattagaaaaaacgccatatccggcgggagagcctgggaaggagctataa

SEQ ID NO: 70402 - protein, 154 aa, Bacillus anthracis str. Ames
MTNTYYEVIDTEISIEEVAKRVIRRECGAVTTFIGTVREFTKGRRTLYLEYVAYKTMAEKMLEKIGSEVKEKWPGTHVAITHRVGTLQISDIAVVVAVSTPHRKAAYEANEYIMERIKQIVPIWKKEFWEDGDSWIGDQLEKTPYPAGEPGKEL

SEQ ID NO: 70403 - DNA, 513 bp, Rhodopirellula baltica SH 1
  CDS (1)..(513): transl_table=11
ttgatcgtgcctgtccaacccaccaccgacgagaaatccggttccgttcacgtctgtttgacggacaaacctttggaacccatggttgccgcgacgtcctccgaagaaccttggctggcacaccccgacgcgggtgcgatgctttggttccatggagtgactcgccgcaaaacggtacagggcgatcgcgttaccgtcacgaaagaactttcgtacacggcccatcgcgaaatggcggtcaagcaactcagagagcttgctcacgacgccgtgcgggaattcaccttgcaccgggtcgtgatttggcaccgcctgggcgttgtcccgatcggacaagccagcgtgatcgtcggatgcagcagttcccaccgagtcgcctcgctcgatgcggttgccaccatcatggatcgcttgaaaaaagaagttccgatttggaaacaggaacgatttgaatcaggcgaccgccaatggattcacccgtcacccacgacggacgatccaacgactcattga

SEQ ID NO: 70404 - protein, 170 aa, Rhodopirellula baltica SH 1
MIVPVQPTTDEKSGSVHVCLTDKPLEPMVAATSSEEPWLAHPDAGAMLWFHGVTRRKTVQGDRVTVTKELSYTAHREMAVKQLRELAHDAVREFTLHRVVIWHRLGVVPIGQASVIVGCSSSHRVASLDAVATIMDRLKKEVPIWKQERFESGDRQWIHPSPTTDDPTTH

SEQ ID NO: 70405 - DNA, 456 bp, Haemophilus ducreyi 35000HP
  CDS (1)..(456): transl_table=11
atgcaacaaagtgttattgaagtacaacaagcaccttttgatcagcacgccatttatcagtggttaagtgagccacatagtgtgggtgcaaccactatatttgttggaaaagtacgggaaatgaatttaggtgataatgtctctggtttatatttagagcactatcccgcaatgactaaaaaagcattacaagaaattgtcaatcaggcacgccaacgctgggagttacaacgtatcgccgtgattcatcggatcggacaattacacacaggtgatgaaattgtattagtaggtgttagctcagcacatcgaggcgatgcttatctcgcaaacgaatttattatggactatctcaaaactaaagcacctttttggaaacgtgaaacaactgctgagggagagcgttggattgaaagccgtgaaagtgatgaacaacaactagaaaaatggcgataa

SEQ ID NO: 70406 - protein, 151 aa, Haemophilus ducreyi 35000HP
MQQSVIEVQQAPFDQHAIYQWLSEPHSVGATTIFVGKVREMNLGDNVSGLYLEHYPAMTKKALQEIVNQARQRWELQRIAVIHRIGQLHTGDEIVLVGVSSAHRGDAYLANEFIMDYLKTKAPFWKRETTAEGERWIESRESDEQQLEKWR

SEQ ID NO: 70407 - DNA, 492 bp, Bordetella pertussis Tohama I
  CDS (1)..(492): transl_table=11
ttgaacatcatggttatcgtccaggaagccgatttcgacagcgccgccctgctggcggcgctgcgcgaacgcgtcggcggacaggccggcgcaatcgtcacgttcgtgggctacgtgcgcgacttcgcgcccgagcaggccaccgagacgctgtatctcgaccactatcccggcatgtgcgaacgcgagctggaaaccatcgcggccaccgcgcgcgagcgctgggacctggccggcacggtcatcgcccaccgggtgggcgccctgccgcgcggcgcgcagatcgtgttcgtggcggccgccagcgcgcatcgcggcgacgcctttcgcggctgcgagtacatcatcgacgccttgaagacccgggcgccattctggaaacgcgaaaccctggctgccggcgacagcttctgggtggagcagcgccaatccgacgccgaccgcacccagtcctgggacgacccgggcacgcccaccaaggagcatccatga

SEQ ID NO: 70408 - protein, 163 aa, Bordetella pertussis Tohama I
MNIMVIVQEADFDSAALLAALRERVGGQAGAIVTFVGYVRDFAPEQATETLYLDHYPGMCERELETIAATARERWDLAGTVIAHRVGALPRGAQIVFVAAASAHRGDAFRGCEYIIDALKTRAPFWKRETLAAGDSFWVEQRQSDADRTQSWDDPGTPTKEHP

SEQ ID NO: 70409 - DNA, 429 bp, Synechococcus sp. WH 8102
  CDS (1)..(429): transl_table=11
atgaccggttgccgtgtggaggtgtgcccggatccctttgatccgtggcagcagcttgcgctctggtgtggggatgccgcggccgcggccatcttcatcggtcgggtgcggcccaccacgatggatggccggcctctggaggcgctggagctggagcacttccccggcctctgcgaacgtcagatcacagctatggcccagcgtctgcagcaggagcaccaggcggggccgattttggtgctgcatcgggtgggcaagcttgcccccggtgagccgatcgtgctggtggcggtgcaggccgatcgtcgtggagcggcgcagcgctgctcagccgccttgttggagcatctcaagcaccaggccccgttctggaagcgggagtggtgcgcgggtcagggcacctggctggtggccaacacgccactctga

SEQ ID NO: 70410 - protein, 142 aa, Synechococcus sp. WH 8102
MTGCRVEVCPDPFDPWQQLALWCGDAAAAAIFIGRVRPTTMDGRPLEALELEHFPGLCERQITAMAQRLQQEHQAGPILVLHRVGKLAPGEPIVLVAVQADRRGAAQRCSAALLEHLKHQAPFWKREWCAGQGTWLVANTPL

SEQ ID NO: 70411 - DNA, 477 bp, Chromobacterium violaceum ATCC 12472
  CDS (1)..(477): transl_table=11
atgacggtcaaccatatccgggtgcagaccgagggcttcgacgtcggcgccgaggtcaggcgctggtcggtcaatccggcctgcggcgcggtggtcagcttcaccggcctggtgcgcgattacggcgaccgccaggacgtggtggcgctggagctcgagcattacccgggcatgaccgaaaaggcgctggccgacatcgtccgccaagcgcgcgcgcgctggtcgctgaagggcgtgacgctgatccaccgcgtcggccggctggcgctgggcgacgacatcgtgttggtggtggtggccagcggccaccgccgcgacgccttcgaggccgccgccttcctgatggactatctgaagcggcaggcgccgttctggaaatgcgagatcctggccgacggcagccgccactgggtggacgccaaggccagcgacgaggcggcggcggcgcgctggaacgcgcagggggagcaatcatga

SEQ ID NO: 70412 - protein, 158 aa, Chromobacterium violaceum ATCC 12472
MTVNHIRVQTEGFDVGAEVRRWSVNPACGAVVSFTGLVRDYGDRQDVVALELEHYPGMTEKALADIVRQARARWSLKGVTLIHRVGRLALGDDIVLVVVASGHRRDAFEAAAFLMDYLKRQAPFWKCEILADGSRHWVDAKASDEAAAARWNAQGEQS

SEQ ID NO: 70413 - DNA, 450 bp, Gloeobacter violaceus PCC 7421
  CDS (1)..(450): transl_table=11
gtgggcggcgaacacttttgttttacggacaaaccgctttcgatcgagcgcgcctacaccctgacggccgctcccgcctcgggggcggtggtgacgatggtgggcaccgtgcgcgccagcaccggggggcgggcggtcgcttttcttgattacgaagcgtttgaaccgatggccctggatgtctttgcgcagatcgcccgtcagatccgcgagcgctggcccgccaccggcaacatcgtcatccaccaccgcctgggacgcctcatggtgggcgaagcgagcgtgatcatcgccgtgggcaacgcccaccgagccgacgcctttgccgcctgccagtacgccatcgacaccctcaagctggatgctcctatctggaaaaaagagcactgggcggatggggacagcgactgggtggtgggtctggcggttctcactgaaccgagtacctga

SEQ ID NO: 70414 - protein, 149 aa, Gloeobacter violaceus PCC 7421
MGGEHFCFTDKPLSIERAYTLTAAPASGAVVTMVGTVRASTGGRAVAFLDYEAFEPMALDVFAQIARQIRERWPATGNIVIHHRLGRLMVGEASVIIAVGNAHRADAFAACQYAIDTLKLDAPIWKKEHWADGDSDWVVGLAVLTEPST

SEQ ID NO: 70415 - DNA, 453 bp, Photorhabdus luminescens subsp. laumondii TTO1
  CDS (1)..(453): transl_table=11
atggaaaacacccgcattttcgttgggccgaagaatttcaagctaggggatgaatatcaatggcttgctcaatgtgatgaagatggtgctattgtcactttcaccggcaaagtccgcaatcataatttgggagataatgtcggggcgctgagattggaacactatccgggaatgacggaaaaaacattacggcgtattgtcaccgaagcacgcagtcgctggccgttgcagcgaatcagtgttgtccatcgggttggtacattgtatccgggtgatgagatcgtgtttgtgggtgtgaccggtgctcatcgtcatatggcttttgaagcggctgaatttattatggattttttgaaaacgcaggcacctttctggaaaaaggagttcttgcctgatggtgaacgttgggttgaatcccgagagagcgatcaggaagccgtgaaacgctggtaa

SEQ ID NO: 70416 - protein, 150 aa, Photorhabdus luminescens subsp. laumondii TTO1
MENTRIFVGPKNFKLGDEYQWLAQCDEDGAIVTFTGKVRNHNLGDNVGALRLEHYPGMTEKTLRRIVTEARSRWPLQRISVVHRVGTLYPGDEIVFVGVTGAHRHMAFEAAEFIMDFLKTQAPFWKKEFLPDGERWVESRESDQEAVKRW

SEQ ID NO: 70417 - DNA, 996 bp, Corynebacterium diphtheriae NCTC 13129
  CDS (1)..(996): transl_table=11
atgtcatcacattctcctgtgcagccacgtcgcgcacgtgttgttgtggcgtcgacacgcgccgcagcaggtcagtacgccgatacctccggccccatcttggtggagtggctgcgagcgcgtggttttgataccccagaaccactcgttgttgctgatgctgacatgcatactgccatcgccactatgtttgctgaggcggagtcactgcctgatgttgtcctcacaaccggtggcacggggattactgccgacgatcatactgtcgatgtagtagccccactgattgatacgccgcttccgggtatttcacaggcgttctggcatcgcggactgctcaatagtgtggacacagctattcttagtcgctgcgtagcgggtattcatcgcggttctacgtttattatgaccctgcctggttctcagagcggatgcaatgatggcatcgctgtcctcgataccatcattgatcatgtgtgcgacctcttggctcgcacaccttcttctcccccacaagcgcatcagtgctgttcccattccgcccccgacccagattatgtgaaggcgcaggtaggcaaagtcattgatgcgtttatcaccgaagatccattggagccgctagcggcccaagcctatgatgacgtgcgcactgatgctatgggcgcggtcgtggtttttgatggtctggtacgagatcatgatggaggtaagcgtgtcagcaacctcacctactccgcacaccccacctctcatgcagtgttaaaaaaggtagtagcccgtgtcagtgtcaagcaccccgatgcacgaatctgggcagcacaccgcgttggtcgccttgctgtgggggaggctgccttcattgtgattgctgccgcagcgcaccgccgatcagcatttgatgcagcaagcgcagtagctgatgaagtcaaagcttcggttccgatctggaaagagcagaaaatggcagatggttccatccagtgggttggactctga

SEQ ID NO: 70418 - protein, 331 aa, Corynebacterium diphtheriae NCTC 13129
MSSHSPVQPRRARVVVASTRAAAGQYADTSGPILVEWLRARGFDTPEPLVVADADMHTAIATMFAEAESLPDVVLTTGGTGITADDHTVDVVAPLIDTPLPGISQAFWHRGLLNSVDTAILSRCVAGIHRGSTFIMTLPGSQSGCNDGIAVLDTIIDHVCDLLARTPSSPPQAHQCCSHSAPDPDYVKAQVGKVIDAFITEDPLEPLAAQAYDDVRTDAMGAVVVFDGLVRDHDGGKRVSNLTYSAHPTSHAVLKKVVARVSVKHPDARIWAAHRVGRLAVGEAAFIVIAAAAHRRSAFDAASAVADEVKASVPIWKEQKMADGSIQWVGL

SEQ ID NO: 70419 - DNA, 468 bp, Rhodopseudomonas palustris CGA009
  CDS (1)..(468): transl_table=11
atgaccgttccggtgaccatccgcattcaggaagccgatttcgacgtcgctgccgagaccgccgcgatgacgcgcggccgtaccgatatcggcgcggtggtgtcgttcatgggcctgtgccgcggcgtcgaaggcgacgacaccgtcgcggcgctgacgctcgagcactatcccggcatggccgagaaggaaatccagcgccatgccgatgaggcgatcaagcgctggccgatcaccgcgctgacgatcatccaccgcgtcggccggctggtgccgggcgacaacatcgtgctggtgctggcggcctcggcgcatcgccaggcggcgttcgcggcggcggaatttctgatggactatctcaaggccaacgcgccgttctggaagcgcgaggagcgctcagacggctcgcgctgggtcgaggcgcacagccgcgacgacgccgcgctggcgcgatggagcaaggattga

SEQ ID NO: 70420 - protein, 155 aa, Rhodopseudomonas palustris CGA009
MTVPVTIRIQEADFDVAAETAAMTRGRTDIGAVVSFMGLCRGVEGDDTVAALTLEHYPGMAEKEIQRHADEAIKRWPITALTIIHRVGRLVPGDNIVLVLAASAHRQAAFAAAEFLMDYLKANAPFWKREERSDGSRWVEAHSRDDAALARWSKD

SEQ ID NO: 70421 - DNA, 426 bp, Mycobacterium avium subsp. paratuberculosis str. k10
  CDS (1)..(426): transl_table=11
atgacgctcgtcgtgcgcgccgccgtgaccgagcacccgatcgtgctggcccagcacgaggaactggtcggccatcagtcggccggggcggtcgtcgggttcgtcgggatgatccgcgaccacgacggcgggcggcgggtggttcggctggagtactccgcgcatccgagtgccggcgaggtcatggccgaggtggtggccgaggtggcggagcggtcctgcggggtgcgggccgtcgccgccagccatcggatcggtgtgctcagcatcggcgaggcggcgctggtggccgccgtggccgccgaccaccggcaggccgcattcgacacctgtgcacagctggtggacaccgtcaaggcgcgattgccggtgtggaagcaccagttcttcgccgacggcaccgacgaatgggtgggctcggcctga

SEQ ID NO: 70422 - protein, 141 aa, Mycobacterium avium subsp. paratuberculosis str. k10
MTLVVRAAVTEHPIVLAQHEELVGHQSAGAVVGFVGMIRDHDGGRRVVRLEYSAHPSAGEVMAEVVAEVAERSCGVRAVAASHRIGVLSIGEAALVAAVAADHRQAAFDTCAQLVDTVKARLPVWKHQFFADGTDEWVGSA

SEQ ID NO: 70423 - DNA, 465 bp, Bacillus cereus ATCC 10987
  CDS (1)..(465): transl_table=11
atgggacaagtgctatttgagattgttgatataccgattgtagttgaagaagtaacgaataaagttgcaagaagagaggcaggtgcgattacaacttttattggtacagtgagagaattaacaaaaggaaaacgaacgctacatttagagtatgaagcatataaaccgatggcagtaaagcaacttatgagaattggtgaagaaattagtgaaagatggccggatgcaaaagtagcaattactcaccgagtaggccggctagaaataatggatattgcggtagtcattgcagtttcatcaccgcatcgcaaagtagcttatgaagcgaatgaatacgcaattgaacgtataaagcgaatcgtcccaatatggaaaaaagaattttgggaagatgggacgatgtggattggcgatcaacttgaaaatacaccatatccagcaggaaaaccgaagaaggaagaatga

SEQ ID NO: 70424 - protein, 154 aa, Bacillus cereus ATCC 10987
MGQVLFEIVDIPIVVEEVTNKVARREAGAITTFIGTVRELTKGKRTLHLEYEAYKPMAVKQLMRIGEEISERWPDAKVAITHRVGRLEIMDIAVVIAVSSPHRKVAYEANEYAIERIKRIVPIWKKEFWEDGTMWIGDQLENTPYPAGKPKKEE

SEQ ID NO: 70425 - DNA, 426 bp, Methanococcus maripaludis S2
  CDS (1)..(426): transl_table=11
atgattagagtgtctaatgaagattttaacgttgacgttgaaactaaagcccttttaaaaaatcatcctgaaataggtggacttgtaaattttgtaggggttgttagaaacgtaggatacgataaaggcgttgaaaaagaagctgaatttattgaatttgaatgctatgaacagatggcttctaaaaaactcgaagaattaaaaaatagggcaattgaaaagttcaacataatcgatgctacgttaatccacaggatcggaaccttgaaagtaggggacaatattgtattgatagttgttggggcaaaacacagaaaagaagcatttttagcctgcgaatatttaattgacagcctaaaagaagaagttccgatatggaaaaaggaattttcaaaagatggttcttactgggtagaacaacactaa

SEQ ID NO: 70426 - protein, 141 aa, Methanococcus maripaludis S2
MIRVSNEDFNVDVETKALLKNHPEIGGLVNFVGVVRNVGYDKGVEKEAEFIEFECYEQMASKKLEELKNRAIEKFNIIDATLIHRIGTLKVGDNIVLIVVGAKHRKEAFLACEYLIDSLKEEVPIWKKEFSKDGSYWVEQH

SEQ ID NO: 70427 - DNA, 417 bp, Anopheles gambiae str. PEST
  CDS (1)..(417)
atgattgatataaaaataacagaaaacaaactgaatattacagaatgccttgagattgcaaacgatttagggagtggtggtattgcaagttttataggaacagttagaaataaaaccaaagataaaccagttgtccggttagaatatgaatgctatagatctatggctattaaagaaattcagaaaataatcgatcaggcaattaccatattttctgtacgaaatattgttgttcaccatcggactggagttctttttccgggagaagaagctgtaattattgtagtaagcgatggacatcgtgatgctgttttcgatgcttgccgctatattatagataccataaagcaaacagtgcctatctggaaaaaagaaatttttgaagatggagaagaatgggtttctgcgcatccttga

SEQ ID NO: 70428 - protein, 138 aa, Anopheles gambiae str. PEST
MIDIKITENKLNITECLEIANDLGSGGIASFIGTVRNKTKDKPVVRLEYECYRSMAIKEIQKIIDQAITIFSVRNIVVHHRTGVLFPGEEAVIIVVSDGHRDAVFDACRYIIDTIKQTVPIWKKEIFEDGEEWVSAHP

SEQ ID NO: 70429 - DNA, 456 bp, Anopheles gambiae str. PEST
  CDS (1)..(456)
atgaattatctaaagttaacgtttgataagctggacgtcggggcgctgaacgatcaggtggcgcacgaaagctgcggtgcggtgtcattgttcgtcggcacgaccagagataactttgagggcaaaaccgtcgttttgctagagtacgaggcttatgaagccatggcgatcaaaacgatgaatctgctgtgcgaggaggtccgcgcgcgctggccggatgtggtcaacatcggcatacaccatcggctggggacggttccggtaaaggaagcgtccgttgtgatagcgataagctcgccgcatcgcaagtccagtctagaggcggtgcattttaccatcgacgagctgaagaaatccgtacctgtttggaagaaggagctgtacgatggagagggcagctcagaatggaaggagaacagcgaatgcacatggtcgaagaagtacaaggacaactag

SEQ ID NO: 70430 - protein, 151 aa, Anopheles gambiae str. PEST
MNYLKLTFDKLDVGALNDQVAHESCGAVSLFVGTTRDNFEGKTVVLLEYEAYEAMAIKTMNLLCEEVRARWPDVVNIGIHHRLGTVPVKEASVVIAISSPHRKSSLEAVHFTIDELKKSVPVWKKELYDGEGSSEWKENSECTWSKKYKDN

SEQ ID NO: 70431 - DNA, 621 bp, Neurospora crassa
  CDS (1)..(621)
atggcaactcaacaaccaacccaaaccgataattcggctcaagctcaaccgccacaaacaaacccagcaaagcccaccgagatctcagaacccggcatctacgtagccctcacccacgaccacctcaactatcaatccgttatagaccgagtccgctccccagaagctggggccattgttgtctttgccggtaccacccgcaacaactttaactccctccctgtccagcacctctcctatacctcctatgcgcccctagctttgcgcaccatgttaaccatatgccgctccattctcaccaagcacgggttgaaggggatagcgatggtacacaggttaggtgtggtccccatcggagaggaaagtatcttgattgctgtatcatctccccatagacaggcggcatggagggcgggggaagaggcgttggaggagtgtaaagccaaagtggaggtgtggaagcgggaggagtttggtggcgaggggggaggggtgtggagagctaatagggatggtgcggtgggggttaaggttgatgagcctaggataggcaaaggggaagtggatgagaaggaggatgagggcgacagcgggaacgggggaaatgataggaagagctga

SEQ ID NO: 70432 - protein, 206 aa, Neurospora crassa
MATQQPTQTDNSAQAQPPQTNPAKPTEISEPGIYVALTHDHLNYQSVIDRVRSPEAGAIVVFAGTTRNNFNSLPVQHLSYTSYAPLALRTMLTICRSILTKHGLKGIAMVHRLGVVPIGEESILIAVSSPHRQAAWRAGEEALEECKAKVEVWKREEFGGEGGGVWRANRDGAVGVKVDEPRIGKGEVDEKEDEGDSGNGGNDRKS

SEQ ID NO: 70433 - DNA, 549 bp, Magnaporthe grisea 70-15
  CDS (1)..(549)
atgtcacaactagactctgcccagctgccaaacgaggcaaacgaggtgggggaagacggttgctacgtcggactcacgcacgacaaactcgatgtgcaacgcaccatggacagagtgcgaagcccagaggctggggcgattgtggtttttgtcggcacaacacgcaacagcttcgacggcaagcccgtcaaggagctaaactacacagcctacaacccaatggccctgcgcaccatgatttcgatctgcaaggccatgaagacaaagcacggtctcaagggaatcgccatggtgcacaggctgggagtcgtcccgatctccgaggacagcatcgtcatcgccgtgtcatccccccaccggcaggctgcctggagggctggcgaggaggcgttagaggagtgcaaggccaaggttgaggtctggaagcgtgaagaatttgagggcggcgagggagtatggagagccaaccgcgacggcgcgcccgggcaaaggattgacacggcggaacccgcagtcggagctggcagcggcggggaaattgatgactag

SEQ ID NO: 70434 - protein, 182 aa, Magnaporthe grisea 70-15
MSQLDSAQLPNEANEVGEDGCYVGLTHDKLDVQRTMDRVRSPEAGAIVVFVGTTRNSFDGKPVKELNYTAYNPMALRTMISICKAMKTKHGLKGIAMVHRLGVVPISEDSIVIAVSSPHRQAAWRAGEEALEECKAKVEVWKREEFEGGEGVWRANRDGAPGQRIDTAEPAVGAGSGGEIDD

SEQ ID NO: 70435 - DNA, 492 bp, Gibberella zeae PH-1
  CDS (1)..(492)
atggcgggttcacagaatactcaagatgtctgggaacaaacagaacaagactgctatgttgccttgacacacaatcacttaaacgcccaggccatcatggaccgtgtacgcagaccctcagctggcgctattgttctctttgcaggaaccactcgtgataatttcgccgggaaaccggtcaaggaactgcaatacacagcatatcatcctcgtgctcttaagtccatgatggccattgcgaaagacgtttgtgagaagcatggtctgcgtggagtagccatgattcatcgtcttggtgctgttcccatcggtgaggagagcattctgatcgccgtatcatccccgcatcgtcaagcagcgtggcgggcgggtgaagaagcgttggaagagtgtaaaaacaaggttgaggtatggaaacgtgaagagttcgaaggtgaggagggagtttggagagccaatagggatggagctataggacagcgcgaaacatag

SEQ ID NO: 70436 - protein, 163 aa, Gibberella zeae PH-1
MAGSQNTQDVWEQTEQDCYVALTHNHLNAQAIMDRVRRPSAGAIVLFAGTTRDNFAGKPVKELQYTAYHPRALKSMMAIAKDVCEKHGLRGVAMIHRLGAVPIGEESILIAVSSPHRQAAWRAGEEALEECKNKVEVWKREEFEGEEGVWRANRDGAIGQRET

SEQ ID NO: 70437 - DNA, 1341 bp, Apis mellifera
  CDS (1)..(1341)
atggataacagtgttgaaatacaagttaaagttttatttttcgctaaagcaagagaaataacagggaaaaaagaatggtatattgttgttccacaaaaattatcatatactgatttggtagataaaataataactcattttaatttagaaaatattcgtgatactttaatcctagcagtgaacgaagaatttgttcccttaaatagcacattaatactttcgcaaaaagacgaaattgctgttattccaccacttagtggaggtttgactttgccatatgttagaatgggtactacaaaagatatcgtgaaattgcaacaagaagagttaaatattggatatataattgatttagtaactgcatctaattgtggagctgtatcaaattttattggtattactcgtgataattttgataataaaagggttttaaaattagaatacgaagcatatgaaccaatggcattaaaagaaatgaataatatatgttcaaaaattcgttctcaatggaatgttcatcatattgctatatatcaccgtttaggagaagtaccagtatctaaagcaagtgtagtaattgcaatttcatctcctcatagagaagaatcattaaaagctgttgaatatgctattaatgcattaaagtcatctgttccaatttggaaaaaagaaatatacgatacacaagaaatgcaatggaaagaaaacaaagaatgtgcctggtcaaatattcataatgcaattgattttgaagaatcagaaaatattgcaataacaaatgaagtaatagagacaacagtagaatatgatacttttattgaacgaaaacgtcaacaagtaaatattgtgaatgtacaagaattttgttgtcacagagatcaaaatgatgagaatgaagattcttgtgcaagagttgatgccattcttattagaagaaaagattcaaaaagtcatgtaaaagtgcatagagtacttaatacatggggaccgcaaacggtagatcaacatgttttacataaagttacaatgtcgggagcaaatcaaacaaataattattcatcggtattagatgaaagaatttcaactactgaaaaaattcttggaataaatcgacctgttcccaaagatgtttatgaaaggcttaaaaatattgaagatagaatattatatttagaaggcatatctcctgaatataagaatctttggaaagcagaagatatgaataatcttaaaggaacatttaaaccaattagaaaaaggacatattccatggcagaacttgattcaaaattgcatgaattagaagataaatatgccaaaagaatgtcggtcagagattaa

SEQ ID NO: 70438 - protein, 446 aa, Apis mellifera
MDNSVEIQVKVLFFAKAREITGKKEWYIVVPQKLSYTDLVDKIITHFNLENIRDTLILAVNEEFVPLNSTLILSQKDEIAVIPPLSGGLTLPYVRMGTTKDIVKLQQEELNIGYIIDLVTASNCGAVSNFIGITRDNFDNKRVLKLEYEAYEPMALKEMNNICSKIRSQWNVHHIAIYHRLGEVPVSKASVVIAISSPHREESLKAVEYAINALKSSVPIWKKEIYDTQEMQWKENKECAWSNIHNAIDFEESENIAITNEVIETTVEYDTFIERKRQQVNIVNVQEFCCHRDQNDENEDSCARVDAILIRRKDSKSHVKVHRVLNTWGPQTVDQHVLHKVTMSGANQTNNYSSVLDERISTTEKILGINRPVPKDVYERLKNIEDRILYLEGISPEYKNLWKAEDMNNLKGTFKPIRKRTYSMAELDSKLHELEDKYAKRMSVRD

SEQ ID NO: 70439 - DNA, 669 bp, Ustilago maydis 521
  CDS (1)..(669)
atgacgggcactttatcgcaagagggtggtctgagtcctgcctcagcggaagcatcaccctctacgtcgggcagcatcaggaatcagtacggagacgaagcagtcctcacctacagcgtgttagacgagaagcaagcgatgaaatttgtcgccgacgacggtgctggagctactgtccttttcagtgggactacaagggactctttcagaggcaaaaaagtcaccaagctcgagtacgaagcatactcttcgctagctttaaagacgctccagtcgttactcgacaacgcgcacacgtctgctccctttgcagaaacgccgacacctatctctgccaacgtagatcctcaagcggaccactcgagcgaagacagggtgacaaggtgctatatttcgcatcgacttggcgtagtgggcgtgggcgagtgcagtatactgatcgcggtcagctcaccacatcggaaggaagcatttgtggtagcggaatggttattagaagaggttaaaaagaacgttgccgtttggaagcgggaattctacactacgggagatgacctgactgcattggatggagacgccaggacatatgatcctaggaaaaacgaagcagtagtcgatgctgctgacagtcaaagctggagctggaaggccaactttcctagcacatga

SEQ ID NO: 70440 - protein, 222 aa, Ustilago maydis 521
MTGTLSQEGGLSPASAEASPSTSGSIRNQYGDEAVLTYSVLDEKQAMKFVADDGAGATVLFSGTTRDSFRGKKVTKLEYEAYSSLALKTLQSLLDNAHTSAPFAETPTPISANVDPQADHSSEDRVTRCYISHRLGVVGVGECSILIAVSSPHRKEAFVVAEWLLEEVKKNVAVWKREFYTTGDDLTALDGDARTYDPRKNEAVVDAADSQSWSWKANFPST

SEQ ID NO: 70441 - DNA, 588 bp, Aspergillus nidulans FGSC A4
  CDS (1)..(588)
atgtcagccagacccgaaccgcaaccgggatccgaacgcaacgcaacagaacccctcccttcacaccttgacccaacaacctatccgcgaaccctcacaacaactcacgggcccaccagcattcccctccacctcgagctaacataccacacgctctcccccaccaccgccctgcaacacgtttcctcccctagtagcggtgcaaacattctcttcctcggcacaacacgcgacacgtttgatgaccgtcccgtcgcccgcctctcatatacatcatacccagccctcgcgctgaaatcattgcacaaaatctcctctgaagcggttgagaagttcgggctgaatggtgtctatatcgcgcatcggcttggtgaagttcccgttggggaggcgagtattgttgttgcggtgggggcggggcatagaggggaggcctggaggggcgcggagtgggtgcttgaggttgtgaaggagcgggttgaggtgtggaagagggaggagtttgtggatggagggatggagtggagggagaacagggagagggatgggtttggaaaattgaagaccaaaaaggaggattctagatga

SEQ ID NO: 70442 - protein, 195 aa, Aspergillus nidulans FGSC A4
MSARPEPQPGSERNATEPLPSHLDPTTYPRTLTTTHGPTSIPLHLELTYHTLSPTTALQHVSSPSSGANILFLGTTRDTFDDRPVARLSYTSYPALALKSLHKISSEAVEKFGLNGVYIAHRLGEVPVGEASIVVAVGAGHRGEAWRGAEWVLEVVKERVEVWKREEFVDGGMEWRENRERDGFGKLKTKKEDSR

SEQ ID NO: 70443 - DNA, 468 bp, Gallus gallus
  CDS (1)..(468)
atggatgaaagagaggatgtgccaaaagattttatcaagctcaagtctgaaaagctgtctgtagatgaagtgtcagaactggtcatttcaccatgctgtggggcggtgtctctgttcattggtactacaagaaataattttgaagggaaaaaagtgattcacttagagtatgaagcatatacttcaatggcagagatggaaataaagaagatctgcagagatgttagacagaagtggccatcagtcaaacatattgcattgcatcatagacttggagtggttccagtaacagaggcaagtgtaattattgcagtctcatctccacacagagcagaatcccttgaagctgtaacacactgtatcaacactttaaaagcaatcgtcccaatatggaaaaaggagatttatgaggacgagtattcttggaaagaaaacaaggaatgcttttggacaaattcagaaaaataa

SEQ ID NO: 70444 - protein, 155 aa, Gallus gallus
MDEREDVPKDFIKLKSEKLSVDEVSELVISPCCGAVSLFIGTTRNNFEGKKVIHLEYEAYTSMAEMEIKKICRDVRQKWPSVKHIALHHRLGVVPVTEASVIIAVSSPHRAESLEAVTHCINTLKAIVPIWKKEIYEDEYSWKENKECFWTNSEK

SEQ ID NO: 70445 - DNA, 582 bp, Oryza sativa (japonica cultivar-group)
  CDS (1)..(582)
atggctagcgacgagctccccgtggcggcagcggcaaccgaggaggaggacctcgtggagatcctcgacgaggggtcaggccggctcgacatcgcacggtacgtggaccacgtccgcgacctggcggcgggcgccatcgccacgttcgagggcaccacccgcgacagcttcgaggggaggcgggtggtggagctccggtacgaggcgtacggggccatggcgcggcgccggctcgcggccatcctccgggaggcccgcgccgcccactcgctgcggcggctcgccgtggcgcaccgcctcgggacggtccccgccggcgaggcgagcgtgttcgtggcggcgtccgcggtgcaccgcgccgacgcgatggaggcgtgccgctacgtcatcgacgaggtcaaagcgtccgtgcccatctggaagaaggaggtgtacgacgacggcgaggtctggaaggagaaccgcgagttcctcgaccgcaccaccaccgacggcaccaccgcgtcgtcgccggcgccggcgacgcggccggcgaagggcggcggttgctgcggccgcaaggtgagagtcaacgagagctga

SEQ ID NO: 70446 - protein, 193 aa, Oryza sativa (japonica cultivar-group)
MASDELPVAAAATEEEDLVEILDEGSGRLDIARYVDHVRDLAAGAIATFEGTTRDSFEGRRVVELRYEAYGAMARRRLAAILREARAAHSLRRLAVAHRLGTVPAGEASVFVAASAVHRADAMEACRYVIDEVKASVPIWKKEVYDDGEVWKENREFLDRTTTDGTTASSPAPATRPAKGGGCCGRKVRVNES

SEQ ID NO: 70447 - DNA, 414 bp, Picrophilus torridus DSM 9790
  CDS (1)..(414): transl_table=11
atgattgagtttacaaatgataaaataaataaggataaaataatagattctttaagatccggtatggcaggtgcgattgtaacgttctctggaactgtaagatcgtttgatgaaacctctgataatatcagggccctttactatgaggcatatatagatatggcagaatcaataataagaggtataatcgatgatgcaaaatccaggtataatataatagatgcttctgtatcacagagacttggaataatacctgttggtgatgaatcaatatacatagccgtttctgcaccacatagaaatgatgcattcgacgcatgcaggtttataatagacagaataaaaacggagccacccatatggaaaaaggagatttataatgattctgaactctggaaatcggattttaaataa

SEQ ID NO: 70448 - protein, 137 aa, Picrophilus torridus DSM 9790
MIEFTNDKINKDKIIDSLRSGMAGAIVTFSGTVRSFDETSDNIRALYYEAYIDMAESIIRGIIDDAKSRYNIIDASVSQRLGIIPVGDESIYIAVSAPHRNDAFDACRFIIDRIKTEPPIWKKEIYNDSELWKSDFK

SEQ ID NO: 70449 - DNA, 471 bp, Bacillus thuringiensis serovar konkukian str. 97-27
  CDS (1)..(471): transl_table=11
atgacacatacgtattatgaagtaattgatacacctatatcaattgaagaagttacaaacaaagtaattcggcgtgagtgtggtgcggttactacttttattggcactgttagagaatttacgaaaggccgacgtacgctttatttagagtatgtagcttataagacgatggcggagaaacagcttgagagaattggtaccgaagtaggggagaaatggcctggaacatatgtggcaattacacatcgcattggtatgttacaaatttcggatcttgctgttgttgtcgctgttgctacaccacatcggaaagcggcctatgaagcaaatgaatatattatggagcgcataaaacaaattgttccaatttggaagaaagagttttgggaagatggtgagtcatggataggtgatcagttagagcgggtaacatatgcaaatggtgagcctagaaaggagatgagaatatga

SEQ ID NO: 70450 - protein, 156 aa, Bacillus thuringiensis serovar konkukian str. 97-27
MTHTYYEVIDTPISIEEVTNKVIRRECGAVTTFIGTVREFTKGRRTLYLEYVAYKTMAEKQLERIGTEVGEKWPGTYVAITHRIGMLQISDLAVVVAVATPHRKAAYEANEYIMERIKQIVPIWKKEFWEDGESWIGDQLERVTYANGEPRKEMRI

SEQ ID NO: 70451 - DNA, 555 bp, Acinetobacter sp. ADP1
  CDS (1)..(555): transl_table=11
ctgattgtacgcttgtacttttatcgccagttgctggaggctaatatgaaagagtttcagcgggtacagtcagaagatttaagtttagattgttttgattcaattgcagagtttccagaatgtgggggaattggaatctttcagggaactgttagaaatcatcatgaaggtcgagcggttcaagctttaaaatacacctcttatacacctgtagcggaaaaaatgattcgccagattgagcaggatattacccagaaatatggcgtatcttatgtgcgagtcattcatcgcattggggctttagatattggtggtacagcaatcattgccgtggcttatgcaccacatcgccgtgaggcttttcaggcatgtgaagaagctgttgagcgtgtgaagcacgaagtacccatctggaaagaagaattttatatcgatgggagcagtcaatttgtagaaggctgttgtatccgtaaagatcatagtcatccgcatgaggatacgcctcatcaccatcattcagaacatcatcacaatcaccataatcatcagcattaa

SEQ ID NO: 70452 - protein, 184 aa, Acinetobacter sp. ADP1
MIVRLYFYRQLLEANMKEFQRVQSEDLSLDCFDSIAEFPECGGIGIFQGTVRNHHEGRAVQALKYTSYTPVAEKMIRQIEQDITQKYGVSYVRVIHRIGALDIGGTAIIAVAYAPHRREAFQACEEAVERVKHEVPIWKEEFYIDGSSQFVEGCCIRKDHSHPHEDTPHHHHSEHHHNHHNHQH

SEQ ID NO: 70453 - DNA, 453 bp, Erwinia carotovora subsp. atroseptica SCRI1043
  CDS (1)..(453)
atggcagaaacgcgtattcaggtcggcgaagagaacttcaacgtaggtgatgagtatcagtggctggcacagtgtgatgaagacggcgcagtcgtgacgttcacgggtaaggtgcgtaatcacaatttggcgaaagacgtcagcgcactcacgttggaacattatcccggcatgacggaaaaagcgctggcagagattgtcgagctggcacgcgaacgttgggaactgccgcgtgtgagcgtgattcatcgggtaggcgcactctatccgggcgatgaaattgtgtttgttggcgtcagtgccgcccaccgcagcgcggcatttgatgccgcccaattcatcatggattacctgaaaacccgcgcgccattctggaagcgagaagccacgccggaaggtgagcattggattgaatcgcgagacagtgataaacaggccgcgcagcgctggtag

SEQ ID NO: 70454 - protein, 150 aa, Erwinia carotovora subsp. atroseptica SCRI1043
MAETRIQVGEENFNVGDEYQWLAQCDEDGAVVTFTGKVRNHNLAKDVSALTLEHYPGMTEKALAEIVELARERWELPRVSVIHRVGALYPGDEIVFVGVSAAHRSAAFDAAQFIMDYLKTRAPFWKREATPEGEHWIESRDSDKQAAQRW

SEQ ID NO: 70455 - DNA, 423 bp, Propionibacterium acnes KPA171202
  CDS (1)..(423): transl_table=11
atgcacgccaagatcagtgacgagccgctgaacgtcgccaaggtcgtcagcttggtgagtgacgaccgcagtggcgctgtcgtgactttcaccggagtggttcgcaaccacgatggcggccagtccattacagccatcgactatagtgcccacccccatgccacgcagatcttggcagacctagtcgaacagtgcgccacgcgcgatggcgtccacggcgtagctgccgagcaccgaatcggccacgtggaggtcggcgggacagcgatggtcgtggccgtgtcggcagaccaccgcgggcaagcatttgaggcggcctgtgaattcgtcgacgccgttaaggaaagcctgccggtgtggaagtgccaatggctcactgacggctcccacgaatgggccgggctgcccggggaggagccgtga

SEQ ID NO: 70456 - protein, 140 aa, Propionibacterium acnes KPA171202
MHAKISDEPLNVAKVVSLVSDDRSGAVVTFTGVVRNHDGGQSITAIDYSAHPHATQILADLVEQCATRDGVHGVAAEHRIGHVEVGGTAMVVAVSADHRGQAFEAACEFVDAVKESLPVWKCQWLTDGSHEWAGLPGEEP

SEQ ID NO: 70457 - DNA, 693 bp, Symbiobacterium thermophilum IAM 14863
  CDS (1)..(693): transl_table=11
gtgaaactcttcgcggcggcggccgacgccgtgggccggcgtaccctggagggcgactgggccggccggacgaccgcgcagctcctggagatcctgacgcagcagtacccgaacctggcccgcctcgccccggtgctctctgtggccgtcaaccgcgagtatgcccccgccgaccgggtgctggccgacggcgacgaggtggcgctcatcccgccggtcagcgggggggccgatgacccggagcctccgctcttcgccatcaccaccgagcccctctcggccgacgagatcgccgccagggtcaccaacccgcattccggcgcgacgctggtcttcgtcggcacggttcgggagtggacccggggccggcgcacggtctacctggagtacgaggcctatcccgagatggccgtggcacagatggaacagatcgggcgggagatcgcggagcgctggccgggtgcgcgcaccgcgatcgtgcaccgggtgggcaggttggagatcggcgaggccagcgtagtcatcgccgtggccaccccccaccgggcggacgccttcgaggcctgccggcacgccatcgagcggctgaagcagatcgtgcccatctggaagaaagaggtctgggaggacggcgaggcctgggtcggcagccagatcggtcccgactggatgcatcaacctctcaaagaataa

SEQ ID NO: 70458 - protein, 230 aa, Symbiobacterium thermophilum IAM 14863
MKLFAAAADAVGRRTLEGDWAGRTTAQLLEILTQQYPNLARLAPVLSVAVNREYAPADRVLADGDEVALIPPVSGGADDPEPPLFAITTEPLSADEIAARVTNPHSGATLVFVGTVREWTRGRRTVYLEYEAYPEMAVAQMEQIGREIAERWPGARTAIVHRVGRLEIGEASVVIAVATPHRADAFEACRHAIERLKQIVPIWKKEVWEDGEAWVGSQIGPDWMHQPLKE

SEQ ID NO: 70459 - DNA, 486 bp, Mannheimia succiniciproducens MBEL55E
  CDS (1)..(486): transl_table=11
ttgccttttttccgcctgttaccgggggataaaatgtcggatattaaaattgcagtgcaggaagcggaattcgatcaaaacagcgaatatcgctggttgtcacaatccgattcagtgggggcaagtgtcatttttgtagggaaagtgcgtgatctcaatttgggcgatgaagtatcaagcctttatttagaacattacccggcaatgacggaaaaagcactgaatgaaattgtggatgaagcaaaatcccgctgggatattcagcgggttgtcgttatccacagagtcggcttattgcatacaggtgatgaaatagtactggtcggcgtaagttcggctcatcgcggcgatgcctatcatgccaatgaatttattatggattacctgaaaaccaaagcgccgttttggaaaaaagaaaaaacggataaaggcgaacgctggatagaaagccgggacagcgatcaacaggctgcggaaaaatggtaa

SEQ ID NO: 70460 - protein, 161 aa, Mannheimia succiniciproducens MBEL55E
MPFFRLLPGDKMSDIKIAVQEAEFDQNSEYRWLSQSDSVGASVIFVGKVRDLNLGDEVSSLYLEHYPAMTEKALNEIVDEAKSRWDIQRVVVIHRVGLLHTGDEIVLVGVSSAHRGDAYHANEFIMDYLKTKAPFWKKEKTDKGERWIESRDSDQQAAEKW

SEQ ID NO: 70461 - DNA, 489 bp, Burkholderia pseudomallei K96243
  CDS (1)..(489): transl_table=11
atggcgacggtacgggtgcaggcggacgatttcgacgtgagtgccgagatcgcggcgctgcgcgcgcgcaatccgaaggtgggcgcgatcgcgtgcttcgtcggcacggtgcgcgatttgaacgaaggcgagcaggtcgacgcgctcgagctcgagcactatccgggaatgaccgagaaggcgctcgccgcgatcgcggaggacgcgatcgcgcgctggccgggcatcgacgtcgccatcgtccatcgggtcggcaagctgtatccgcttgatcagatcgtgttcgtcgcgaccgtgtccgcgcaccgcggcgacgcgttccagtcgtgcgagttcgtgatggattacctgaagacgcaggcgccgttctggaagaaggagaagacgccggcgggcgagcgctgggtcgacgcgcgcagcgccgacgacgcggcgctcgcgcgttggggcgtcgaatcggggaacgcgcgggaaaagcgttcgacgtag

SEQ ID NO: 70462 - protein, 162 aa, Burkholderia pseudomallei K96243
MATVRVQADDFDVSAEIAALRARNPKVGAIACFVGTVRDLNEGEQVDALELEHYPGMTEKALAAIAEDAIARWPGIDVAIVHRVGKLYPLDQIVFVATVSAHRGDAFQSCEFVMDYLKTQAPFWKKEKTPAGERWVDARSADDAALARWGVESGNAREKRST

SEQ ID NO: 70463 - DNA, 456 bp, Methylococcus capsulatus str. Bath
  CDS (1)..(456): transl_table=11
atgctgatcgagatccgcagtgaggccttcgaccctctcgccgaactctcccgctaccaggacgcgtctctgcccacggcacgcataggggccctcgcggtcttcatcggtaccatgcgcgacttcaacgaaggctcatccgtccacaagatgacgctcgagcactatgccggcatgaccgaacgtcagctgcaaaccatcgtcgacgaagcccggaaccgctggccgttcgacgacgctctcgtgattcaccgcgtcggcgagctgtttcccgccgaccccatcgtgctggtcgccgtctggtcgtcccaccgcggaaccgccttcgatgcctgccgccatatcttggaagcgctcaagcaccgtgctccgttctggaagaaagagagcctggagcaaggcgagcgctgggtccggacgaacacggacggccatgctcctccccccagcccgtga

SEQ ID NO: 70464 - protein, 151 aa, Methylococcus capsulatus str. Bath
MLIEIRSEAFDPLAELSRYQDASLPTARIGALAVFIGTMRDFNEGSSVHKMTLEHYAGMTERQLQTIVDEARNRWPFDDALVIHRVGELFPADPIVLVAVWSSHRGTAFDACRHILEALKHRAPFWKKESLEQGERWVRTNTDGHAPPPSP

SEQ ID NO: 70465 - DNA, 438 bp, Nocardia farcinica IFM 10152
  CDS (1)..(438): transl_table=11
atgaccagtgagacgacgaccggggtacggctggcccgcatcagcgaccagccgctcgacccgacgagggccgaagcggccgtcaccggccccgaacacggggcggtggtggtgttcaccggcaaggtccgcaaccacgacggcgggcaggcggtggcggcgctggagtactccgcccacccgcaggccgagcgcttcctgcgcgaatgctgcgcggcgatcgcgacgagcagcggcctgccggtcgcggccgagcaccgtgtcggggcgctcgggatcggcgatccggccatcgtggtggcggtggccgcaccgcaccgggccgaggccttcaccgcctgcgccgaactggtcgaccggatcaagcacgaggtgccgatctggaagcgtcaactcttcgccgacggcctctccgaatgggtgaacgcctgcacctga

SEQ ID NO: 70466 - protein, 145 aa, Nocardia farcinica IFM 10152
MTSETTTGVRLARISDQPLDPTRAEAAVTGPEHGAVVVFTGKVRNHDGGQAVAALEYSAHPQAERFLRECCAAIATSSGLPVAAEHRVGALGIGDPAIVVAVAAPHRAEAFTACAELVDRIKHEVPIWKRQLFADGLSEWVNACT

SEQ ID NO: 70467 - DNA, 450 bp, Photobacterium profundum SS9
  CDS (1)..(450): transl_table=11
atgatttcggttcagtttgaggatttttctgttgctgaagaatatgcgcttttatcggcaggaacagatgctggtgcagtggtaacctttattggtaaagtgcgtgactttaatcacggtgatgatgtaacaggactaacgctcgagcattatcctggtatgacagagaagtcattagaagaaatcgtagtacaagcacgcgagcgctggccattattaaaaacacgtgtgattcaccgtgttggagacttggggttaggcgatcagattgtatttgtcggtgtaacaagtgcacaccgtggtgctgcatttgaagcgtgtgaattcatcatggattttcttaaaacccgagcgcctttttggaagaaagagcaaacgagcaacgaaactcgttgggtcgatgctagagataccgatacttctgctgcagaacgttggcataaaaaataa

SEQ ID NO: 70468 - protein, 149 aa, Photobacterium profundum SS9
MISVQFEDFSVAEEYALLSAGTDAGAVVTFIGKVRDFNHGDDVTGLTLEHYPGMTEKSLEEIVVQARERWPLLKTRVIHRVGDLGLGDQIVFVGVTSAHRGAAFEACEFIMDFLKTRAPFWKKEQTSNETRWVDARDTDTSAAERWHKK

SEQ ID NO: 70469 - DNA, 828 bp, Haloarcula marismortui ATCC 43049
  CDS (1)..(828): transl_table=11
atgcaagtcctcggtatcgtcggccactccgactcggggaagaccacgctggtcgagcggttgacacagcggctctccgggaccggccgtgtcgcgacggtgaaacactgcacgcacgcgccggatgttgacacggacggaaaagacacggttcgccaccgcgacgccggagcggccgagaccgtcgcgctcaccgacgacggcgagtggtacgcgacggggcagtcgcggacgctcgacgagacgctggacgacctttcgcccgactacgactacgtactcgtagaggggtattcggacgcgaacatcccgaaagttgtcctcggcgaccgcgaggccgccgaccccgtcatccatcgcacgccccacggtgcagacgctgaccttgacgacatcctcaccgcgatggaggagcgagacccctacatcacgctggaaacacttgtcgcggacgtaaagcgggacccggacgaggtgtactcgggtgcaatagcgacgtttaccgggcgcgttcgtgcacaggaggggccggaggacccgccaacggagctgctggagttcgaacgctacgacgaggtcgccgcggaaaagatggccgcacttcggcgggatcttgaagcacgcgacggcgtctacgcggttcgactacaccacaaaaccggtgtggtcgatgctggcgaggacatcgttttcgtcgtcattctggccggccaccgaactgaggcgttccgcgccgtcgaagacggtatcaaccggctgaaagaggaggtgccgctgttcaagaaggaagtcaccgtcgacgaggagttctgggcacacgagcgataa

SEQ ID NO: 70470 - protein, 275 aa, Haloarcula marismortui ATCC 43049
MQVLGIVGHSDSGKTTLVERLTQRLSGTGRVATVKHCTHAPDVDTDGKDTVRHRDAGAAETVALTDDGEWYATGQSRTLDETLDDLSPDYDYVLVEGYSDANIPKVVLGDREAADPVIHRTPHGADADLDDILTAMEERDPYITLETLVADVKRDPDEVYSGAIATFTGRVRAQEGPEDPPTELLEFERYDEVAAEKMAALRRDLEARDGVYAVRLHHKTGVVDAGEDIVFVVILAGHRTEAFRAVEDGINRLKEEVPLFKKEVTVDEEFWAHER

SEQ ID NO: 70471 - DNA, 672 bp, Thermus thermophilus HB8
  CDS (1)..(672): transl_table=11
atgcggattgaggtccggctcttcgccctttaccgggagcaggcggggacggaccgcctcgccctggagctccccgagggcgcccgggtgcgggaggcccagaaagccctggaggaacgcttccccaggcttcgcctcgagggcgggatggcggcggtgaaccaggccctggcgggggcggaaacccccttaaaggagggggacgaggtggcctttcttcccccggtctctggcgggcaggactcctacggcctgacccaggagcctctggacctcgaggccctcgtggcctgggccacggccccggagtacggggcggtggtgagcttcctcggcaccacccgcagccccaaccggggggaggaggtggcctttttggagtacgaggcctacccggagatggcggagaaggtgatggcggaaatcctcgccgagatgcgcgcccgctggcccctgggccgcatcgccctctggcaccgcctgggccgggtggacccgggggaggcctccatcgccatcgtcgtctcggcccgccaccgcaaggaggccttcgccgcctgccagtacgccatagaccgggtgaagcagatcctccccgtctggaagaaggagcaccgcaaggacgggagcttctgggtggagggcttcgccccggaggacaagcggctatga

SEQ ID NO: 70472 - protein, 223 aa, Thermus thermophilus HB8
MRIEVRLFALYREQAGTDRLALELPEGARVREAQKALEERFPRLRLEGGMAAVNQALAGAETPLKEGDEVAFLPPVSGGQDSYGLTQEPLDLEALVAWATAPEYGAVVSFLGTTRSPNRGEEVAFLEYEAYPEMAEKVMAEILAEMRARWPLGRIALWHRLGRVDPGEASIAIVVSARHRKEAFAACQYAIDRVKQILPVWKKEHRKDGSFWVEGFAPEDKRL

SEQ ID NO: 70473 - DNA, 468 bp, Geobacillus kaustophilus HTA426
  CDS (1)..(468): transl_table=11
atgaccgaaccgttgtttgtcattaccgataggccgatttcggtcgaggatgtgatgaaaaaagtgatgcgcccggaagcgggggcggttgctgtctttgccgggacggtgcgcgaatggacgaacggcaagcggacgctctttttgcaatatgaggcgtacgtgtcgatggcggagaaaatgctcgcgcaaatcggggcggaaatcgccgaaaaatggccgggggcgaaaacggcgatcacccaccggatcgggcggcttgagatcggcgacatcgccgtcgtcatcgccgtttcttcgccgcaccgcgccgaagcgtatgaggcgaaccgctacgccattgagcggatcaaacaaatcgtgccgatttggaaaaaagagcaatgggaggacggaagcgcctgggtgggcgaccagttggaaacgacggcgtatccgtccggaaagccggaggtgagtgaggaatga

SEQ ID NO: 70474 - protein, 155 aa, Geobacillus kaustophilus HTA426
MTEPLFVITDRPISVEDVMKKVMRPEAGAVAVFAGTVREWTNGKRTLFLQYEAYVSMAEKMLAQIGAEIAEKWPGAKTAITHRIGRLEIGDIAVVIAVSSPHRAEAYEANRYAIERIKQIVPIWKKEQWEDGSAWVGDQLETTAYPSGKPEVSEE

SEQ ID NO: 70475 - DNA, 486 bp, Azoarcus sp. EbN1
  CDS (1)..(486): transl_table=11
atgtcggtaagcgtccagcaagcagatttcgatgtcggcgccgagattgccgcgctgtcgcaggggcgccacgaggtcggggccgtggcgagctttgtcgggctggtgcgggatgtcagcggcggtgccgaagtcgcggcgatgaccctcgagcactatccgggaatgaccgagcgctcgctcgaagacatcgtcggtgaagcccggcggcgctggcaactcgatggcgtgcgcgtgatccaccgctacggcaggctcgagccgggagaccgcatcgtcttcgtcggcgtcgccggggctcaccgcggcgaggcgttcgccgcatgcgaatttgtcatggactatctgaagacccgcgcgccattctggaagctcgaagaaacaccggacggtgcgcactgggtcgatgcgcgggacagcgacgacagcgcagcggcgcgctgggatacggagtcggtggagtcggagtcgtcaccggagcgctga

SEQ ID NO: 70476 - protein, 161 aa, Azoarcus sp. EbN1
MSVSVQQADFDVGAEIAALSQGRHEVGAVASFVGLVRDVSGGAEVAAMTLEHYPGMTERSLEDIVGEARRRWQLDGVRVIHRYGRLEPGDRIVFVGVAGAHRGEAFAACEFVMDYLKTRAPFWKLEETPDGAHWVDARDSDDSAAARWDTESVESESSPER

SEQ ID NO: 70477 - DNA, 444 bp, Silicibacter pomeroyi DSS-3
  CDS (1)..(444): transl_table=11
atgcgggtggtggtccagcaggaaccttttgaccttggcgccgaggccaacgcctttgccgccgccgataccggcatgggcgccatcgtgacctttaccggcgtggtacgcgatctggcgcagggcgatctggatgtgatggagatcgagcactatccgggcatgaccgaaaaggcgctggccaggatcgccgccgaggcgcaagagcgctggtcgctgggtgatgtgctggtgatccatcggtacgggcggctggcgcccggcgaccggatcatgatggtcgccaccgccgccccccatcgcaaggatgcgttcgaggccgccgaatacctgatggactatctgaaatcccgcgcgccgttctggaaaaaggaaatcaccgggactggcgcaggctgggtcgccgccaaggacgaagacgaagacgccctgacccgctggtag

SEQ ID NO: 70478 - protein, 147 aa, Silicibacter pomeroyi DSS-3
MRVVVQQEPFDLGAEANAFAAADTGMGAIVTFTGVVRDLAQGDLDVMEIEHYPGMTEKALARIAAEAQERWSLGDVLVIHRYGRLAPGDRIMMVATAAPHRKDAFEAAEYLMDYLKSRAPFWKKEITGTGAGWVAAKDEDEDALTRW

SEQ ID NO: 70479 - DNA, 498 bp, Synechococcus elongatus PCC 6301
  CDS (1)..(498): transl_table=11
atgccagacttgctgacctgcgatcgccatcagattgaactgagcctagcccccattcccctctcagctgctgctgaattttgtcacgacgatcgctacggggcctttgccagctttgtgggctgggtgcggcgcgtcaatgtcggtcgcttagtgacgggcatcacctatcaaagttttcagccgctctgccgcacagttcagaccgaaatttgccaagaggctgagcaggtgttcggccaagaactgcgcatctacgtccaacaccgcctcggtgaaactcgtgttggtgaccccaccgtgctgatcggcgtcggtgccattcatcgcgatgaagcctgtgaagcctgccgctacgtaattgaggagctaaaacatcgcgccccaatctggaaactcgaacactatgaagatggagactcgggctgggtgcctggcaactgtctctgccaagagcggcgatcgcgcgatcgcagaggatccacagggccggaatga

SEQ ID NO: 70480 - protein, 165 aa, Synechococcus elongatus PCC 6301
MPDLLTCDRHQIELSLAPIPLSAAAEFCHDDRYGAFASFVGWVRRVNVGRLVTGITYQSFQPLCRTVQTEICQEAEQVFGQELRIYVQHRLGETRVGDPTVLIGVGAIHRDEACEACRYVIEELKHRAPIWKLEHYEDGDSGWVPGNCLCQERRSRDRRGSTGPE

SEQ ID NO: 70481 - DNA, 429 bp, Bacillus clausii KSM-K16
  CDS (1)..(429): transl_table=11
gtgtttcagttaaccaataaaccaattgatgtccaacaggtaatcaaccaagtgaccgatagaaactgcggagcgattgccacttttatcggcactgtccgtgaatttaccaatggcaaaaaaacagtgcgtctagaatacatcgcctatgaatcaatggctgaaaaaatgctgaaacggattggcgctgaaataaacgaaaggtggccaggtacaaatgtcgcgattgtacacaggctcggcgttctcgacatttctgaagcagcggtcgtgatcgcagtcagttcaccacatcgacaggccgcgtatgaggccaatgcatacgcaatggaacggataaaagcgatggtgccaatatggaaaaaagaaatttgggaagacggcagttcgtggattggcgatcagcttgaaaccaaacggtatacataa

SEQ ID NO: 70482 - protein, 142 aa, Bacillus clausii KSM-K16
MFQLTNKPIDVQQVINQVTDRNCGAIATFIGTVREFTNGKKTVRLEYIAYESMAEKMLKRIGAEINERWPGTNVAIVHRLGVLDISEAAVVIAVSSPHRQAAYEANAYAMERIKAMVPIWKKEIWEDGSSWIGDQLETKRYT

SEQ ID NO: 70483 - DNA, 426 bp, Thermococcus kodakaraensis KOD1
  CDS (1)..(426): transl_table=11
atgaaagtcagactcaccaaagataaattcagcgttgatgaggcaatttccctgctccgagttccagagtccggcgcttacgttgtgttcctcggccaggttaggaacgagaaccttggaagaaaggtcgagaagctcatatacgaggcttacccagagatggccgaagcagagatggagaggataagagaggaggcactcaaaaagttcccgattctggacatggtaatatggcacagatacggagagcttgatgtcggcgaggacacaatactgatcgtggcgagtgccaagcacaggaaggaggcgtttagggcctgtgagtgggcaattgacgaggtaaaacgaagggtcccagtgtggaagaaggaggtcacccccgaaggagctttctggcttgagggagacaaggctgttagggagtaa

SEQ ID NO: 70484 - protein, 141 aa, Thermococcus kodakaraensis KOD1
MKVRLTKDKFSVDEAISLLRVPESGAYVVFLGQVRNENLGRKVEKLIYEAYPEMAEAEMERIREEALKKFPILDMVIWHRYGELDVGEDTILIVASAKHRKEAFRACEWAIDEVKRRVPVWKKEVTPEGAFWLEGDKAVRE

SEQ ID NO: 70485 - DNA, 513 bp, Gluconobacter oxydans 621H
  CDS (1)..(513): transl_table=11
atgagccgctttcgcatggcgtccgcacccgtggatctgaacgcgctgcgtgaggatctgcatctggccgtggcaggcgggttctgcacctttgaaggctgggtccgcaacaggaacgagggccgtccggtggatggtctggaatatgaatcctatgaggcgctggcccagctcgaaggtgagcggatcgtggctgaggctctggagcgtttcgagatcagccaggctgtagcgatgcaccgcaccgggagcctgaaggtcggggatgttgcggtctggatcggcgtttcggcgccgcaccgggatgccgcgtttcgggcctgtcgctacatcatcgacgagataaagcatcgcgtgcccgtctggaagaaagagcactatctggacggagatgccgaatgggtggcctgccatcactgccagactgctccgcgtgcctcggagacggggacgcatgatcacgatcatgaccatggccacgatcatggaagctgcggccaccatcatcactga

SEQ ID NO: 70486 - protein, 170 aa, Gluconobacter oxydans 621H
MSRFRMASAPVDLNALREDLHLAVAGGFCTFEGWVRNRNEGRPVDGLEYESYEALAQLEGERIVAEALERFEISQAVAMHRTGSLKVGDVAVWIGVSAPHRDAAFRACRYIIDEIKHRVPVWKKEHYLDGDAEWVACHHCQTAPRASETGTHDHDHDHGHDHGSCGHHHH

SEQ ID NO: 70487 - DNA, 447 bp, Xanthomonas oryzae pv. oryzae KACC10331
  CDS (1)..(447): transl_table=11
ttgagcgtgagcgaacagggtgcagcgatctttacgctttccgaggtgccattgccggtcgaccagttgcgtgcctgcgtcgagcacccgcacgctggggcgtttgccagtttcgaaggctgggtacgcaatcacaacgaaggccgcggcgtggccgggctgcgctacgaagcctacgccgcgctcgcacaggccgaagggcagcgcgttctcgacgaagcaatgcagcgattcgccatcgtgcacgcgcattgcgtgcaccgcgtgggcgagctgcgcatcggcgacatggcggtgtgggtcggcgtcagtgcagcgcaccgtggcgccgcattcgatgcgtgccgctacatcatcgatgaagtcaaggcacgcgtgccgatctggaagcacgagcattacctggaaggcgatgcgggttggttgcatccggagtcgcaaccgtag

SEQ ID NO: 70488 - protein, 148 aa, Xanthomonas oryzae pv. oryzae KACC10331
MSVSEQGAAIFTLSEVPLPVDQLRACVEHPHAGAFASFEGWVRNHNEGRGVAGLRYEAYAALAQAEGQRVLDEAMQRFAIVHAHCVHRVGELRIGDMAVWVGVSAAHRGAAFDACRYIIDEVKARVPIWKHEHYLEGDAGWLHPESQP

SEQ ID NO: 70489 - DNA, 447 bp, Vibrio fischeri ES114
  CDS (1)..(447): transl_table=11
atgatttctgttcaagagcatgattttaatgttggcgatgaatatcaattactagcagaaggtacagctgctggcgctgtggttactttcattggtaaagttcgtgatatgaacctaggtgatgatgttacaggtctatccttagaacattaccctggaatgactgagaagtctcttaacgatatcgtggcacaagctaaagagcgctggcctctacttaaagtgaaggtaattcatagagttggtgacttagaacttggcgatcaaattgtatttgtaggtgtatcaagtgctcaccgtggtgctgcgtttgattcttgtgaattcattatggattacttgaaaaccaatgctccgttctggaaaaaagaacgaacaacaaaagaagtacgttgggttgaatctcgtgatacggataaaacagcggcagagcgttgggaaaaataa

SEQ ID NO: 70490 - protein, 148 aa, Vibrio fischeri ES114
MISVQEHDFNVGDEYQLLAEGTAAGAVVTFIGKVRDMNLGDDVTGLSLEHYPGMTEKSLNDIVAQAKERWPLLKVKVIHRVGDLELGDQIVFVGVSSAHRGAAFDSCEFIMDYLKTNAPFWKKERTTKEVRWVESRDTDKTAAERWEK

SEQ ID NO: 70491 - DNA, 453 bp, Magnetospirillum magnetotacticum MS-1
  CDS (1)..(453)
atgacggtcagcatccagtccgagcccttcgacaccgccgccgagatcgcgcgcatcgaggccgaactcgccggccgggccggcgccgtcgtgaccttctccggcctgtgccgggacgaggcggggcggctgaccgccctggagctggagcattatcccggcatggccgaggccgagatcggccgggtggtcgaggaggcccgcgcgcgctggccggtccaggcggtgcgggtgatccatcgccacggtctggtgcggccgggcgagggcatcgtgctcgtcgtcaccgcttcgccccaccgcaaggccgccttcgccgccgccgatttcctgatggattacctcaagacccgcgctcctttctggaagcgcgagcacctcgccgacggcggcaccggcggctgggtcgaggcgacggaggccgatgccgccgccgccgaagcctggacgtga

SEQ ID NO: 70492 - protein, 150 aa, Magnetospirillum magnetotacticum MS-1
MTVSIQSEPFDTAAEIARIEAELAGRAGAVVTFSGLCRDEAGRLTALELEHYPGMAEAEIGRVVEEARARWPVQAVRVIHRHGLVRPGEGIVLVVTASPHRKAAFAAADFLMDYLKTRAPFWKREHLADGGTGGWVEATEADAAAAEAWT

SEQ ID NO: 70493 - DNA, 477 bp, Magnetospirillum magnetotacticum MS-1
  CDS (1)..(477)
atggccgtccgggtccagcgcgaggaattcgaccccggcgccgaactggcgcgcttctccgcgggcaagaccagcgtgggcggcatttgcctgttcatcggactggtccgcgactatatgggggccgatcaggcttcgggctctgtggtcaatgccatgaccctcgaacattatcccggcatgaccgagcgccagttggaagccatcgaggccgaggcccacgcgcgctggcccctggacgacacgctggtcattcaccggtatggccggttggaaccgggcgagcgcatcgtgctggtggcggcgtcctcggcccatcgcgacgcggccttcgaggcctgccgctttctcatggattggctgaagaccaaggcgccgttctggaaggtggaacataccccggacggcgacgcctgggtggatgccaaggagtccgacgaggccgcggcctcgcggtggaatcagggaaccccctga

SEQ ID NO: 70494 - protein, 158 aa, Magnetospirillum magnetotacticum MS-1
MAVRVQREEFDPGAELARFSAGKTSVGGICLFIGLVRDYMGADQASGSVVNAMTLEHYPGMTERQLEAIEAEAHARWPLDDTLVIHRYGRLEPGERIVLVAASSAHRDAAFEACRFLMDWLKTKAPFWKVEHTPDGDAWVDAKESDEAAASRWNQGTP

SEQ ID NO: 70495 - DNA, 447 bp, Azotobacter vinelandii
  CDS (1)..(447)
atgggtattcgggtacaggtcggaaccttcgagccggggcgcgaactcgatgcgttgcacgcggccaacgccggggtcggcgcggtggtcggcttcgtcggctacgtgcgcgatttcaacgagggccgcgaggtcggcgggatgttcctggagcactatccggggatgaccgagaaggccctggcgaagatcgccgacgaggccgcgcggcgctggccgctgctccgggtggaggtgctgcaccgcatcggccgcctggagccgggcgagccgatcgttttcgtcggcaccgccagcgcccaccggcaggcggccttcgacgcctgcgcgttcatcatggattacctgaagatccgcgcaccgttctggaagaaggaagataccggtgagggaccgcgctgggtcgagggccgcgatagcgaccaggaagcggcgcggcgctggtag

SEQ ID NO: 70496 - protein, 148 aa, Azotobacter vinelandii
MGIRVQVGTFEPGRELDALHAANAGVGAVVGFVGYVRDFNEGREVGGMFLEHYPGMTEKALAKIADEAARRWPLLRVEVLHRIGRLEPGEPIVFVGTASAHRQAAFDACAFIMDYLKIRAPFWKKEDTGEGPRWVEGRDSDQEAARRW

SEQ ID NO: 70497 - DNA, 489 bp, Nostoc punctiforme PCC 73102
  CDS (1)..(489)
atgacaactacacttacctctcgtgttaaaccaagagatgaagatagttttaccattagctttgcaccattgtctctcgaagagatttacactaagtctgacgatccagctaacggtgccttagttttgatgagtggaatggttcgcaatcaaaccgacgggaaaccagtggttgccttggagtatcaagcttatgaaccaatggcattgcagatattttatcaaattgctgctgatattcgtttatctacatctgatgtaaatcgagtagcaattcatcatcgcatcggacgtttacaagttggagaaattagcgttttagtagcagtgggttgccctcatcggagtgaggcgtttgaagcttgccagtatgctattgataccctcaagcacaatgcacctatatggaagaaagaacattgggaagatggttctagtcgctgggtaagtattggtgcttgcgaacagttagcagaaaattgttcttag

SEQ ID NO: 70498 - protein, 162 aa, Nostoc punctiforme PCC 73102
MTTTLTSRVKPRDEDSFTISFAPLSLEEIYTKSDDPANGALVLMSGMVRNQTDGKPVVALEYQAYEPMALQIFYQIAADIRLSTSDVNRVAIHHRIGRLQVGEISVLVAVGCPHRSEAFEACQYAIDTLKHNAPIWKKEHWEDGSSRWVSIGACEQLAENCS

SEQ ID NO: 70499 - DNA, 453 bp, Pseudomonas syringae pv. syringae B728a
  CDS (1)..(453)
atgatgagcgttcgtgtccaggcagaggctttcgaccccggcactgaagtcaacgcgctgcatgccgcgaatctgggcatcggcgcggtggtcagttttgttggctatgttcgggatttcaatgaagggcgtgaagtgtccggcatgtttctcgagcactatccggggatgaccgagaaggcactggcaaaaatcattgccgatgccgaacagcgctggccgttgctacgcgttgacgtactgcatcgggttggcgcgctggagcccggcgagccgatcgtgttcgtcggcgttgccagcgcgcaccgtcaggcggcgttcgaagcctgtgatttcgtcatggattacctcaagacccgcgcgccgttctggaagcgtgaaaacacgtcagaaggcacgcgctgggtcgaaggtcgtcacagcgatcaccaggcggctgatcgctggaagtaa

SEQ ID NO: 70500 - protein, 150 aa, Pseudomonas syringae pv. syringae B728a
MMSVRVQAEAFDPGTEVNALHAANLGIGAVVSFVGYVRDFNEGREVSGMFLEHYPGMTEKALAKIIADAEQRWPLLRVDVLHRVGALEPGEPIVFVGVASAHRQAAFEACDFVMDYLKTRAPFWKRENTSEGTRWVEGRHSDHQAADRWK

SEQ ID NO: 70501 - DNA, 456 bp, Actinobacillus pleuropneumoniae serovar 1 str. 4074
  CDS (1)..(456)
atgcacactacgttaatcgaagttcaacaagaaacctttgatcaaaatgcgatttatcgttggttaagcgaacatcatagcgttggagcaactacgctttttgtcggtaaagtacgagaaatgaatttaggcgataatgtgtccggtttatatctggaacactaccctgcaatgactaaaaaagccctccaagaaattgtggatgaggctcgtaagcgttggggtttgcaacgtgttgcggtaattcatcgtattgggcaactgcataccggcgatgaaattgtattggttggggtaagttccgctcaccgaggcgatgcttatcacgccaacgaatttatcatggactatctgaaaactcgtgcgccgttttggaaacgtgaaaccacacaagacggtgatcgctggatagaaggcagagaaagcgaccaacttgaagcggataaatggcaatga

SEQ ID NO: 70502 - protein, 151 aa, Actinobacillus pleuropneumoniae serovar 1 str. 4074
MHTTLIEVQQETFDQNAIYRWLSEHHSVGATTLFVGKVREMNLGDNVSGLYLEHYPAMTKKALQEIVDEARKRWGLQRVAVIHRIGQLHTGDEIVLVGVSSAHRGDAYHANEFIMDYLKTRAPFWKRETTQDGDRWIEGRESDQLEADKWQ

SEQ ID NO: 70503 - DNA, 555 bp, Psychrobacter sp. 273-4
  CDS (1)..(555)
atggaagatagtgtgaacaatagcaataaagatgctgatgtaaaaaaccataaagcagagcacgacaaaaaagatgtgcatagccaatccatgcacataagccgtagcgtcgatgacgcctatatgatcgctgagcgtgatggctttgccttattagatatcgccattgatgagagtagactcagagatatgcttgatgatgacagttgcggcgccttcgtaagctttgaaggacgcgtgcgtaatcacaataatgccagtagtgtcgatcgcttaagttattatggctatgaagaattagccgttaatcaaggccggcaaattattgaaaaggcaaagaataaatttgatatcacccatgctattgctattcatcgtatcggtgcgttagagataggtgatatagccgtatggatcggggtggtttctgcgcatcgctatcctgcgtttgatgcctgtcgttggatacttgatactattaaggctgatattcccgtgtggaagcaagaatactacgaggatgactcctctaaatggctaagcaacaatggttaa

SEQ ID NO: 70504 - protein, 184 aa, Psychrobacter sp. 273-4
MEDSVNNSNKDADVKNHKAEHDKKDVHSQSMHISRSVDDAYMIAERDGFALLDIAIDESRLRDMLDDDSCGAFVSFEGRVRNHNNASSVDRLSYYGYEELAVNQGRQIIEKAKNKFDITHAIAIHRIGALEIGDIAVWIGVVSAHRYPAFDACRWILDTIKADIPVWKQEYYEDDSSKWLSNNG

SEQ ID NO: 70505 - DNA, 825 bp, Methanococcoides burtonii DSM 6242
  CDS (1)..(825)
atgaaagtcatttcagtcataggctacaagaacacagggaaaacgaccttcgttacccgaatggtaaaggagcttttagaacttggtcgtgtgggaacggtcaaactgatgcttgaccatcgtcttgatgatccgaatactgataccggcaaacatttcgattccggtgccgacatggtaactgccgtcacggacagggaacttgtgacaataagtcgtaacccctcttttgaaaaagcactggatgaacttgctgatgcaggaatggattttgccatcgttgaaggtgcaaaggacagtgaggttccaaaggtcgttctcggggaaatggatgaggacgtttctaatgttattgcaagacttcctgaaaaggccgactggaaccttgaaaatatcgtctcaatgctaatggaacaaccggaccacgttacgctcaattcccttatagaaaaggtcagatcaaatccagaaattgtaaaagcaggtggaattggtacttttatcggtatcgtaaggactgataatgaagattacgagacccgaatgctcgaattcgagaaatatgataaggtcgcagatgccagcatccaaaagataagggaagaaatgatgcaacaggatggtatcatcgatgttctcattcatcataaagccggaaggataatgccacttgaagatatcgtatatatcgtgatagcagcaggccaccgccagcaactgttcgcagctcttagtgagacattggatcgagtgaaatcagaagtgcccatatggaaaaaagagataaccatcgatggtaatttttgggtacatgatcatgcctga

SEQ ID NO: 70506 - protein, 274 aa, Methanococcoides burtonii DSM 6242
MKVISVIGYKNTGKTTFVTRMVKELLELGRVGTVKLMLDHRLDDPNTDTGKHFDSGADMVTAVTDRELVTISRNPSFEKALDELADAGMDFAIVEGAKDSEVPKVVLGEMDEDVSNVIARLPEKADWNLENIVSMLMEQPDHVTLNSLIEKVRSNPEIVKAGGIGTFIGIVRTDNEDYETRMLEFEKYDKVADASIQKIREEMMQQDGIIDVLIHHKAGRIMPLEDIVYIVIAAGHRQQLFAALSETLDRVKSEVPIWKKEITIDGNFWVHDHA

SEQ ID NO: 70507 - DNA, 453 bp, Dechloromonas aromatica RCB
  CDS (1)..(453)
atgactgtccgggttcagggagcggatttcgatgttggtgccgaactggccgcattgcgcgccggggatgcccgcgtcggggcgctggccagctttcttggcctcgtccgcgatctgaacgatggggccagcgtttcggaaatgacgctcgagcactatccgggcatgaccgaaaaggcgcttgaggagatcgtcgctgaagcccgtggtcgttgggaactctacgacgcgctggtcatccatcgtgtcgggccgctcaagccctgcgagcagatcgtgctcgtggccgtcaccagcgcccatcgcggcgaagctttcgccgcctgcgagttcatcatggattacctgaagacccgggctccgttctggaagcgcgaggcgacgccggatggcggccgttgggtcgatgcccgtgagaccgacgacagcgcggcagcgcgctggcagaaataa

SEQ ID NO: 70508 - protein, 150 aa, Dechloromonas aromatica RCB
MTVRVQGADFDVGAELAALRAGDARVGALASFLGLVRDLNDGASVSEMTLEHYPGMTEKALEEIVAEARGRWELYDALVIHRVGPLKPCEQIVLVAVTSAHRGEAFAACEFIMDYLKTRAPFWKREATPDGGRWVDARETDDSAAARWQK

SEQ ID NO: 70509 - DNA, 504 bp, Anabaena variabilis ATCC 29413
  CDS (1)..(504)
atgactatggaatcagtgctgccatctacacccattgttgcaattaaacccaaaattgaagatagttttgctatcactttcgcacctttatctctagaagaaatttacgctctagccgatgactctgctaacggtgcggtagtagtaatgagtggaatggttcgcaatcaaactgacggaaaacccgtacttgccttagaatatcaagcttatgaaccaatggcgttgcgtgtattttatcaaatagcagcagacattcgctcggcttggcctgctgtcaatcgggtagtaattcatcatcgtattggacgtttgcaggtaggacaaatcagcgttttagtagctattggttgtccccatcgtagtgaggcctttgaagcttgtcgctatgcaattgatattctgaaacataacgcccccatttggaaaaaagaacattggcaagatggttctagcacttgggtaagtattggtgcttgtgaacagtcaggacaaaattgctaa

SEQ ID NO: 70510 - protein, 167 aa, Anabaena variabilis ATCC 29413
MTMESVLPSTPIVAIKPKIEDSFAITFAPLSLEEIYALADDSANGAVVVMSGMVRNQTDGKPVLALEYQAYEPMALRVFYQIAADIRSAWPAVNRVVIHHRIGRLQVGQISVLVAIGCPHRSEAFEACRYAIDILKHNAPIWKKEHWQDGSSTWVSIGACEQSGQNC

SEQ ID NO: 70511 - DNA, 501 bp, Ralstonia eutropha JMP134
  CDS (1)..(501)
atgagcgtcagggtacagagggaggatttcgacctcggcgccgaagtcgcggcgctacggagcggccgtccggccgtgggcgcggtggcaagcttcatcggcacggtacgcgatatcagcgagggtagcgccgtcagcgcgatggagctcgagcactatcccggcatgaccgagaaggcgctcgcccgcatcgaagccgctgcctgcgcgcgctgggagctactgggcgtgacgattatccaccgcgtcgggccgctgctgccgctggaccagatcgtactggtggcggtcgcctccgcgcatcgcggcaatgcgtttgcggcgtgcgaattcatcatggactacctcaagtccgaagcgccgttctggaagaaggaagagacgccggaaggtgcgcgctgggtcgacgcccgcgtgaccgacgaggcggccctgaagcgttgggggattccgtccttcaacgcgagcggcactgaagccgacagcgacggcgaggcctga

SEQ ID NO: 70512 - protein, 166 aa, Ralstonia eutropha JMP134
MSVRVQREDFDLGAEVAALRSGRPAVGAVASFIGTVRDISEGSAVSAMELEHYPGMTEKALARIEAAACARWELLGVTIIHRVGPLLPLDQIVLVAVASAHRGNAFAACEFIMDYLKSEAPFWKKEETPEGARWVDARVTDEAALKRWGIPSFNASGTEADSDGEA

SEQ ID NO: 70513 - DNA, 450 bp, Methylobacillus flagellatus KT
  CDS (1)..(450)
atgacggtacgcgtacaggagcaggatttcgacgtaggcgaggaaatcacgcgcctgcgactgcagtatccacaagcgggcgcggtcgtgtcgtttacggggcaagtgcgtgacctgaacgatggccagtcagttgccagcctgaagctggagcattatccgggcatgacggagaaatcgctggctgccatcgttgagcaggcgagaaagcgctggcccatcttcgatgccgtcgtgatccatcgcatcggcacactggcgccgcaggcgcagatcgtgctggttgttgtggcaagcgcacatcggggagatgcctttgccgcctgcgaattcatcatggactacctcaagaccgaagcgcctttctggaagaaggaagcgacaccggaaggtgaaaaatggctggattcccgcgaaagcgatcaagccgctcgcgggcgctggcaatag

SEQ ID NO: 70514 - protein, 149 aa, Methylobacillus flagellatus KT
MTVRVQEQDFDVGEEITRLRLQYPQAGAVVSFTGQVRDLNDGQSVASLKLEHYPGMTEKSLAAIVEQARKRWPIFDAVVIHRIGTLAPQAQIVLVVVASAHRGDAFAACEFIMDYLKTEAPFWKKEATPEGEKWLDSRESDQAARGRWQ

SEQ ID NO: 70515 - DNA, 486 bp, Crocosphaera watsonii WH 8501
  CDS (1)..(486)
atgaaatcttctcttaatccttttcctgccacaaattcagaccatccccacgatagttttagaattagctttgctcctctatccttggaagaggtttatggcttagctgatgaccctagtaacggggcgatcgctttgatgagtgggacagttcgacaagaaaccgagggcaaagccgttcgttatctagaatatcagggttatgaacggatggctctgctcattttccaggaaattgccgctcatattcgtcaaaaatggccgcaaaccaaccgagtcgtcatccatcatcgcattggtaagctaaagattggggaaattagtgtcttaatcgctgtaggctgtcctcatcggggtgaagcgtttgctgcttgtcgttatggtattgacacgttaaaacataatgctcccatctggaaaaaagaattgtgggctgatggttctggcacttgggtcagtatgggtgcttgtgaagacatagactaa

SEQ ID NO: 70516 - protein, 161 aa, Crocosphaera watsonii WH 8501
MKSSLNPFPATNSDHPHDSFRISFAPLSLEEVYGLADDPSNGAIALMSGTVRQETEGKAVRYLEYQGYERMALLIFQEIAAHIRQKWPQTNRVVIHHRIGKLKIGEISVLIAVGCPHRGEAFAACRYGIDTLKHNAPIWKKELWADGSGTWVSMGACEDID

SEQ ID NO: 70517 - DNA, 441 bp, Rubrobacter xylanophilus DSM 9941
  CDS (1)..(441)
ttgttcaggatcgtcgagggccccatagacgtgggggccgtcatcctggcggcccagcggccggactgcggggcggtctccgccttcgtgggcaccacgcgggtggaccggtcgggggaggcctttgtccggtacctggagtacgaggcctaccgccccatggccgaccggaagctccgcgagatcggggaggagatccagaggcggtgggacgcgcgccacgtctccatcgtgcacaggataggccgggtggaccccggggaggcgagcgtcgccatagccgtggccgcgccccgccgggatgaggccttccaggccagccgctacgccatagagcggataaagcaggtggtccccatctggaagcgcgaggtgtggtccgacgggtacgtgtgggtcggcagccaggtcggcacccgtcccgccgcgcagaccggctga

SEQ ID NO: 70518 - protein, 146 aa, Rubrobacter xylanophilus DSM 9941
MFRIVEGPIDVGAVILAAQRPDCGAVSAFVGTTRVDRSGEAFVRYLEYEAYRPMADRKLREIGEEIQRRWDARHVSIVHRIGRVDPGEASVAIAVAAPRRDEAFQASRYAIERIKQVVPIWKREVWSDGYVWVGSQVGTRPAAQTG

SEQ ID NO: 70519 - DNA, 465 bp, Mesorhizobium sp. BNC1
  CDS (1)..(465)
atgggctgcgagccccatattcgcgtgcaggcggaggatttcgatctcgccgttgaaatcgatcggctgacggatggccgcagggatgtgggtgcggtcgtcaccttcaccggaaaatgccgcgatgaaggcggtcgcttggcagcactggagcttgaacactatcccggcatggctgaagccgaaatgacccgcatcgcccgtcaagcggcagagcgctggcagctttccgggctgaccgtggtccaccgttacggcaagatcaggccgggcgaaaacatcgtgcttgtggtaaccgcctcgtcgcacaggaaagcagcattagaggctgcggatttcctgatggattatctgaagtcgagagcgcctttttggaaaaaggagcatctgacggatgccgggccaggccaatgggtggaagccaaggcggaagacgaaaacgcccttgagcgctggaagaaataa

SEQ ID NO: 70520 - protein, 154 aa, Mesorhizobium sp. BNC1
MGCEPHIRVQAEDFDLAVEIDRLTDGRRDVGAVVTFTGKCRDEGGRLAALELEHYPGMAEAEMTRIARQAAERWQLSGLTVVHRYGKIRPGENIVLVVTASSHRKAALEAADFLMDYLKSRAPFWKKEHLTDAGPGQWVEAKAEDENALERWKK

SEQ ID NO: 70521 - DNA, 570 bp, Burkholderia cepacia R18194
  CDS (1)..(570)
atgacgagcttcaccgaatcccgtgccgggctaccggacgatccgttgcacgcgggcagccccgctcccgacagcacgaccgacccgcaccccgagccgccaccgtcgattaccgccggcttcgaagtacgcgtgcagtacgcgccgatcgacgcgggcgccgagctcgcgccgatcgttcgcaatccgaatgtcggcgcggtcgtgaatttcctcggtgtcgtgcgtaacgaaggcgacgtcgacgacgtgatcgcgctcgaggtcgagcactatccgacgatgaccgaacaggcgctgtggagcatcgtcgaggaagccagcgcacgctggcgtctcgaggcgatcaagatcgtgcatcgcgtcgggcgcatcccgctcggccaggcggtcgtgctggtcgtggtggccgccgcgcatcggggggccgcgttcgatgcgtgcgaattcctgatggacttcctgaagacccacgccccgttctggaagaaggagatccgccacgacggcgtatccggctgggtcgaggcgaaggcgcacgacgaccaggcgatgcggcgctggggctga

SEQ ID NO: 70522 - protein, 189 aa, Burkholderia cepacia R18194
MTSFTESRAGLPDDPLHAGSPAPDSTTDPHPEPPPSITAGFEVRVQYAPIDAGAELAPIVRNPNVGAVVNFLGVVRNEGDVDDVIALEVEHYPTMTEQALWSIVEEASARWRLEAIKIVHRVGRIPLGQAVVLVVVAAAHRGAAFDACEFLMDFLKTHAPFWKKEIRHDGVSGWVEAKAHDDQAMRRWG

SEQ ID NO: 70523 - DNA, 477 bp, Burkholderia cepacia R1808
  CDS (1)..(477)
atgccgacagtacgaatccagaccgccgatttcgacctgaatgccgaggtcgcggcattgcgcgcgcgcaatccgcggatcggcgccgtcgcgtgcttcgtcggcacggtgcgcgacctgaacgaaggcgatgcggtcgccgcgctggagctcgagcactatccgggcatgaccgagaaggcgctcgagaagatcgccgccgaagccggccggcgctggccggggatcgacgtcgcgatcgtgcaccgggtcggccggctgctgccgctcgaccagatcgtgatggtcgcgaccgtcgcggcgcatcgcggcgatgcgttcgcgtcgtgcgaattcgtgatggattacctgaagaccgaggcgccgttctggaagaaggaaacgacgccggacggcgagcgctgggtcgatgcgcgcagcaccgacgacgcggcgctcgcgcgctggggaatcgagtcgggcaaccggccgcgctga

SEQ ID NO: 70524 - protein, 158 aa, Burkholderia cepacia R1808
MPTVRIQTADFDLNAEVAALRARNPRIGAVACFVGTVRDLNEGDAVAALELEHYPGMTEKALEKIAAEAGRRWPGIDVAIVHRVGRLLPLDQIVMVATVAAHRGDAFASCEFVMDYLKTEAPFWKKETTPDGERWVDARSTDDAALARWGIESGNRPR

SEQ ID NO: 70525 - DNA, 423 bp, Listeria monocytogenes str. 4b H7858
  CDS (1)..(423): transl_table=11
atgaaatatgtagctttgcaacatgaaaaaatcgaaataggaccactttctgaaaaactaatcaataaaaatcacggtgggactaatctttttgttggtacaattcgagaatggacgggtgatattcaaacagaagaaattcgttacacatcgtacgaggaaatggcgctcaaagaactaaataaattagcagcagaagtagaaacaaagtggggggcggatgttgtcatcgtccaccgactaggacttttacaaataacagatgtcgctgtggtcatcggtgtatcaacaccacacagagccgcttgctacgagggatccagatatattattgaacgtttaaaagaacgggtacctatatggaaagaagaaaaagatgtcgataaaacaaggtggggtggcatagatgctaacaacagttaa

SEQ ID NO: 70526 - protein, 140 aa, Listeria monocytogenes str. 4b H7858
MKYVALQHEKIEIGPLSEKLINKNHGGTNLFVGTIREWTGDIQTEEIRYTSYEEMALKELNKLAAEVETKWGADVVIVHRLGLLQITDVAVVIGVSTPHRAACYEGSRYIIERLKERVPIWKEEKDVDKTRWGGIDANNS

SEQ ID NO: 70527 - DNA, 465 bp, Bacillus cereus G9241
  CDS (1)..(465): transl_table=11
atgacacatacgtattatgaagtaattgatacagaaattttggttgaagaagtagcgaataaggttattcgccgcgaatgtggtgctgttacaacatttattggaacggttagagagtttacgaaagggcgtcgtacattatacttagaatatgtcgcttataaaacgatggcagaaaagatgctagagaaaatcggatcagaagtgaaagagaaatggccaggtacacacgttgcggttacacatcgcatcggtacactgcaaatttctgatattgcggttgttgtggctgtttcaacgccgcatcgtaaagcagcttatgaagcaaatgaatacattatggaacgcataaaacaaattgttccgatttggaaaaaggagttttgggaagatggagactcttggattggcgatcaattagaaaaaacgccatatccggcgggagagcctgggaaggagctataa

SEQ ID NO: 70528 - protein, 154 aa, Bacillus cereus G9241
MTHTYYEVIDTEILVEEVANKVIRRECGAVTTFIGTVREFTKGRRTLYLEYVAYKTMAEKMLEKIGSEVKEKWPGTHVAVTHRIGTLQISDIAVVVAVSTPHRKAAYEANEYIMERIKQIVPIWKKEFWEDGDSWIGDQLEKTPYPAGEPGKEL

SEQ ID NO: 70529 - DNA, 471 bp, Bacillus cereus G9241
  CDS (1)..(471): transl_table=11
atgacacatacgtattatgaagtaattgatacacctatttcaattgaagaagttacaaacaaagtaattcggagtgagtgcggcgcagttactactttcattggtactgttagagaatttacggaaggtcgacgtacgctttatttagagtatgtagcttatataacaatggcggaaaaacagcttgagagaattggcactgaagtaggagagaagtggccggggacatatgtcgctattacacatcgcattggtacattacaaatttctgatcttgctgttgtcgttgctgtttctacaccacaccggaaagcggcctatgaggcgaatgaatatattatggagcgtataaaacaaattgttccaatttggaagaaagagttttgggaagatggtgagtcatggataggtgatcagttagagcgggtaacatatgcaaatggtgagcctagaaaggagatgagaatatga

SEQ ID NO: 70530 - protein, 156 aa, Bacillus cereus G9241
MTHTYYEVIDTPISIEEVTNKVIRSECGAVTTFIGTVREFTEGRRTLYLEYVAYITMAEKQLERIGTEVGEKWPGTYVAITHRIGTLQISDLAVVVAVSTPHRKAAYEANEYIMERIKQIVPIWKKEFWEDGESWIGDQLERVTYANGEPRKEMRI

SEQ ID NO: 70531 - DNA, 480 bp, Rubrivivax gelatinosus PM1
  CDS (1)..(480)
atgaagaccggccgcgtgaccatccagacggaggactttgatctgtcctccgaagtggccgcgttgcgcgcccatcagcgcggcgtcggtgcagtcgccagcttcgtcggcaccgtccgcgaccgcaacgacggtgacgaagtcagccgcatggagctcgagcactaccccggcatgaccgagcgggcgatcgaggccatgatcgacgcagccttcgcgcgcttcgacctgctgggcgcccgcgtcatccatcgcatcggcccgctcgaggtgggcgaacagatcgtgctggtggtggtcagttccgcgcaccgcggccaggccttccaggcctgcgagttcctgatggactacctgaagacccaggcaccgttctggaagaaggaacagactccgcagggcgcccgctgggtcgatgcccgcgttgccgacgacgacgccctccgacgctggggcatcgcagcgagcggcaacgcgtga

SEQ ID NO: 70532 - protein, 159 aa, Rubrivivax gelatinosus PM1
MKTGRVTIQTEDFDLSSEVAALRAHQRGVGAVASFVGTVRDRNDGDEVSRMELEHYPGMTERAIEAMIDAAFARFDLLGARVIHRIGPLEVGEQIVLVVVSSAHRGQAFQACEFLMDYLKTQAPFWKKEQTPQGARWVDARVADDDALRRWGIAASGNA

SEQ ID NO: 70533 - DNA, 462 bp, Pseudomonas fluorescens PfO-1
  CDS (1)..(462)
atgggtgttcgagtccagcgtaaaggcttcgatgccggtcagttgattgccgacctgcatgcgcgcaatccacgggtgggcgcggtggtgaatttcattggttatgtgcgggatctgaacgtcgggcagtcggtgaccgagctgtttctggagcactatccgggcatgaccgagaaggctctggagcagatagccgaacaggctcgcgagcgctggccgttgctggcggtggagattgtgcatcgggtcggtgcgttgtcggtgaccgaaccgatcgtgtttgttggcgtcagcagcaagcatcggcatgcggcgttccaggcctgtgcgttcatcatggatgtgctgaagacccacgcgccgttctggaaacgtgagaccacgccagagggttcgcattgggtcgaggcgcgggagagtgatcggaatgcggcgtttcgctggagtctggcgcatgcctga

SEQ ID NO: 70534 - protein, 153 aa, Pseudomonas fluorescens PfO-1
MGVRVQRKGFDAGQLIADLHARNPRVGAVVNFIGYVRDLNVGQSVTELFLEHYPGMTEKALEQIAEQARERWPLLAVEIVHRVGALSVTEPIVFVGVSSKHRHAAFQACAFIMDVLKTHAPFWKRETTPEGSHWVEARESDRNAAFRWSLAHA

SEQ ID NO: 70535 - DNA, 453 bp, Pseudomonas fluorescens PfO-1
  CDS (1)..(453)
atgggcattcgggtgcagtccgaaccgttcgatcctggcgctgaagtcaacgcgatgcacgcggcgaatgtcggcgtcggcgcggtggtgagttttgtcggctacgtgcgcgacttcaacgatggcctcgatgtcgccgggatgttcctcgaacactatccgggcatgaccgaaaaggccctcggcaagatcgccttggaggccgagcagcgctggccgctgttgaagctggaagtgctgcaccgcatcggcgcgctggaaccgggtgaaccgatcgtgtttgtcgccgccgccagtgcccaccgccaggcggcgttcgacgcctgcgccttcgtcatggattacctgaaaacccgcgcgccgttctggaagaaagagaacaccagcgacggcccgcgctgggtcgaaggccgtgacagcgatcatgcggcggcggatcgctggaagcagtaa

SEQ ID NO: 70536 - protein, 150 aa, Pseudomonas fluorescens PfO-1
MGIRVQSEPFDPGAEVNAMHAANVGVGAVVSFVGYVRDFNDGLDVAGMFLEHYPGMTEKALGKIALEAEQRWPLLKLEVLHRIGALEPGEPIVFVAAASAHRQAAFDACAFVMDYLKTRAPFWKKENTSDGPRWVEGRDSDHAAADRWKQ

SEQ ID NO: 70537 - DNA, 489 bp, Rhodospirillum rubrum
  CDS (1)..(489)
atggccgttcacgtccaaagcgccgatttcgacagcgccgccgagatcgcccgcttcgagcgccaagccgccctcaagggcgccggggcggtggccagcttctgcgggctggtgcgcggccgcgagggggaggatggtccgctgatcggggcgatgaccctggaacactaccccggcatgaccgagcgcgccctggccgccatcgaggccgaggcgctggcccgctggccgctgaccgatagcctgatcatccaccgcttcggccggctggagccgggcgcgcgcatcgtgctggtctgcaccgcgtcctcgcaccgcgaagccgccttcgccgcctgcgcctttctgatggactggctcaagaccaaggcgcccttctggaaaaaagaggaaaccgccgagggaccgcggtgggtcgacgccaaggccgaagacgacgcccgcgccgcggcctggaacgaggcaagcgcgccgcgcaaccccgactaa

SEQ ID NO: 70538 - protein, 162 aa, Rhodospirillum rubrum
MAVHVQSADFDSAAEIARFERQAALKGAGAVASFCGLVRGREGEDGPLIGAMTLEHYPGMTERALAAIEAEALARWPLTDSLIIHRFGRLEPGARIVLVCTASSHREAAFAACAFLMDWLKTKAPFWKKEETAEGPRWVDAKAEDDARAAAWNEASAPRNPD

SEQ ID NO: 70539 - DNA, 492 bp, Ralstonia metallidurans CH34
  CDS (1)..(492)
atggcggtgcgcgttcagcacgaggatttcgatctcggcgcggaagtggcggcgctgcgcgccggcaatccgggcgttggggcggtggccagcttcatcggaacggtgcgcgatgtcagcgaaggcacgcgcgtcagtacgatggagctcgagcactatcccggcatgaccgagaaggcgctggagacgatcgaggcggcggcgcgcgaacgctggccgctgcttggcgtgaccatcgtgcatcgcgtgggcctgctgcagccgctggaccagatcgtgctggttgccgtgtcctcggcccaccgtggggccgcgtttgcggcgtgcgagttcatcatggactatctgaagtccgaggcaccgttctggaagaaagaagacacgccggaaggcgcgcgctgggtcgacgcgcgggtctcggacgatgccgcgctgcgccgctggggtatcgaatcgttcaacgcggatcccgccaataacaaggaagaatga

SEQ ID NO: 70540 - protein, 163 aa, Ralstonia metallidurans CH34
MAVRVQHEDFDLGAEVAALRAGNPGVGAVASFIGTVRDVSEGTRVSTMELEHYPGMTEKALETIEAAARERWPLLGVTIVHRVGLLQPLDQIVLVAVSSAHRGAAFAACEFIMDYLKSEAPFWKKEDTPEGARWVDARVSDDAALRRWGIESFNADPANNKEE

SEQ ID NO: 70541 - DNA, 477 bp, Burkholderia fungorum LB400
  CDS (1)..(477)
atgcccgttcgtgtccagacggaagacttcgacctcaccgccgaggtcgccggattgcgcgcgcgcaacccgaagatcggcgcggtcgcctgttttgtcggcaccgtgcgcgacctgaacgacggcagcatgatcgagacgatggagctcgaacactatcccggcatgacggagaagtcgctggaggcgattatcgtcagcgcgcgtgaacgctggccgggcatcgaggtgctgatcgtgcaccgggtcggcaagctgtatccgctcgatcagatcgtgctggtggcgacgacggccgcgcatcgcggggaagccttcgcgtcgtgcgaattcgtgatggattatctgaagacccaggcgccgttctggaagaaagagaagaccgaggccggcgagcgctgggtcgacgcccgtgtcaccgacgacgcggcactcgcccgctggggcatcgaatcggacaatcggacggtggagtag

SEQ ID NO: 70542 - protein, 158 aa, Burkholderia fungorum LB400
MPVRVQTEDFDLTAEVAGLRARNPKIGAVACFVGTVRDLNDGSMIETMELEHYPGMTEKSLEAIIVSARERWPGIEVLIVHRVGKLYPLDQIVLVATTAAHRGEAFASCEFVMDYLKTQAPFWKKEKTEAGERWVDARVTDDAALARWGIESDNRTVE

SEQ ID NO: 70543 - DNA, 1131 bp, Magnetococcus sp. MC-1
  CDS (1)..(1131)
atgggtaatgtagtgaggttgaccgcatactctagcgagatcttggccatggatagcatacgcatacagacagaggatttttcggcgcaggatgaagtggatgccctgctcaaagccaatcctaaaattggtggggtggtcacttttttgggtaccgtgcgcgattttacctcatccgacgctgtgaccgcgctggagctggaacactacccaggtatgaccgaacgggagcttgagcgcattgtggcagccgcccacgcccagtttcctgtcgaggcgattcgggtgattcaccgggttggttatctggaggtgggacaaaatattgttctggtgattgccgctgggcgtcaccgggccgaatcgtttgaagcctgccgctatgtgatcgaccatttaaaggtacgtgcaaccttgtggaaaaaagagatctcccccagtggttcgcgctgggtagagagctgccccggttgcgaggccgcagccagccaatgggccgatcttaaacaaggggccaaacatacccacgccgtaagcgcggttgaggcagaccatcaccaccacggcgaccatcagcacggcgaccatcagcacggcggcggcccgcaacatggccatgctgagcatcgggatcatggggcggcggtggccagttggcctggattgcgggtggggatcgttaccctgtcggatagccgtaccctggcaacggataaaagcggtgatgcccttgagggcgcggtgttgagctatggggggcgggtggtgcaacgcaccctgttggccgatgatcaggcggtgctggcggcttgtctctgtacatgggccgatgagcagggggtggatgtgattttgaccaccgggggcaccggtcccagccctcgggatattaccccagaagccacccgtcaggtgtgcaatcgggaactccctggatttgcggaactcatacgtgcagcgggtatgcagcagacccgcaatgcagtgtttacccggggggtaacggcgctgcgtgggcagaccttggtggtgaacttgcccggcagcacccgtggcgcactgcacagtttgcaagcggttgcggatcttattccccatgccctaagaatggccgctggggcaggccactaa

SEQ ID NO: 70544 - protein, 376 aa, Magnetococcus sp. MC-1
MGNVVRLTAYSSEILAMDSIRIQTEDFSAQDEVDALLKANPKIGGVVTFLGTVRDFTSSDAVTALELEHYPGMTERELERIVAAAHAQFPVEAIRVIHRVGYLEVGQNIVLVIAAGRHRAESFEACRYVIDHLKVRATLWKKEISPSGSRWVESCPGCEAAASQWADLKQGAKHTHAVSAVEADHHHHGDHQHGDHQHGGGPQHGHAEHRDHGAAVASWPGLRVGIVTLSDSRTLATDKSGDALEGAVLSYGGRVVQRTLLADDQAVLAACLCTWADEQGVDVILTTGGTGPSPRDITPEATRQVCNRELPGFAELIRAAGMQQTRNAVFTRGVTALRGQTLVVNLPGSTRGALHSLQAVADLIPHALRMAAGAGH

SEQ ID NO: 70545 - DNA, 432 bp, Thermobifida fusca
  CDS (1)..(432)
atggaagccatcgcgctcgcggagatccgtaccactccgctgtccgtcgacgaagtcctcgcggccgtcaaagacgaccgggcaggagggaccgccttcttcgtggggaccgtccgcaaccatgaccacggccgcgacgtggccgcgctgtcctactcggcgcatcccaccgccgagcagcggatgcgcgacgtcatggagaagatcgtggccgatacggccgacggcaccgtgcaccgggtcgcggccgtgcaccgggtcggcgacctcaccgtaggcgacctggcagtggttgtcgccgcggcagcctcccaccgggaggaagcgttcacggtctgccgacggctcatcgacgacatcaaagcagaagtgccgatctggaagcaccaaacattcaccgagggcgacagcgagtgggtgggcgcttactaa

SEQ ID NO: 70546 - protein, 143 aa, Thermobifida fusca
MEAIALAEIRTTPLSVDEVLAAVKDDRAGGTAFFVGTVRNHDHGRDVAALSYSAHPTAEQRMRDVMEKIVADTADGTVHRVAAVHRVGDLTVGDLAVVVAAAASHREEAFTVCRRLIDDIKAEVPIWKHQTFTEGDSEWVGAY

SEQ ID NO: 70547 - DNA, 858 bp, Methanosarcina barkeri str. fusaro
  CDS (1)..(858)
atgaaagtcatttcagttgtcgggtataaagaatcggataaaacatccgtagtttcatcccttgtccggaatctttccgggttcggaactgtgggcacaataaaacacatgggtgagcagcgcttcaattccgcagagaccgatgtaggcaggcactttgatgccggggctgacacagtaataggaataacaggcacagaagcaacaggtactgaacttatcagtttttccagagatctggaccttgaggacgcacttgacgtgctttgcgaccaggggcttgattttgccgtggtagaggggtttaaggaaagcaatcttccgaaaattgtaattggtgatcttcagggcgtttccaatgtcgttttcaggctgccggcagaaatcgatatgcacgaagaacttacagcctcgcttgtagggatagcccttgcacagcctgaccggtacactctggaagcccttataaagaaagtcagaaaaaaccctgcaatcagaaaagcaggcgcaatcggcacctttgccggcattgtccgcgagctggccggaaacgagagaacttcaaagctcgaattcgagaaatacgaaccagaagcttcaaaaacccttgaccagatccgggaagaactaaaacaaaaagaaggaatctttgaagtcctgatccaccataaaacaggcgttatcaaagccggagaagacatagtatacattgttgtcacagccgcccacaggggagagcttttttctgccctcagcgaagccatagaacgcataaaagccgaagctcctatctggaagaaggaattcacagaaaaagaggaattctgggttcacgatagagaacatcacgaaaattaa

SEQ ID NO: 70548 - protein, 285 aa, Methanosarcina barkeri str. fusaro
MKVISVVGYKESDKTSVVSSLVRNLSGFGTVGTIKHMGEQRFNSAETDVGRHFDAGADTVIGITGTEATGTELISFSRDLDLEDALDVLCDQGLDFAVVEGFKESNLPKIVIGDLQGVSNVVFRLPAEIDMHEELTASLVGIALAQPDRYTLEALIKKVRKNPAIRKAGAIGTFAGIVRELAGNERTSKLEFEKYEPEASKTLDQIREELKQKEGIFEVLIHHKTGVIKAGEDIVYIVVTAAHRGELFSALSEAIERIKAEAPIWKKEFTEKEEFWVHDREHHEN

SEQ ID NO: 70549 - DNA, 447 bp, Novosphingobium aromaticivorans DSM 12444
  CDS (1)..(447)
atggccagggtccggctcgctctggatgcgttcgaaccggcggatgaaatcgcggcgttcaatgcgctgcacccggctgcgggcgggatcgtcacgttcctcggtcaggtccgcgaaggcggcggggtcgaagccctcgaactccagcactatgcgccgatgacacttccggggatggaggaactggcgcgggtcgcggaacgccgctggccgctggagggccttttgatcgtccaccgcagcggtgtgatgaagccgcgcgatccgatcgtgctcgtctgcgcggcagcccgccatcggcgcgatgcctttgccgcggccgattacgtgatggaccacctcaagagcgagagctggttctggaagcgcgagaagaccgctgcgggctggcactgggttgagccgcgcgcgcaggatcacgacgacctgtcacgctggcgggcctga

SEQ ID NO: 70550 - protein, 148 aa, Novosphingobium aromaticivorans DSM 12444
MARVRLALDAFEPADEIAAFNALHPAAGGIVTFLGQVREGGGVEALELQHYAPMTLPGMEELARVAERRWPLEGLLIVHRSGVMKPRDPIVLVCAAARHRRDAFAAADYVMDHLKSESWFWKREKTAAGWHWVEPRAQDHDDLSRWRA

SEQ ID NO: 70551 - DNA, 411 bp, Ferroplasma acidarmanus
  CDS (1)..(411)
atgatcaaaatacaggaagaaaaaatagaccatgaaacactggtaaatgaagttaaaaatgataaggctggcgccatcgtcacattttatggaacagttaggtcaatagatgaaacttctgatgatattatagcactggtatatgaagcatatgaagagatggcaattaaaaaaatagaagaaataataaaagacgcacagaaaaagtatccggtaatcaatgtggctgtgattcagagaatagggcgcgtaaatgttggtgaggactccataggcatagctgtttcctctgaacacagggatagcgcattccatgcctgtgaatttataatagacaaaataaaaattttgccgccaatatggaaaaaggagatttactcctcaggcgaagtctggaggtcagaggcatag

SEQ ID NO: 70552 - protein, 136 aa, Ferroplasma acidarmanus
MIKIQEEKIDHETLVNEVKNDKAGAIVTFYGTVRSIDETSDDIIALVYEAYEEMAIKKIEEIIKDAQKKYPVINVAVIQRIGRVNVGEDSIGIAVSSEHRDSAFHACEFIIDKIKILPPIWKKEIYSSGEVWRSEA

SEQ ID NO: 70553 - DNA, 432 bp, Cytophaga hutchinsonii
  CDS (1)..(432)
atggttaatgatatacatatttcagcggctgaaatttccccggccgatctgctgaaagagtatcatcatccggaagccggcgccatcgttctcttcagcggtgaagtgcgtacggattctgctaaagaagttttatacctggattatgaagtacatacttccttagcggagcatatgatccatgaaattttactcgaagcagccgctaaatggaatttgaaaatggctctttgcgtacaccgatccggcagcgtagatgtgtcgggagctgcagtggttgttattaccgcttcgcgtcatcgtaaagaagcatacgaagcaaaccaatatattattaaccgggtaaaacatgaagcgcctatctggaagcgtgaatattttgcagacggaaccagcgaatgggggcataactgttcatgttccactacctga

SEQ ID NO: 70554 - protein, 143 aa, Cytophaga hutchinsonii
MVNDIHISAAEISPADLLKEYHHPEAGAIVLFSGEVRTDSAKEVLYLDYEVHTSLAEHMIHEILLEAAAKWNLKMALCVHRSGSVDVSGAAVVVITASRHRKEAYEANQYIINRVKHEAPIWKREYFADGTSEWGHNCSCSTT

SEQ ID NO: 70555 - DNA, 438 bp, Microbulbifer degradans 2-40
  CDS (1)..(438)
atgattcgagtacaaaccgaagactttcacctgcaaacagaatatgagcagttacaaaagcatggccacagtggcgccattgtaacgtttgtgggcagtgtgcgagattttggtggcgagggaagttttaggctagaccactacccaggcatgaccgaaaaggtacttgaaaaaatagagcaacaagccaaccaacgctgggacttaattagcaccaccattatacaccgcgtaggtaacttggctgcaggtgaccaaattgtgtttgtgggggtgagcagtcgccaccgtaaaaatgccttcgccgcgtgcgaatacatgatagacatactaaaaacccaagcaccattttggaaaaaagaaggcgacacatgggtagatgccaaagaatctgatagcgaggcagccgacaaatggctaagccactcgcaaccataa

SEQ ID NO: 70556 - protein, 145 aa, Microbulbifer degradans 2-40
MIRVQTEDFHLQTEYEQLQKHGHSGAIVTFVGSVRDFGGEGSFRLDHYPGMTEKVLEKIEQQANQRWDLISTTIIHRVGNLAAGDQIVFVGVSSRHRKNAFAACEYMIDILKTQAPFWKKEGDTWVDAKESDSEAADKWLSHSQP

SEQ ID NO: 70557 - DNA, 525 bp, Trichodesmium erythraeum IMS101
  CDS (1)..(525)
atgaattctaattttacagcacctttctctggagaactgaaagaagaaaaagataacttttctattactatagctcctttatctattgcagaaatatatgctttagcagataaccctagcaatggcgctgtagttgtaatgagcggaatggttcgtaatataacagacgctaaatctgttattgctttagaataccaatcctatcaacctatggctatcaaagtcttcgagcaaattgccacagaaattcgccatcaatggccagaagttaatacagtcgtaattcatcatcgggtgggacgtttaaacgttggtgacatcagcgtattagtcgcaataggttgtccccatcgctcagaagcatttgaagcttgtcgttatactattgacactttaaagcatacagcccctatctggaaaaaagaacattgggccgatggatcaagtagttgggtaagtattggagcttgtgaaatagaaaatcagaataactcggaacctcttaaaaatattccacgcctataa

SEQ ID NO: 70558 - protein, 174 aa, Trichodesmium erythraeum IMS101
MNSNFTAPFSGELKEEKDNFSITIAPLSIAEIYALADNPSNGAVVVMSGMVRNITDAKSVIALEYQSYQPMAIKVFEQIATEIRHQWPEVNTVVIHHRVGRLNVGDISVLVAIGCPHRSEAFEACRYTIDTLKHTAPIWKKEHWADGSSSWVSIGACEIENQNNSEPLKNIPRL

SEQ ID NO: 70559 - DNA, 456 bp, Thiobacillus denitrificans ATCC 25259
  CDS (1)..(456)
atgaaaatcgcggtacagaacgaagccttcgatctcggcagcgaagtcgcggcgctgacgcacggccggcgcgacgtcggcgcggtcgcgagcttcgtcggactcgcgcgcgacatcaacgaaggcagcggcgtcgccgcgatgacgctcgaacattacccgggcatgaccgagaaggcgctcgccgcgctggtcgacgaggcctgcgcgcgctgggccttgctcgacgtgagcgtggtccatcgcgtcgggcgtctgctgccgggcgacccgatcgtgctcgtcgcggtcgcgagcgcccaccgcggtgaggcgttcgccgcgtgcgaattcatcatggacgcgctgaagacgcgtgcgccgttctggaagaaggaagagacgccggacggcgagcgctgggtcgaggcgcgcgccagcgacgaagccgccgccgggcgctgggagaaacgctga

SEQ ID NO: 70560 - protein, 151 aa, Thiobacillus denitrificans ATCC 25259
MKIAVQNEAFDLGSEVAALTHGRRDVGAVASFVGLARDINEGSGVAAMTLEHYPGMTEKALAALVDEACARWALLDVSVVHRVGRLLPGDPIVLVAVASAHRGEAFAACEFIMDALKTRAPFWKKEETPDGERWVEARASDEAAAGRWEKR

SEQ ID NO: 70561 - DNA, 447 bp, Silicibacter sp. TM1040
  CDS (1)..(447)
atgcgggtggttgtgcaggaggcgccgtttgattttgctgcagaagccgaagcgtttgcacaaggtgcaaaaggagctggggccgtggtcactttcaccggcgtagtacgagaagccgacggtggtgccatggcggtgatggagattgagcattatccgggcatgaccgaaaaagcgctggccaacatcgcgtcagacgctgccacgcgctgggagctgaccgatgcgctggtaatccaccgccacggtcgcctggcgcccggagatcagatcatgatggtcgcgacggccgcccgtcaccgtgttgctgcctttgaggctgcagaatatctgatggactacctcaaatcccgcgccccgttttggaagaaagaaattcttgaagacggctctgcggattgggtcgaggccaagaactccgatgaatccgcgctctcgcggtggtga

SEQ ID NO: 70562 - protein, 148 aa, Silicibacter sp. TM1040
MRVVVQEAPFDFAAEAEAFAQGAKGAGAVVTFTGVVREADGGAMAVMEIEHYPGMTEKALANIASDAATRWELTDALVIHRHGRLAPGDQIMMVATAARHRVAAFEAAEYLMDYLKSRAPFWKKEILEDGSADWVEAKNSDESALSRW

SEQ ID NO: 70563 - DNA, 414 bp, Chloroflexus aurantiacus
  CDS (1)..(414)
atggtcgaaccgtttgtcattaccacagaaccgcttgatccagcgccactggtagcggcagtccagacgcccaatgatggggctgttgtcacctttagcggcgtggttcgcaaccacttcggtggacggcctacggcatttctggtgtacgaagcctacaccgaaatggccgtgccggtgttacgccagattgccgacgaggcacgagtgcgctggccgattgggcgggtctgtgtccaccaccgggtcggtcggctagagattggcgagacggcagtgctggttgttgttgcggctccgcaccgcgacgccgcctttgcggctgcggcctacattatggatcgaatcaaagagattgcgcccatctggaaacaggagcattgggccgatggtgaagccgaatggcgtgaatag

SEQ ID NO: 70564 - protein, 137 aa, Chloroflexus aurantiacus
MVEPFVITTEPLDPAPLVAAVQTPNDGAVVTFSGVVRNHFGGRPTAFLVYEAYTEMAVPVLRQIADEARVRWPIGRVCVHHRVGRLEIGETAVLVVVAAPHRDAAFAAAAYIMDRIKEIAPIWKQEHWADGEAEWRE

SEQ ID NO: 70565 - DNA, 567 bp, Polaromonas sp. JS666
  CDS (1)..(567)
atggctctatcccgcgttctgatcacgaccgaagacttcaacctggccgatgaggtggctgttctgcgcgcgaatgacagccgggtcggcgccgtatgcactttcacgggcaccgtgagggaccgcaatatggcccccacacttgccactgcgtgtgctgcgctgccccccgagggggctgaacttgctaggggcggcccgtcgctgcgttcgtcggcccagcaaggggaggtgctttcgatggaactggaacactaccccggcatgaccgaaaaagccattgaggccatgatcgacgaggcgatggtgcgcttcgatatttttggcgttcgggtgatccaccgtgtcggacttttgcagccgctggatcaggtggtcatggtggcggtgacttccgctcaccgcggtgaaagcttcaaggcctgtgaatttttgatggactacctgaaaacccaggcgccgttctggaaaaaagagcagacgccagagggcgcgcgctgggtcgatgcgcgcgtgagcgacgatgccgcactggccaaatggggcatacaagccaccaatggctag

SEQ ID NO: 70566 - protein, 188 aa, Polaromonas sp. JS666
MALSRVLITTEDFNLADEVAVLRANDSRVGAVCTFTGTVRDRNMAPTLATACAALPPEGAELARGGPSLRSSAQQGEVLSMELEHYPGMTEKAIEAMIDEAMVRFDIFGVRVIHRVGLLQPLDQVVMVAVTSAHRGESFKACEFLMDYLKTQAPFWKKEQTPEGARWVDARVSDDAALAKWGIQATNG

SEQ ID NO: 70567 - DNA, 405 bp, uncultured archaeon GZfos32E4
  CDS (1)..(405)
atgatcacagaacaagattttttccttgatgtgctcgtgaggaaaatgaaaaacccggagataggagccattgtaacttttcttggtgtagtgagagccgatgaaactctaaaagaactggaaatagaaattaaagacgaaatgaaggcagagaaagagcttgaacgcttgaaacgagaagccttagaaaagtttgatgttgaagctgtggaaatcgtacatcggaagggctctttggaagcaggcgataatatcgttgctattctggtgggtgcgaagcatagaaaggaagcattcagggcgtgtgaatatttgatagacgtgttgaggataagtgaagctataagactgaaagatcacttatatagaaaccacgagattacacaacactttttctttttttaa

SEQ ID NO: 70568 - protein, 134 aa, uncultured archaeon GZfos32E4
MITEQDFFLDVLVRKMKNPEIGAIVTFLGVVRADETLKELEIEIKDEMKAEKELERLKREALEKFDVEAVEIVHRKGSLEAGDNIVAILVGAKHRKEAFRACEYLIDVLRISEAIRLKDHLYRNHEITQHFFFF

SEQ ID NO: 70569 - DNA, 393 bp, uncultured archaeon GZfos28G7
  CDS (1)..(393)
atgattacagaacaagattttttccttgatgagctcgtgaggaaaatgaaaaacctggagataggagccattgtaacttttcttggtgtagtgagagccgataaaactctaaaaagactggaaatagaaattaaagacgaaatgaaggcagagagagagcttgaacgcttgaaacgagaagccatagaaaagtttgatgttgaatcggtggaaatcgtacatcgaaaaggttcgtttgaagtaggtgacaatatcgttgccattctggtgggtgcgaagcatagaaaggaagcattcagggcttgtgaatatttgatagacgtgttgaggataagtgaagctataagactgaaggggcatttatatagaaaccacgagatttcacaagattaa

SEQ ID NO: 70570 - protein, 130 aa, uncultured archaeon GZfos28G7
MITEQDFFLDELVRKMKNLEIGAIVTFLGVVRADKTLKRLEIEIKDEMKAERELERLKREAIEKFDVESVEIVHRKGSFEVGDNIVAILVGAKHRKEAFRACEYLIDVLRISEAIRLKGHLYRNHEISQD

SEQ ID NO: 70571 - DNA, 453 bp, uncultured bacterium 560
  CDS (1)..(453): transl_table=11
atggataaaatagtcgttcaaacagaggatttcgatttaacaaccgaagtcgctcatactcgcagcaacaaccctcagattggtgccattgtaagctttatcggaaccgttagagacctgcaccctggttccattagtagcatgacgcttgaacattatccagagatgactgaaaaatcacttaaatcaatagtcacagaggctagagagcgctgggatctacaaaacattactattattcaccgtattggtaaactaaaagttaatgatcaaattgttctagttgtgacaacaagcaaacaccgtcaagcggcttttgaatcatgccattttattatggattatttaaaaacagacgcacctttttggaaaaaagaatcaacagagcaaaaagaggaatgggtagaatcacgagaaagtgacgatgaacaaaaaaaacgctggcagtcttaa

SEQ ID NO: 70572 - protein, 150 aa, uncultured bacterium 560
MDKIVVQTEDFDLTTEVAHTRSNNPQIGAIVSFIGTVRDLHPGSISSMTLEHYPEMTEKSLKSIVTEARERWDLQNITIIHRIGKLKVNDQIVLVVTTSKHRQAAFESCHFIMDYLKTDAPFWKKESTEQKEEWVESRESDDEQKKRWQS

SEQ ID NO: 70573 - DNA, 447 bp, uncultured bacterium 439
  CDS (1)..(447): transl_table=11
atggataaaatagtcattcaaacagaggatttcgatttaacaaccgcagtcagtcagacacgagacaacaactctcaggttggtgccattgtaagctttattggtaccgttagagatctacactctggccccattagtagtatgacacttgaacattatccagagatgactgaaaaatcacttaaatcaattgtcacagaggctagagagcgctgggatctgcaaaacgttaccattattcaccgtattggaaaactaaaagttaatgatcaaattgttctagttgtgacaacaagtaaacatcgtcaagcggcttttgaatcatgctattttattatggattatttaaaaacagatgcgcctttttggaaaaaagaatcaacagagcaaaaagaggaatgggtggaatcacgaaaaagtgacgatgaacaaaaaaaacgctggtag

SEQ ID NO: 70574 - protein, 148 aa, uncultured bacterium 439
MDKIVIQTEDFDLTTAVSQTRDNNSQVGAIVSFIGTVRDLHSGPISSMTLEHYPEMTEKSLKSIVTEARERWDLQNVTIIHRIGKLKVNDQIVLVVTTSKHRQAAFESCYFIMDYLKTDAPFWKKESTEQKEEWVESRKSDDEQKKRW

SEQ ID NO: 70575 - DNA, 477 bp, uncultured bacterium 106
  CDS (1)..(477): transl_table=11
atgacctgttcagtagttcgtaatgtaattgatcttgaaggtttacgccaacgtgcacaacatcctcaagctggagcagtcataattttttacggtgatgtgcgtaaccacagtcagcagcaggaagtctcgttcctagaatatgaagcacatgagaacatggccctaaaacaaatatcaatggtaattgatgaagcccggaaaaagtgggtacttcattcagtagaagttattcaccgtctcggtaaacttgctgtgaaagactgttcaatcgccattgccgtagcaacttctcaccgaggtgatgcttatgcagcaagtcgatacatcattgacactattaaacattctgttccaatctggaaaaaagaacattttgttgacggtgtttccgcatggagtaaagggtgcgaagcatacagcgttgttgaagagactgcggaacctccgcctgctgtgaataacgaggttccatga

SEQ ID NO: 70576 - protein, 158 aa, uncultured bacterium 106
MTCSVVRNVIDLEGLRQRAQHPQAGAVIIFYGDVRNHSQQQEVSFLEYEAHENMALKQISMVIDEARKKWVLHSVEVIHRLGKLAVKDCSIAIAVATSHRGDAYAASRYIIDTIKHSVPIWKKEHFVDGVSAWSKGCEAYSVVEETAEPPPAVNNEVP

SEQ ID NO: 70577 - DNA, 477 bp, Dictyostelium discoideum
  CDS (1)..(477)
atgtcaaaagaatcaagaatatttattgaaattagtgaaaatataattgatttaaattattggtataaaattgtatcagatgatagtagtggtgcaacctcatcatttttaggtacaacaagaaatgaatttaaaggtaaatcagttgaaagattagaatatgaaacctatgaaccaatggcaattaaagagattgaaaaaatttgtaaaactatattaaatggatttgaaaatgatattaaaaaaattggtattgttcatagaattggtaatgttccagttggtgaatcaagtatattaattgtaatttcttctggtcatagaaaatcatcattagaagctgttcattatgctattgacacaattaaatcaactgtaccaatttggaaaaaagaattttatactgatggttctgagaatcaatggaaaggaaattgtgaatcttgtcattttaataataataatcatcctcattaa

SEQ ID NO: 70578 - protein, 158 aa, Dictyostelium discoideum
MSKESRIFIEISENIIDLNYWYKIVSDDSSGATSSFLGTTRNEFKGKSVERLEYETYEPMAIKEIEKICKTILNGFENDIKKIGIVHRIGNVPVGESSILIVISSGHRKSSLEAVHYAIDTIKSTVPIWKKEFYTDGSENQWKGNCESCHFNNNNHPH

SEQ ID NO: 70579 - DNA, 468 bp, Arthrobacter nicotinovorans
  CDS (1)..(468): transl_table=11
atgaggcaagcctttgccgtcgtccattccgcgctcagcgatcagccaatttccgtcgacgtggctattgcggctgtggattcacgtacgtctggagcagtggtgagtttttgtggagtggtgcgcgatcacgacggcggcaaagcagtcgaccgactgagctacaccgctcaccccacggcacaccaggccctaagcgacgtaatggaagcggttgctgccaagtactcgttcagtgacgaggcggaggaaggcgttcccgtgcgaatctgggcggcgcatcgtgtgggcgcactccaaattgggcaagcggcactcgtttgtgctgtagccgccggacaccggggacaggcattcgccgtgtgttcggaactggttgaccgcatcaaggaagaggtacccatttggaaggaacagttcttttccgatggaaccgtggaatgggtcggtgccggtggcgcaggttga

SEQ ID NO: 70580 - protein, 155 aa, Arthrobacter nicotinovorans
MRQAFAVVHSALSDQPISVDVAIAAVDSRTSGAVVSFCGVVRDHDGGKAVDRLSYTAHPTAHQALSDVMEAVAAKYSFSDEAEEGVPVRIWAAHRVGALQIGQAALVCAVAAGHRGQAFAVCSELVDRIKEEVPIWKEQFFSDGTVEWVGAGGAG

SEQ ID NO: 70581 - DNA, 519 bp, Alcaligenes eutrophus
  CDS (1)..(519): transl_table=11
atgagcgtcagggtgcagcgtgaggatttcgatctcggcgcggaagtcgctgcgctgcgtgccggcaatccggcggtcggcgcggtggccagctttatcggcacggtgcgcgatgtcagcgacggcagcgcggtcagcgcgatggagcttgagcactatccgggtatgaccgagaaggcgctggcgcagatcgaagcggctgcgtgcgcgcgctgggcgctgctgggcgtgaccatcatccaccgcgtcgggccgatgcagccgctggaccagatcgtgatggtcgcggtggcgtcggcgcatcgcggcaatgcctttgccgcgtgcgagttcatcatggactacctcaagtccgaagcgccgttctggaagaaggaagacaccccggaaggggcgcgctgggtcgacgcccgcgtgaccgacgaagccgccctccagcgctgggggatcgcatcgttcaatgccagcggcgacgatgctggcgcaccaccggagaagcagggcgggagccagccctga

SEQ ID NO: 70582 - protein, 172 aa, Alcaligenes eutrophus
MSVRVQREDFDLGAEVAALRAGNPAVGAVASFIGTVRDVSDGSAVSAMELEHYPGMTEKALAQIEAAACARWALLGVTIIHRVGPMQPLDQIVMVAVASAHRGNAFAACEFIMDYLKSEAPFWKKEDTPEGARWVDARVTDEAALQRWGIASFNASGDDAGAPPEKQGGSQP

SEQ ID NO: 70583 - DNA, 453 bp, uncultured bacterium pCosHE1
  CDS (1)..(453): transl_table=11
atggatgatacgcgaattctggttagccctgagcgctttaacgtcggtacggaatatcactggctggcagagcgcgatgaagacggtgctgttgtgaccttcaccggtaaagtgcgtaaccacaaccttggcgacagcgtaaaagcgctgacgctggaacactatccgggcatgaccgagaaatctctggctgcgatcgtcgaagaggcgcgaggccgctggccgctcgggcgtgtgacggttatccaccgcatcggtgagatgtggccgggcgaggagatcgttttcgtgggggtgaccagcgcccatcgcggcagcgcgtttgccgccggggagttcatcatggattacctgaaaaccaaagccccgttctggaaacgtgaagcgacgccggagggggagcggtgggttgaatcgcgcgacagcgacaaacaggccgccagccgttggtaa

SEQ ID NO: 70584 - protein, 150 aa, uncultured bacterium pCosHE1
MDDTRILVSPERFNVGTEYHWLAERDEDGAVVTFTGKVRNHNLGDSVKALTLEHYPGMTEKSLAAIVEEARGRWPLGRVTVIHRIGEMWPGEEIVFVGVTSAHRGSAFAAGEFIMDYLKTKAPFWKREATPEGERWVESRDSDKQAASRW

SEQ ID NO: 70585 - DNA, 444 bp, Mycobacterium tuberculosis
  CDS (1)..(444): transl_table=11
atggccaatgtggtagctgaaggtgcctacccttactgtcggctcactgatcagccgctgagtgtggacgaagtgctagccgccgtctcgggccccgaacaaggcggcattgtcatatttgtgggaaacgtgcgtgaccacaatgccgggcatgatgtcacgcggttgttctacgaggcgtatccgccgatggtgattcggacattgatgtcgatcatcggacggtgtgaagacaaggccgagggtgtccgcgttgctgtcgcgcaccggaccggtgaattgcaaatcggtgatgccgcggtcgttattggcgcgtcagctccccaccgtgcggaggcatttgacgccgcgcgtatgtgtatcgagttgcttaagcaggaagtgccgatttggaagaaggaattcagctcgaccggtgctgaatgggtcggcgatagaccatga

SEQ ID NO: 70586 - protein, 147 aa, Mycobacterium tuberculosis
MANVVAEGAYPYCRLTDQPLSVDEVLAAVSGPEQGGIVIFVGNVRDHNAGHDVTRLFYEAYPPMVIRTLMSIIGRCEDKAEGVRVAVAHRTGELQIGDAAVVIGASAPHRAEAFDAARMCIELLKQEVPIWKKEFSSTGAEWVGDRP

SEQ ID NO: 70587 - DNA, 426 bp, Mycobacterium tuberculosis
  CDS (1)..(426): transl_table=11
atgacgcaggtcctgcgcgccgcgctgacagatcaaccgatctttctggccgagcacgaggagctggtgagccatcggtcggctggcgccattgtcgggttcgtcggaatgatccgcgaccgtgacggtggacggggggtgttgcggctggagtactccgcgcacccgtcggccgcacaggtccttgcggatttggtggcggaggtagctgaagagtccagtggcgtgcgtgcggtggcggccagccaccggatcggcgtcttgcaggtcggggaggccgccctggtggcggcggttgccgccgatcaccggcgggcggcgtttggcacctgtgcgcacctggtggagaccatcaaggcgcggcttcccgtgtggaagcaccagttcttcgaggacggtaccgacgaatgggtgggttcggtttaa

SEQ ID NO: 70588 - protein, 141 aa, Mycobacterium tuberculosis
MTQVLRAALTDQPIFLAEHEELVSHRSAGAIVGFVGMIRDRDGGRGVLRLEYSAHPSAAQVLADLVAEVAEESSGVRAVAASHRIGVLQVGEAALVAAVAADHRRAAFGTCAHLVETIKARLPVWKHQFFEDGTDEWVGSV

SEQ ID NO: 70589 - DNA, 498 bp, Anabaena sp
  CDS (1)..(498)
atgaaatcagtgctgccatctacacccattgttacgctcaaacccaaaattgaagatagttttgctatcactttcgcacctttatctctagaagaaattcatgctctagccgatgactcggctaatggtgcggtggtagtaatgagtgggatggttcgcaatcaaaccgatggaaaacctgtagtttccttagaatatcaagcttatgaaccaatggcattgcgtgtattttatcaaatagcggcagacattcgctcggcttggcctgctgtcaatcgggtagtgattcatcatcgtattgggcgtttgcaggtaggacaaatcagcgttttagtagccataggttgtccccatcgtagtgaggcatttgcagcctgtcgctatgcaattgataccctgaaacataacgcccccatttggaaaaaagaacattggcaagatggttctagcacttgggtaagtattggtgcttgtgaacagtcaggacaaaattgctaa

SEQ ID NO: 70590 - protein, 165 aa, Anabaena sp
MKSVLPSTPIVTLKPKIEDSFAITFAPLSLEEIHALADDSANGAVVVMSGMVRNQTDGKPVVSLEYQAYEPMALRVFYQIAADIRSAWPAVNRVVIHHRIGRLQVGQISVLVAIGCPHRSEAFAACRYAIDTLKHNAPIWKKEHWQDGSSTWVSIGACEQSGQNC

SEQ ID NO: 70591 - DNA, 465 bp, Aquifex aeolicus
  CDS (1)..(465): transl_table=11
atggaggtgggcatgattccgagagtttacctcggacacgagtggttcggtgcggaaaggatactgagtgaataccaagttcccgaagactgcggagcgcaggttctgttcctcggcattcccagaaacgcacccgaagacggcggaaatatagaagctcttgagtacgaggcgtaccccgaaatggctataaaagaaatggaaaagataagacaggaaacgatagagaagttcggcgtaaaggaagtattcatacaccacaggcttggtctggtgaaaatcggagaaccttccttcttagtgcttgcggtaggtggacacagggaagaaacctttaaagcgtgcaggtacgccgttgacgagacgaaaaaacgcgtccccatatggaagaaggaaatctttaaggaaggaaaaggagagtgggtcctaggggaaaagaaaaatgcttctggacaaactaagtag

SEQ ID NO: 70592 - protein, 154 aa, Aquifex aeolicus
MEVGMIPRVYLGHEWFGAERILSEYQVPEDCGAQVLFLGIPRNAPEDGGNIEALEYEAYPEMAIKEMEKIRQETIEKFGVKEVFIHHRLGLVKIGEPSFLVLAVGGHREETFKACRYAVDETKKRVPIWKKEIFKEGKGEWVLGEKKNASGQTK

SEQ ID NO: 70593 - DNA, 471 bp, Bacillus halodurans
  CDS (1)..(471)
atgacgagcaaacgatttgccatcatggaacaaccgattgtgatccagcaagtgatcgatcaggtcgttcacccacatgcaggagcgattaatacgtttattggcaccgttcgtgagctgacaaagggaaagagaaccctttatttacagtacgaggcctatccatcgatggcagaaaaaaagttggcgcaaatcggccaagaaattcaagagcgctggcctgaggcgagggtcgcaattactcatcgaataggtcggctagaaattaccgatgtagcggtagtcattgctgtttcaacccctcaccgcgctgattcgtatgaagcaagccgctatgcgatagaacgaattaaagaaattgtcccaatctggaaaaaagaacattgggaggatggcgaaatgtgggtcggggatcaattagagacaacctcatatcctgaaggagcgccaaagatggaggaagaggaatga

SEQ ID NO: 70594 - protein, 156 aa, Bacillus halodurans
MTSKRFAIMEQPIVIQQVIDQVVHPHAGAINTFIGTVRELTKGKRTLYLQYEAYPSMAEKKLAQIGQEIQERWPEARVAITHRIGRLEITDVAVVIAVSTPHRADSYEASRYAIERIKEIVPIWKKEHWEDGEMWVGDQLETTSYPEGAPKMEEEE

SEQ ID NO: 70595 - DNA, 474 bp, Bacillus subtilis
  CDS (1)..(474): transl_table=11
atggaacggtttgagattacgaaaacacccattaatactgaaaacatcatcaaaaaagtggagaaacgggaagcgggagccattacaacatttattggtacggttcgggaatggacaaacggaaaaagaacggttcggcttgaatatgaggcatatgaaccgatggccgtgcaaatgcttgctcaaatcggcgctgaaatcgaagaaaaatgggaaggtgcctcagctgcgatcacgcaccgtataggtgtgctcgatatcggtgaagcagcggtagtgattgctgtatcttctccccatcgaaaagccgcatatgaagccaatgagtatgcgattgaacgcattaaacagattgtgccgatttggaaaaaagaaatttgggaagacggtgagcaatggatcggcgaccagctagaaacgacagcttatccgaacggaaaaccagacctaagcgagggagagcagcatgattaa

SEQ ID NO: 70596 - protein, 157 aa, Bacillus subtilis
MERFEITKTPINTENIIKKVEKREAGAITTFIGTVREWTNGKRTVRLEYEAYEPMAVQMLAQIGAEIEEKWEGASAAITHRIGVLDIGEAAVVIAVSSPHRKAAYEANEYAIERIKQIVPIWKKEIWEDGEQWIGDQLETTAYPNGKPDLSEGEQHD

SEQ ID NO: 70597 - DNA, 492 bp, Brucella melitensis
  CDS (1)..(492): transl_table=11
atggacgggcaacccacctgtccgctatcgatcagcgttcgcagcgaagatttcgatattgccgccgagatcgaccgcattggcaagaaccgcagggaaatcggcgcgattgtaacctttaccggcctttgccgcgatgaagacggacagcttgccgctcttgagcttgagcattatccgggcatggcacaagccgaaatttcgcgcatggcaaagcaggccctggaacgctggccgctgaacggcctgaccatcattcaccgctatggtctgattaaacccggcgaaaatatcgttctcgtcgtcgccgcgtccagacatcgacacgccgctttcgaggccgcttcgtttctgatggactatatgaaaaccaatgcgcctttctggaagcgtgagcatcttgccgatggcacggctggcggctgggtgtcctccaaagaagaggacgaagaaagccgcaagcgatgggaagagcctcgcaaaagcgaatga

SEQ ID NO: 70598 - protein, 163 aa, Brucella melitensis
MDGQPTCPLSISVRSEDFDIAAEIDRIGKNRREIGAIVTFTGLCRDEDGQLAALELEHYPGMAQAEISRMAKQALERWPLNGLTIIHRYGLIKPGENIVLVVAASRHRHAAFEAASFLMDYMKTNAPFWKREHLADGTAGGWVSSKEEDEESRKRWEEPRKSE

SEQ ID NO: 70599 - DNA, 453 bp, Caulobacter crescentus
  CDS (1)..(453): transl_table=11
atgatcgtcaccctgaccgatcagccgttcgagcccggcgttctggtttccgccttttgcgccggccgtgaagagacgggcgcggtggcgaccttcatcggactcgcccgcgccgagcaaggcgccgcccgcgcgctggagcttgaggcctatccgggtttcacggacgccgcgatcacagagatcgcgcaaggcgcggtgacgcgcttcgccctgcaggatgtccacatcgtgcatcgtgtcggcgtcatcgcgccgggcgaggcgattgtgttcgtggccaccgccgccgcccatcgccgcgaggccttcgaggcctgcgactacctgatggactacctcaagagccgtgcgcccttctggaagaaggagcatggccccgagggtccgcgctggatcgaacccacggcgcgcgataggaccgacgcgcaacgctgggatcaggaggcctga

SEQ ID NO: 70600 - protein, 150 aa, Caulobacter crescentus
MIVTLTDQPFEPGVLVSAFCAGREETGAVATFIGLARAEQGAARALELEAYPGFTDAAITEIAQGAVTRFALQDVHIVHRVGVIAPGEAIVFVATAAAHRREAFEACDYLMDYLKSRAPFWKKEHGPEGPRWIEPTARDRTDAQRWDQEA

SEQ ID NO: 70601 - DNA, 453 bp, Pasteurella multocida
  CDS (1)..(453): transl_table=11
atgagcgatattcaaattgcagtacaagaacagccctttgatcaaaatgcggcatatcgttggttatcagaacaacattctgtcggggctaccgtggtttttgtgggcaaagtacgggatttaaatctcggcgatgaagtatccagtttgtatttagaacattatcccgcgatgactgaaaaagccctaacagagattgtggcgcaagcaaaagcccgctgggacattcaacgtgtttgtgtcattcaccgtgttggtttattacaaacaggtgatgagattgttttcgtcggggtgagctctgcacatcgtggtgaagcttatcaagctaatgaatttattatggattttttaaaaagcaaagccccattttggaaaaaagaaaaaaccactcagggtgagcgctggattgaaagtcgcgatactgatcagcaagccttagcacgctggtaa

SEQ ID NO: 70602 - protein, 150 aa, Pasteurella multocida
MSDIQIAVQEQPFDQNAAYRWLSEQHSVGATVVFVGKVRDLNLGDEVSSLYLEHYPAMTEKALTEIVAQAKARWDIQRVCVIHRVGLLQTGDEIVFVGVSSAHRGEAYQANEFIMDFLKSKAPFWKKEKTTQGERWIESRDTDQQALARW

SEQ ID NO: 70603 - DNA, 453 bp, Pseudomonas aeruginosa
  CDS (1)..(453): transl_table=11
atggccatccgcgtccagcaggccgctttcgatccggggcaggagcttaacgccctgcatgcgcagaacgtcggcatcggcgcggtggtcggcttcgtcggctacgtgcgcgacttcaacgacggtcgcgaggtcggcgggatgttcctcgaacattatccgggcatgaccgagaaggccctcggcaagatcgccgccgaggccgggcagcgctggccgctgctgcgcctggagatcctccaccgcatcggccgcctggagccgggcgagccgatcgtcttcgtcggttgcgccagcgcccaccggcaggcggcgttcgacgcctgcaacttcgtcatggactacctgaagacccgcgcgccgttctggaagaaggaagacaccgccgaaggcccgcgctgggtcgaaggccgctgcagcgaccaggccgccgcgcagcgctgggaggagtga

SEQ ID NO: 70604 - protein, 150 aa, Pseudomonas aeruginosa
MAIRVQQAAFDPGQELNALHAQNVGIGAVVGFVGYVRDFNDGREVGGMFLEHYPGMTEKALGKIAAEAGQRWPLLRLEILHRIGRLEPGEPIVFVGCASAHRQAAFDACNFVMDYLKTRAPFWKKEDTAEGPRWVEGRCSDQAAAQRWEE

SEQ ID NO: 70605 - DNA, 447 bp, Pyrococcus abyssi
  CDS (1)..(447): transl_table=11
atggggaagtcgaaggtctctttggttaagaagcccgaggattttaacatcgaggaagcaatagccctagtttcctctagctccactggggggatagttattttcctgggcaaagttagggatgaaaatcttggtaggaaggttgagaagttgatatatgaggcctacgatgagatggcgataaaagaaatggaaaggattaggaatgaagcccttgataggtttccgattgtagatgcgctgatttggcataggattggggagctagaggttggagaaaatacgatactagttgtagtatccgcaaagcacaggagggaggcattcgaggcatgtgcttggatagttgatgaggttaagaaaagagtcccagtgtggaagagggaggtaactgatgaaggtgaattctggatcgaaggggataggcacgttccagtcaaaagatag

SEQ ID NO: 70606 - protein, 148 aa, Pyrococcus abyssi
MGKSKVSLVKKPEDFNIEEAIALVSSSSTGGIVIFLGKVRDENLGRKVEKLIYEAYDEMAIKEMERIRNEALDRFPIVDALIWHRIGELEVGENTILVVVSAKHRREAFEACAWIVDEVKKRVPVWKREVTDEGEFWIEGDRHVPVKR

SEQ ID NO: 70607 - DNA, 531 bp, Ralstonia solanacearum
  CDS (1)..(531): transl_table=11
atgcccacgatacgtgtacaggaagcggatttcgacctgggcgccgagatcgccgcgctgcgcgcgggccggccgcagatcggcgcggtggcgagcttcatcggcacggtgcgcgacatcaacgacggcagcggcgtgtccgagatggagctggagcactatccgggcatgacggagaaggcgctggccaatatcgtcgatgcggcgatgcagcgctgggacctgatcgatgcgctggtcatccaccgggtgggcaagctccggcccgaagaccagatcgtgctggtggcggtggcgtccggccatcgcggcgaggcctttgccgcctgcgaattcatcatggactacctcaagagcgaggccccgttctggaagaaggagcagacggcgcagggtgcccgctgggtcgacgcgcgcgtgaccgatgaacgggcgctggcgcgctggggcatcgtcacggacaacgcctcggctgccaccgcccaggcagcctccgccaacgaccagaaccagaaggaccgcgacgcatga

SEQ ID NO: 70608 - protein, 176 aa, Ralstonia solanacearum
MPTIRVQEADFDLGAEIAALRAGRPQIGAVASFIGTVRDINDGSGVSEMELEHYPGMTEKALANIVDAAMQRWDLIDALVIHRVGKLRPEDQIVLVAVASGHRGEAFAACEFIMDYLKSEAPFWKKEQTAQGARWVDARVTDERALARWGIVTDNASAATAQAASANDQNQKDRDA

SEQ ID NO: 70609 - DNA, 480 bp, Rhizobium loti
  CDS (1)..(480)
atgtcggccgtcctggcgccgaccgtgcgcatccagcgccaggatttcgacgtcgccgccgagatcgctgcgctgacccaaggccgcgcggacgttggcgcggtggtttctttctccggcctctgccgcgatgagcagggcgcgctctcggcactggagctcgaacattatcccggcatggcggaggccgagatcggccgtatcgccgccgaggcggttgagcgctggccgctgcaaggcctcaccgtcatccaccgccatggcaagattcgtccgggcgaaaacatcgtgctggtggtggccgcctcggcccatcgccaagccgcgttcgaggcggcgaactttctcatggattacctcaaatcgcgcgcgcccttctggaagaaggagcatcgcaccgatggttccgaaggtggctgggtcgaggccaaggaaaccgacacccaggcggcaaagcgctggaagtcatcgtccgaataa

SEQ ID NO: 70610 - protein, 159 aa, Rhizobium loti
MSAVLAPTVRIQRQDFDVAAEIAALTQGRADVGAVVSFSGLCRDEQGALSALELEHYPGMAEAEIGRIAAEAVERWPLQGLTVIHRHGKIRPGENIVLVVAASAHRQAAFEAANFLMDYLKSRAPFWKKEHRTDGSEGGWVEAKETDTQAAKRWKSSSE

SEQ ID NO: 70611 - DNA, 468 bp, Rhizobium meliloti
  CDS (1)..(468): transl_table=11
atggccgcccccgtcaccgtgcgcgtccagcgcgacgacttcgacatcgccgccgaagtctcggcgctttgccgtgcgcggactgacatcggtgcggtggtcacgttttcggggctgtgccgggacgaggccggagccctcagtgcgctcgagctcgagcattatcccggcatggcagaggcggagatcgaacggatatgccacgaagcggtcgagcgcttcggcctgcaggctgcaaccgccatccatcgcttcggccgcatggagccgggagcgaatatcgtcctggtggcaaccgcctcgccgcaccggcaggcggcattcgatggcgcgaatttcatcatggatttcctgaagacctcggcccccttctggaagaaggaacatcacgccgacggcagcgcaggcgattgggtcagcgcgaaggatgcggacgacgcggcacgcgatcgctggacgcgccgctga

SEQ ID NO: 70612 - protein, 155 aa, Rhizobium meliloti
MAAPVTVRVQRDDFDIAAEVSALCRARTDIGAVVTFSGLCRDEAGALSALELEHYPGMAEAEIERICHEAVERFGLQAATAIHRFGRMEPGANIVLVATASPHRQAAFDGANFIMDFLKTSAPFWKKEHHADGSAGDWVSAKDADDAARDRWTRR

SEQ ID NO: 70613 - DNA, 441 bp, Rhodobacter sphaeroides
  CDS (1)..(441): transl_table=11
atgcgcgttctggttcaggccgagcccttcgagttcggcgccgaggcgcagaccttcgcggacggcgctgcaggggcgggggccatcgtgaccttcaccgggctcgtgcgcgacctgtcgggcgcgctcgaggccatggagatcgagcattatccgggcatgaccgaacgcgccatcgccgccatcgccgaggaggcccggcagcgctggcacctgatcgatgcgctggtgatccaccggcacggccggctcgggccctcggagcccatcatgatggtcgcgaccgctgcggcgcaccgggccgaggccttcgccgcagccgagttcctgatggattatctgaagtcgcgggcgcccttctggaagaaggaagtcaccgccgggggcgccgactgggtggcggccaaggaagcggacgaggccgcgctcgggcgctggtag

SEQ ID NO: 70614 - protein, 146 aa, Rhodobacter sphaeroides
MRVLVQAEPFEFGAEAQTFADGAAGAGAIVTFTGLVRDLSGALEAMEIEHYPGMTERAIAAIAEEARQRWHLIDALVIHRHGRLGPSEPIMMVATAAAHRAEAFAAAEFLMDYLKSRAPFWKKEVTAGGADWVAAKEADEAALGRW

SEQ ID NO: 70615 - DNA, 453 bp, Salmonella typhi
  CDS (1)..(453): transl_table=11
atgcacgaaacgcgaattgtagtcggccctgcgccgtttagcgtcggggaggaatattcctggctggcggcgcgcgacgaagacggcgcggtcgtcacctttaccggaaaagtgcgcaatcataacctgggcgatagcgttaaggcgctgacgctggagcattatcccggcatgactgagaaagctctggcggagatcgtcgcgaaggcgcgttcccgctggccgctggggcgggtcacggtgattcatcgcgttggcgaattatggccgggcgatgagattgtgtttgtcggcgtcaccagcgcgcaccgcagtagcgcgttcgacgccggtcagttcattatggattatctgaaaacccgtgcgccgttctggaagcgtgaagccacgccggaaggcgatcgctgggtcgaagcgcgcgacagcgaccagcagttggcgaaacgttggtag

SEQ ID NO: 70616 - protein, 150 aa, Salmonella typhi
MHETRIVVGPAPFSVGEEYSWLAARDEDGAVVTFTGKVRNHNLGDSVKALTLEHYPGMTEKALAEIVAKARSRWPLGRVTVIHRVGELWPGDEIVFVGVTSAHRSSAFDAGQFIMDYLKTRAPFWKREATPEGDRWVEARDSDQQLAKRW

SEQ ID NO: 70617 - DNA, 447 bp, Staphylococcus aureus
  CDS (1)..(447)
atgaaacaatttgaaatcgtgatagaaccgatacaaacagaacaatatcgtgaattcactataaatgaatatcaaggtgcagtagttgtttttaccggtcatgttcgcgaatggactaaaggcgtcaaaacggaatatttagaatatgaagcgtatattccaatggctgaaaagaaattggcacaaattggagatgaaataaatgaaaaatggcctggaacgataacgagtattgttcatagaatagggccattacaaatttcagatatcgctgtattaattgcagtttcttcaccgcatcgtaaagatgcctatcgagcaaatgaatatgcaattgagcgtataaaagaaattgttccgatttggaaaaaagaaatttgggaagatggttcaaaatggcaagggcatcaaaaagggaattatgaagaagcgaagagggaggaataa

SEQ ID NO: 70618 - protein, 148 aa, Staphylococcus aureus
MKQFEIVIEPIQTEQYREFTINEYQGAVVVFTGHVREWTKGVKTEYLEYEAYIPMAEKKLAQIGDEINEKWPGTITSIVHRIGPLQISDIAVLIAVSSPHRKDAYRANEYAIERIKEIVPIWKKEIWEDGSKWQGHQKGNYEEAKREE

SEQ ID NO: 70619 - DNA, 447 bp, Staphylococcus aureus
  CDS (1)..(447)
atgaaacaatttgaaatcgtgacagaaccgatacaaacagaacaatatcgtgaattcactataaatgaatatcaaggtgcagtagttgtttttaccggtcatgttcgcgaatggactaaaggcgtcaaaacggaatatttagaatatgaagcgtatattccaatggctgaaaagaaattggcacaaattggagatgaaataaatgaaaaatggcctggaacgataacgagtattgttcatagaatagggccattacaaatttcagatatcgctgtattaattgcagtttcttcaccgcatcgtaaagatgcctatcgagcaaatgaatatgcaattgagcgtatcaaagaaattgttccgatttggaaaaaagaaatttgggaagatggttcaaaatggcaaggacatcaaaaagggaattatgaagaagcgaagagggaggaataa

SEQ ID NO: 70620 - protein, 148 aa, Staphylococcus aureus
MKQFEIVTEPIQTEQYREFTINEYQGAVVVFTGHVREWTKGVKTEYLEYEAYIPMAEKKLAQIGDEINEKWPGTITSIVHRIGPLQISDIAVLIAVSSPHRKDAYRANEYAIERIKEIVPIWKKEIWEDGSKWQGHQKGNYEEAKREE

SEQ ID NO: 70621 - DNA, 453 bp, Staphylococcus carnosus
  CDS (1)..(453): transl_table=11
atgaaacagtttgagattgtaacagaaccgatacaaacagaacagcatcgagactttacacttaatccgcaccaaggagcagtggttgtatttacaggacatgtccgagaatggactaaagggatacgcactgaacatttagaatatgaagcttatattccaatggctgagaagaaactcgcacaaatcggtgatgaaattaatgaacagtggccaggtacaattgtaagtattgtacatcgaatcgggccattaaaaatttcagatatagctgtgttgattgcggtatcttctccgcatagaaaagatgcatacgctgctaatgagtatgcaatagatcgtattaaagaagttgttcccatttggaaaaaagaaatttgggaagatggagctgagtggattggccatcaacgcggctaccacgatgatgcagttgaaagggggcaaaattaa

SEQ ID NO: 70622 - protein, 150 aa, Staphylococcus carnosus
MKQFEIVTEPIQTEQHRDFTLNPHQGAVVVFTGHVREWTKGIRTEHLEYEAYIPMAEKKLAQIGDEINEQWPGTIVSIVHRIGPLKISDIAVLIAVSSPHRKDAYAANEYAIDRIKEVVPIWKKEIWEDGAEWIGHQRGYHDDAVERGQN

SEQ ID NO: 70623 - DNA, 498 bp, Synechococcus sp
  CDS (1)..(498): transl_table=11
atgccagacttgctgacctgcgatcgccatcagattgaactgagcctagcccccattcccctctcagctgctgctgaattttgtcacgacgatcgctacggggcctttgccagctttgtgggctgggtgcggcgcgtcaatgtcggtcgcttagtgacgggcatcacctatcaaagttttcagccgctctgccgcacagttctgaccgaaatttgccaagaggctgagcaggtgttcggccaagaactgcgcatctacgtccaacaccgcctcggtgaaacccgtgttggtgaccccaccgtgctgatcggcgtcggtgccattcatcgcgatgaagcctgtgaagcctgccgctacgtaattgaggagctaaaacatcgcgccccaatctggaaactcgaacactatgaagatggagactcgggctgggtgcctggcaactgtctctgccaagagcggcgatcgcgcgatcgcagaggatccacagggccggaatga

SEQ ID NO: 70624 - protein, 165 aa, Synechococcus sp
MPDLLTCDRHQIELSLAPIPLSAAAEFCHDDRYGAFASFVGWVRRVNVGRLVTGITYQSFQPLCRTVLTEICQEAEQVFGQELRIYVQHRLGETRVGDPTVLIGVGAIHRDEACEACRYVIEELKHRAPIWKLEHYEDGDSGWVPGNCLCQERRSRDRRGSTGPE

SEQ ID NO: 70625 - DNA, 414 bp, Thermoplasma volcanium
  CDS (1)..(414)
atgataaacacgtacgttgagataacagaaaaagatattaacccacttgacttgataaacagggtaagaaggcctgacgcaggggcaatagtgacatttgaaggaacagttaggaacgattcagatggcgttcgtgttaccgctttgtattatgaggcatataaggagatggcagagatgcagatagctgacctcattgatgaagctaagaaaaaatacaatattttagatgcagctgtatgccaccggataggacttgtaggtctcacagaagattctgtggttatatcagtaagttcagcacaccgttccagtgcatttgaagcctgcaggtacataatagacactataaaagaaagagtacctatatggaagagagatatacttgagaacggaaacggatcctggcattga

SEQ ID NO: 70626 - protein, 137 aa, Thermoplasma volcanium
MINTYVEITEKDINPLDLINRVRRPDAGAIVTFEGTVRNDSDGVRVTALYYEAYKEMAEMQIADLIDEAKKKYNILDAAVCHRIGLVGLTEDSVVISVSSAHRSSAFEACRYIIDTIKERVPIWKRDILENGNGSWH

SEQ ID NO: 70627 - DNA, 453 bp, Vibrio cholerae
  CDS (1)..(453): transl_table=11
atggaccatcgcgtatcggtgcagaaggaagatttctctgttgctcaagaatatgaagcgttagcgcaaggctcacaagcgggggctgtggtgacttttgtcggcaaagttcgggatatgaacttgggcgataatgtcgtgggcttacaccttgaacactatccgggcatgacggaaaaatccttgctggagatttgcgatatggctcaggagcgttggcctctacaacgcgttcgcgttattcatcgcatcggcgatatgctcagcggcgatcaaatcgtgttggttggtgtcagcagtgcgcaccgcaatgctgcgtttgcagcgtgcgagttcatcatggattacttgaaaacccgcgcgccattttggaaaaaagagctgacgaccgaagcgagtcgctggattgattcacgcgacagtgatcatcaagccgcgcagcgctgggaataa

SEQ ID NO: 70628 - protein, 150 aa, Vibrio cholerae
MDHRVSVQKEDFSVAQEYEALAQGSQAGAVVTFVGKVRDMNLGDNVVGLHLEHYPGMTEKSLLEICDMAQERWPLQRVRVIHRIGDMLSGDQIVLVGVSSAHRNAAFAACEFIMDYLKTRAPFWKKELTTEASRWIDSRDSDHQAAQRWE

SEQ ID NO: 70629 - DNA, 567 bp, Homo sapiens
  CDS (1)..(567)
atgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagcccacagagctgcatctcttgaagctgtgagctatgccattgatactttaaaagccaaggtgcccatatggaaaaaggaaatatacgaagagtcatcaacttggaaaggaaacaaagagtgcttttgggcatccaacagttaa

SEQ ID NO: 70630 - protein, 188 aa, Homo sapiens
MSSLEISSSCFSLETKLPLSPPLVEDSAFEPSRKDMDEVEEKSKDVINFTAEKLSVDEVSQLVISPLCGAISLFVGTTRNNFEGKKVISLEYEAYLPMAENEVRKICSDIRQKWPVKHIAVFHRLGLVPVSEASIIIAVSSAHRAASLEAVSYAIDTLKAKVPIWKKEIYEESSTWKGNKECFWASNS

SEQ ID NO: 70631 - DNA, 438 bp, Synechocystis sp
  CDS (1)..(438)
atggctttagctttatttgacattagtgatcaaccaatcaatacccaacctttaatttcagctttacagtgtgaccaagctggagccctagtaacttttgctggttgggtgagaaaccacaatgacggtaaacaagtcgactctttggaataccaagtctatcgggagttagccatcaacgagggttttaaaattattgctgaagctaaagaaaaatatgatctccaccaggcgatcgccgtccatcgtagtggccatttaaaaattggtgaaactgcagtatgggtggggactgtggctagccatcgccaagctgcttttcaaggtactcagtatgttattgaccaaattaaactgagattacccatttggaaaaaggaacattacttcgattatccggccacatgggtttattgttgccatcatcatggtagttag

SEQ ID NO: 70632 - protein, 145 aa, Synechocystis sp
MALALFDISDQPINTQPLISALQCDQAGALVTFAGWVRNHNDGKQVDSLEYQVYRELAINEGFKIIAEAKEKYDLHQAIAVHRSGHLKIGETAVWVGTVASHRQAAFQGTQYVIDQIKLRLPIWKKEHYFDYPATWVYCCHHHGS

SEQ ID NO: 70633 - DNA, 25 bp, Primer
atggcagaaaccaaaattgttgttg

SEQ ID NO: 70634 - DNA, 22 bp, Primer
ttaccagcgttttgccgcctgc

SEQ ID NO: 70635 - protein, 170 aa, consensus
  MISC_FEATURE (1)..(170): consensus for the disclosure of xaa see table XV
AXXXFXGXXRXXXXXXXXXXXXXXXXXXXXXXXXXXXXXXXXXXXXXXXXXXXXXYXXXXXXXXXXXXXXXXXXXXXXXXXXXXXXXXXXXXXXXXXXXXXXXXXXHRXGXXXXXXXXXXXXXXXXHRXXAXXAXXXXXXXXKXXXPXWKXEXXXXXXXXXXXXXXXXXW

SEQ ID NO: 70636 - protein, 12 aa, consensus
  MISC_FEATURE (1)..(12): consensus for the disclosure of xaa see table XV
GXXXXXXGXXXX

SEQ ID NO: 70637 - protein, 46 aa, consensus
  MISC_FEATURE (1)..(46): consensus for the disclosure of xaa see table XV
XXXXXXXXXXXXXXXXXXXXXRXXXXXXXXXXXXXXXXXXXXXXXX

SEQ ID NO: 70638 - DNA, 660 bp, Escherichia coli; identical to SEQ ID NO: 58632
  CDS (1)..(660)

SEQ ID NO: 70639 - protein, 219 aa, Escherichia coli; identical to SEQ ID NO: 58633

SEQ ID NO: 70640 - DNA, 977 bp, Cryptococcus neoformans var. neoformans JEC21; identical to SEQ ID NO: 58634
  CDS (27)..(878)

SEQ ID NO: 70641 - protein, 283 aa, Cryptococcus neoformans var. neoformans JEC21; identical to SEQ ID NO: 58635

SEQ ID NO: 70642 - DNA, 663 bp, Azoarcus sp. EbN1; identical to SEQ ID NO: 58636
  CDS (1)..(663)

SEQ ID NO: 70643 - protein, 220 aa, Azoarcus sp. EbN1; identical to SEQ ID NO: 58637

SEQ ID NO: 70644 - DNA, 705 bp, Ehrlichia ruminantium str. Welgevonden; identical to SEQ ID NO: 58638
  CDS (1)..(705)

SEQ ID NO: 70645 - protein, 234 aa, Ehrlichia ruminantium str. Welgevonden; identical to SEQ ID NO: 58639

SEQ ID NO: 70646 - DNA, 723 bp, Wolbachia endosymbiont strain TRS of Brugia malayi; identical to SEQ ID NO: 58640
  CDS (1)..(723)

SEQ ID NO: 70647 - protein, 240 aa, Wolbachia endosymbiont strain TRS of Brugia malayi; identical to SEQ ID NO: 58641

SEQ ID NO: 70648 - DNA, 663 bp, Vibrio fischeri ES114; identical to SEQ ID NO: 58642
  CDS (1)..(663)

SEQ ID NO: 70649 - protein, 220 aa, Vibrio fischeri ES114; identical to SEQ ID NO: 58643

SEQ ID NO: 70650 - DNA, 684 bp, Neisseria gonorrhoeae FA 1090; identical to SEQ ID NO: 58644
  CDS (1)..(684)

SEQ ID NO: 70651 - protein, 227 aa, Neisseria gonorrhoeae FA 1090; identical to SEQ ID NO: 58645

SEQ ID NO: 70652 - DNA, 708 bp, Xenopus tropicalis; identical to SEQ ID NO: 58646
  CDS (1)..(708)

SEQ ID NO: 70653 - protein, 235 aa, Xenopus tropicalis; identical to SEQ ID NO: 58647

SEQ ID NO: 70654 - DNA, 714 bp, Sus scrofa; identical to SEQ ID NO: 58648
  CDS (1)..(714)

SEQ ID NO: 70655 - protein, 237 aa, Sus scrofa; identical to SEQ ID NO: 58649

SEQ ID NO: 70656 - DNA, 975 bp, Danio rerio; identical to SEQ ID NO: 58650
  CDS (1)..(975)

SEQ ID NO: 70657 - protein, 324 aa, Danio rerio; identical to SEQ ID NO: 58651

SEQ ID NO: 70658 - DNA, 1116 bp, Homo sapiens; identical to SEQ ID NO: 58652
  CDS (1)..(1116)

SEQ ID NO: 70659 - protein, 371 aa, Homo sapiens; identical to SEQ ID NO: 58653

SEQ ID NO: 70660 - DNA, 714 bp, Mus musculus; identical to SEQ ID NO: 58654
  CDS (1)..(714)

SEQ ID NO: 70661 - protein, 237 aa, Mus musculus; identical to SEQ ID NO: 58655

SEQ ID NO: 70662 - DNA, 774 bp, Mesorhizobium loti MAFF303099; identical to SEQ ID NO: 58656
  CDS (1)..(774): transl_table=11

SEQ ID NO: 70663 - protein, 257 aa, Mesorhizobium loti MAFF303099; identical to SEQ ID NO: 58657

SEQ ID NO: 70664 - DNA, 744 bp, Arabidopsis thaliana; identical to SEQ ID NO: 58658
  CDS (1)..(744)

SEQ ID NO: 70665 - protein, 247 aa, Arabidopsis thaliana; identical to SEQ ID NO: 58659

SEQ ID NO: 70666 - DNA, 720 bp, Arabidopsis thaliana; identical to SEQ ID NO: 58660
  CDS (1)..(720)

SEQ ID NO: 70667 - protein, 239 aa, Arabidopsis thaliana; identical to SEQ ID NO: 58661

SEQ ID NO: 70668 - DNA, 747 bp, Arabidopsis thaliana; identical to SEQ ID NO: 58662
  CDS (1)..(747)

SEQ ID NO: 70669 - protein, 248 aa, Arabidopsis thaliana; identical to SEQ ID NO: 58663

SEQ ID NO: 70670 - DNA, 708 bp, Arabidopsis thaliana; identical to SEQ ID NO: 58664
  CDS (1)..(708)

SEQ ID NO: 70671 - protein, 235 aa, Arabidopsis thaliana; identical to SEQ ID NO: 58665

SEQ ID NO: 70672 - DNA, 744 bp, Arabidopsis thaliana; identical to SEQ ID NO: 58666
  CDS (1)..(744)

SEQ ID NO: 70673 - protein, 247 aa, Arabidopsis thaliana; identical to SEQ ID NO: 58667

SEQ ID NO: 70674 - DNA, 714 bp, Lactococcus lactis subsp. lactis Il1403; identical to SEQ ID NO: 58668
  CDS (1)..(714): transl_table=11

SEQ ID NO: 70675 - protein, 237 aa, Lactococcus lactis subsp. lactis Il1403; identical to SEQ ID NO: 58669

SEQ ID NO: 70676 - DNA, 705 bp, Escherichia coli O157:H7; identical to SEQ ID NO: 58670
  CDS (1)..(705): transl_table=11

SEQ ID NO: 70677 - protein, 234 aa, Escherichia coli O157:H7; identical to SEQ ID NO: 58671

SEQ ID NO: 70678 - DNA, 696 bp, Clostridium acetobutylicum ATCC 824; identical to SEQ ID NO: 58672
  CDS (1)..(696): transl_table=11

SEQ ID NO: 70679 - protein, 231 aa, Clostridium acetobutylicum ATCC 824; identical to SEQ ID NO: 58673

SEQ ID NO: 70680 - DNA, 708 bp, Streptococcus pneumoniae R6; identical to SEQ ID NO: 58674
  CDS (1)..(708): transl_table=11

SEQ ID NO: 70681 - protein, 235 aa, Streptococcus pneumoniae R6; identical to SEQ ID NO: 58675

SEQ ID NO: 70682 - DNA, 738 bp, Sinorhizobium meliloti 1021; identical to SEQ ID NO: 58676
  CDS (1)..(738): transl_table=11

SEQ ID NO: 70683 - protein, 245 aa, Sinorhizobium meliloti 1021; identical to SEQ ID NO: 58677

SEQ ID NO: 70684 - DNA, 645 bp, Bacillus subtilis subsp. subtilis str. 168; identical to SEQ ID NO: 58678
  CDS (1)..(645): transl_table=11

SEQ ID NO: 70685 - protein, 214 aa, Bacillus subtilis subsp. subtilis str. 168; identical to SEQ ID NO: 58679

SEQ ID NO: 70686 - DNA, 705 bp, Salmonella typhimurium LT2; identical to SEQ ID NO: 58680
  CDS (1)..(705): transl_table=11

SEQ ID NO: 70687 - protein, 234 aa, Salmonella typhimurium LT2; identical to SEQ ID NO: 58681

SEQ ID NO: 70688 - DNA, 660 bp, Salmonella typhimurium LT2; identical to SEQ ID NO: 58682
  CDS (1)..(660): transl_table=11

SEQ ID NO: 70689 - protein, 219 aa, Salmonella typhimurium LT2; identical to SEQ ID NO: 58683

SEQ ID NO: 70690 - DNA, 678 bp, Listeria innocua Clip11262; identical to SEQ ID NO: 58684
  CDS (1)..(678): transl_table=11

SEQ ID NO: 70691 - protein, 225 aa, Listeria innocua Clip11262; identical to SEQ ID NO: 58685

SEQ ID NO: 70692 - DNA, 702 bp, Ralstonia solanacearum GMI1000; identical to SEQ ID NO: 58686
  CDS (1)..(702): transl_table=11

SEQ ID NO: 70693 - protein, 233 aa, Ralstonia solanacearum GMI1000; identical to SEQ ID NO: 58687

SEQ ID NO: 70694 - DNA, 783 bp, Agrobacterium tumefaciens str. C58; identical to SEQ ID NO: 58688
  CDS (1)..(783): transl_table=11

SEQ ID NO: 70695 - protein, 260 aa, Agrobacterium tumefaciens str. C58; identical to SEQ ID NO: 58689

SEQ ID NO: 70696 - DNA, 771 bp, Arabidopsis thaliana; identical to SEQ ID NO: 58690
  CDS (1)..(771)

SEQ ID NO: 70697 - protein, 256 aa, Arabidopsis thaliana; identical to SEQ ID NO: 58691

SEQ ID NO: 70698 - DNA, 714 bp, Camelpox virus; identical to SEQ ID NO: 58692
  CDS (1)..(714)

SEQ ID NO: 70699 - protein, 237 aa, Camelpox virus; identical to SEQ ID NO: 58693

SEQ ID NO: 70700 - DNA, 690 bp, Streptococcus pyogenes MGAS8232; identical to SEQ ID NO: 58694
  CDS (1)..(690): transl_table=11

SEQ ID NO: 70701 - protein, 229 aa, Streptococcus pyogenes MGAS8232; identical to SEQ ID NO: 58695

SEQ ID NO: 70702 - DNA, 795 bp, Drosophila melanogaster; identical to SEQ ID NO: 58696
  CDS (1)..(795)

SEQ ID NO: 70703 - protein, 264 aa, Drosophila melanogaster; identical to SEQ ID NO: 58697

SEQ ID NO: 70704 - DNA, 711 bp, Yersinia pestis KIM; identical to SEQ ID NO: 58698
  CDS (1)..(711): transl_table=11

SEQ ID NO: 70705 - protein, 236 aa, Yersinia pestis KIM; identical to SEQ ID NO: 58699

SEQ ID NO: 70706 - DNA, 690 bp, Streptococcus agalactiae 2603V/R; identical to SEQ ID NO: 58700
  CDS (1)..(690): transl_table=11

SEQ ID NO: 70707 - protein, 229 aa, Streptococcus agalactiae 2603V/R; identical to SEQ ID NO: 58701

SEQ ID NO: 70708 - DNA, 900 bp, Bifidobacterium longum NCC2705; identical to SEQ ID NO: 58702
  CDS (1)..(900): transl_table=11

SEQ ID NO: 70709 - protein, 299 aa, Bifidobacterium longum NCC2705; identical to SEQ ID NO: 58703

SEQ ID NO: 70710 - DNA, 738 bp, Brucella suis 1330; identical to SEQ ID NO: 58704
  CDS (1)..(738): transl_table=11

SEQ ID NO: 70711 - protein, 245 aa, Brucella suis 1330; identical to SEQ ID NO: 58705

SEQ ID NO: 70712 - DNA, 870 bp, Plasmodium falciparum 3D7; identical to SEQ ID NO: 58706
  CDS (1)..(870)

SEQ ID NO: 70713 - protein, 289 aa, Plasmodium falciparum 3D7; identical to SEQ ID NO: 58707

SEQ ID NO: 70714 - DNA, 705 bp, Shigella flexneri 2a str. 301; identical to SEQ ID NO: 58708
  CDS (1)..(705): transl_table=11

SEQ ID NO: 70715 - protein, 234 aa, Shigella flexneri 2a str. 301; identical to SEQ ID NO: 58709

SEQ ID NO: 70716 - DNA, 660 bp, Shewanella oneidensis MR-1; identical to SEQ ID NO: 58710
  CDS (1)..(660): transl_table=11

SEQ ID NO: 70717 - protein, 219 aa, Shewanella oneidensis MR-1; identical to SEQ ID NO: 58711

SEQ ID NO: 70718 - DNA, 825 bp, Drosophila melanogaster; identical to SEQ ID NO: 58712
  CDS (1)..(825)

SEQ ID NO: 70719 - protein, 274 aa, Drosophila melanogaster; identical to SEQ ID NO: 58713

SEQ ID NO: 70720 - DNA, 714 bp, Drosophila melanogaster; identical to SEQ ID NO: 58714
  CDS (1)..(714)

SEQ ID NO: 70721 - protein, 237 aa, Drosophila melanogaster; identical to SEQ ID NO: 58715

SEQ ID NO: 70722 - DNA, 672 bp, Pseudomonas putida KT2440; identical to SEQ ID NO: 58716
  CDS (1)..(672): transl_table=11

SEQ ID NO: 70723 - protein, 223 aa, Pseudomonas putida KT2440; identical to SEQ ID NO: 58717

SEQ ID NO: 70724 - DNA, 663 bp, Vibrio vulnificus CMCP6; identical to SEQ ID NO: 58718
  CDS (1)..(663): transl_table=11

SEQ ID NO: 70725 - protein, 220 aa, Vibrio vulnificus CMCP6; identical to SEQ ID NO: 58719

SEQ ID NO: 70726 - DNA, 837 bp, Bradyrhizobium japonicum USDA 110; identical to SEQ ID NO: 58720
  CDS (1)..(837)

SEQ ID NO: 70727 - protein, 278 aa, Bradyrhizobium japonicum USDA 110; identical to SEQ ID NO: 58721

SEQ ID NO: 70728 - DNA, 699 bp, Bradyrhizobium japonicum USDA 110; identical to SEQ ID NO: 58722
  CDS (1)..(699)

SEQ ID NO: 70729 - protein, 232 aa, Bradyrhizobium japonicum USDA 110; identical to SEQ ID NO: 58723

SEQ ID NO: 70730 - DNA, 690 bp, Streptococcus pyogenes SSI-1; identical to SEQ ID NO: 58724
  CDS (1)..(690): transl_table=11

SEQ ID NO: 70731 - protein, 229 aa, Streptococcus pyogenes SSI-1; identical to SEQ ID NO: 58725

SEQ ID NO: 70732 - DNA, 687 bp, Enterococcus faecalis V583; identical to SEQ ID NO: 58726
  CDS (1)..(687): transl_table=11

SEQ ID NO: 70733 - protein, 228 aa, Enterococcus faecalis V583; identical to SEQ ID NO: 58727

SEQ ID NO: 70734 - DNA, 720 bp, Coxiella burnetii RSA 493; identical to SEQ ID NO: 58728
  CDS (1)..(720): transl_table=11

SEQ ID NO: 70735 - protein, 239 aa, Coxiella burnetii RSA 493; identical to SEQ ID NO: 58729

SEQ ID NO: 70736 - DNA, 696 bp, Nitrosomonas europaea ATCC 19718; identical to SEQ ID NO: 58730
  CDS (1)..(696): transl_table=11

SEQ ID NO: 70737 - protein, 231 aa, Nitrosomonas europaea ATCC 19718; identical to SEQ ID NO: 58731

SEQ ID NO: 70738 - DNA, 693 bp, Helicobacter hepaticus ATCC 51449; identical to SEQ ID NO: 58732
  CDS (1)..(693): transl_table=11

SEQ ID NO: 70739 - protein, 230 aa, Helicobacter hepaticus ATCC 51449; identical to SEQ ID NO: 58733

SEQ ID NO: 70740 - DNA, 660 bp, Wigglesworthia glossinidia endosymbiont of Glossina brevipalpis; identical to SEQ ID NO: 58734
  CDS (1)..(660): transl_table=11

SEQ ID NO: 70741 - protein, 219 aa, Wigglesworthia glossinidia endosymbiont of Glossina brevipalpis; identical to SEQ ID NO: 58735

SEQ ID NO: 70742 - DNA, 711 bp, Candidatus Blochmannia floridanus; identical to SEQ ID NO: 58736
  CDS (1)..(711): transl_table=11

SEQ ID NO: 70743 - protein, 236 aa, Candidatus Blochmannia floridanus; identical to SEQ ID NO: 58737

SEQ ID NO: 70744 - DNA, 711 bp, Bordetella bronchiseptica RB50; identical to SEQ ID NO: 58738
  CDS (1)..(711): transl_table=11

SEQ ID NO: 70745 - protein, 236 aa, Bordetella bronchiseptica RB50; identical to SEQ ID NO: 58739

SEQ ID NO: 70746 - DNA, 690 bp, Chromobacterium violaceum ATCC 12472; identical to SEQ ID NO: 58740
  CDS (1)..(690): transl_table=11

SEQ ID NO: 70747 - protein, 229 aa, Chromobacterium violaceum ATCC 12472; identical to SEQ ID NO: 58741

SEQ ID NO: 70748 - DNA, 717 bp, Wolinella succinogenes DSM 1740; identical to SEQ ID NO: 58742
  CDS (1)..(717): transl_table=11

SEQ ID NO: 70749 - protein, 238 aa, Wolinella succinogenes DSM 1740; identical to SEQ ID NO: 58743

SEQ ID NO: 70750 - DNA, 711 bp, Photorhabdus luminescens subsp. laumondii TTO1; identical to SEQ ID NO: 58744
  CDS (1)..(711): transl_table=11

SEQ ID NO: 70751 - protein, 236 aa, Photorhabdus luminescens subsp. laumondii TTO1; identical to SEQ ID NO: 58745

SEQ ID NO: 70752 - DNA, 669 bp, Vibrio vulnificus YJ016; identical to SEQ ID NO: 58746
  CDS (1)..(669): transl_table=11

SEQ ID NO: 70753 - protein, 222 aa, Vibrio vulnificus YJ016; identical to SEQ ID NO: 58747

SEQ ID NO: 70754 - DNA, 792 bp, Rhodopseudomonas palustris CGA009; identical to SEQ ID NO: 58748
  CDS (1)..(792): transl_table=11

SEQ ID NO: 70755 - protein, 263 aa, Rhodopseudomonas palustris CGA009; identical to SEQ ID NO: 58749

SEQ ID NO: 70756 - DNA, 714 bp, Lactobacillus johnsonii NCC 533; identical to SEQ ID NO: 58750
  CDS (1)..(714): transl_table=11

SEQ ID NO: 70757 - protein, 237 aa, Lactobacillus johnsonii NCC 533; identical to SEQ ID NO: 58751

SEQ ID NO: 70758 - DNA, 723 bp, Wolbachia endosymbiont of Drosophila melanogaster; identical to SEQ ID NO: 58752
  CDS (1)..(723): transl_table=11

SEQ ID NO: 70759 - protein, 240 aa, Wolbachia endosymbiont of Drosophila melanogaster; identical to SEQ ID NO: 58753

SEQ ID NO: 70760 - DNA, 864 bp, Neurospora crassa; identical to SEQ ID NO: 58754
  CDS (1)..(864)

SEQ ID NO: 70761 - protein, 287 aa, Neurospora crassa; identical to SEQ ID NO: 58755

SEQ ID NO: 70762 - DNA, 849 bp, Magnaporthe grisea 70-15; identical to SEQ ID NO: 58756
  CDS (1)..(849)

SEQ ID NO: 70763 - protein, 282 aa, Magnaporthe grisea 70-15; identical to SEQ ID NO: 58757

SEQ ID NO: 70764 - DNA, 831 bp, Gibberella zeae PH-1; identical to SEQ ID NO: 58758
  CDS (1)..(831)

SEQ ID NO: 70765 - protein, 276 aa, Gibberella zeae PH-1; identical to SEQ ID NO: 58759

SEQ ID NO: 70766 - DNA, 822 bp, Ustilago maydis 521; identical to SEQ ID NO: 58760
  CDS (1)..(822)

SEQ ID NO: 70767 - protein, 273 aa, Ustilago maydis 521; identical to SEQ ID NO: 58761

SEQ ID NO: 70768 - DNA, 813 bp, Aspergillus nidulans FGSC A4; identical to SEQ ID NO: 58762
  CDS (1)..(813)

SEQ ID NO: 70769 - protein, 270 aa, Aspergillus nidulans FGSC A4; identical to SEQ ID NO: 58763

SEQ ID NO: 70770 - DNA, 555 bp, Oryza sativa (japonica cultivar-group); identical to SEQ ID NO: 58764
  CDS (1)..(555)

SEQ ID NO: 70771 - protein, 184 aa, Oryza sativa (japonica cultivar-group); identical to SEQ ID NO: 58765

SEQ ID NO: 70772 - DNA, 690 bp, Oryza sativa (japonica cultivar-group); identical to SEQ ID NO: 58766
  CDS (1)..(690)

SEQ ID NO: 70773 - protein, 229 aa, Oryza sativa (japonica cultivar-group); identical to SEQ ID NO: 58767

SEQ ID NO: 70774 - DNA, 672 bp, Oryza sativa (japonica cultivar-group); identical to SEQ ID NO: 58768
  CDS (1)..(672)

SEQ ID NO: 70775 - protein, 223 aa, Oryza sativa (japonica cultivar-group); identical to SEQ ID NO: 58769

SEQ ID NO: 70776 - DNA, 735 bp, Oryza sativa (japonica cultivar-group); identical to SEQ ID NO: 58770
  CDS (1)..(735)

SEQ ID NO: 70777 - protein, 244 aa, Oryza sativa (japonica cultivar-group); identical to SEQ ID NO: 58771

SEQ ID NO: 70778 - DNA, 786 bp, Yarrowia lipolytica CLIB99; identical to SEQ ID NO: 58772
  CDS (1)..(786)

SEQ ID NO: 70779 - protein, 261 aa, Yarrowia lipolytica CLIB99; identical to SEQ ID NO: 58773

SEQ ID NO: 70780 - DNA, 657 bp, Pan troglodytes; identical to SEQ ID NO: 58774
  CDS (1)..(657)

SEQ ID NO: 70781 - protein, 218 aa, Pan troglodytes; identical to SEQ ID NO: 58775

SEQ ID NO: 70782 - DNA, 702 bp, Desulfovibrio vulgaris subsp. vulgaris str. Hildenborough; identical to SEQ ID NO: 58776
  CDS (1)..(702): transl_table=11

SEQ ID NO: 70783 - protein, 233 aa, Desulfovibrio vulgaris subsp. vulgaris str. Hildenborough; identical to SEQ ID NO: 58777

SEQ ID NO: 70784 - DNA, 774 bp, Bartonella quintana str. Toulouse; identical to SEQ ID NO: 58778
  CDS (1)..(774): transl_table=11

SEQ ID NO: 70785 - protein, 257 aa, Bartonella quintana str. Toulouse; identical to SEQ ID NO: 58779

SEQ ID NO: 70786 - DNA, 774 bp, Bartonella henselae str. Houston-1; identical to SEQ ID NO: 58780
  CDS (1)..(774): transl_table=11

SEQ ID NO: 70787 - protein, 257 aa, Bartonella henselae str. Houston-1; identical to SEQ ID NO: 58781

SEQ ID NO: 70788 - DNA, 660 bp, Erwinia carotovora subsp. atroseptica SCRI1043; identical to SEQ ID NO: 58782
  CDS (1)..(660)

SEQ ID NO: 70789 - protein, 219 aa, Erwinia carotovora subsp. atroseptica SCRI1043; identical to SEQ ID NO: 58783

SEQ ID NO: 70790 - DNA, 708 bp, Erwinia carotovora subsp. atroseptica SCRI1043; identical to SEQ ID NO: 58784
  CDS (1)..(708)

SEQ ID NO: 70791 - protein, 235 aa, Erwinia carotovora subsp. atroseptica SCRI1043; identical to SEQ ID NO: 58785

SEQ ID NO: 70792 - DNA, 723 bp, Desulfotalea psychrophila LSv54; identical to SEQ ID NO: 58786
  CDS (1)..(723): transl_table=11

SEQ ID NO: 70793 - protein, 240 aa, Desulfotalea psychrophila LSv54; identical to SEQ ID NO: 58787

SEQ ID NO: 70794 - DNA, 711 bp, Yersinia pseudotuberculosis IP 32953; identical to SEQ ID NO: 58788
  CDS (1)..(711): transl_table=11

SEQ ID NO: 70795 - protein, 236 aa, Yersinia pseudotuberculosis IP 32953; identical to SEQ ID NO: 58789

SEQ ID NO: 70796 - DNA, 699 bp, Borrelia garinii PBi; identical to SEQ ID NO: 58790
  CDS (1)..(699): transl_table=11

SEQ ID NO: 70797 - protein, 232 aa, Borrelia garinii PBi; identical to SEQ ID NO: 58791

SEQ ID NO: 70798 - DNA, 672 bp, Mannheimia succiniciproducens MBEL55E; identical to SEQ ID NO: 58792
  CDS (1)..(672): transl_table=11

SEQ ID NO: 70799 - protein, 223 aa, Mannheimia succiniciproducens MBEL55E; identical to SEQ ID NO: 58793

SEQ ID NO: 70800 - DNA, 675 bp, Legionella pneumophila subsp. pneumophila str. Philadelphia 1; identical to SEQ ID NO: 58794
  CDS (1)..(675): transl_table=11

SEQ ID NO: 70801 - protein, 224 aa, Legionella pneumophila subsp. pneumophila str. Philadelphia 1; identical to SEQ ID NO: 58795

SEQ ID NO: 70802 - DNA, 714 bp, Burkholderia pseudomallei K96243; identical to SEQ ID NO: 58796
  CDS (1)..(714): transl_table=11

SEQ ID NO: 70803 - protein, 237 aa, Burkholderia pseudomallei K96243; identical to SEQ ID NO: 58797

SEQ ID NO: 70804 - DNA, 678 bp, Methylococcus capsulatus str. Bath; identical to SEQ ID NO: 58798
  CDS (1)..(678): transl_table=11

SEQ ID NO: 70805 - protein, 225 aa, Methylococcus capsulatus str. Bath; identical to SEQ ID NO: 58799

SEQ ID NO: 70806 - DNA, 666 bp, Photobacterium profundum SS9; identical to SEQ ID NO: 58800
  CDS (1)..(666): transl_table=11

SEQ ID NO: 70807 - protein, 221 aa, Photobacterium profundum SS9; identical to SEQ ID NO: 58801

SEQ ID NO: 70808 - DNA, 690 bp, Streptococcus thermophilus CNRZ1066; identical to SEQ ID NO: 58802
  CDS (1)..(690): transl_table=11

SEQ ID NO: 70809 - protein, 229 aa, Streptococcus thermophilus CNRZ1066; identical to SEQ ID NO: 58803

SEQ ID NO: 70810 - DNA, 639 bp, Geobacillus kaustophilus HTA426; identical to SEQ ID NO: 58804
  CDS (1)..(639): transl_table=11

SEQ ID NO: 70811 - protein, 212 aa, Geobacillus kaustophilus HTA426; identical to SEQ ID NO: 58805

SEQ ID NO: 70812 - DNA, 705 bp, Salmonella enterica subsp. enterica serovar Paratypi A str. ATCC; identical to SEQ ID NO: 58806
  CDS (1)..(705): transl_table=11

SEQ ID NO: 70813 - protein, 234 aa, Salmonella enterica subsp. enterica serovar Paratypi A str. ATCC; identical to SEQ ID NO: 58807

SEQ ID NO: 70814 - DNA, 702 bp, Anaplasma marginale str. St. Maries; identical to SEQ ID NO: 58808
  CDS (1)..(702): transl_table=11

SEQ ID NO: 70815 - protein, 233 aa, Anaplasma marginale str. St. Maries; identical to SEQ ID NO: 58809

SEQ ID NO: 70816 - DNA, 669 bp, Idiomarina loihiensis L2TR; identical to SEQ ID NO: 58810
  CDS (1)..(669): transl_table=11

SEQ ID NO: 70817 - protein, 222 aa, Idiomarina loihiensis L2TR; identical to SEQ ID NO: 58811

SEQ ID NO: 70818 - DNA, 666 bp, Azoarcus sp. EbN1; identical to SEQ ID NO: 58812
  CDS (1)..(666): transl_table=11

SEQ ID NO: 70819 - protein, 221 aa, Azoarcus sp. EbN1; identical to SEQ ID NO: 58813

SEQ ID NO: 70820 - DNA, 705 bp, Zymomonas mobilis subsp. mobilis ZM4; identical to SEQ ID NO: 58814
  CDS (1)..(705): transl_table=11

SEQ ID NO: 70821 - protein, 234 aa, Zymomonas mobilis subsp. mobilis ZM4; identical to SEQ ID NO: 58815

SEQ ID NO: 70822 - DNA, 687 bp, Francisella tularensis subsp. tularensis Schu 4; identical to SEQ ID NO: 58816
  CDS (1)..(687): transl_table=11

SEQ ID NO: 70823 - protein, 228 aa, Francisella tularensis subsp. tularensis Schu 4; identical to SEQ ID NO: 58817

SEQ ID NO: 70824 - DNA, 705 bp, Ehrlichia ruminantium str. Welgevonden; identical to SEQ ID NO: 58818
  CDS (1)..(705): transl_table=11

SEQ ID NO: 70825 - protein, 234 aa, Ehrlichia ruminantium str. Welgevonden; identical to SEQ ID NO: 58819

SEQ ID NO: 70826 - DNA, 714 bp, Rhodobacter sphaeroides 2.4.1; identical to SEQ ID NO: 58820
  CDS (1)..(714)

SEQ ID NO: 70827 - protein, 237 aa, Rhodobacter sphaeroides 2.4.1; identical to SEQ ID NO: 58821

SEQ ID NO: 70828 - DNA, 732 bp, Lactobacillus gasseri; identical to SEQ ID NO: 58822
  CDS (1)..(732)

SEQ ID NO: 70829 - protein, 243 aa, Lactobacillus gasseri; identical to SEQ ID NO: 58823

SEQ ID NO: 70830 - DNA, 768 bp, Magnetospirillum magnetotacticum MS-1; identical to SEQ ID NO: 58824
  CDS (1)..(768)

SEQ ID NO: 70831 - protein, 255 aa, Magnetospirillum magnetotacticum MS-1; identical to SEQ ID NO: 58825

SEQ ID NO: 70832 - DNA, 696 bp, Magnetospirillum magnetotacticum MS-1; identical to SEQ ID NO: 58826
  CDS (1)..(696)

SEQ ID NO: 70833 - protein, 231 aa, Magnetospirillum magnetotacticum MS-1; identical to SEQ ID NO: 58827

SEQ ID NO: 70834 - DNA, 720 bp, Leuconostoc mesenteroides subsp. mesenteroides ATCC 8293; identical to SEQ ID NO: 58828
  CDS (1)..(720)

SEQ ID NO: 70835 - protein, 239 aa, Leuconostoc mesenteroides subsp. mesenteroides ATCC 8293; identical to SEQ ID NO: 58829

SEQ ID NO: 70836 - DNA, 672 bp, Azotobacter vinelandii; identical to SEQ ID NO: 58830
  CDS (1)..(672)

SEQ ID NO: 70837 - protein, 223 aa, Azotobacter vinelandii; identical to SEQ ID NO: 58831

SEQ ID NO: 70838 - DNA, 702 bp, Desulfovibrio desulfuricans G20; identical to SEQ ID NO: 58832
  CDS (1)..(702)

SEQ ID NO: 70839 - protein, 233 aa, Desulfovibrio desulfuricans G20; identical to SEQ ID NO: 58833

SEQ ID NO: 70840 - DNA, 711 bp, Rickettsia sibirica 246; identical to SEQ ID NO: 58834
  CDS (1)..(711): transl_table=11

SEQ ID NO: 70841 - protein, 236 aa, Rickettsia sibirica 246; identical to SEQ ID NO: 58835

SEQ ID NO: 70842 - DNA, 693 bp, Dechloromonas aromatica RCB; identical to SEQ ID NO: 58836
  CDS (1)..(693)

SEQ ID NO: 70843 - protein, 230 aa, Dechloromonas aromatica RCB; identical to SEQ ID NO: 58837

SEQ ID NO: 70844 - DNA, 711 bp, Rickettsia rickettsii; identical to SEQ ID NO: 58838
  CDS (1)..(711)

SEQ ID NO: 70845 - protein, 236 aa, Rickettsia rickettsii; identical to SEQ ID NO: 58839

SEQ ID NO: 70846 - DNA, 702 bp, Ralstonia eutropha JMP134; identical to SEQ ID NO: 58840
  CDS (1)..(702)

SEQ ID NO: 70847 - protein, 233 aa, Ralstonia eutropha JMP134; identical to SEQ ID NO: 58841

SEQ ID NO: 70848 - DNA, 606 bp, Methylobacillus flagellatus KT; identical to SEQ ID NO: 58842
  CDS (1)..(606)

SEQ ID NO: 70849 - protein, 201 aa, Methylobacillus flagellatus KT; identical to SEQ ID NO: 58843

SEQ ID NO: 70850 - DNA, 645 bp, Exiguobacterium sp. 255-15; identical to SEQ ID NO: 58844
  CDS (1)..(645)

SEQ ID NO: 70851 - protein, 214 aa, Exiguobacterium sp. 255-15; identical to SEQ ID NO: 58845

SEQ ID NO: 70852 - DNA, 705 bp, Ehrlichia canis str. Jake; identical to SEQ ID NO: 58846
  CDS (1)..(705)

SEQ ID NO: 70853 - protein, 234 aa, Ehrlichia canis str. Jake; identical to SEQ ID NO: 58847

SEQ ID NO: 70854 - DNA, 699 bp, Burkholderia cepacia R18194; identical to SEQ ID NO: 58848
  CDS (1)..(699)

SEQ ID NO: 70855 - protein, 232 aa, Burkholderia cepacia R18194; identical to SEQ ID NO: 58849

SEQ ID NO: 70856 - DNA, 831 bp, Burkholderia cepacia R1808; identical to SEQ ID NO: 58850
  CDS (1)..(831)

SEQ ID NO: 70857 - protein, 276 aa, Burkholderia cepacia R1808; identical to SEQ ID NO: 58851

SEQ ID NO: 70858 - DNA, 696 bp, Rubrivivax gelatinosus PM1; identical to SEQ ID NO: 58852
  CDS (1)..(696)

SEQ ID NO: 70859 - protein, 231 aa, Rubrivivax gelatinosus PM1; identical to SEQ ID NO: 58853

SEQ ID NO: 70860 - DNA, 609 bp, Rubrivivax gelatinosus PM1; identical to SEQ ID NO: 58854
  CDS (1)..(609)

SEQ ID NO: 70861 - protein, 202 aa, Rubrivivax gelatinosus PM1; identical to SEQ ID NO: 58855

SEQ ID NO: 70862 - DNA, 753 bp, Rhodospirillum rubrum; identical to SEQ ID NO: 58856
  CDS (1)..(753)

SEQ ID NO: 70863 - protein, 250 aa, Rhodospirillum rubrum; identical to SEQ ID NO: 58857

SEQ ID NO: 70864 - DNA, 708 bp, Ralstonia metallidurans CH34; identical to SEQ ID NO: 58858
  CDS (1)..(708)

SEQ ID NO: 70865 - protein, 235 aa, Ralstonia metallidurans CH34; identical to SEQ ID NO: 58859

SEQ ID NO: 70866 - DNA, 699 bp, Burkholderia fungorum LB400; identical to SEQ ID NO: 58860
  CDS (1)..(699)

SEQ ID NO: 70867 - protein, 232 aa, Burkholderia fungorum LB400; identical to SEQ ID NO: 58861

SEQ ID NO: 70868 - DNA, 705 bp, Magnetococcus sp. MC-1; identical to SEQ ID NO: 58862
  CDS (1)..(705)

SEQ ID NO: 70869 - protein, 234 aa, Magnetococcus sp. MC-1; identical to SEQ ID NO: 58863

SEQ ID NO: 70870 - DNA, 744 bp, Novosphingobium aromaticivorans DSM 12444; identical to SEQ ID NO: 58864
  CDS (1)..(744)

SEQ ID NO: 70871 - protein, 247 aa, Novosphingobium aromaticivorans DSM 12444; identical to SEQ ID NO: 58865

SEQ ID NO: 70872 - DNA, 627 bp, Microbulbifer degradans 2-40; identical to SEQ ID NO: 58866
  CDS (1)..(627)

SEQ ID NO: 70873 - protein, 208 aa, Microbulbifer degradans 2-40; identical to SEQ ID NO: 58867

SEQ ID NO: 70874 - DNA, 639 bp, Pediococcus pentosaceus ATCC 25745; identical to SEQ ID NO: 58868
  CDS (1)..(639)

SEQ ID NO: 70875 - protein, 212 aa, Pediococcus pentosaceus ATCC 25745; identical to SEQ ID NO: 58869

SEQ ID NO: 70876 - DNA, 666 bp, Thiobacillus denitrificans ATCC 25259; identical to SEQ ID NO: 58870
  CDS (1)..(666)

SEQ ID NO: 70877 - protein, 221 aa, Thiobacillus denitrificans ATCC 25259; identical to SEQ ID NO: 58871

SEQ ID NO: 70878 - DNA, 711 bp, Rickettsia akari str. Hartford; identical to SEQ ID NO: 58872
  CDS (1)..(711)

SEQ ID NO: 70879 - protein, 236 aa, Rickettsia akari str. Hartford; identical to SEQ ID NO: 58873

SEQ ID NO: 70880 - DNA, 690 bp, Polaromonas sp. JS666; identical to SEQ ID NO: 58874
  CDS (1)..(690)

SEQ ID NO: 70881 - protein, 229 aa, Polaromonas sp. JS666; identical to SEQ ID NO: 58875

SEQ ID NO: 70882 - DNA, 702 bp, Campylobacter lari RM2100; identical to SEQ ID NO: 58876
  CDS (1)..(702): transl_table=11

SEQ ID NO: 70883 - protein, 233 aa, Campylobacter lari RM2100; identical to SEQ ID NO: 58877

SEQ ID NO: 70884 - DNA, 633 bp, Cowpox virus; identical to SEQ ID NO: 58878
  CDS (1)..(633)

SEQ ID NO: 70885 - protein, 210 aa, Cowpox virus; identical to SEQ ID NO: 58879

SEQ ID NO: 70886 - DNA, 711 bp, Brachydanio rerio; identical to SEQ ID NO: 58880
  CDS (1)..(711)

SEQ ID NO: 70887 - protein, 236 aa, Brachydanio rerio; identical to SEQ ID NO: 58881

SEQ ID NO: 70888 - DNA, 1008 bp, Xenopus laevis; identical to SEQ ID NO: 58882
  CDS (1)..(1008)

SEQ ID NO: 70889 - protein, 335 aa, Xenopus laevis; identical to SEQ ID NO: 58883

SEQ ID NO: 70890 - DNA, 795 bp, Oryza sativa; identical to SEQ ID NO: 58884
  CDS (1)..(795)

SEQ ID NO: 70891 - protein, 264 aa, Oryza sativa; identical to SEQ ID NO: 58885

SEQ ID NO: 70892 - DNA, 714 bp, Xenopus laevis; identical to SEQ ID NO: 58886
  CDS (1)..(714)

SEQ ID NO: 70893 - protein, 237 aa, Xenopus laevis; identical to SEQ ID NO: 58887

SEQ ID NO: 70894 - DNA, 726 bp, Oryza sativa; identical to SEQ ID NO: 58888
  CDS (1)..(726)

SEQ ID NO: 70895 - protein, 241 aa, Oryza sativa; identical to SEQ ID NO: 58889

SEQ ID NO: 70896 - DNA, 747 bp, Chlamydomonas reinhardtii; identical to SEQ ID NO: 58890
  CDS (1)..(747)

SEQ ID NO: 70897 - protein, 248 aa, Chlamydomonas reinhardtii; identical to SEQ ID NO: 58891

SEQ ID NO: 70898 - DNA, 747 bp, Lycopersicon esculentum; identical to SEQ ID NO: 58892
  CDS (1)..(747)

SEQ ID NO: 70899 - protein, 248 aa, Lycopersicon esculentum; identical to SEQ ID NO: 58893

SEQ ID NO: 70900 - DNA, 744 bp, Brassica oleracea; identical to SEQ ID NO: 58894
  CDS (1)..(744)

SEQ ID NO: 70901 - protein, 247 aa, Brassica oleracea; identical to SEQ ID NO: 58895

SEQ ID NO: 70902 - DNA, 741 bp, Cryptosporidium parvum; identical to SEQ ID NO: 58896
  CDS (1)..(741)

SEQ ID NO: 70903 - protein, 246 aa, Cryptosporidium parvum; identical to SEQ ID NO: 58897

SEQ ID NO: 70904 - DNA, 714 bp, Xenopus laevis; identical to SEQ ID NO: 58898
  CDS (1)..(714)

SEQ ID NO: 70905 - protein, 237 aa, Xenopus laevis; identical to SEQ ID NO: 58899

SEQ ID NO: 70906 - DNA, 660 bp, Schistosoma japonicum; identical to SEQ ID NO: 58900
  CDS (1)..(660)

SEQ ID NO: 70907 - protein, 219 aa, Schistosoma japonicum; identical to SEQ ID NO: 58901

SEQ ID NO: 70908 - DNA, 744 bp, Arabidopsis thaliana; identical to SEQ ID NO: 58902
  CDS (1)..(744)

SEQ ID NO: 70909 - protein, 247 aa, Arabidopsis thaliana; identical to SEQ ID NO: 58903

SEQ ID NO: 70910 - DNA, 714 bp, Camelpox virus; identical to SEQ ID NO: 58904
  CDS (1)..(714)

SEQ ID NO: 70911 - protein, 237 aa, Camelpox virus; identical to SEQ ID NO: 58905

SEQ ID NO: 70912 - DNA, 741 bp, Brassica oleracea; identical to SEQ ID NO: 58906
  CDS (1)..(741)

SEQ ID NO: 70913 - protein, 246 aa, Brassica oleracea; identical to SEQ ID NO: 58907

SEQ ID NO: 70914 - DNA, 750 bp, Nicotiana tabacum; identical to SEQ ID NO: 58908
  CDS (1)..(750)

SEQ ID NO: 70915 - protein, 249 aa, Nicotiana tabacum; identical to SEQ ID NO: 58909

SEQ ID NO: 70916 - DNA, 744 bp, Hordeum vulgare; identical to SEQ ID NO: 58910
  CDS (1)..(744)

SEQ ID NO: 70917 - protein, 247 aa, Hordeum vulgare; identical to SEQ ID NO: 58911

SEQ ID NO: 70918 - DNA, 744 bp, Arabidopsis thaliana; identical to SEQ ID NO: 58912
  CDS (1)..(744)

SEQ ID NO: 70919 - protein, 247 aa, Arabidopsis thaliana; identical to SEQ ID NO: 58913

SEQ ID NO: 70920 - DNA, 750 bp, Oryza sativa; identical to SEQ ID NO: 58914
  CDS (1)..(750)

SEQ ID NO: 70921 - protein, 249 aa, Oryza sativa; identical to SEQ ID NO: 58915

SEQ ID NO: 70922 - DNA, 714 bp, Paralichthys olivaceus; identical to SEQ ID NO: 58916
  CDS (1)..(714): n means a or g or c or t/u

SEQ ID NO: 70923 - protein, 237 aa, Paralichthys olivaceus; identical to SEQ ID NO: 58917
  misc_feature (187)..(187): Xaa can be Cys or Phe or Ser or Tyr

SEQ ID NO: 70924 - DNA, 663 bp, Haemophilus influenzae; identical to SEQ ID NO: 58918
  CDS (1)..(663): transl_table=11

SEQ ID NO: 70925 - protein, 220 aa, Haemophilus influenzae; identical to SEQ ID NO: 58919

SEQ ID NO: 70926 - DNA, 672 bp, Vibrio cholerae; identical to SEQ ID NO: 58920
  CDS (1)..(672): transl_table=11

SEQ ID NO: 70927 - protein, 223 aa, Vibrio cholerae; identical to SEQ ID NO: 58921

SEQ ID NO: 70928 - DNA, 711 bp, Rickettsia prowazekii; identical to SEQ ID NO: 58922
  CDS (1)..(711): transl_table=11

SEQ ID NO: 70929 - protein, 236 aa, Rickettsia prowazekii; identical to SEQ ID NO: 58923

SEQ ID NO: 70930 - DNA, 696 bp, Campylobacter jejuni; identical to SEQ ID NO: 58924
  CDS (1)..(696): transl_table=11

SEQ ID NO: 70931 - protein, 231 aa, Campylobacter jejuni; identical to SEQ ID NO: 58925

SEQ ID NO: 70932 - DNA, 669 bp, Pseudomonas aeruginosa; identical to SEQ ID NO: 58926
  CDS (1)..(669): transl_table=11

SEQ ID NO: 70933 - protein, 222 aa, Pseudomonas aeruginosa; identical to SEQ ID NO: 58927

SEQ ID NO: 70934 - DNA, 663 bp, Pasteurella multocida; identical to SEQ ID NO: 58928
  CDS (1)..(663): transl_table=11

SEQ ID NO: 70935 - protein, 220 aa, Pasteurella multocida; identical to SEQ ID NO: 58929

SEQ ID NO: 70936 - DNA, 699 bp, Borrelia burgdorferi; identical to SEQ ID NO: 58930
  CDS (1)..(699): transl_table=11

SEQ ID NO: 70937 - protein, 232 aa, Borrelia burgdorferi; identical to SEQ ID NO: 58931

SEQ ID NO: 70938 - DNA, 696 bp, Deinococcus radiodurans; identical to SEQ ID NO: 58932
  CDS (1)..(696): transl_table=11

SEQ ID NO: 70939 - protein, 231 aa, Deinococcus radiodurans; identical to SEQ ID NO: 58933

SEQ ID NO: 70940 - DNA, 693 bp, Helicobacter pylori J99; identical to SEQ ID NO: 58934
  CDS (1)..(693): transl_table=11

SEQ ID NO: 70941 - protein, 230 aa, Helicobacter pylori J99; identical to SEQ ID NO: 58935

SEQ ID NO: 70942 - DNA, 705 bp, Escherichia coli; identical to SEQ ID NO: 58936
  CDS (1)..(705): transl_table=11

SEQ ID NO: 70943 - protein, 234 aa, Escherichia coli; identical to SEQ ID NO: 58937

SEQ ID NO: 70944 - DNA, 705 bp, Lactococcus lactis; identical to SEQ ID NO: 58938
  CDS (1)..(705)

SEQ ID NO: 70945 - protein, 234 aa, Lactococcus lactis; identical to SEQ ID NO: 58939

SEQ ID NO: 70946 - DNA, 809 bp, Mus musculus; identical to SEQ ID NO: 58940
  CDS (22)..(738)

SEQ ID NO: 70947 - protein, 238 aa, Mus musculus; identical to SEQ ID NO: 58941

SEQ ID NO: 70948 - DNA, 25 bp, Primer
atggatcgtattgttagttcttcac

SEQ ID NO: 70949 - DNA, 22 bp, Primer
ttaatcgcggctagcgaagccc

SEQ ID NO: 70950 - protein, 228 aa, consensus; identical to SEQ ID NO: 58944
  MISC_FEATURE (1)..(228): consensus for the disclosure of xaa see table XV

SEQ ID NO: 70951 - DNA, 645 bp, Escherichia coli K12; identical to SEQ ID NO: 10161
  CDS (1)..(645)

SEQ ID NO: 70952 - protein, 214 aa, Escherichia coli K12; identical to SEQ ID NO: 10162

SEQ ID NO: 70953 - DNA, 639 bp, Salmonella enterica subsp. enterica serovar Typhi; identical to SEQ ID NO: 10163
  CDS (1)..(639)

SEQ ID NO: 70954 - protein, 212 aa, Salmonella enterica subsp. enterica serovar Typhi; identical to SEQ ID NO: 10164

SEQ ID NO: 70955 - DNA, 690 bp, Vibrio cholerae; identical to SEQ ID NO: 10165
  CDS (1)..(690)

SEQ ID NO: 70956 - protein, 229 aa, Vibrio cholerae; identical to SEQ ID NO: 10166

SEQ ID NO: 70957 - DNA, 732 bp, Vibrio vulnificus; identical to SEQ ID NO: 10167
  CDS (1)..(732)

SEQ ID NO: 70958 - protein, 243 aa, Vibrio vulnificus; identical to SEQ ID NO: 10168

SEQ ID NO: 70959 - DNA, 645 bp, Shigella flexneri; identical to SEQ ID NO: 10169
  CDS (1)..(645)

SEQ ID NO: 70960 - protein, 214 aa, Shigella flexneri; identical to SEQ ID NO: 10170

SEQ ID NO: 70961 - DNA, 678 bp, Vibrio parahaemolyticus; identical to SEQ ID NO: 10171
  CDS (1)..(678)

SEQ ID NO: 70962 - protein, 225 aa, Vibrio parahaemolyticus; identical to SEQ ID NO: 10172

SEQ ID NO: 70963 - DNA, 687 bp, Vibrio vulnificus; identical to SEQ ID NO: 10173
  CDS (1)..(687)

SEQ ID NO: 70964 - protein, 228 aa, Vibrio vulnificus; identical to SEQ ID NO: 10174

SEQ ID NO: 70965 - DNA, 711 bp, Shewanella oneidensis; identical to SEQ ID NO: 10175
  CDS (1)..(711)

SEQ ID NO: 70966 - protein, 236 aa, Shewanella oneidensis; identical to SEQ ID NO: 10176

SEQ ID NO: 70967 - DNA, 639 bp, Escherichia coli; identical to SEQ ID NO: 10177
  CDS (1)..(639)

SEQ ID NO: 70968 - protein, 212 aa, Escherichia coli; identical to SEQ ID NO: 10178

SEQ ID NO: 70969 - DNA, 696 bp, Photobacterium profundum; identical to SEQ ID NO: 10179
  CDS (1)..(696)

SEQ ID NO: 70970 - protein, 231 aa, Photobacterium profundum; identical to SEQ ID NO: 10180

SEQ ID NO: 70971 - DNA, 26 bp, Primer
atgcgccctcttattttatcgatttt

SEQ ID NO: 70972 - DNA, 25 bp, Primer
ttatggtgcgggtttaagaaacgtc

SEQ ID NO: 70973 - protein, 217 aa, consensus
  MISC_FEATURE (1)..(217): consensus for the disclosure of xaa see table XV
GCXXXXXXXXXTXXXXXFXXXXXXXXXXXXXXXPYASXYXXXXXXXXXFXVLXXXEXXXXXXXXXXXXXXXQXKWXSXDXXMXVTXXGRXXKTXXLXXXNLXXXXXXXXXXXXXXPXXXXXXXXXXXXXXXXXXXXXXXXXXXXXXXXXXXXXGXXXXXXXXXXXXXXXXXXEXXXXXXXXXXXXNXXWXXXXXGXVXXSXQXLXXXXXXXXXXXXK

SEQ ID NO: 70974 - protein, 27 aa, Artificial sequence
  protein pattern
  Variant (1)..(1): Xaa in position 1 is Ile, Val or Leu
  Variant (2)..(4): Xaa in position 2 to 4 is any amino acid
  Variant (7)..(7): Xaa in position 7 is Ala or Ser
  Variant (8)..(8): Xaa in position 8 is Ser or Thr
  Variant (9)..(9): Xaa in position 9 is any amino acid
  Variant (11)..(19): Xaa in position 11 to 19 is any amino acid
  Variant (20)..(20): Xaa in position 20 is Phe or Leu
  Variant (21)..(21): Xaa in position 21 is Val or Met
  Variant (24)..(24): Xaa in position 24 is Ala or Gly
  Variant (25)..(26): Xaa in position 25 to 26 is any amino acid
XXXXPYXXXYXXXXXXXXXXXVLXXXE

SEQ ID NO: 70975 - protein, 28 aa, consensus
  MISC_FEATURE (1)..(28): consensus for the disclosure of xaa see table XV
KWXXXXXXXXVTXXGXXXKXXXXXXXNL

SEQ ID NO: 70976 - protein, 45 aa, consensus; identical to SEQ ID NO: 10213
  MISC_FEATURE (1)..(45): consensus for the disclosure of xaa see table XV

SEQ ID NO: 70977 - DNA, 1008 bp, Escherichia coli; identical to SEQ ID NO: 42264
  CDS (1)..(1008)

SEQ ID NO: 70978 - protein, 335 aa, Escherichia coli; identical to SEQ ID NO: 42265

SEQ ID NO: 70979 - DNA, 1014 bp, Staphylococcus aureus subsp. aureus COL; identical to SEQ ID NO: 42266
  CDS (1)..(1014)

SEQ ID NO: 70980 - protein, 337 aa, Staphylococcus aureus subsp. aureus COL; identical to SEQ ID NO: 42267

SEQ ID NO: 70981 - DNA, 1176 bp, Xanthomonas oryzae pv. oryzae KACC10331; identical to SEQ ID NO: 42268
  CDS (1)..(1176)

SEQ ID NO: 70982 - protein, 391 aa, Xanthomonas oryzae pv. oryzae KACC10331; identical to SEQ ID NO: 42269

SEQ ID NO: 70983 - DNA, 1008 bp, Bacillus halodurans C-125; identical to SEQ ID NO: 42270
  CDS (1)..(1008): transl_table=11

SEQ ID NO: 70984 - protein, 335 aa, Bacillus halodurans C-125; identical to SEQ ID NO: 42271

SEQ ID NO: 70985 - DNA, 1002 bp, Pseudomonas aeruginosa PAO1; identical to SEQ ID NO: 42272
  CDS (1)..(1002): transl_table=11

SEQ ID NO: 70986 - protein, 333 aa, Pseudomonas aeruginosa PAO1; identical to SEQ ID NO: 42273

SEQ ID NO: 70987 - DNA, 1017 bp, Halobacterium salinarum NRC-1; identical to SEQ ID NO: 42274
  CDS (1)..(1017): transl_table=11

SEQ ID NO: 70988 - protein, 338 aa, Halobacterium salinarum NRC-1; identical to SEQ ID NO: 42275

SEQ ID NO: 70989 - DNA, 1017 bp, Deinococcus radiodurans R1; identical to SEQ ID NO: 42276
  CDS (1)..(1017): transl_table=11

SEQ ID NO: 70990 - protein, 338 aa, Deinococcus radiodurans R1; identical to SEQ ID NO: 42277

SEQ ID NO: 70991 - DNA, 1044 bp, Mycoplasma pulmonis UAB CTIP; identical to SEQ ID NO: 42278
  CDS (1)..(1044): transl_table=4

SEQ ID NO: 70992 - protein, 347 aa, Mycoplasma pulmonis UAB CTIP; identical to SEQ ID NO: 42279

SEQ ID NO: 70993 - DNA, 1008 bp, Agrobacterium tumefaciens str. C58; identical to SEQ ID NO: 42280
  CDS (1)..(1008): transl_table=11

SEQ ID NO: 70994 - protein, 335 aa, Agrobacterium tumefaciens str. C58; identical to SEQ ID NO: 42281

SEQ ID NO: 70995 - DNA, 1026 bp, Staphylococcus aureus subsp. aureus Mu50; identical to SEQ ID NO: 42282
  CDS (1)..(1026): transl_table=11

SEQ ID NO: 70996 - protein, 341 aa, Staphylococcus aureus subsp. aureus Mu50; identical to SEQ ID NO: 42283

SEQ ID NO: 70997 - DNA, 990 bp, Sinorhizobium meliloti 1021; identical to SEQ ID NO: 42284
  CDS (1)..(990): transl_table=11

SEQ ID NO: 70998 - protein, 329 aa, Sinorhizobium meliloti 1021; identical to SEQ ID NO: 42285

SEQ ID NO: 70999 - DNA, 1014 bp, Caulobacter crescentus CB15; identical to SEQ ID NO: 42286
  CDS (1)..(1014): transl_table=11

SEQ ID NO: 71000 - protein, 337 aa, Caulobacter crescentus CB15; identical to SEQ ID NO: 42287

SEQ ID NO: 71001 - DNA, 1008 bp, Salmonella typhimurium LT2; identical to SEQ ID NO: 42288
  CDS (1)..(1008): transl_table=11

SEQ ID NO: 71002 - protein, 335 aa, Salmonella typhimurium LT2; identical to SEQ ID NO: 42289

SEQ ID NO: 71003 - DNA, 996 bp, Listeria innocua Clip11262; identical to SEQ ID NO: 42290
  CDS (1)..(996): transl_table=11

SEQ ID NO: 71004 - protein, 331 aa, Listeria innocua Clip11262; identical to SEQ ID NO: 42291

SEQ ID NO: 71005 - DNA, 1053 bp, Ralstonia solanacearum GMI1000; identical to SEQ ID NO: 42292
  CDS (1)..(1053): transl_table=11

SEQ ID NO: 71006 - protein, 350 aa, Ralstonia solanacearum GMI1000; identical to SEQ ID NO: 42293

SEQ ID NO: 71007 - DNA, 1002 bp, Agrobacterium tumefaciens str. C58; identical to SEQ ID NO: 42294
  CDS (1)..(1002): transl_table=11

SEQ ID NO: 71008 - protein, 333 aa, Agrobacterium tumefaciens str. C58; identical to SEQ ID NO: 42295

SEQ ID NO: 71009 - DNA, 984 bp, Brucella melitensis 16M; identical to SEQ ID NO: 42296
  CDS (1)..(984): transl_table=11

SEQ ID NO: 71010 - protein, 327 aa, Brucella melitensis 16M; identical to SEQ ID NO: 42297

SEQ ID NO: 71011 - DNA, 981 bp, Corynebacterium glutamicum ATCC 13032; identical to SEQ ID NO: 42298
  CDS (1)..(981): transl_table=11

SEQ ID NO: 71012 - protein, 326 aa, Corynebacterium glutamicum ATCC 13032; identical to SEQ ID NO: 42299

SEQ ID NO: 71013 - DNA, 999 bp, Streptococcus pyogenes MGAS8232; identical to SEQ ID NO: 42300
  CDS (1)..(999): transl_table=11

SEQ ID NO: 71014 - protein, 332 aa, Streptococcus pyogenes MGAS8232; identical to SEQ ID NO: 42301

SEQ ID NO: 71015 - DNA, 1101 bp, Streptomyces coelicolor A3(2); identical to SEQ ID NO: 42302
  CDS (1)..(1101)

SEQ ID NO: 71016 - protein, 366 aa, Streptomyces coelicolor A3(2); identical to SEQ ID NO: 42303

SEQ ID NO: 71017 - DNA, 1110 bp, Xanthomonas axonopodis pv. citri str. 306; identical to SEQ ID NO: 42304
  CDS (1)..(1110): transl_table=11

SEQ ID NO: 71018 - protein, 369 aa, Xanthomonas axonopodis pv. citri str. 306; identical to SEQ ID NO: 42305

SEQ ID NO: 71019 - DNA, 1056 bp, Yersinia pestis KIM; identical to SEQ ID NO: 42306
  CDS (1)..(1056): transl_table=11

SEQ ID NO: 71020 - protein, 351 aa, Yersinia pestis KIM; identical to SEQ ID NO: 42307

SEQ ID NO: 71021 - DNA, 1002 bp, Oceanobacillus iheyensis HTE831; identical to SEQ ID NO: 42308
  CDS (1)..(1002): transl_table=11

SEQ ID NO: 71022 - protein, 333 aa, Oceanobacillus iheyensis HTE831; identical to SEQ ID NO: 42309

SEQ ID NO: 71023 - DNA, 912 bp, Oceanobacillus iheyensis HTE831; identical to SEQ ID NO: 42310
  CDS (1)..(912): transl_table=11

SEQ ID NO: 71024 - protein, 303 aa, Oceanobacillus iheyensis HTE831; identical to SEQ ID NO: 42311

SEQ ID NO: 71025 - DNA, 1020 bp, Oceanobacillus iheyensis HTE831; identical to SEQ ID NO: 42312
  CDS (1)..(1020): transl_table=11

SEQ ID NO: 71026 - protein, 339 aa, Oceanobacillus iheyensis HTE831; identical to SEQ ID NO: 42313

SEQ ID NO: 71027 - DNA, 987 bp, Streptococcus agalactiae NEM316; identical to SEQ ID NO: 42314
  CDS (1)..(987): transl_table=11

SEQ ID NO: 71028 - protein, 328 aa, Streptococcus agalactiae NEM316; identical to SEQ ID NO: 42315

SEQ ID NO: 71029 - DNA, 1041 bp, Corynebacterium efficiens YS-314; identical to SEQ ID NO: 42316
  CDS (1)..(1041): transl_table=11

SEQ ID NO: 71030 - protein, 346 aa, Corynebacterium efficiens YS-314; identical to SEQ ID NO: 42317

SEQ ID NO: 71031 - DNA, 966 bp, Corynebacterium efficiens YS-314; identical to SEQ ID NO: 42318
  CDS (1)..(966): transl_table=11

SEQ ID NO: 71032 - protein, 321 aa, Corynebacterium efficiens YS-314; identical to SEQ ID NO: 42319

SEQ ID NO: 71033 - DNA, 1005 bp, Pseudomonas putida KT2440; identical to SEQ ID NO: 42320
  CDS (1)..(1005): transl_table=11

SEQ ID NO: 71034 - protein, 334 aa, Pseudomonas putida KT2440; identical to SEQ ID NO: 42321

SEQ ID NO: 71035 - DNA, 981 bp, Pseudomonas putida KT2440; identical to SEQ ID NO: 42322
  CDS (1)..(981): transl_table=11

SEQ ID NO: 71036 - protein, 326 aa, Pseudomonas putida KT2440; identical to SEQ ID NO: 42323

SEQ ID NO: 71037 - DNA, 996 bp, Staphylococcus epidermidis ATCC 12228; identical to SEQ ID NO: 42324
  CDS (1)..(996): transl_table=11

SEQ ID NO: 71038 - protein, 331 aa, Staphylococcus epidermidis ATCC 12228; identical to SEQ ID NO: 42325

SEQ ID NO: 71039 - DNA, 1047 bp, Staphylococcus epidermidis ATCC 12228; identical to SEQ ID NO: 42326
  CDS (1)..(1047): transl_table=11

SEQ ID NO: 71040 - protein, 348 aa, Staphylococcus epidermidis ATCC 12228; identical to SEQ ID NO: 42327

SEQ ID NO: 71041 - DNA, 1008 bp, Bradyrhizobium japonicum USDA 110; identical to SEQ ID NO: 42328
  CDS (1)..(1008)

SEQ ID NO: 71042 - protein, 335 aa, Bradyrhizobium japonicum USDA 110; identical to SEQ ID NO: 42329

SEQ ID NO: 71043 - DNA, 1014 bp, Bradyrhizobium japonicum USDA 110; identical to SEQ ID NO: 42330
  CDS (1)..(1014)

SEQ ID NO: 71044 - protein, 337 aa, Bradyrhizobium japonicum USDA 110; identical to SEQ ID NO: 42331

SEQ ID NO: 71045 - DNA, 1002 bp, Pseudomonas syringae pv. tomato str. DC3000; identical to SEQ ID NO: 42332
  CDS (1)..(1002): transl_table=11

SEQ ID NO: 71046 - protein, 333 aa, Pseudomonas syringae pv. tomato str. DC3000; identical to SEQ ID NO: 42333

SEQ ID NO: 71047 - DNA, 987 bp, Enterococcus faecalis V583; identical to SEQ ID NO: 42334
  CDS (1)..(987): transl_table=11

SEQ ID NO: 71048 - protein, 328 aa, Enterococcus faecalis V583; identical to SEQ ID NO: 42335

SEQ ID NO: 71049 - DNA, 1017 bp, Streptomyces avermitilis MA-4680; identical to SEQ ID NO: 42336
  CDS (1)..(1017)

SEQ ID NO: 71050 - protein, 338 aa, Streptomyces avermitilis MA-4680; identical to SEQ ID NO: 42337

SEQ ID NO: 71051 - DNA, 1008 bp, Streptomyces avermitilis MA-4680; identical to SEQ ID NO: 42338
  CDS (1)..(1008)

SEQ ID NO: 71052 - protein, 335 aa, Streptomyces avermitilis MA-4680; identical to SEQ ID NO: 42339

SEQ ID NO: 71053 - DNA, 972 bp, Bordetella bronchiseptica RB50; identical to SEQ ID NO: 42340
  CDS (1)..(972): transl_table=11

SEQ ID NO: 71054 - protein, 323 aa, Bordetella bronchiseptica RB50; identical to SEQ ID NO: 42341

SEQ ID NO: 71055 - DNA, 1026 bp, Bordetella bronchiseptica RB50; identical to SEQ ID NO: 42342
  CDS (1)..(1026): transl_table=11

SEQ ID NO: 71056 - protein, 341 aa, Bordetella bronchiseptica RB50; identical to SEQ ID NO: 42343

SEQ ID NO: 71057 - DNA, 1032 bp, Chromobacterium violaceum ATCC 12472; identical to SEQ ID NO: 42344
  CDS (1)..(1032): transl_table=11

SEQ ID NO: 71058 - protein, 343 aa, Chromobacterium violaceum ATCC 12472; identical to SEQ ID NO: 42345

SEQ ID NO: 71059 - DNA, 1017 bp, Rhodopseudomonas palustris CGA009; identical to SEQ ID NO: 42346
  CDS (1)..(1017): transl_table=11

SEQ ID NO: 71060 - protein, 338 aa, Rhodopseudomonas palustris CGA009; identical to SEQ ID NO: 42347

SEQ ID NO: 71061 - DNA, 1122 bp, Mycobacterium avium subsp. paratuberculosis str. k10; identical to SEQ ID NO: 42348
  CDS (1)..(1122): transl_table=11

SEQ ID NO: 71062 - protein, 373 aa, Mycobacterium avium subsp. paratuberculosis str. k10; identical to SEQ ID NO: 42349

SEQ ID NO: 71063 - DNA, 1032 bp, Mycobacterium avium subsp. paratuberculosis str. k10; identical to SEQ ID NO: 42350
  CDS (1)..(1032): transl_table=11

SEQ ID NO: 71064 - protein, 343 aa, Mycobacterium avium subsp. paratuberculosis str. k10; identical to SEQ ID NO: 42351

SEQ ID NO: 71065 - DNA, 1011 bp, Bdellovibrio bacteriovorus HD100; identical to SEQ ID NO: 42352
  CDS (1)..(1011): transl_table=11

SEQ ID NO: 71066 - protein, 336 aa, Bdellovibrio bacteriovorus HD100; identical to SEQ ID NO: 42353

SEQ ID NO: 71067 - DNA, 972 bp, Anopheles gambiae str. PEST; identical to SEQ ID NO: 42354
  CDS (1)..(972)

SEQ ID NO: 71068 - protein, 323 aa, Anopheles gambiae str. PEST; identical to SEQ ID NO: 42355

SEQ ID NO: 71069 - DNA, 1014 bp, Staphylococcus aureus subsp. aureus MRSA252; identical to SEQ ID NO: 42356
  CDS (1)..(1014): transl_table=11

SEQ ID NO: 71070 - protein, 337 aa, Staphylococcus aureus subsp. aureus MRSA252; identical to SEQ ID NO: 42357

SEQ ID NO: 71071 - DNA, 1023 bp, Acinetobacter sp. ADP1; identical to SEQ ID NO: 42358
  CDS (1)..(1023): transl_table=11

SEQ ID NO: 71072 - protein, 340 aa, Acinetobacter sp. ADP1; identical to SEQ ID NO: 42359

SEQ ID NO: 71073 - DNA, 981 bp, Erwinia carotovora subsp. atroseptica SCRI1043; identical to SEQ ID NO: 42360
  CDS (1)..(981)

SEQ ID NO: 71074 - protein, 326 aa, Erwinia carotovora subsp. atroseptica SCRI1043; identical to SEQ ID NO: 42361

SEQ ID NO: 71075 - DNA, 981 bp, Propionibacterium acnes KPA171202; identical to SEQ ID NO: 42362
  CDS (1)..(981): transl_table=11

SEQ ID NO: 71076 - protein, 326 aa, Propionibacterium acnes KPA171202; identical to SEQ ID NO: 42363

SEQ ID NO: 71077 - DNA, 1014 bp, Symbiobacterium thermophilum IAM 14863; identical to SEQ ID NO: 42364
  CDS (1)..(1014): transl_table=11

SEQ ID NO: 71078 - protein, 337 aa, Symbiobacterium thermophilum IAM 14863; identical to SEQ ID NO: 42365

SEQ ID NO: 71079 - DNA, 993 bp, Bacillus licheniformis ATCC 14580; identical to SEQ ID NO: 42366
  CDS (1)..(993): transl_table=11

SEQ ID NO: 71080 - protein, 330 aa, Bacillus licheniformis ATCC 14580; identical to SEQ ID NO: 42367

SEQ ID NO: 71081 - DNA, 1038 bp, Mannheimia succiniciproducens MBEL55E; identical to SEQ ID NO: 42368
  CDS (1)..(1038): transl_table=11

SEQ ID NO: 71082 - protein, 345 aa, Mannheimia succiniciproducens MBEL55E; identical to SEQ ID NO: 42369

SEQ ID NO: 71083 - DNA, 1008 bp, Bacillus licheniformis ATCC 14580; identical to SEQ ID NO: 42370
  CDS (1)..(1008): transl_table=11

SEQ ID NO: 71084 - protein, 335 aa, Bacillus licheniformis ATCC 14580; identical to SEQ ID NO: 42371

SEQ ID NO: 71085 - DNA, 1002 bp, Burkholderia mallei ATCC 23344; identical to SEQ ID NO: 42372
  CDS (1)..(1002): transl_table=11

SEQ ID NO: 71086 - protein, 333 aa, Burkholderia mallei ATCC 23344; identical to SEQ ID NO: 42373

SEQ ID NO: 71087 - DNA, 1059 bp, Burkholderia pseudomallei K96243; identical to SEQ ID NO: 42374
  CDS (1)..(1059): transl_table=11

SEQ ID NO: 71088 - protein, 352 aa, Burkholderia pseudomallei K96243; identical to SEQ ID NO: 42375

SEQ ID NO: 71089 - DNA, 1185 bp, Nocardia farcinica IFM 10152; identical to SEQ ID NO: 42376
  CDS (1)..(1185): transl_table=11

SEQ ID NO: 71090 - protein, 394 aa, Nocardia farcinica IFM 10152; identical to SEQ ID NO: 42377

SEQ ID NO: 71091 - DNA, 1032 bp, Nocardia farcinica IFM 10152; identical to SEQ ID NO: 42378
  CDS (1)..(1032): transl_table=11

SEQ ID NO: 71092 - protein, 343 aa, Nocardia farcinica IFM 10152; identical to SEQ ID NO: 42379

SEQ ID NO: 71093 - DNA, 993 bp, Nocardia farcinica IFM 10152; identical to SEQ ID NO: 42380
  CDS (1)..(993): transl_table=11

SEQ ID NO: 71094 - protein, 330 aa, Nocardia farcinica IFM 10152; identical to SEQ ID NO: 42381

SEQ ID NO: 71095 - DNA, 1029 bp, Haloarcula marismortui ATCC 43049; identical to SEQ ID NO: 42382
  CDS (1)..(1029): transl_table=11

SEQ ID NO: 71096 - protein, 342 aa, Haloarcula marismortui ATCC 43049; identical to SEQ ID NO: 42383

SEQ ID NO: 71097 - DNA, 1011 bp, Geobacillus kaustophilus HTA426; identical to SEQ ID NO: 42384
  CDS (1)..(1011): transl_table=11

SEQ ID NO: 71098 - protein, 336 aa, Geobacillus kaustophilus HTA426; identical to SEQ ID NO: 42385

SEQ ID NO: 71099 - DNA, 984 bp, Idiomarina loihiensis L2TR; identical to SEQ ID NO: 42386
  CDS (1)..(984): transl_table=11

SEQ ID NO: 71100 - protein, 327 aa, Idiomarina loihiensis L2TR; identical to SEQ ID NO: 42387

SEQ ID NO: 71101 - DNA, 1005 bp, Silicibacter pomeroyi DSS-3; identical to SEQ ID NO: 42388
  CDS (1)..(1005): transl_table=11

SEQ ID NO: 71102 - protein, 334 aa, Silicibacter pomeroyi DSS-3; identical to SEQ ID NO: 42389

SEQ ID NO: 71103 - DNA, 999 bp, Bacillus clausii KSM-K16; identical to SEQ ID NO: 42390
  CDS (1)..(999): transl_table=11

SEQ ID NO: 71104 - protein, 332 aa, Bacillus clausii KSM-K16; identical to SEQ ID NO: 42391

SEQ ID NO: 71105 - DNA, 1005 bp, Bacillus clausii KSM-K16; identical to SEQ ID NO: 42392
  CDS (1)..(1005): transl_table=11

SEQ ID NO: 71106 - protein, 334 aa, Bacillus clausii KSM-K16; identical to SEQ ID NO: 42393

SEQ ID NO: 71107 - DNA, 984 bp, Rhodobacter sphaeroides 2.4.1; identical to SEQ ID NO: 42394
  CDS (1)..(984)

SEQ ID NO: 71108 - protein, 327 aa, Rhodobacter sphaeroides 2.4.1; identical to SEQ ID NO: 42395

SEQ ID NO: 71109 - DNA, 996 bp, Azotobacter vinelandii; identical to SEQ ID NO: 42396
  CDS (1)..(996)

SEQ ID NO: 71110 - protein, 331 aa, Azotobacter vinelandii; identical to SEQ ID NO: 42397

SEQ ID NO: 71111 - DNA, 1050 bp, Actinobacillus pleuropneumoniae serovar 1 str. 4074; identical to SEQ ID NO: 42398
  CDS (1)..(1050)

SEQ ID NO: 71112 - protein, 349 aa, Actinobacillus pleuropneumoniae serovar 1 str. 4074; identical to SEQ ID NO: 42399

SEQ ID NO: 71113 - DNA, 972 bp, Pseudomonas aeruginosa UCBPP-PA14; identical to SEQ ID NO: 42400
  CDS (1)..(972)

SEQ ID NO: 71114 - protein, 323 aa, Pseudomonas aeruginosa UCBPP-PA14; identical to SEQ ID NO: 42401

SEQ ID NO: 71115 - DNA, 1005 bp, Dechloromonas aromatica RCB; identical to SEQ ID NO: 42402
  CDS (1)..(1005)

SEQ ID NO: 71116 - protein, 334 aa, Dechloromonas aromatica RCB; identical to SEQ ID NO: 42403

SEQ ID NO: 71117 - DNA, 1026 bp, Ralstonia eutropha JMP134; identical to SEQ ID NO: 42404
  CDS (1)..(1026)

SEQ ID NO: 71118 - protein, 341 aa, Ralstonia eutropha JMP134; identical to SEQ ID NO: 42405

SEQ ID NO: 71119 - DNA, 1002 bp, Methylobacillus flagellatus KT; identical to SEQ ID NO: 42406
  CDS (1)..(1002)

SEQ ID NO: 71120 - protein, 333 aa, Methylobacillus flagellatus KT; identical to SEQ ID NO: 42407

SEQ ID NO: 71121 - DNA, 990 bp, Exiguobacterium sp. 255-15; identical to SEQ ID NO: 42408
  CDS (1)..(990)

SEQ ID NO: 71122 - protein, 329 aa, Exiguobacterium sp. 255-15; identical to SEQ ID NO: 42409

SEQ ID NO: 71123 - DNA, 987 bp, Mesorhizobium sp. BNC1; identical to SEQ ID NO: 42410
  CDS (1)..(987)

SEQ ID NO: 71124 - protein, 328 aa, Mesorhizobium sp. BNC1; identical to SEQ ID NO: 42411

SEQ ID NO: 71125 - DNA, 1011 bp, Exiguobacterium sp. 255-15; identical to SEQ ID NO: 42412
  CDS (1)..(1011)

SEQ ID NO: 71126 - protein, 336 aa, Exiguobacterium sp. 255-15; identical to SEQ ID NO: 42413

SEQ ID NO: 71127 - DNA, 1050 bp, Burkholderia cepacia R18194; identical to SEQ ID NO: 42414
  CDS (1)..(1050)

SEQ ID NO: 71128 - protein, 349 aa, Burkholderia cepacia R18194; identical to SEQ ID NO: 42415

SEQ ID NO: 71129 - DNA, 999 bp, Burkholderia cepacia R1808; identical to SEQ ID NO: 42416
  CDS (1)..(999)

SEQ ID NO: 71130 - protein, 332 aa, Burkholderia cepacia R1808; identical to SEQ ID NO: 42417

SEQ ID NO: 71131 - DNA, 1032 bp, Burkholderia cepacia R1808; identical to SEQ ID NO: 42418
  CDS (1)..(1032)

SEQ ID NO: 71132 - protein, 343 aa, Burkholderia cepacia R1808; identical to SEQ ID NO: 42419

SEQ ID NO: 71133 - DNA, 996 bp, Listeria monocytogenes str. 1/2a F6854; identical to SEQ ID NO: 42420
  CDS (1)..(996): transl_table=11

SEQ ID NO: 71134 - protein, 331 aa, Listeria monocytogenes str. 1/2a F6854; identical to SEQ ID NO: 42421

SEQ ID NO: 71135 - DNA, 1044 bp, Rubrivivax gelatinosus PM1; identical to SEQ ID NO: 42422
  CDS (1)..(1044)

SEQ ID NO: 71136 - protein, 347 aa, Rubrivivax gelatinosus PM1; identical to SEQ ID NO: 42423

SEQ ID NO: 71137 - DNA, 1002 bp, Pseudomonas fluorescens PfO-1; identical to SEQ ID NO: 42424
  CDS (1)..(1002)

SEQ ID NO: 71138 - protein, 333 aa, Pseudomonas fluorescens PfO-1; identical to SEQ ID NO: 42425

SEQ ID NO: 71139 - DNA, 1002 bp, Rhodospirillum rubrum; identical to SEQ ID NO: 42426
  CDS (1)..(1002)

SEQ ID NO: 71140 - protein, 333 aa, Rhodospirillum rubrum; identical to SEQ ID NO: 42427

SEQ ID NO: 71141 - DNA, 1017 bp, Ralstonia metallidurans CH34; identical to SEQ ID NO: 42428
  CDS (1)..(1017)

SEQ ID NO: 71142 - protein, 338 aa, Ralstonia metallidurans CH34; identical to SEQ ID NO: 42429

SEQ ID NO: 71143 - DNA, 1020 bp, Ralstonia metallidurans CH34; identical to SEQ ID NO: 42430
  CDS (1)..(1020)

SEQ ID NO: 71144 - protein, 339 aa, Ralstonia metallidurans CH34; identical to SEQ ID NO: 42431

SEQ ID NO: 71145 - DNA, 999 bp, Burkholderia fungorum LB400; identical to SEQ ID NO: 42432
  CDS (1)..(999)

SEQ ID NO: 71146 - protein, 332 aa, Burkholderia fungorum LB400; identical to SEQ ID NO: 42433

SEQ ID NO: 71147 - DNA, 1002 bp, Burkholderia fungorum LB400; identical to SEQ ID NO: 42434
  CDS (1)..(1002)

SEQ ID NO: 71148 - protein, 333 aa, Burkholderia fungorum LB400; identical to SEQ ID NO: 42435

SEQ ID NO: 71149 - DNA, 996 bp, Burkholderia fungorum LB400; identical to SEQ ID NO: 42436
  CDS (1)..(996)

SEQ ID NO: 71150 - protein, 331 aa, Burkholderia fungorum LB400; identical to SEQ ID NO: 42437

SEQ ID NO: 71151 - DNA, 1020 bp, Burkholderia fungorum LB400; identical to SEQ ID NO: 42438
  CDS (1)..(1020)

SEQ ID NO: 71152 - protein, 339 aa, Burkholderia fungorum LB400; identical to SEQ ID NO: 42439

SEQ ID NO: 71153 - DNA, 993 bp, Novosphingobium aromaticivorans DSM 12444; identical to SEQ ID NO: 42440
  CDS (1)..(993)

SEQ ID NO: 71154 - protein, 330 aa, Novosphingobium aromaticivorans DSM 12444; identical to SEQ ID NO: 42441

SEQ ID NO: 71155 - DNA, 1014 bp, Cytophaga hutchinsonii; identical to SEQ ID NO: 42442
  CDS (1)..(1014)

SEQ ID NO: 71156 - protein, 337 aa, Cytophaga hutchinsonii; identical to SEQ ID NO: 42443

SEQ ID NO: 71157 - DNA, 987 bp, Silicibacter sp. TM1040; identical to SEQ ID NO: 42444
  CDS (1)..(987)

SEQ ID NO: 71158 - protein, 328 aa, Silicibacter sp. TM1040; identical to SEQ ID NO: 42445

SEQ ID NO: 71159 - DNA, 1020 bp, Psychrobacter sp. 273-4; identical to SEQ ID NO: 42446
  CDS (1)..(1020)

SEQ ID NO: 71160 - protein, 339 aa, Psychrobacter sp. 273-4; identical to SEQ ID NO: 42447

SEQ ID NO: 71161 - DNA, 1020 bp, Rubrobacter xylanophilus DSM 9941; identical to SEQ ID NO: 42448
  CDS (1)..(1020)

SEQ ID NO: 71162 - protein, 339 aa, Rubrobacter xylanophilus DSM 9941; identical to SEQ ID NO: 42449

SEQ ID NO: 71163 - DNA, 1002 bp, Polaromonas sp. JS666; identical to SEQ ID NO: 42450
  CDS (1)..(1002)

SEQ ID NO: 71164 - protein, 333 aa, Polaromonas sp. JS666; identical to SEQ ID NO: 42451

SEQ ID NO: 71165 - DNA, 954 bp, Corynebacterium glutamicum; identical to SEQ ID NO: 42452
  CDS (1)..(954): transl_table=11

SEQ ID NO: 71166 - protein, 317 aa, Corynebacterium glutamicum; identical to SEQ ID NO: 42453

SEQ ID NO: 71167 - DNA, 981 bp, uncultured bacterium 311; identical to SEQ ID NO: 42454
  CDS (1)..(981): transl_table=11

SEQ ID NO: 71168 - protein, 326 aa, uncultured bacterium 311; identical to SEQ ID NO: 42455

SEQ ID NO: 71169 - DNA, 1035 bp, Yersinia enterocolitica; identical to SEQ ID NO: 42456
  CDS (1)..(1035): transl_table=11

SEQ ID NO: 71170 - protein, 344 aa, Yersinia enterocolitica; identical to SEQ ID NO: 42457

SEQ ID NO: 71171 - DNA, 942 bp, Bacillus subtilis; identical to SEQ ID NO: 42458
  CDS (1)..(942): transl_table=11

SEQ ID NO: 71172 - protein, 313 aa, Bacillus subtilis; identical to SEQ ID NO: 42459

SEQ ID NO: 71173 - DNA, 1020 bp, Bacillus subtilis; identical to SEQ ID NO: 42460
  CDS (1)..(1020): transl_table=11

SEQ ID NO: 71174 - protein, 339 aa, Bacillus subtilis; identical to SEQ ID NO: 42461

SEQ ID NO: 71175 - DNA, 1005 bp, Bacillus subtilis; identical to SEQ ID NO: 42462
  CDS (1)..(1005): transl_table=11

SEQ ID NO: 71176 - protein, 334 aa, Bacillus subtilis; identical to SEQ ID NO: 42463

SEQ ID NO: 71177 - DNA, 1011 bp, Bacillus subtilis; identical to SEQ ID NO: 42464
  CDS (1)..(1011): transl_table=11

SEQ ID NO: 71178 - protein, 336 aa, Bacillus subtilis; identical to SEQ ID NO: 42465

SEQ ID NO: 71179 - DNA, 1002 bp, Bacillus subtilis; identical to SEQ ID NO: 42466
  CDS (1)..(1002): transl_table=11

SEQ ID NO: 71180 - protein, 333 aa, Bacillus subtilis; identical to SEQ ID NO: 42467

SEQ ID NO: 71181 - DNA, 26 bp, Primer
atgactgataaaaccattgcgttttc

SEQ ID NO: 71182 - DNA, 26 bp, Primer
ttatcccaacaactcttccttaacat

SEQ ID NO: 71183 - protein, 413 aa, consensus; identical to SEQ ID NO: 42470
  MISC_FEATURE (1)..(413): consensus for the disclosure of xaa see table XV

SEQ ID NO: 71184 - protein, 82 aa, consensus; identical to SEQ ID NO: 42471
  MISC_FEATURE (1)..(82): consensus for the disclosure of xaa see table XV

SEQ ID NO: 71185 - protein, 26 aa, consensus
  MISC_FEATURE (1)..(26): consensus for the disclosure of xaa see table XV
XXXXXXXXXXXXXAXXXXXXXXXXXX

SEQ ID NO: 71186 - DNA, 318 bp, Escherichia coli K12; identical to SEQ ID NO: 26631
  CDS (1)..(318)

SEQ ID NO: 71187 - protein, 105 aa, Escherichia coli K12; identical to SEQ ID NO: 26632

SEQ ID NO: 71188 - DNA, 318 bp, Salmonella typhimurium; identical to SEQ ID NO: 26633
  CDS (1)..(318)

SEQ ID NO: 71189 - protein, 105 aa, Salmonella typhimurium; identical to SEQ ID NO: 26634

SEQ ID NO: 71190 - DNA, 318 bp, Haemophilus influenzae; identical to SEQ ID NO: 26635
  CDS (1)..(318)

SEQ ID NO: 71191 - protein, 105 aa, Haemophilus influenzae; identical to SEQ ID NO: 26636

SEQ ID NO: 71192 - DNA, 318 bp, Yersinia pestis; identical to SEQ ID NO: 26637
  CDS (1)..(318)

SEQ ID NO: 71193 - protein, 105 aa, Yersinia pestis; identical to SEQ ID NO: 26638

SEQ ID NO: 71194 - DNA, 318 bp, Yersinia pseudotuberculosis IP 32953; identical to SEQ ID NO: 26639
  CDS (1)..(318)

SEQ ID NO: 71195 - protein, 105 aa, Yersinia pseudotuberculosis IP 32953; identical to SEQ ID NO: 26640

SEQ ID NO: 71196 - DNA, 318 bp, Erwinia carotovora; identical to SEQ ID NO: 26641
  CDS (1)..(318)

SEQ ID NO: 71197 - protein, 105 aa, Erwinia carotovora; identical to SEQ ID NO: 26642

SEQ ID NO: 71198 - DNA, 318 bp, Photobacterium profundum; identical to SEQ ID NO: 26643
  CDS (1)..(318)

SEQ ID NO: 71199 - protein, 105 aa, Photobacterium profundum; identical to SEQ ID NO: 26644

SEQ ID NO: 71200 - DNA, 318 bp, Haemophilus ducreyi; identical to SEQ ID NO: 26645
  CDS (1)..(318)

SEQ ID NO: 71201 - protein, 105 aa, Haemophilus ducreyi; identical to SEQ ID NO: 26646

SEQ ID NO: 71202 - DNA, 318 bp, Pasteurella multocida; identical to SEQ ID NO: 26647
  CDS (1)..(318)

SEQ ID NO: 71203 - protein, 105 aa, Pasteurella multocida; identical to SEQ ID NO: 26648

SEQ ID NO: 71204 - DNA, 318 bp, Photorhabdus luminescens; identical to SEQ ID NO: 26649
  CDS (1)..(318)

SEQ ID NO: 71205 - protein, 105 aa, Photorhabdus luminescens; identical to SEQ ID NO: 26650

SEQ ID NO: 71206 - DNA, 315 bp, Shewanella oneidensis; identical to SEQ ID NO: 26651
  CDS (1)..(315)

SEQ ID NO: 71207 - protein, 104 aa, Shewanella oneidensis; identical to SEQ ID NO: 26652

SEQ ID NO: 71208 - DNA, 321 bp, Vibrio parahaemolyticus; identical to SEQ ID NO: 26653
  CDS (1)..(321)

SEQ ID NO: 71209 - protein, 106 aa, Vibrio parahaemolyticus; identical to SEQ ID NO: 26654

SEQ ID NO: 71210 - DNA, 318 bp, Vibrio vulnificus; identical to SEQ ID NO: 26655
  CDS (1)..(318)

SEQ ID NO: 71211 - protein, 105 aa, Vibrio vulnificus; identical to SEQ ID NO: 26656

SEQ ID NO: 71212 - DNA, 20 bp, Primer
atggctgaatggagcggcga

SEQ ID NO: 71213 - DNA, 22 bp, Primer
ttagtattcccacgtctccggg

SEQ ID NO: 71214 - protein, 97 aa, consensus; identical to SEQ ID NO: 27310
  MISC_FEATURE (1)..(97): consensus for the disclosure of xaa see table XV

SEQ ID NO: 71215 - protein, 97 aa, consensus; identical to SEQ ID NO: 27309
  MISC_FEATURE (1)..(97): consensus for the disclosure of xaa see table XV

SEQ ID NO: 71216 - DNA, 465 bp, Escherichia coli K12; identical to SEQ ID NO: 17712
  CDS (1)..(465)

SEQ ID NO: 71217 - protein, 154 aa, Escherichia coli K12; identical to SEQ ID NO: 17713

SEQ ID NO: 71218 - DNA, 402 bp, Vibrio cholerae; identical to SEQ ID NO: 17714
  CDS (1)..(402)

SEQ ID NO: 71219 - protein, 133 aa, Vibrio cholerae; identical to SEQ ID NO: 17715

SEQ ID NO: 71220 - DNA, 414 bp, Nostoc sp. PCC 7120; identical to SEQ ID NO: 17716
  CDS (1)..(414)

SEQ ID NO: 71221 - protein, 137 aa, Nostoc sp. PCC 7120; identical to SEQ ID NO: 17717

SEQ ID NO: 71222 - DNA, 438 bp, Listeria innocua; identical to SEQ ID NO: 17718
  CDS (1)..(438)

SEQ ID NO: 71223 - protein, 145 aa, Listeria innocua; identical to SEQ ID NO: 17719

SEQ ID NO: 71224 - DNA, 411 bp, Nostoc sp. PCC 7120; identical to SEQ ID NO: 17720
  CDS (1)..(411)

SEQ ID NO: 71225 - protein, 136 aa, Nostoc sp. PCC 7120; identical to SEQ ID NO: 17721

SEQ ID NO: 71226 - DNA, 426 bp, Agrobacterium tumefaciens; identical to SEQ ID NO: 17722
  CDS (1)..(426)

SEQ ID NO: 71227 - protein, 141 aa, Agrobacterium tumefaciens; identical to SEQ ID NO: 17723

SEQ ID NO: 71228 - DNA, 447 bp, Vibrio cholerae; identical to SEQ ID NO: 17724
  CDS (1)..(447)

SEQ ID NO: 71229 - protein, 148 aa, Vibrio cholerae; identical to SEQ ID NO: 17725

SEQ ID NO: 71230 - DNA, 471 bp, Pseudomonas aeruginosa; identical to SEQ ID NO: 17726
  CDS (1)..(471)

SEQ ID NO: 71231 - protein, 156 aa, Pseudomonas aeruginosa; identical to SEQ ID NO: 17727

SEQ ID NO: 71232 - DNA, 426 bp, Pseudomonas aeruginosa; identical to SEQ ID NO: 17728
  CDS (1)..(426)

SEQ ID NO: 71233 - protein, 141 aa, Pseudomonas aeruginosa; identical to SEQ ID NO: 17729

SEQ ID NO: 71234 - DNA, 534 bp, Agrobacterium tumefaciens; identical to SEQ ID NO: 17730
  CDS (1)..(534)

SEQ ID NO: 71235 - protein, 177 aa, Agrobacterium tumefaciens; identical to SEQ ID NO: 17731

SEQ ID NO: 71236 - DNA, 405 bp, Sinorhizobium meliloti; identical to SEQ ID NO: 17732
  CDS (1)..(405)

SEQ ID NO: 71237 - protein, 134 aa, Sinorhizobium meliloti; identical to SEQ ID NO: 17733

SEQ ID NO: 71238 - DNA, 399 bp, Pseudomonas aeruginosa; identical to SEQ ID NO: 17734
  CDS (1)..(399)

SEQ ID NO: 71239 - protein, 132 aa, Pseudomonas aeruginosa; identical to SEQ ID NO: 17735

SEQ ID NO: 71240 - DNA, 528 bp, Streptomyces coelicolor; identical to SEQ ID NO: 17736
  CDS (1)..(528)

SEQ ID NO: 71241 - protein, 175 aa, Streptomyces coelicolor; identical to SEQ ID NO: 17737

SEQ ID NO: 71242 - DNA, 591 bp, Streptomyces violaceoruber; identical to SEQ ID NO: 17738
  CDS (1)..(591)

SEQ ID NO: 71243 - protein, 196 aa, Streptomyces violaceoruber; identical to SEQ ID NO: 17739

SEQ ID NO: 71244 - DNA, 474 bp, Erwinia carotovora subsp; identical to SEQ ID NO: 17740
  CDS (1)..(474)

SEQ ID NO: 71245 - protein, 157 aa, Erwinia carotovora subsp; identical to SEQ ID NO: 17741

SEQ ID NO: 71246 - DNA, 441 bp, Rhodococcus opacus; identical to SEQ ID NO: 17742
  CDS (1)..(441)

SEQ ID NO: 71247 - protein, 146 aa, Rhodococcus opacus; identical to SEQ ID NO: 17743

SEQ ID NO: 71248 - DNA, 495 bp, Acinetobacter sp; identical to SEQ ID NO: 17744
  CDS (1)..(495)

SEQ ID NO: 71249 - protein, 164 aa, Acinetobacter sp; identical to SEQ ID NO: 17745

SEQ ID NO: 71250 - DNA, 432 bp, Photobacterium profundum; identical to SEQ ID NO: 17746
  CDS (1)..(432)

SEQ ID NO: 71251 - protein, 143 aa, Photobacterium profundum; identical to SEQ ID NO: 17747

SEQ ID NO: 71252 - DNA, 426 bp, Photobacterium profundum; identical to SEQ ID NO: 17748
  CDS (1)..(426)

SEQ ID NO: 71253 - protein, 141 aa, Photobacterium profundum; identical to SEQ ID NO: 17749

SEQ ID NO: 71254 - DNA, 474 bp, Bdellovibrio bacteriovorus; identical to SEQ ID NO: 17750
  CDS (1)..(474)

SEQ ID NO: 71255 - protein, 157 aa, Bdellovibrio bacteriovorus; identical to SEQ ID NO: 17751

SEQ ID NO: 71256 - DNA, 402 bp, Rhodopseudomonas palustris; identical to SEQ ID NO: 17752
  CDS (1)..(402)

SEQ ID NO: 71257 - protein, 133 aa, Rhodopseudomonas palustris; identical to SEQ ID NO: 17753

SEQ ID NO: 71258 - DNA, 459 bp, Rhodococcus erythropolis; identical to SEQ ID NO: 17754
  CDS (1)..(459)

SEQ ID NO: 71259 - protein, 152 aa, Rhodococcus erythropolis; identical to SEQ ID NO: 17755

SEQ ID NO: 71260 - DNA, 456 bp, Actinoplanes teichomyceticus; identical to SEQ ID NO: 17756
  CDS (1)..(456)

SEQ ID NO: 71261 - protein, 151 aa, Actinoplanes teichomyceticus; identical to SEQ ID NO: 17757

SEQ ID NO: 71262 - DNA, 456 bp, Listeria monocytogenes; identical to SEQ ID NO: 17758
  CDS (1)..(456)

SEQ ID NO: 71263 - protein, 151 aa, Listeria monocytogenes; identical to SEQ ID NO: 17759

SEQ ID NO: 71264 - DNA, 477 bp, Mycobacterium paratuberculosis; identical to SEQ ID NO: 17760
  CDS (1)..(477)

SEQ ID NO: 71265 - protein, 158 aa, Mycobacterium paratuberculosis; identical to SEQ ID NO: 17761

SEQ ID NO: 71266 - DNA, 465 bp, Bordetella pertussis; identical to SEQ ID NO: 17762
  CDS (1)..(465)

SEQ ID NO: 71267 - protein, 154 aa, Bordetella pertussis; identical to SEQ ID NO: 17763

SEQ ID NO: 71268 - DNA, 492 bp, Bordetella bronchiseptica; identical to SEQ ID NO: 17764
  CDS (1)..(492)

SEQ ID NO: 71269 - protein, 163 aa, Bordetella bronchiseptica; identical to SEQ ID NO: 17765

SEQ ID NO: 71270 - DNA, 510 bp, Streptomyces avermitilis; identical to SEQ ID NO: 17766
  CDS (1)..(510)

SEQ ID NO: 71271 - protein, 169 aa, Streptomyces avermitilis; identical to SEQ ID NO: 17767

SEQ ID NO: 71272 - DNA, 420 bp, Vibrio parahaemolyticus; identical to SEQ ID NO: 17768
  CDS (1)..(420)

SEQ ID NO: 71273 - protein, 139 aa, Vibrio parahaemolyticus; identical to SEQ ID NO: 17769

SEQ ID NO: 71274 - DNA, 438 bp, Vibrio parahaemolyticus; identical to SEQ ID NO: 17770
  CDS (1)..(438)

SEQ ID NO: 71275 - protein, 145 aa, Vibrio parahaemolyticus; identical to SEQ ID NO: 17771

SEQ ID NO: 71276 - DNA, 399 bp, Vibrio parahaemolyticus; identical to SEQ ID NO: 17772
  CDS (1)..(399)

SEQ ID NO: 71277 - protein, 132 aa, Vibrio parahaemolyticus; identical to SEQ ID NO: 17773

SEQ ID NO: 71278 - DNA, 402 bp, Pseudomonas syringae; identical to SEQ ID NO: 17774
  CDS (1)..(402)

SEQ ID NO: 71279 - protein, 133 aa, Pseudomonas syringae; identical to SEQ ID NO: 17775

SEQ ID NO: 71280 - DNA, 420 bp, Pseudomonas putida; identical to SEQ ID NO: 17776
  CDS (1)..(420)

SEQ ID NO: 71281 - protein, 139 aa, Pseudomonas putida; identical to SEQ ID NO: 17777

SEQ ID NO: 71282 - DNA, 372 bp, Pseudomonas putida; identical to SEQ ID NO: 17778
  CDS (1)..(372)

SEQ ID NO: 71283 - protein, 123 aa, Pseudomonas putida; identical to SEQ ID NO: 17779

SEQ ID NO: 71284 - DNA, 456 bp, Pseudomonas putida; identical to SEQ ID NO: 17780
  CDS (1)..(456)

SEQ ID NO: 71285 - protein, 151 aa, Pseudomonas putida; identical to SEQ ID NO: 17781

SEQ ID NO: 71286 - DNA, 411 bp, Pseudomonas putida; identical to SEQ ID NO: 17782
  CDS (1)..(411)

SEQ ID NO: 71287 - protein, 136 aa, Pseudomonas putida; identical to SEQ ID NO: 17783

SEQ ID NO: 71288 - DNA, 468 bp, Vibrio vulnificus; identical to SEQ ID NO: 17784
  CDS (1)..(468)

SEQ ID NO: 71289 - protein, 155 aa, Vibrio vulnificus; identical to SEQ ID NO: 17785

SEQ ID NO: 71290 - DNA, 447 bp, Xanthomonas campestris; identical to SEQ ID NO: 17786
  CDS (1)..(447)

SEQ ID NO: 71291 - protein, 148 aa, Xanthomonas campestris; identical to SEQ ID NO: 17787

SEQ ID NO: 71292 - DNA, 435 bp, Xanthomonas axonopodis; identical to SEQ ID NO: 17788
  CDS (1)..(435)

SEQ ID NO: 71293 - protein, 144 aa, Xanthomonas axonopodis; identical to SEQ ID NO: 17789

SEQ ID NO: 71294 - DNA, 384 bp, Listeria grayi; identical to SEQ ID NO: 17790
  CDS (1)..(384)

SEQ ID NO: 71295 - protein, 127 aa, Listeria grayi; identical to SEQ ID NO: 17791

SEQ ID NO: 71296 - DNA, 594 bp, Enterobacter aerogenes; identical to SEQ ID NO: 17792
  CDS (69)..(527)

SEQ ID NO: 71297 - protein, 152 aa, Enterobacter aerogenes; identical to SEQ ID NO: 17793

SEQ ID NO: 71298 - DNA, 480 bp, Ralstonia solanacearum; identical to SEQ ID NO: 17794
  CDS (1)..(480)

SEQ ID NO: 71299 - protein, 159 aa, Ralstonia solanacearum; identical to SEQ ID NO: 17795

SEQ ID NO: 71300 - DNA, 465 bp, Salmonella typhimurium; identical to SEQ ID NO: 17796
  CDS (1)..(465)

SEQ ID NO: 71301 - protein, 154 aa, Salmonella typhimurium; identical to SEQ ID NO: 17797

SEQ ID NO: 71302 - DNA, 486 bp, Rhizobium meliloti; identical to SEQ ID NO: 17798
  CDS (1)..(486)

SEQ ID NO: 71303 - protein, 161 aa, Rhizobium meliloti; identical to SEQ ID NO: 17799

SEQ ID NO: 71304 - DNA, 456 bp, Thiobacillus ferrooxidans; identical to SEQ ID NO: 17800
  CDS (1)..(456)

SEQ ID NO: 71305 - protein, 151 aa, Thiobacillus ferrooxidans; identical to SEQ ID NO: 17801

SEQ ID NO: 71306 - DNA, 480 bp, Amycolatopsis mediterranei; identical to SEQ ID NO: 17802
  CDS (1)..(480)

SEQ ID NO: 71307 - protein, 159 aa, Amycolatopsis mediterranei; identical to SEQ ID NO: 17803

SEQ ID NO: 71308 - DNA, 372 bp, Clostridium acetobutylicum; identical to SEQ ID NO: 17804
  CDS (1)..(372)

SEQ ID NO: 71309 - protein, 123 aa, Clostridium acetobutylicum; identical to SEQ ID NO: 17805

SEQ ID NO: 71310 - DNA, 447 bp, Rhizobium loti; identical to SEQ ID NO: 17806
  CDS (1)..(447)

SEQ ID NO: 71311 - protein, 148 aa, Rhizobium loti; identical to SEQ ID NO: 17807

SEQ ID NO: 71312 - DNA, 399 bp, Streptomyces coelicolor; identical to SEQ ID NO: 17808
  CDS (1)..(399)

SEQ ID NO: 71313 - protein, 132 aa, Streptomyces coelicolor; identical to SEQ ID NO: 17809

SEQ ID NO: 71314 - DNA, 408 bp, Streptomyces coelicolor; identical to SEQ ID NO: 17810
  CDS (1)..(408)

SEQ ID NO: 71315 - protein, 135 aa, Streptomyces coelicolor; identical to SEQ ID NO: 17811

SEQ ID NO: 71316 - DNA, 408 bp, Escherichia coli O6; identical to SEQ ID NO: 17812
  CDS (1)..(408)

SEQ ID NO: 71317 - protein, 135 aa, Escherichia coli O6; identical to SEQ ID NO: 17813

SEQ ID NO: 71318 - DNA, 447 bp, Chromobacterium violaceum; identical to SEQ ID NO: 17814
  CDS (1)..(447)

SEQ ID NO: 71319 - protein, 148 aa, Chromobacterium violaceum; identical to SEQ ID NO: 17815

SEQ ID NO: 71320 - DNA, 25 bp, Primer
atggaaaagaaattaccccgcatta

SEQ ID NO: 71321 - DNA, 25 bp, Primer
ttagttttgttcatcttccagcaag

SEQ ID NO: 71322 - protein, 104 aa, consensus
  MISC_FEATURE (1)..(104): consensus for the disclosure of xaa see table XV
GXXAXXXGXXXXXXXXYEXXGLXXXXXXRXXXXXRXYXXXXXXXXXXIXXXXXXGXXLXXXXXXXXXXXXXXXXXXXXXXXXXXXXXXXXXXXIXXLXXXXXXL

SEQ ID NO: 71323 - protein, 62 aa, consensus; identical to SEQ ID NO: 18684
  MISC_FEATURE (1)..(62): consensus for the disclosure of xaa see table XV

SEQ ID NO: 71324 - DNA, 354 bp, Saccharomyces cerevisiae; identical to SEQ ID NO: 55425
  CDS (1)..(354)

SEQ ID NO: 71325 - protein, 117 aa, Saccharomyces cerevisiae; identical to SEQ ID NO: 55426

SEQ ID NO: 71326 - DNA, 28 bp, Primer
atgatagttgaactttattcaaatatca

SEQ ID NO: 71327 - DNA, 25 bp, Primer
tcacttggattgattggttctagtg

SEQ ID NO: 71328 - DNA, 378 bp, Escherichia coli; identical to SEQ ID NO: 44321
  CDS (1)..(378)

SEQ ID NO: 71329 - protein, 125 aa, Escherichia coli; identical to SEQ ID NO: 44322

SEQ ID NO: 71330 - DNA, 474 bp, Gluconobacter oxydans 621H; identical to SEQ ID NO: 44323
  CDS (1)..(474)

SEQ ID NO: 71331 - protein, 157 aa, Gluconobacter oxydans 621H; identical to SEQ ID NO: 44324

SEQ ID NO: 71332 - DNA, 405 bp, Wolbachia endosymbiont strain TRS of Brugia malayi; identical to SEQ ID NO: 44325
  CDS (1)..(405)

SEQ ID NO: 71333 - protein, 134 aa, Wolbachia endosymbiont strain TRS of Brugia malayi; identical to SEQ ID NO: 44326

SEQ ID NO: 71334 - DNA, 384 bp, Xanthomonas oryzae pv. oryzae KACC10331; identical to SEQ ID NO: 44327
  CDS (1)..(384)

SEQ ID NO: 71335 - protein, 127 aa, Xanthomonas oryzae pv. oryzae KACC10331; identical to SEQ ID NO: 44328

SEQ ID NO: 71336 - DNA, 465 bp, Caulobacter crescentus CB15; identical to SEQ ID NO: 44329
  CDS (1)..(465): transl_table=11

SEQ ID NO: 71337 - protein, 154 aa, Caulobacter crescentus CB15; identical to SEQ ID NO: 44330

SEQ ID NO: 71338 - DNA, 402 bp, Agrobacterium tumefaciens str. C58; identical to SEQ ID NO: 44331
  CDS (1)..(402): transl_table=11

SEQ ID NO: 71339 - protein, 133 aa, Agrobacterium tumefaciens str. C58; identical to SEQ ID NO: 44332

SEQ ID NO: 71340 - DNA, 426 bp, Brucella melitensis 16M; identical to SEQ ID NO: 44333
  CDS (1)..(426): transl_table=11

SEQ ID NO: 71341 - protein, 141 aa, Brucella melitensis 16M; identical to SEQ ID NO: 44334

SEQ ID NO: 71342 - DNA, 405 bp, Bradyrhizobium japonicum USDA 110; identical to SEQ ID NO: 44335
  CDS (1)..(405)

SEQ ID NO: 71343 - protein, 134 aa, Bradyrhizobium japonicum USDA 110; identical to SEQ ID NO: 44336

SEQ ID NO: 71344 - DNA, 375 bp, Bordetella bronchiseptica RB50; identical to SEQ ID NO: 44337
  CDS (1)..(375): transl_table=11

SEQ ID NO: 71345 - protein, 124 aa, Bordetella bronchiseptica RB50; identical to SEQ ID NO: 44338

SEQ ID NO: 71346 - DNA, 378 bp, Erwinia carotovora subsp. atroseptica SCRI1043; identical to SEQ ID NO: 44339
  CDS (1)..(378)

SEQ ID NO: 71347 - protein, 125 aa, Erwinia carotovora subsp. atroseptica SCRI1043; identical to SEQ ID NO: 44340

SEQ ID NO: 71348 - DNA, 378 bp, Yersinia pseudotuberculosis IP 32953; identical to SEQ ID NO: 44341
  CDS (1)..(378): transl_table=11

SEQ ID NO: 71349 - protein, 125 aa, Yersinia pseudotuberculosis IP 32953; identical to SEQ ID NO: 44342

SEQ ID NO: 71350 - DNA, 381 bp, Methylococcus capsulatus str. Bath; identical to SEQ ID NO: 44343
  CDS (1)..(381): transl_table=11

SEQ ID NO: 71351 - protein, 126 aa, Methylococcus capsulatus str. Bath; identical to SEQ ID NO: 44344

SEQ ID NO: 71352 - DNA, 453 bp, Anaplasma marginale str. St. Maries; identical to SEQ ID NO: 44345
  CDS (1)..(453): transl_table=11

SEQ ID NO: 71353 - protein, 150 aa, Anaplasma marginale str. St. Maries; identical to SEQ ID NO: 44346

SEQ ID NO: 71354 - DNA, 375 bp, Idiomarina loihiensis L2TR; identical to SEQ ID NO: 44347
  CDS (1)..(375): transl_table=11

SEQ ID NO: 71355 - protein, 124 aa, Idiomarina loihiensis L2TR; identical to SEQ ID NO: 44348

SEQ ID NO: 71356 - DNA, 384 bp, Azoarcus sp. EbN1; identical to SEQ ID NO: 44349
  CDS (1)..(384): transl_table=11

SEQ ID NO: 71357 - protein, 127 aa, Azoarcus sp. EbN1; identical to SEQ ID NO: 44350

SEQ ID NO: 71358 - DNA, 405 bp, Ehrlichia ruminantium str. Welgevonden; identical to SEQ ID NO: 44351
  CDS (1)..(405): transl_table=11

SEQ ID NO: 71359 - protein, 134 aa, Ehrlichia ruminantium str. Welgevonden; identical to SEQ ID NO: 44352

SEQ ID NO: 71360 - DNA, 384 bp, Xylella fastidiosa Ann-1; identical to SEQ ID NO: 44353
  CDS (1)..(384)

SEQ ID NO: 71361 - protein, 127 aa, Xylella fastidiosa Ann-1; identical to SEQ ID NO: 44354

SEQ ID NO: 71362 - DNA, 393 bp, Magnetospirillum magnetotacticum MS-1; identical to SEQ ID NO: 44355
  CDS (1)..(393)

SEQ ID NO: 71363 - protein, 130 aa, Magnetospirillum magnetotacticum MS-1; identical to SEQ ID NO: 44356

SEQ ID NO: 71364 - DNA, 393 bp, Magnetospirillum magnetotacticum MS-1; identical to SEQ ID NO: 44357
  CDS (1)..(393)

SEQ ID NO: 71365 - protein, 130 aa, Magnetospirillum magnetotacticum MS-1; identical to SEQ ID NO: 44358

SEQ ID NO: 71366 - DNA, 381 bp, Azotobacter vinelandii; identical to SEQ ID NO: 44359
  CDS (1)..(381)

SEQ ID NO: 71367 - protein, 126 aa, Azotobacter vinelandii; identical to SEQ ID NO: 44360

SEQ ID NO: 71368 - DNA, 384 bp, Desulfitobacterium hafniense DCB-2; identical to SEQ ID NO: 44361
  CDS (1)..(384)

SEQ ID NO: 71369 - protein, 127 aa, Desulfitobacterium hafniense DCB-2; identical to SEQ ID NO: 44362

SEQ ID NO: 71370 - DNA, 384 bp, Methylobacillus flagellatus KT; identical to SEQ ID NO: 44363
  CDS (1)..(384)

SEQ ID NO: 71371 - protein, 127 aa, Methylobacillus flagellatus KT; identical to SEQ ID NO: 44364

SEQ ID NO: 71372 - DNA, 393 bp, Mesorhizobium sp. BNC1; identical to SEQ ID NO: 44365
  CDS (1)..(393)

SEQ ID NO: 71373 - protein, 130 aa, Mesorhizobium sp. BNC1; identical to SEQ ID NO: 44366

SEQ ID NO: 71374 - DNA, 384 bp, Ehrlichia canis str. Jake; identical to SEQ ID NO: 44367
  CDS (1)..(384)

SEQ ID NO: 71375 - protein, 127 aa, Ehrlichia canis str. Jake; identical to SEQ ID NO: 44368

SEQ ID NO: 71376 - DNA, 375 bp, Rubrivivax gelatinosus PM1; identical to SEQ ID NO: 44369
  CDS (1)..(375)

SEQ ID NO: 71377 - protein, 124 aa, Rubrivivax gelatinosus PM1; identical to SEQ ID NO: 44370

SEQ ID NO: 71378 - DNA, 381 bp, Pseudomonas fluorescens PfO-1; identical to SEQ ID NO: 44371
  CDS (1)..(381)

SEQ ID NO: 71379 - protein, 126 aa, Pseudomonas fluorescens PfO-1; identical to SEQ ID NO: 44372

SEQ ID NO: 71380 - DNA, 408 bp, Rhodospirillum rubrum; identical to SEQ ID NO: 44373
  CDS (1)..(408)

SEQ ID NO: 71381 - protein, 135 aa, Rhodospirillum rubrum; identical to SEQ ID NO: 44374

SEQ ID NO: 71382 - DNA, 375 bp, Ralstonia metallidurans CH34; identical to SEQ ID NO: 44375
  CDS (1)..(375)

SEQ ID NO: 71383 - protein, 124 aa, Ralstonia metallidurans CH34; identical to SEQ ID NO: 44376

SEQ ID NO: 71384 - DNA, 375 bp, Burkholderia fungorum LB400; identical to SEQ ID NO: 44377
  CDS (1)..(375)

SEQ ID NO: 71385 - protein, 124 aa, Burkholderia fungorum LB400; identical to SEQ ID NO: 44378

SEQ ID NO: 71386 - DNA, 381 bp, Magnetococcus sp. MC-1; identical to SEQ ID NO: 44379
  CDS (1)..(381)

SEQ ID NO: 71387 - protein, 126 aa, Magnetococcus sp. MC-1; identical to SEQ ID NO: 44380

SEQ ID NO: 71388 - DNA, 399 bp, Novosphingobium aromaticivorans DSM 12444; identical to SEQ ID NO: 44381
  CDS (1)..(399)

SEQ ID NO: 71389 - protein, 132 aa, Novosphingobium aromaticivorans DSM 12444; identical to SEQ ID NO: 44382

SEQ ID NO: 71390 - DNA, 387 bp, Cytophaga hutchinsonii; identical to SEQ ID NO: 44383
  CDS (1)..(387)

SEQ ID NO: 71391 - protein, 128 aa, Cytophaga hutchinsonii; identical to SEQ ID NO: 44384

SEQ ID NO: 71392 - DNA, 372 bp, Microbulbifer degradans 2-40; identical to SEQ ID NO: 44385
  CDS (1)..(372)

SEQ ID NO: 71393 - protein, 123 aa, Microbulbifer degradans 2-40; identical to SEQ ID NO: 44386

SEQ ID NO: 71394 - DNA, 384 bp, Thiobacillus denitrificans ATCC 25259; identical to SEQ ID NO: 44387
  CDS (1)..(384)

SEQ ID NO: 71395 - protein, 127 aa, Thiobacillus denitrificans ATCC 25259; identical to SEQ ID NO: 44388

SEQ ID NO: 71396 - DNA, 384 bp, Dechloromonas aromatica RCB; identical to SEQ ID NO: 44389
  CDS (1)..(384)

SEQ ID NO: 71397 - protein, 127 aa, Dechloromonas aromatica RCB; identical to SEQ ID NO: 44390

SEQ ID NO: 71398 - DNA, 414 bp, Chloroflexus aurantiacus; identical to SEQ ID NO: 44391
  CDS (1)..(414)

SEQ ID NO: 71399 - protein, 137 aa, Chloroflexus aurantiacus; identical to SEQ ID NO: 44392

SEQ ID NO: 71400 - DNA, 396 bp, Polaromonas sp. JS666; identical to SEQ ID NO: 44393
  CDS (1)..(396)

SEQ ID NO: 71401 - protein, 131 aa, Polaromonas sp. JS666; identical to SEQ ID NO: 44394

SEQ ID NO: 71402 - DNA, 903 bp, Oryza sativa; identical to SEQ ID NO: 44395
  CDS (1)..(903)

SEQ ID NO: 71403 - protein, 300 aa, Oryza sativa; identical to SEQ ID NO: 44396

SEQ ID NO: 71404 - DNA, 384 bp, Bdellovibrio bacteriovorus; identical to SEQ ID NO: 44397
  CDS (1)..(384)

SEQ ID NO: 71405 - protein, 127 aa, Bdellovibrio bacteriovorus; identical to SEQ ID NO: 44398

SEQ ID NO: 71406 - DNA, 393 bp, Brucella suis; identical to SEQ ID NO: 44399
  CDS (1)..(393)

SEQ ID NO: 71407 - protein, 130 aa, Brucella suis; identical to SEQ ID NO: 44400

SEQ ID NO: 71408 - DNA, 381 bp, Chromobacterium violaceum; identical to SEQ ID NO: 44401
  CDS (1)..(381): transl_table=11

SEQ ID NO: 71409 - protein, 126 aa, Chromobacterium violaceum; identical to SEQ ID NO: 44402

SEQ ID NO: 71410 - DNA, 387 bp, Deinococcus radiodurans; identical to SEQ ID NO: 44403
  CDS (1)..(387): transl_table=11

SEQ ID NO: 71411 - protein, 128 aa, Deinococcus radiodurans; identical to SEQ ID NO: 44404

SEQ ID NO: 71412 - DNA, 384 bp, Nitrosomonas europaea; identical to SEQ ID NO: 44405
  CDS (1)..(384): transl_table=11

SEQ ID NO: 71413 - protein, 127 aa, Nitrosomonas europaea; identical to SEQ ID NO: 44406

SEQ ID NO: 71414 - DNA, 378 bp, Photorhabdus luminescens; identical to SEQ ID NO: 44407
  CDS (1)..(378): transl_table=11

SEQ ID NO: 71415 - protein, 125 aa, Photorhabdus luminescens; identical to SEQ ID NO: 44408

SEQ ID NO: 71416 - DNA, 384 bp, Photobacterium profundum; identical to SEQ ID NO: 44409
  CDS (1)..(384): transl_table=11

SEQ ID NO: 71417 - protein, 127 aa, Photobacterium profundum; identical to SEQ ID NO: 44410

SEQ ID NO: 71418 - DNA, 381 bp, Pseudomonas aeruginosa; identical to SEQ ID NO: 44411
  CDS (1)..(381): transl_table=11

SEQ ID NO: 71419 - protein, 126 aa, Pseudomonas aeruginosa; identical to SEQ ID NO: 44412

SEQ ID NO: 71420 - DNA, 375 bp, Ralstonia solanacearum; identical to SEQ ID NO: 44413
  CDS (1)..(375): transl_table=11

SEQ ID NO: 71421 - protein, 124 aa, Ralstonia solanacearum; identical to SEQ ID NO: 44414

SEQ ID NO: 71422 - DNA, 393 bp, Rhizobium etli; identical to SEQ ID NO: 44415
  CDS (1)..(393)

SEQ ID NO: 71423 - protein, 130 aa, Rhizobium etli; identical to SEQ ID NO: 44416

SEQ ID NO: 71424 - DNA, 393 bp, Rhizobium loti; identical to SEQ ID NO: 44417
  CDS (1)..(393)

SEQ ID NO: 71425 - protein, 130 aa, Rhizobium loti; identical to SEQ ID NO: 44418

SEQ ID NO: 71426 - DNA, 393 bp, Rhodopseudomonas palustris; identical to SEQ ID NO: 44419
  CDS (1)..(393): transl_table=11

SEQ ID NO: 71427 - protein, 130 aa, Rhodopseudomonas palustris; identical to SEQ ID NO: 44420

SEQ ID NO: 71428 - DNA, 378 bp, Salmonella typhi; identical to SEQ ID NO: 44421
  CDS (1)..(378): transl_table=11

SEQ ID NO: 71429 - protein, 125 aa, Salmonella typhi; identical to SEQ ID NO: 44422

SEQ ID NO: 71430 - DNA, 378 bp, Salmonella typhimurium; identical to SEQ ID NO: 44423
  CDS (1)..(378): transl_table=11

SEQ ID NO: 71431 - protein, 125 aa, Salmonella typhimurium; identical to SEQ ID NO: 44424

SEQ ID NO: 71432 - DNA, 381 bp, Shewanella oneidensis; identical to SEQ ID NO: 44425
  CDS (1)..(381): transl_table=11

SEQ ID NO: 71433 - protein, 126 aa, Shewanella oneidensis; identical to SEQ ID NO: 44426

SEQ ID NO: 71434 - DNA, 381 bp, Vibrio cholerae; identical to SEQ ID NO: 44427
  CDS (1)..(381): transl_table=11

SEQ ID NO: 71435 - protein, 126 aa, Vibrio cholerae; identical to SEQ ID NO: 44428

SEQ ID NO: 71436 - DNA, 381 bp, Vibrio parahaemolyticus; identical to SEQ ID NO: 44429
  CDS (1)..(381)

SEQ ID NO: 71437 - protein, 126 aa, Vibrio parahaemolyticus; identical to SEQ ID NO: 44430

SEQ ID NO: 71438 - DNA, 402 bp, Wolbachia pipientis wMel; identical to SEQ ID NO: 44431
  CDS (1)..(402): transl_table=11

SEQ ID NO: 71439 - protein, 133 aa, Wolbachia pipientis wMel; identical to SEQ ID NO: 44432

SEQ ID NO: 71440 - DNA, 384 bp, Xanthomonas campestris; identical to SEQ ID NO: 44433
  CDS (1)..(384): transl_table=11

SEQ ID NO: 71441 - protein, 127 aa, Xanthomonas campestris; identical to SEQ ID NO: 44434

SEQ ID NO: 71442 - DNA, 384 bp, Xylella fastidiosa; identical to SEQ ID NO: 44435
  CDS (1)..(384): transl_table=11

SEQ ID NO: 71443 - protein, 127 aa, Xylella fastidiosa; identical to SEQ ID NO: 44436

SEQ ID NO: 71444 - DNA, 23 bp, Primer
atgatcaattcgccccgagtgtg

SEQ ID NO: 71445 - DNA, 24 bp, Primer
ttaatgaatgagtgtgggaacggc

SEQ ID NO: 71446 - protein, 78 aa, consensus; identical to SEQ ID NO: 44439
  MISC_FEATURE (1)..(78): consensus for the disclosure of xaa see table XV

SEQ ID NO: 71447 - protein, 112 aa, consensus; identical to SEQ ID NO: 44440
  MISC_FEATURE (1)..(112): consensus for the disclosure of xaa see table XV

SEQ ID NO: 71448 - protein, 114 aa, consensus; identical to SEQ ID NO: 44441
  MISC_FEATURE (1)..(114): consensus for the disclosure of xaa see table XV

SEQ ID NO: 71449 - DNA, 1425 bp, Escherichia coli K12; identical to SEQ ID NO: 28717
  CDS (1)..(1425)

SEQ ID NO: 71450 - protein, 474 aa, Escherichia coli K12; identical to SEQ ID NO: 28718

SEQ ID NO: 71451 - DNA, 1401 bp, Haemophilus influenzae; identical to SEQ ID NO: 28719
  CDS (1)..(1401)

SEQ ID NO: 71452 - protein, 466 aa, Haemophilus influenzae; identical to SEQ ID NO: 28720

SEQ ID NO: 71453 - DNA, 1350 bp, Bacillus subtilis; identical to SEQ ID NO: 28721
  CDS (1)..(1350)

SEQ ID NO: 71454 - protein, 449 aa, Bacillus subtilis; identical to SEQ ID NO: 28722

SEQ ID NO: 71455 - DNA, 1545 bp, Xylella fastidiosa; identical to SEQ ID NO: 28723
  CDS (1)..(1545)

SEQ ID NO: 71456 - protein, 514 aa, Xylella fastidiosa; identical to SEQ ID NO: 28724

SEQ ID NO: 71457 - DNA, 1251 bp, Nostoc sp. PCC 7120; identical to SEQ ID NO: 28725
  CDS (1)..(1251)

SEQ ID NO: 71458 - protein, 416 aa, Nostoc sp. PCC 7120; identical to SEQ ID NO: 28726

SEQ ID NO: 71459 - DNA, 1428 bp, Salmonella enterica subsp. enterica serovar Typhi; identical to SEQ ID NO: 28727
  CDS (1)..(1428)

SEQ ID NO: 71460 - protein, 475 aa, Salmonella enterica subsp. enterica serovar Typhi; identical to SEQ ID NO: 28728

SEQ ID NO: 71461 - DNA, 1290 bp, Nostoc sp. PCC 7120; identical to SEQ ID NO: 28729
  CDS (1)..(1290)

SEQ ID NO: 71462 - protein, 429 aa, Nostoc sp. PCC 7120; identical to SEQ ID NO: 28730

SEQ ID NO: 71463 - DNA, 1206 bp, Nostoc sp. PCC 7120; identical to SEQ ID NO: 28731
  CDS (1)..(1206)

SEQ ID NO: 71464 - protein, 401 aa, Nostoc sp. PCC 7120; identical to SEQ ID NO: 28732

SEQ ID NO: 71465 - DNA, 1545 bp, Agrobacterium tumefaciens; identical to SEQ ID NO: 28733
  CDS (1)..(1545)

SEQ ID NO: 71466 - protein, 514 aa, Agrobacterium tumefaciens; identical to SEQ ID NO: 28734

SEQ ID NO: 71467 - DNA, 1446 bp, Yersinia pestis; identical to SEQ ID NO: 28735
  CDS (1)..(1446)

SEQ ID NO: 71468 - protein, 481 aa, Yersinia pestis; identical to SEQ ID NO: 28736

SEQ ID NO: 71469 - DNA, 1572 bp, Agrobacterium tumefaciens; identical to SEQ ID NO: 28737
  CDS (1)..(1572)

SEQ ID NO: 71470 - protein, 523 aa, Agrobacterium tumefaciens; identical to SEQ ID NO: 28738

SEQ ID NO: 71471 - DNA, 1407 bp, Agrobacterium tumefaciens; identical to SEQ ID NO: 28739
  CDS (1)..(1407)

SEQ ID NO: 71472 - protein, 468 aa, Agrobacterium tumefaciens; identical to SEQ ID NO: 28740

SEQ ID NO: 71473 - DNA, 1425 bp, Brucella melitensis; identical to SEQ ID NO: 28741
  CDS (1)..(1425)

SEQ ID NO: 71474 - protein, 474 aa, Brucella melitensis; identical to SEQ ID NO: 28742

SEQ ID NO: 71475 - DNA, 1362 bp, Aquifex aeolicus; identical to SEQ ID NO: 28743
  CDS (1)..(1362)

SEQ ID NO: 71476 - protein, 453 aa, Aquifex aeolicus; identical to SEQ ID NO: 28744

SEQ ID NO: 71477 - DNA, 1500 bp, Neisseria meningitidis; identical to SEQ ID NO: 28745
  CDS (1)..(1500)

SEQ ID NO: 71478 - protein, 499 aa, Neisseria meningitidis; identical to SEQ ID NO: 28746

SEQ ID NO: 71479 - DNA, 1170 bp, Pseudomonas aeruginosa; identical to SEQ ID NO: 28747
  CDS (1)..(1170)

SEQ ID NO: 71480 - protein, 389 aa, Pseudomonas aeruginosa; identical to SEQ ID NO: 28748

SEQ ID NO: 71481 - DNA, 1407 bp, Sinorhizobium meliloti; identical to SEQ ID NO: 28749
  CDS (1)..(1407)

SEQ ID NO: 71482 - protein, 468 aa, Sinorhizobium meliloti; identical to SEQ ID NO: 28750

SEQ ID NO: 71483 - DNA, 1332 bp, Helicobacter pylori; identical to SEQ ID NO: 28751
  CDS (1)..(1332)

SEQ ID NO: 71484 - protein, 443 aa, Helicobacter pylori; identical to SEQ ID NO: 28752

SEQ ID NO: 71485 - DNA, 1419 bp, Caulobacter crescentus; identical to SEQ ID NO: 28753
  CDS (1)..(1419)

SEQ ID NO: 71486 - protein, 472 aa, Caulobacter crescentus; identical to SEQ ID NO: 28754

SEQ ID NO: 71487 - DNA, 1446 bp, Xylella fastidiosa; identical to SEQ ID NO: 28755
  CDS (1)..(1446)

SEQ ID NO: 71488 - protein, 481 aa, Xylella fastidiosa; identical to SEQ ID NO: 28756

SEQ ID NO: 71489 - DNA, 1458 bp, Treponema pallidum subsp. pallidum (syphilis spirochete); identical to SEQ ID NO: 28757
  CDS (1)..(1458)

SEQ ID NO: 71490 - protein, 485 aa, Treponema pallidum subsp. pallidum (syphilis spirochete); identical to SEQ ID NO: 28758

SEQ ID NO: 71491 - DNA, 1380 bp, Thermotoga maritima; identical to SEQ ID NO: 28759
  CDS (1)..(1380)

SEQ ID NO: 71492 - protein, 459 aa, Thermotoga maritima; identical to SEQ ID NO: 28760

SEQ ID NO: 71493 - DNA, 1371 bp, Vibrio cholerae; identical to SEQ ID NO: 28761
  CDS (1)..(1371)

SEQ ID NO: 71494 - protein, 456 aa, Vibrio cholerae; identical to SEQ ID NO: 28762

SEQ ID NO: 71495 - DNA, 1961 bp, Pseudomonas aeruginosa; identical to SEQ ID NO: 28763
  CDS (496)..(1920)

SEQ ID NO: 71496 - protein, 474 aa, Pseudomonas aeruginosa; identical to SEQ ID NO: 28764

SEQ ID NO: 71497 - DNA, 1593 bp, Caulobacter crescentus; identical to SEQ ID NO: 28765
  CDS (1)..(1593)

SEQ ID NO: 71498 - protein, 530 aa, Caulobacter crescentus; identical to SEQ ID NO: 28766

SEQ ID NO: 71499 - DNA, 1536 bp, Rickettsia conorii; identical to SEQ ID NO: 28767
  CDS (1)..(1536)

SEQ ID NO: 71500 - protein, 511 aa, Rickettsia conorii; identical to SEQ ID NO: 28768

SEQ ID NO: 71501 - DNA, 1452 bp, Borrelia burgdorferi (Lyme disease spirochete); identical to SEQ ID NO: 28769
  CDS (1)..(1452)

SEQ ID NO: 71502 - protein, 483 aa, Borrelia burgdorferi (Lyme disease spirochete); identical to SEQ ID NO: 28770

SEQ ID NO: 71503 - DNA, 1494 bp, Chlamydia trachomatis; identical to SEQ ID NO: 28771
  CDS (1)..(1494)

SEQ ID NO: 71504 - protein, 497 aa, Chlamydia trachomatis; identical to SEQ ID NO: 28772

SEQ ID NO: 71505 - DNA, 1431 bp, Helicobacter pylori; identical to SEQ ID NO: 28773
  CDS (1)..(1431)

SEQ ID NO: 71506 - protein, 476 aa, Helicobacter pylori; identical to SEQ ID NO: 28774

SEQ ID NO: 71507 - DNA, 1302 bp, Clostridium acetobutylicum; identical to SEQ ID NO: 28775
  CDS (1)..(1302)

SEQ ID NO: 71508 - protein, 433 aa, Clostridium acetobutylicum; identical to SEQ ID NO: 28776

SEQ ID NO: 71509 - DNA, 2009 bp, Brucella abortus; identical to SEQ ID NO: 28777
  CDS (275)..(1816)

SEQ ID NO: 71510 - protein, 513 aa, Brucella abortus; identical to SEQ ID NO: 28778

SEQ ID NO: 71511 - DNA, 1185 bp, Synechocystis sp; identical to SEQ ID NO: 28779
  CDS (1)..(1185)

SEQ ID NO: 71512 - protein, 394 aa, Synechocystis sp; identical to SEQ ID NO: 28780

SEQ ID NO: 71513 - DNA, 1251 bp, Synechocystis sp; identical to SEQ ID NO: 28781
  CDS (1)..(1251)

SEQ ID NO: 71514 - protein, 416 aa, Synechocystis sp; identical to SEQ ID NO: 28782

SEQ ID NO: 71515 - DNA, 1359 bp, Synechocystis sp; identical to SEQ ID NO: 28783
  CDS (1)..(1359)

SEQ ID NO: 71516 - protein, 452 aa, Synechocystis sp; identical to SEQ ID NO: 28784

SEQ ID NO: 71517 - DNA, 1740 bp, Lactococcus lactis; identical to SEQ ID NO: 28785
  CDS (230)..(1456)

SEQ ID NO: 71518 - protein, 408 aa, Lactococcus lactis; identical to SEQ ID NO: 28786

SEQ ID NO: 71519 - DNA, 1383 bp, Rhodobacter capsulatus; identical to SEQ ID NO: 28787
  CDS (1)..(1383)

SEQ ID NO: 71520 - protein, 460 aa, Rhodobacter capsulatus; identical to SEQ ID NO: 28788

SEQ ID NO: 71521 - DNA, 1392 bp, Haemophilus influenzae; identical to SEQ ID NO: 28789
  CDS (1)..(1392)

SEQ ID NO: 71522 - protein, 463 aa, Haemophilus influenzae; identical to SEQ ID NO: 28790

SEQ ID NO: 71523 - DNA, 1800 bp, Yersinia enterocolitica; identical to SEQ ID NO: 28791
  CDS (244)..(1680)

SEQ ID NO: 71524 - protein, 478 aa, Yersinia enterocolitica; identical to SEQ ID NO: 28792

SEQ ID NO: 71525 - DNA, 2027 bp, Azotobacter vinelandii; identical to SEQ ID NO: 28793
  CDS (483)..(1904)

SEQ ID NO: 71526 - protein, 473 aa, Azotobacter vinelandii; identical to SEQ ID NO: 28794

SEQ ID NO: 71527 - DNA, 1905 bp, Brucella abortus; identical to SEQ ID NO: 28795
  CDS (333)..(1835)

SEQ ID NO: 71528 - protein, 500 aa, Brucella abortus; identical to SEQ ID NO: 28796

SEQ ID NO: 71529 - DNA, 1466 bp, Campylobacter jejuni; identical to SEQ ID NO: 28797
  CDS (48)..(1466)

SEQ ID NO: 71530 - protein, 472 aa, Campylobacter jejuni; identical to SEQ ID NO: 28798

SEQ ID NO: 71531 - DNA, 1191 bp, Pseudomonas aeruginosa; identical to SEQ ID NO: 28799
  CDS (14)..(1183)

SEQ ID NO: 71532 - protein, 389 aa, Pseudomonas aeruginosa; identical to SEQ ID NO: 28800

SEQ ID NO: 71533 - DNA, 1488 bp, Burkholderia mallei ATCC 23344; identical to SEQ ID NO: 28801
  CDS (1)..(1488)

SEQ ID NO: 71534 - protein, 495 aa, Burkholderia mallei ATCC 23344; identical to SEQ ID NO: 28802

SEQ ID NO: 71535 - DNA, 1209 bp, Burkholderia pseudomallei K96243; identical to SEQ ID NO: 28803
  CDS (1)..(1209)

SEQ ID NO: 71536 - protein, 402 aa, Burkholderia pseudomallei K96243; identical to SEQ ID NO: 28804

SEQ ID NO: 71537 - DNA, 1458 bp, Burkholderia pseudomallei K96243; identical to SEQ ID NO: 28805
  CDS (1)..(1458)

SEQ ID NO: 71538 - protein, 485 aa, Burkholderia pseudomallei K96243; identical to SEQ ID NO: 28806

SEQ ID NO: 71539 - DNA, 1557 bp, Burkholderia pseudomallei K96243; identical to SEQ ID NO: 28807
  CDS (1)..(1557)

SEQ ID NO: 71540 - protein, 518 aa, Burkholderia pseudomallei K96243; identical to SEQ ID NO: 28808

SEQ ID NO: 71541 - DNA, 1419 bp, Burkholderia pseudomallei K96243; identical to SEQ ID NO: 28809
  CDS (1)..(1419)

SEQ ID NO: 71542 - protein, 472 aa, Burkholderia pseudomallei K96243; identical to SEQ ID NO: 28810

SEQ ID NO: 71543 - DNA, 1566 bp, Bacteroides fragilis; identical to SEQ ID NO: 28811
  CDS (19)..(1566)

SEQ ID NO: 71544 - protein, 515 aa, Bacteroides fragilis; identical to SEQ ID NO: 28812

SEQ ID NO: 71545 - DNA, 2358 bp, Bacillus licheniformis DSM 13; identical to SEQ ID NO: 28813
  CDS (501)..(1871)

SEQ ID NO: 71546 - protein, 456 aa, Bacillus licheniformis DSM 13; identical to SEQ ID NO: 28814

SEQ ID NO: 71547 - DNA, 1470 bp, Mannheimia succiniciproducens MBEL55E; identical to SEQ ID NO: 28815
  CDS (1)..(1470)

SEQ ID NO: 71548 - protein, 489 aa, Mannheimia succiniciproducens MBEL55E; identical to SEQ ID NO: 28816

SEQ ID NO: 71549 - DNA, 1425 bp, Borrelia garinii PBi; identical to SEQ ID NO: 28817
  CDS (1)..(1425)

SEQ ID NO: 71550 - protein, 474 aa, Borrelia garinii PBi; identical to SEQ ID NO: 28818

SEQ ID NO: 71551 - DNA, 1224 bp, Lactococcus lactis; identical to SEQ ID NO: 28819
  CDS (1)..(1224)

SEQ ID NO: 71552 - protein, 407 aa, Lactococcus lactis; identical to SEQ ID NO: 28820

SEQ ID NO: 71553 - DNA, 1557 bp, Rickettsia typhi; identical to SEQ ID NO: 28821
  CDS (1)..(1557)

SEQ ID NO: 71554 - protein, 518 aa, Rickettsia typhi; identical to SEQ ID NO: 28822

SEQ ID NO: 71555 - DNA, 1485 bp, Onchocerca volvulus endobacterium; identical to SEQ ID NO: 28823
  CDS (1)..(1485)

SEQ ID NO: 71556 - protein, 494 aa, Onchocerca volvulus endobacterium; identical to SEQ ID NO: 28824

SEQ ID NO: 71557 - DNA, 1455 bp, Desulfotalea psychrophila; identical to SEQ ID NO: 28825
  CDS (1)..(1455)

SEQ ID NO: 71558 - protein, 484 aa, Desulfotalea psychrophila; identical to SEQ ID NO: 28826

SEQ ID NO: 71559 - DNA, 1467 bp, Erwinia carotovora; identical to SEQ ID NO: 28827
  CDS (1)..(1467)

SEQ ID NO: 71560 - protein, 488 aa, Erwinia carotovora; identical to SEQ ID NO: 28828

SEQ ID NO: 71561 - DNA, 1371 bp, Erwinia carotovora; identical to SEQ ID NO: 28829
  CDS (1)..(1371)

SEQ ID NO: 71562 - protein, 456 aa, Erwinia carotovora; identical to SEQ ID NO: 28830

SEQ ID NO: 71563 - DNA, 1404 bp, Acinetobacter sp; identical to SEQ ID NO: 28831
  CDS (1)..(1404)

SEQ ID NO: 71564 - protein, 467 aa, Acinetobacter sp; identical to SEQ ID NO: 28832

SEQ ID NO: 71565 - DNA, 1518 bp, Bartonella quintana; identical to SEQ ID NO: 28833
  CDS (1)..(1518)

SEQ ID NO: 71566 - protein, 505 aa, Bartonella quintana; identical to SEQ ID NO: 28834

SEQ ID NO: 71567 - DNA, 1395 bp, Bartonella quintana; identical to SEQ ID NO: 28835
  CDS (1)..(1395)

SEQ ID NO: 71568 - protein, 464 aa, Bartonella quintana; identical to SEQ ID NO: 28836

SEQ ID NO: 71569 - DNA, 1512 bp, Bartonella quintana; identical to SEQ ID NO: 28837
  CDS (1)..(1512)

SEQ ID NO: 71570 - protein, 503 aa, Bartonella quintana; identical to SEQ ID NO: 28838

SEQ ID NO: 71571 - DNA, 1518 bp, Bartonella henselae; identical to SEQ ID NO: 28839
  CDS (1)..(1518)

SEQ ID NO: 71572 - protein, 505 aa, Bartonella henselae; identical to SEQ ID NO: 28840

SEQ ID NO: 71573 - DNA, 1392 bp, Bartonella henselae; identical to SEQ ID NO: 28841
  CDS (1)..(1392)

SEQ ID NO: 71574 - protein, 463 aa, Bartonella henselae; identical to SEQ ID NO: 28842

SEQ ID NO: 71575 - DNA, 1368 bp, Photobacterium profundum; identical to SEQ ID NO: 28843
  CDS (1)..(1368)

SEQ ID NO: 71576 - protein, 455 aa, Photobacterium profundum; identical to SEQ ID NO: 28844

SEQ ID NO: 71577 - DNA, 1455 bp, Parachlamydia sp; identical to SEQ ID NO: 28845
  CDS (1)..(1455)

SEQ ID NO: 71578 - protein, 484 aa, Parachlamydia sp; identical to SEQ ID NO: 28846

SEQ ID NO: 71579 - DNA, 1563 bp, Rhodopseudomonas palustris; identical to SEQ ID NO: 28847
  CDS (1)..(1563)

SEQ ID NO: 71580 - protein, 520 aa, Rhodopseudomonas palustris; identical to SEQ ID NO: 28848

SEQ ID NO: 71581 - DNA, 1506 bp, Rhodopseudomonas palustris; identical to SEQ ID NO: 28849
  CDS (1)..(1506)

SEQ ID NO: 71582 - protein, 501 aa, Rhodopseudomonas palustris; identical to SEQ ID NO: 28850

SEQ ID NO: 71583 - DNA, 1200 bp, Rhodopseudomonas palustris; identical to SEQ ID NO: 28851
  CDS (1)..(1200)

SEQ ID NO: 71584 - protein, 399 aa, Rhodopseudomonas palustris; identical to SEQ ID NO: 28852

SEQ ID NO: 71585 - DNA, 1392 bp, Rhodopseudomonas palustris; identical to SEQ ID NO: 28853
  CDS (1)..(1392)

SEQ ID NO: 71586 - protein, 463 aa, Rhodopseudomonas palustris; identical to SEQ ID NO: 28854

SEQ ID NO: 71587 - DNA, 1572 bp, Rhodopseudomonas palustris; identical to SEQ ID NO: 28855
  CDS (1)..(1572)

SEQ ID NO: 71588 - protein, 523 aa, Rhodopseudomonas palustris; identical to SEQ ID NO: 28856

SEQ ID NO: 71589 - DNA, 1401 bp, uncultured bacterium 580; identical to SEQ ID NO: 28857
  CDS (1)..(1401)

SEQ ID NO: 71590 - protein, 466 aa, uncultured bacterium 580; identical to SEQ ID NO: 28858

SEQ ID NO: 71591 - DNA, 1476 bp, uncultured bacterium 106; identical to SEQ ID NO: 28859
  CDS (1)..(1476)

SEQ ID NO: 71592 - protein, 491 aa, uncultured bacterium 106; identical to SEQ ID NO: 28860

SEQ ID NO: 71593 - DNA, 1143 bp, uncultured bacterium 105; identical to SEQ ID NO: 28861
  CDS (1)..(1143)

SEQ ID NO: 71594 - protein, 380 aa, uncultured bacterium 105; identical to SEQ ID NO: 28862

SEQ ID NO: 71595 - DNA, 1395 bp, Rhizobium sp; identical to SEQ ID NO: 28863
  CDS (1)..(1395)

SEQ ID NO: 71596 - protein, 464 aa, Rhizobium sp; identical to SEQ ID NO: 28864

SEQ ID NO: 71597 - DNA, 1449 bp, Desulfovibrio vulgaris; identical to SEQ ID NO: 28865
  CDS (1)..(1449)

SEQ ID NO: 71598 - protein, 482 aa, Desulfovibrio vulgaris; identical to SEQ ID NO: 28866

SEQ ID NO: 71599 - DNA, 1167 bp, Leptospira interrogans; identical to SEQ ID NO: 28867
  CDS (1)..(1167)

SEQ ID NO: 71600 - protein, 388 aa, Leptospira interrogans; identical to SEQ ID NO: 28868

SEQ ID NO: 71601 - DNA, 1494 bp, Wolbachia pipientis wMel; identical to SEQ ID NO: 28869
  CDS (1)..(1494)

SEQ ID NO: 71602 - protein, 497 aa, Wolbachia pipientis wMel; identical to SEQ ID NO: 28870

SEQ ID NO: 71603 - DNA, 1482 bp, Treponema denticola; identical to SEQ ID NO: 28871
  CDS (1)..(1482)

SEQ ID NO: 71604 - protein, 493 aa, Treponema denticola; identical to SEQ ID NO: 28872

SEQ ID NO: 71605 - DNA, 1395 bp, Geobacter sulfurreducens; identical to SEQ ID NO: 28873
  CDS (1)..(1395)

SEQ ID NO: 71606 - protein, 464 aa, Geobacter sulfurreducens; identical to SEQ ID NO: 28874

SEQ ID NO: 71607 - DNA, 1416 bp, Geobacter sulfurreducens; identical to SEQ ID NO: 28875
  CDS (1)..(1416)

SEQ ID NO: 71608 - protein, 471 aa, Geobacter sulfurreducens; identical to SEQ ID NO: 28876

SEQ ID NO: 71609 - DNA, 1221 bp, Lactobacillus johnsonii; identical to SEQ ID NO: 28877
  CDS (1)..(1221)

SEQ ID NO: 71610 - protein, 406 aa, Lactobacillus johnsonii; identical to SEQ ID NO: 28878

SEQ ID NO: 71611 - DNA, 1425 bp, Wolinella succinogenes; identical to SEQ ID NO: 28879
  CDS (1)..(1425)

SEQ ID NO: 71612 - protein, 474 aa, Wolinella succinogenes; identical to SEQ ID NO: 28880

SEQ ID NO: 71613 - DNA, 1368 bp, Vibrio vulnificus; identical to SEQ ID NO: 28881
  CDS (1)..(1368)

SEQ ID NO: 71614 - protein, 455 aa, Vibrio vulnificus; identical to SEQ ID NO: 28882

SEQ ID NO: 71615 - DNA, 1497 bp, Porphyromonas gingivalis; identical to SEQ ID NO: 28883
  CDS (1)..(1497)

SEQ ID NO: 71616 - protein, 498 aa, Porphyromonas gingivalis; identical to SEQ ID NO: 28884

SEQ ID NO: 71617 - DNA, 1320 bp, Gloeobacter violaceus; identical to SEQ ID NO: 28885
  CDS (1)..(1320)

SEQ ID NO: 71618 - protein, 439 aa, Gloeobacter violaceus; identical to SEQ ID NO: 28886

SEQ ID NO: 71619 - DNA, 1467 bp, Chromobacterium violaceum; identical to SEQ ID NO: 28887
  CDS (1)..(1467)

SEQ ID NO: 71620 - protein, 488 aa, Chromobacterium violaceum; identical to SEQ ID NO: 28888

SEQ ID NO: 71621 - DNA, 1413 bp, Chromobacterium violaceum; identical to SEQ ID NO: 28889
  CDS (1)..(1413)

SEQ ID NO: 71622 - protein, 470 aa, Chromobacterium violaceum; identical to SEQ ID NO: 28890

SEQ ID NO: 71623 - DNA, 1158 bp, Prochlorococcus marinus; identical to SEQ ID NO: 28891
  CDS (1)..(1158)

SEQ ID NO: 71624 - protein, 385 aa, Prochlorococcus marinus; identical to SEQ ID NO: 28892

SEQ ID NO: 71625 - DNA, 1125 bp, Synechococcus sp; identical to SEQ ID NO: 28893
  CDS (1)..(1125)

SEQ ID NO: 71626 - protein, 374 aa, Synechococcus sp; identical to SEQ ID NO: 28894

SEQ ID NO: 71627 - DNA, 1299 bp, Synechococcus sp; identical to SEQ ID NO: 28895
  CDS (1)..(1299)

SEQ ID NO: 71628 - protein, 432 aa, Synechococcus sp; identical to SEQ ID NO: 28896

SEQ ID NO: 71629 - DNA, 1527 bp, Rhodopirellula baltica; identical to SEQ ID NO: 28897
  CDS (1)..(1527)

SEQ ID NO: 71630 - protein, 508 aa, Rhodopirellula baltica; identical to SEQ ID NO: 28898

SEQ ID NO: 71631 - DNA, 1530 bp, Rhodopirellula baltica; identical to SEQ ID NO: 28899
  CDS (1)..(1530)

SEQ ID NO: 71632 - protein, 509 aa, Rhodopirellula baltica; identical to SEQ ID NO: 28900

SEQ ID NO: 71633 - DNA, 1890 bp, Rhodopirellula baltica; identical to SEQ ID NO: 28901
  CDS (1)..(1890)

SEQ ID NO: 71634 - protein, 629 aa, Rhodopirellula baltica; identical to SEQ ID NO: 28902

SEQ ID NO: 71635 - DNA, 1188 bp, Prochlorococcus marinus; identical to SEQ ID NO: 28903
  CDS (1)..(1188)

SEQ ID NO: 71636 - protein, 395 aa, Prochlorococcus marinus; identical to SEQ ID NO: 28904

SEQ ID NO: 71637 - DNA, 1176 bp, Prochlorococcus marinus; identical to SEQ ID NO: 28905
  CDS (1)..(1176)

SEQ ID NO: 71638 - protein, 391 aa, Prochlorococcus marinus; identical to SEQ ID NO: 28906

SEQ ID NO: 71639 - DNA, 1434 bp, Helicobacter hepaticus; identical to SEQ ID NO: 28907
  CDS (1)..(1434)

SEQ ID NO: 71640 - protein, 477 aa, Helicobacter hepaticus; identical to SEQ ID NO: 28908

SEQ ID NO: 71641 - DNA, 1419 bp, Haemophilus ducreyi; identical to SEQ ID NO: 28909
  CDS (1)..(1419)

SEQ ID NO: 71642 - protein, 472 aa, Haemophilus ducreyi; identical to SEQ ID NO: 28910

SEQ ID NO: 71643 - DNA, 1386 bp, Candidatus Blochmannia floridanus; identical to SEQ ID NO: 28911
  CDS (1)..(1386)

SEQ ID NO: 71644 - protein, 461 aa, Candidatus Blochmannia floridanus; identical to SEQ ID NO: 28912

SEQ ID NO: 71645 - DNA, 1137 bp, Bordetella pertussis; identical to SEQ ID NO: 28913
  CDS (1)..(1137)

SEQ ID NO: 71646 - protein, 378 aa, Bordetella pertussis; identical to SEQ ID NO: 28914

SEQ ID NO: 71647 - DNA, 1116 bp, Bordetella parapertussis; identical to SEQ ID NO: 28915
  CDS (1)..(1116)

SEQ ID NO: 71648 - protein, 371 aa, Bordetella parapertussis; identical to SEQ ID NO: 28916

SEQ ID NO: 71649 - DNA, 1488 bp, Bordetella parapertussis; identical to SEQ ID NO: 28917
  CDS (1)..(1488)

SEQ ID NO: 71650 - protein, 495 aa, Bordetella parapertussis; identical to SEQ ID NO: 28918

SEQ ID NO: 71651 - DNA, 1467 bp, Chlamydophila caviae; identical to SEQ ID NO: 28919
  CDS (1)..(1467)

SEQ ID NO: 71652 - protein, 488 aa, Chlamydophila caviae; identical to SEQ ID NO: 28920

SEQ ID NO: 71653 - DNA, 1419 bp, Streptomyces avermitilis; identical to SEQ ID NO: 28921
  CDS (1)..(1419)

SEQ ID NO: 71654 - protein, 472 aa, Streptomyces avermitilis; identical to SEQ ID NO: 28922

SEQ ID NO: 71655 - DNA, 1491 bp, Nitrosomonas europaea; identical to SEQ ID NO: 28923
  CDS (1)..(1491)

SEQ ID NO: 71656 - protein, 496 aa, Nitrosomonas europaea; identical to SEQ ID NO: 28924

SEQ ID NO: 71657 - DNA, 1323 bp, Enterococcus faecalis; identical to SEQ ID NO: 28925
  CDS (25)..(1323)

SEQ ID NO: 71658 - protein, 432 aa, Enterococcus faecalis; identical to SEQ ID NO: 28926

SEQ ID NO: 71659 - DNA, 1356 bp, Coxiella burnetii; identical to SEQ ID NO: 28927
  CDS (1)..(1356)

SEQ ID NO: 71660 - protein, 451 aa, Coxiella burnetii; identical to SEQ ID NO: 28928

SEQ ID NO: 71661 - DNA, 1368 bp, Enterobacter cloacae; identical to SEQ ID NO: 28929
  CDS (1)..(1368)

SEQ ID NO: 71662 - protein, 455 aa, Enterobacter cloacae; identical to SEQ ID NO: 28930

SEQ ID NO: 71663 - DNA, 1545 bp, Xylella fastidiosa; identical to SEQ ID NO: 28931
  CDS (1)..(1545)

SEQ ID NO: 71664 - protein, 514 aa, Xylella fastidiosa; identical to SEQ ID NO: 28932

SEQ ID NO: 71665 - DNA, 1377 bp, Xylella fastidiosa; identical to SEQ ID NO: 28933
  CDS (1)..(1377)

SEQ ID NO: 71666 - protein, 458 aa, Xylella fastidiosa; identical to SEQ ID NO: 28934

SEQ ID NO: 71667 - DNA, 1368 bp, Vibrio parahaemolyticus; identical to SEQ ID NO: 28935
  CDS (1)..(1368)

SEQ ID NO: 71668 - protein, 455 aa, Vibrio parahaemolyticus; identical to SEQ ID NO: 28936

SEQ ID NO: 71669 - DNA, 1161 bp, Pseudomonas syringae; identical to SEQ ID NO: 28937
  CDS (1)..(1161)

SEQ ID NO: 71670 - protein, 386 aa, Pseudomonas syringae; identical to SEQ ID NO: 28938

SEQ ID NO: 71671 - DNA, 1440 bp, Pseudomonas syringae; identical to SEQ ID NO: 28939
  CDS (1)..(1440)

SEQ ID NO: 71672 - protein, 479 aa, Pseudomonas syringae; identical to SEQ ID NO: 28940

SEQ ID NO: 71673 - DNA, 1479 bp, Pseudomonas putida; identical to SEQ ID NO: 28941
  CDS (1)..(1479)

SEQ ID NO: 71674 - protein, 492 aa, Pseudomonas putida; identical to SEQ ID NO: 28942

SEQ ID NO: 71675 - DNA, 1524 bp, Bradyrhizobium japonicum; identical to SEQ ID NO: 28943
  CDS (1)..(1524)

SEQ ID NO: 71676 - protein, 507 aa, Bradyrhizobium japonicum; identical to SEQ ID NO: 28944

SEQ ID NO: 71677 - DNA, 1272 bp, Bradyrhizobium japonicum; identical to SEQ ID NO: 28945
  CDS (1)..(1272)

SEQ ID NO: 71678 - protein, 423 aa, Bradyrhizobium japonicum; identical to SEQ ID NO: 28946

SEQ ID NO: 71679 - DNA, 1578 bp, Bradyrhizobium japonicum; identical to SEQ ID NO: 28947
  CDS (1)..(1578)

SEQ ID NO: 71680 - protein, 525 aa, Bradyrhizobium japonicum; identical to SEQ ID NO: 28948

SEQ ID NO: 71681 - DNA, 1587 bp, Bradyrhizobium japonicum; identical to SEQ ID NO: 28949
  CDS (1)..(1587)

SEQ ID NO: 71682 - protein, 528 aa, Bradyrhizobium japonicum; identical to SEQ ID NO: 28950

SEQ ID NO: 71683 - DNA, 1536 bp, Bacteroides thetaiotaomicron; identical to SEQ ID NO: 28951
  CDS (1)..(1536)

SEQ ID NO: 71684 - protein, 511 aa, Bacteroides thetaiotaomicron; identical to SEQ ID NO: 28952

SEQ ID NO: 71685 - DNA, 1410 bp, Escherichia coli O6; identical to SEQ ID NO: 28953
  CDS (1)..(1410)

SEQ ID NO: 71686 - protein, 469 aa, Escherichia coli O6; identical to SEQ ID NO: 28954

SEQ ID NO: 71687 - DNA, 1392 bp, Yersinia pestis; identical to SEQ ID NO: 28955
  CDS (1)..(1392)

SEQ ID NO: 71688 - protein, 463 aa, Yersinia pestis; identical to SEQ ID NO: 28956

SEQ ID NO: 71689 - DNA, 1374 bp, Wigglesworthia glossinidia brevipalpis; identical to SEQ ID NO: 28957
  CDS (1)..(1374)

SEQ ID NO: 71690 - protein, 457 aa, Wigglesworthia glossinidia brevipalpis; identical to SEQ ID NO: 28958

SEQ ID NO: 71691 - DNA, 1128 bp, Synechococcus elongatus; identical to SEQ ID NO: 28959
  CDS (1)..(1128)

SEQ ID NO: 71692 - protein, 375 aa, Synechococcus elongatus; identical to SEQ ID NO: 28960

SEQ ID NO: 71693 - DNA, 1170 bp, Synechococcus elongatus; identical to SEQ ID NO: 28961
  CDS (1)..(1170)

SEQ ID NO: 71694 - protein, 389 aa, Synechococcus elongatus; identical to SEQ ID NO: 28962

SEQ ID NO: 71695 - DNA, 1353 bp, Shewanella oneidensis; identical to SEQ ID NO: 28963
  CDS (1)..(1353)

SEQ ID NO: 71696 - protein, 450 aa, Shewanella oneidensis; identical to SEQ ID NO: 28964

SEQ ID NO: 71697 - DNA, 1518 bp, Chlorobium tepidum; identical to SEQ ID NO: 28965
  CDS (1)..(1518)

SEQ ID NO: 71698 - protein, 505 aa, Chlorobium tepidum; identical to SEQ ID NO: 28966

SEQ ID NO: 71699 - DNA, 1461 bp, Rhizobium etli; identical to SEQ ID NO: 28967
  CDS (1)..(1461)

SEQ ID NO: 71700 - protein, 486 aa, Rhizobium etli; identical to SEQ ID NO: 28968

SEQ ID NO: 71701 - DNA, 1368 bp, Pasteurella piscicida; identical to SEQ ID NO: 28969
  CDS (1)..(1368)

SEQ ID NO: 71702 - protein, 455 aa, Pasteurella piscicida; identical to SEQ ID NO: 28970

SEQ ID NO: 71703 - DNA, 1437 bp, Xanthomonas campestris; identical to SEQ ID NO: 28971
  CDS (1)..(1437)

SEQ ID NO: 71704 - protein, 478 aa, Xanthomonas campestris; identical to SEQ ID NO: 28972

SEQ ID NO: 71705 - DNA, 1437 bp, Xanthomonas axonopodis; identical to SEQ ID NO: 28973
  CDS (1)..(1437)

SEQ ID NO: 71706 - protein, 478 aa, Xanthomonas axonopodis; identical to SEQ ID NO: 28974

SEQ ID NO: 71707 - DNA, 1578 bp, Xanthomonas axonopodis; identical to SEQ ID NO: 28975
  CDS (1)..(1578)

SEQ ID NO: 71708 - protein, 525 aa, Xanthomonas axonopodis; identical to SEQ ID NO: 28976

SEQ ID NO: 71709 - DNA, 2077 bp, Klebsiella pneumoniae; identical to SEQ ID NO: 28977
  CDS (374)..(1807)

SEQ ID NO: 71710 - protein, 477 aa, Klebsiella pneumoniae; identical to SEQ ID NO: 28978

SEQ ID NO: 71711 - DNA, 1536 bp, Xanthomonas campestris; identical to SEQ ID NO: 28979
  CDS (1)..(1536)

SEQ ID NO: 71712 - protein, 511 aa, Xanthomonas campestris; identical to SEQ ID NO: 28980

SEQ ID NO: 71713 - DNA, 1473 bp, Ralstonia solanacearum; identical to SEQ ID NO: 28981
  CDS (1)..(1473)

SEQ ID NO: 71714 - protein, 490 aa, Ralstonia solanacearum; identical to SEQ ID NO: 28982

SEQ ID NO: 71715 - DNA, 1518 bp, Ralstonia solanacearum; identical to SEQ ID NO: 28983
  CDS (1)..(1518)

SEQ ID NO: 71716 - protein, 505 aa, Ralstonia solanacearum; identical to SEQ ID NO: 28984

SEQ ID NO: 71717 - DNA, 1368 bp, Salmonella typhimurium; identical to SEQ ID NO: 28985
  CDS (1)..(1368)

SEQ ID NO: 71718 - protein, 455 aa, Salmonella typhimurium; identical to SEQ ID NO: 28986

SEQ ID NO: 71719 - DNA, 1512 bp, Rhizobium meliloti; identical to SEQ ID NO: 28987
  CDS (1)..(1512)

SEQ ID NO: 71720 - protein, 503 aa, Rhizobium meliloti; identical to SEQ ID NO: 28988

SEQ ID NO: 71721 - DNA, 1398 bp, Rhizobium meliloti; identical to SEQ ID NO: 28989
  CDS (1)..(1398)

SEQ ID NO: 71722 - protein, 465 aa, Rhizobium meliloti; identical to SEQ ID NO: 28990

SEQ ID NO: 71723 - DNA, 1551 bp, Rhizobium loti; identical to SEQ ID NO: 28991
  CDS (1)..(1551)

SEQ ID NO: 71724 - protein, 516 aa, Rhizobium loti; identical to SEQ ID NO: 28992

SEQ ID NO: 71725 - DNA, 1542 bp, Rhizobium loti; identical to SEQ ID NO: 28993
  CDS (1)..(1542)

SEQ ID NO: 71726 - protein, 513 aa, Rhizobium loti; identical to SEQ ID NO: 28994

SEQ ID NO: 71727 - DNA, 1515 bp, Rhizobium loti; identical to SEQ ID NO: 28995
  CDS (1)..(1515)

SEQ ID NO: 71728 - protein, 504 aa, Rhizobium loti; identical to SEQ ID NO: 28996

SEQ ID NO: 71729 - DNA, 1287 bp, Rhizobium loti; identical to SEQ ID NO: 28997
  CDS (1)..(1287)

SEQ ID NO: 71730 - protein, 428 aa, Rhizobium loti; identical to SEQ ID NO: 28998

SEQ ID NO: 71731 - DNA, 1446 bp, Pseudomonas syringae; identical to SEQ ID NO: 28999
  CDS (1)..(1446)

SEQ ID NO: 71732 - protein, 481 aa, Pseudomonas syringae; identical to SEQ ID NO: 29000

SEQ ID NO: 71733 - DNA, 1380 bp, Pasteurella multocida; identical to SEQ ID NO: 29001
  CDS (1)..(1380)

SEQ ID NO: 71734 - protein, 459 aa, Pasteurella multocida; identical to SEQ ID NO: 29002

SEQ ID NO: 71735 - DNA, 1362 bp, Aeromonas hydrophila; identical to SEQ ID NO: 29003
  CDS (1)..(1362)

SEQ ID NO: 71736 - protein, 453 aa, Aeromonas hydrophila; identical to SEQ ID NO: 29004

SEQ ID NO: 71737 - DNA, 1503 bp, Myxococcus xanthus; identical to SEQ ID NO: 29005
  CDS (1)..(1503)

SEQ ID NO: 71738 - protein, 500 aa, Myxococcus xanthus; identical to SEQ ID NO: 29006

SEQ ID NO: 71739 - DNA, 1476 bp, Shigella sonnei; identical to SEQ ID NO: 29007
  CDS (1)..(1476)

SEQ ID NO: 71740 - protein, 491 aa, Shigella sonnei; identical to SEQ ID NO: 29008

SEQ ID NO: 71741 - DNA, 1512 bp, Bartonella henselae; identical to SEQ ID NO: 29009
  CDS (1)..(1512)

SEQ ID NO: 71742 - protein, 503 aa, Bartonella henselae; identical to SEQ ID NO: 29010

SEQ ID NO: 71743 - DNA, 1437 bp, Buchnera aphidicola; identical to SEQ ID NO: 29011
  CDS (1)..(1437)

SEQ ID NO: 71744 - protein, 478 aa, Buchnera aphidicola; identical to SEQ ID NO: 29012

SEQ ID NO: 71745 - DNA, 1515 bp, Rhizobium meliloti; identical to SEQ ID NO: 29013
  CDS (1)..(1515)

SEQ ID NO: 71746 - protein, 504 aa, Rhizobium meliloti; identical to SEQ ID NO: 29014

SEQ ID NO: 71747 - DNA, 1377 bp, Bacillus subtilis; identical to SEQ ID NO: 29015
  CDS (1)..(1377)

SEQ ID NO: 71748 - protein, 458 aa, Bacillus subtilis; identical to SEQ ID NO: 29016

SEQ ID NO: 71749 - DNA, 24 bp, Primer
atgaaaaaaaccacattagcactg

SEQ ID NO: 71750 - DNA, 25 bp, Primer
ttactgcattaacaggtagatggtg

SEQ ID NO: 71751 - protein, 406 aa, consensus; identical to SEQ ID NO: 29019
  MISC_FEATURE (1)..(406): consensus for the disclosure of xaa see table XV

SEQ ID NO: 71752 - protein, 66 aa, consensus; identical to SEQ ID NO: 29020
  MISC_FEATURE (1)..(66): consensus for the disclosure of xaa see table XV

SEQ ID NO: 71753 - protein, 37 aa, consensus; identical to SEQ ID NO: 29021
  MISC_FEATURE (1)..(37): consensus for the disclosure of xaa see table XV

SEQ ID NO: 71754 - protein, 30 aa, consensus; identical to SEQ ID NO: 29022
  MISC_FEATURE (1)..(30): consensus for the disclosure of xaa see table XV

SEQ ID NO: 71755 - protein, 34 aa, consensus; identical to SEQ ID NO: 29023
  MISC_FEATURE (1)..(34): consensus for the disclosure of xaa see table XV

SEQ ID NO: 71756 - protein, 68 aa, consensus; identical to SEQ ID NO: 29024
  MISC_FEATURE (1)..(68): consensus for the disclosure of xaa see table XV

SEQ ID NO: 71757 - DNA, 648 bp, Escherichia coli; identical to SEQ ID NO: 38273
  CDS (1)..(648)

SEQ ID NO: 71758 - protein, 215 aa, Escherichia coli; identical to SEQ ID NO: 38274

SEQ ID NO: 71759 - DNA, 621 bp, Agrobacterium rhizogenes; identical to SEQ ID NO: 38275
  CDS (1)..(621): transl_table=11

SEQ ID NO: 71760 - protein, 206 aa, Agrobacterium rhizogenes; identical to SEQ ID NO: 38276

SEQ ID NO: 71761 - DNA, 618 bp, Mesorhizobium loti MAFF303099; identical to SEQ ID NO: 38277
  CDS (1)..(618): transl_table=11

SEQ ID NO: 71762 - protein, 205 aa, Mesorhizobium loti MAFF303099; identical to SEQ ID NO: 38278

SEQ ID NO: 71763 - DNA, 735 bp, Mesorhizobium loti MAFF303099; identical to SEQ ID NO: 38279
  CDS (1)..(735): transl_table=11

SEQ ID NO: 71764 - protein, 244 aa, Mesorhizobium loti MAFF303099; identical to SEQ ID NO: 38280

SEQ ID NO: 71765 - DNA, 588 bp, Bacillus halodurans C-125; identical to SEQ ID NO: 38281
  CDS (1)..(588): transl_table=11

SEQ ID NO: 71766 - protein, 195 aa, Bacillus halodurans C-125; identical to SEQ ID NO: 38282

SEQ ID NO: 71767 - DNA, 633 bp, Pseudomonas aeruginosa PAO1; identical to SEQ ID NO: 38283
  CDS (1)..(633): transl_table=11

SEQ ID NO: 71768 - protein, 210 aa, Pseudomonas aeruginosa PAO1; identical to SEQ ID NO: 38284

SEQ ID NO: 71769 - DNA, 639 bp, Pseudomonas aeruginosa PAO1; identical to SEQ ID NO: 38285
  CDS (1)..(639): transl_table=11

SEQ ID NO: 71770 - protein, 212 aa, Pseudomonas aeruginosa PAO1; identical to SEQ ID NO: 38286

SEQ ID NO: 71771 - DNA, 633 bp, Neisseria meningitidis Z2491; identical to SEQ ID NO: 38287
  CDS (1)..(633): transl_table=11

SEQ ID NO: 71772 - protein, 210 aa, Neisseria meningitidis Z2491; identical to SEQ ID NO: 38288

SEQ ID NO: 71773 - DNA, 606 bp, Mycobacterium tuberculosis CDC1551; identical to SEQ ID NO: 38289
  CDS (1)..(606): transl_table=11

SEQ ID NO: 71774 - protein, 201 aa, Mycobacterium tuberculosis CDC1551; identical to SEQ ID NO: 38290

SEQ ID NO: 71775 - DNA, 618 bp, Clostridium acetobutylicum ATCC 824; identical to SEQ ID NO: 38291
  CDS (1)..(618): transl_table=11

SEQ ID NO: 71776 - protein, 205 aa, Clostridium acetobutylicum ATCC 824; identical to SEQ ID NO: 38292

SEQ ID NO: 71777 - DNA, 642 bp, Agrobacterium tumefaciens str. C58; identical to SEQ ID NO: 38293
  CDS (1)..(642): transl_table=11

SEQ ID NO: 71778 - protein, 213 aa, Agrobacterium tumefaciens str. C58; identical to SEQ ID NO: 38294

SEQ ID NO: 71779 - DNA, 651 bp, Sinorhizobium meliloti 1021; identical to SEQ ID NO: 38295
  CDS (1)..(651): transl_table=11

SEQ ID NO: 71780 - protein, 216 aa, Sinorhizobium meliloti 1021; identical to SEQ ID NO: 38296

SEQ ID NO: 71781 - DNA, 654 bp, Salmonella typhimurium LT2; identical to SEQ ID NO: 38297
  CDS (1)..(654): transl_table=11

SEQ ID NO: 71782 - protein, 217 aa, Salmonella typhimurium LT2; identical to SEQ ID NO: 38298

SEQ ID NO: 71783 - DNA, 663 bp, Salmonella typhimurium LT2; identical to SEQ ID NO: 38299
  CDS (1)..(663): transl_table=11

SEQ ID NO: 71784 - protein, 220 aa, Salmonella typhimurium LT2; identical to SEQ ID NO: 38300

SEQ ID NO: 71785 - DNA, 555 bp, Listeria innocua Clip11262; identical to SEQ ID NO: 38301
  CDS (1)..(555): transl_table=11

SEQ ID NO: 71786 - protein, 184 aa, Listeria innocua Clip11262; identical to SEQ ID NO: 38302

SEQ ID NO: 71787 - DNA, 615 bp, Agrobacterium tumefaciens str. C58; identical to SEQ ID NO: 38303
  CDS (1)..(615): transl_table=11

SEQ ID NO: 71788 - protein, 204 aa, Agrobacterium tumefaciens str. C58; identical to SEQ ID NO: 38304

SEQ ID NO: 71789 - DNA, 597 bp, Bacillus anthracis str. A2012; identical to SEQ ID NO: 38305
  CDS (1)..(597): transl_table=11

SEQ ID NO: 71790 - protein, 198 aa, Bacillus anthracis str. A2012; identical to SEQ ID NO: 38306

SEQ ID NO: 71791 - DNA, 657 bp, Yersinia pestis KIM; identical to SEQ ID NO: 38307
  CDS (1)..(657): transl_table=11

SEQ ID NO: 71792 - protein, 218 aa, Yersinia pestis KIM; identical to SEQ ID NO: 38308

SEQ ID NO: 71793 - DNA, 630 bp, Brucella suis 1330; identical to SEQ ID NO: 38309
  CDS (1)..(630): transl_table=11

SEQ ID NO: 71794 - protein, 209 aa, Brucella suis 1330; identical to SEQ ID NO: 38310

SEQ ID NO: 71795 - DNA, 633 bp, Pseudomonas putida KT2440; identical to SEQ ID NO: 38311
  CDS (1)..(633): transl_table=11

SEQ ID NO: 71796 - protein, 210 aa, Pseudomonas putida KT2440; identical to SEQ ID NO: 38312

SEQ ID NO: 71797 - DNA, 582 bp, Pseudomonas syringae pv. tomato str. DC3000; identical to SEQ ID NO: 38313
  CDS (1)..(582): transl_table=11

SEQ ID NO: 71798 - protein, 193 aa, Pseudomonas syringae pv. tomato str. DC3000; identical to SEQ ID NO: 38314

SEQ ID NO: 71799 - DNA, 651 bp, Pseudomonas syringae pv. tomato str. DC3000; identical to SEQ ID NO: 38315
  CDS (1)..(651): transl_table=11

SEQ ID NO: 71800 - protein, 216 aa, Pseudomonas syringae pv. tomato str. DC3000; identical to SEQ ID NO: 38316

SEQ ID NO: 71801 - DNA, 672 bp, Pseudomonas syringae pv. tomato str. DC3000; identical to SEQ ID NO: 38317
  CDS (1)..(672): transl_table=11

SEQ ID NO: 71802 - protein, 223 aa, Pseudomonas syringae pv. tomato str. DC3000; identical to SEQ ID NO: 38318

SEQ ID NO: 71803 - DNA, 600 bp, Vibrio parahaemolyticus RIMD 2210633; identical to SEQ ID NO: 38319
  CDS (1)..(600): transl_table=11

SEQ ID NO: 71804 - protein, 199 aa, Vibrio parahaemolyticus RIMD 2210633; identical to SEQ ID NO: 38320

SEQ ID NO: 71805 - DNA, 615 bp, Streptomyces avermitilis MA-4680; identical to SEQ ID NO: 38321
  CDS (1)..(615)

SEQ ID NO: 71806 - protein, 204 aa, Streptomyces avermitilis MA-4680; identical to SEQ ID NO: 38322

SEQ ID NO: 71807 - DNA, 582 bp, Bacillus cereus ATCC 14579; identical to SEQ ID NO: 38323
  CDS (1)..(582): transl_table=11

SEQ ID NO: 71808 - protein, 193 aa, Bacillus cereus ATCC 14579; identical to SEQ ID NO: 38324

SEQ ID NO: 71809 - DNA, 573 bp, Bacillus cereus ATCC 14579; identical to SEQ ID NO: 38325
  CDS (1)..(573): transl_table=11

SEQ ID NO: 71810 - protein, 190 aa, Bacillus cereus ATCC 14579; identical to SEQ ID NO: 38326

SEQ ID NO: 71811 - DNA, 588 bp, Bacillus cereus ATCC 14579; identical to SEQ ID NO: 38327
  CDS (1)..(588): transl_table=11

SEQ ID NO: 71812 - protein, 195 aa, Bacillus cereus ATCC 14579; identical to SEQ ID NO: 38328

SEQ ID NO: 71813 - DNA, 573 bp, Bacillus anthracis str. Ames; identical to SEQ ID NO: 38329
  CDS (1)..(573): transl_table=11

SEQ ID NO: 71814 - protein, 190 aa, Bacillus anthracis str. Ames; identical to SEQ ID NO: 38330

SEQ ID NO: 71815 - DNA, 606 bp, Mycobacterium bovis AF2122/97; identical to SEQ ID NO: 38331
  CDS (1)..(606): transl_table=11

SEQ ID NO: 71816 - protein, 201 aa, Mycobacterium bovis AF2122/97; identical to SEQ ID NO: 38332

SEQ ID NO: 71817 - DNA, 615 bp, Bordetella parapertussis 12822; identical to SEQ ID NO: 38333
  CDS (1)..(615): transl_table=11

SEQ ID NO: 71818 - protein, 204 aa, Bordetella parapertussis 12822; identical to SEQ ID NO: 38334

SEQ ID NO: 71819 - DNA, 663 bp, Bordetella bronchiseptica RB50; identical to SEQ ID NO: 38335
  CDS (1)..(663): transl_table=11

SEQ ID NO: 71820 - protein, 220 aa, Bordetella bronchiseptica RB50; identical to SEQ ID NO: 38336

SEQ ID NO: 71821 - DNA, 648 bp, Chromobacterium violaceum ATCC 12472; identical to SEQ ID NO: 38337
  CDS (1)..(648): transl_table=11

SEQ ID NO: 71822 - protein, 215 aa, Chromobacterium violaceum ATCC 12472; identical to SEQ ID NO: 38338

SEQ ID NO: 71823 - DNA, 612 bp, Chromobacterium violaceum ATCC 12472; identical to SEQ ID NO: 38339
  CDS (1)..(612): transl_table=11

SEQ ID NO: 71824 - protein, 203 aa, Chromobacterium violaceum ATCC 12472; identical to SEQ ID NO: 38340

SEQ ID NO: 71825 - DNA, 642 bp, Photorhabdus luminescens subsp. laumondii TTO1; identical to SEQ ID NO: 38341
  CDS (1)..(642): transl_table=11

SEQ ID NO: 71826 - protein, 213 aa, Photorhabdus luminescens subsp. laumondii TTO1; identical to SEQ ID NO: 38342

SEQ ID NO: 71827 - DNA, 627 bp, Rhodopseudomonas palustris CGA009; identical to SEQ ID NO: 38343
  CDS (1)..(627): transl_table=11

SEQ ID NO: 71828 - protein, 208 aa, Rhodopseudomonas palustris CGA009; identical to SEQ ID NO: 38344

SEQ ID NO: 71829 - DNA, 642 bp, Mycobacterium avium subsp. paratuberculosis str. k10; identical to SEQ ID NO: 38345
  CDS (1)..(642): transl_table=11

SEQ ID NO: 71830 - protein, 213 aa, Mycobacterium avium subsp. paratuberculosis str. k10; identical to SEQ ID NO: 38346

SEQ ID NO: 71831 - DNA, 648 bp, Treponema denticola ATCC 35405; identical to SEQ ID NO: 38347
  CDS (1)..(648): transl_table=11

SEQ ID NO: 71832 - protein, 215 aa, Treponema denticola ATCC 35405; identical to SEQ ID NO: 38348

SEQ ID NO: 71833 - DNA, 582 bp, Bacillus cereus ATCC 10987; identical to SEQ ID NO: 38349
  CDS (1)..(582): transl_table=11

SEQ ID NO: 71834 - protein, 193 aa, Bacillus cereus ATCC 10987; identical to SEQ ID NO: 38350

SEQ ID NO: 71835 - DNA, 657 bp, Bacillus cereus ATCC 10987; identical to SEQ ID NO: 38351
  CDS (1)..(657): transl_table=11

SEQ ID NO: 71836 - protein, 218 aa, Bacillus cereus ATCC 10987; identical to SEQ ID NO: 38352

SEQ ID NO: 71837 - DNA, 588 bp, Bacillus cereus ATCC 10987; identical to SEQ ID NO: 38353
  CDS (1)..(588): transl_table=11

SEQ ID NO: 71838 - protein, 195 aa, Bacillus cereus ATCC 10987; identical to SEQ ID NO: 38354

SEQ ID NO: 71839 - DNA, 588 bp, Desulfovibrio vulgaris subsp. vulgaris str. Hildenborough; identical to SEQ ID NO: 38355
  CDS (1)..(588): transl_table=11

SEQ ID NO: 71840 - protein, 195 aa, Desulfovibrio vulgaris subsp. vulgaris str. Hildenborough; identical to SEQ ID NO: 38356

SEQ ID NO: 71841 - DNA, 573 bp, Bacillus thuringiensis serovar konkukian str. 97-27; identical to SEQ ID NO: 38357
  CDS (1)..(573): transl_table=11

SEQ ID NO: 71842 - protein, 190 aa, Bacillus thuringiensis serovar konkukian str. 97-27; identical to SEQ ID NO: 38358

SEQ ID NO: 71843 - DNA, 642 bp, Erwinia carotovora subsp. atroseptica SCRI1043; identical to SEQ ID NO: 38359
  CDS (1)..(642)

SEQ ID NO: 71844 - protein, 213 aa, Erwinia carotovora subsp. atroseptica SCRI1043; identical to SEQ ID NO: 38360

SEQ ID NO: 71845 - DNA, 582 bp, Bacillus licheniformis ATCC 14580; identical to SEQ ID NO: 38361
  CDS (1)..(582): transl_table=11

SEQ ID NO: 71846 - protein, 193 aa, Bacillus licheniformis ATCC 14580; identical to SEQ ID NO: 38362

SEQ ID NO: 71847 - DNA, 585 bp, Bacillus cereus ZK; identical to SEQ ID NO: 38363
  CDS (1)..(585): transl_table=11

SEQ ID NO: 71848 - protein, 194 aa, Bacillus cereus ZK; identical to SEQ ID NO: 38364

SEQ ID NO: 71849 - DNA, 573 bp, Bacillus cereus ZK; identical to SEQ ID NO: 38365
  CDS (1)..(573): transl_table=11

SEQ ID NO: 71850 - protein, 190 aa, Bacillus cereus ZK; identical to SEQ ID NO: 38366

SEQ ID NO: 71851 - DNA, 873 bp, Bacillus cereus ZK; identical to SEQ ID NO: 38367
  CDS (1)..(873): transl_table=11

SEQ ID NO: 71852 - protein, 290 aa, Bacillus cereus ZK; identical to SEQ ID NO: 38368

SEQ ID NO: 71853 - DNA, 672 bp, Burkholderia pseudomallei K96243; identical to SEQ ID NO: 38369
  CDS (1)..(672): transl_table=11

SEQ ID NO: 71854 - protein, 223 aa, Burkholderia pseudomallei K96243; identical to SEQ ID NO: 38370

SEQ ID NO: 71855 - DNA, 648 bp, Nocardia farcinica IFM 10152; identical to SEQ ID NO: 38371
  CDS (1)..(648): transl_table=11

SEQ ID NO: 71856 - protein, 215 aa, Nocardia farcinica IFM 10152; identical to SEQ ID NO: 38372

SEQ ID NO: 71857 - DNA, 585 bp, Geobacillus kaustophilus HTA426; identical to SEQ ID NO: 38373
  CDS (1)..(585): transl_table=11

SEQ ID NO: 71858 - protein, 194 aa, Geobacillus kaustophilus HTA426; identical to SEQ ID NO: 38374

SEQ ID NO: 71859 - DNA, 615 bp, Idiomarina loihiensis L2TR; identical to SEQ ID NO: 38375
  CDS (1)..(615): transl_table=11

SEQ ID NO: 71860 - protein, 204 aa, Idiomarina loihiensis L2TR; identical to SEQ ID NO: 38376

SEQ ID NO: 71861 - DNA, 618 bp, Azoarcus sp. EbN1; identical to SEQ ID NO: 38377
  CDS (1)..(618): transl_table=11

SEQ ID NO: 71862 - protein, 205 aa, Azoarcus sp. EbN1; identical to SEQ ID NO: 38378

SEQ ID NO: 71863 - DNA, 612 bp, Bacillus clausii KSM-K16; identical to SEQ ID NO: 38379
  CDS (1)..(612): transl_table=11

SEQ ID NO: 71864 - protein, 203 aa, Bacillus clausii KSM-K16; identical to SEQ ID NO: 38380

SEQ ID NO: 71865 - DNA, 588 bp, Bacillus clausii KSM-K16; identical to SEQ ID NO: 38381
  CDS (1)..(588): transl_table=11

SEQ ID NO: 71866 - protein, 195 aa, Bacillus clausii KSM-K16; identical to SEQ ID NO: 38382

SEQ ID NO: 71867 - DNA, 654 bp, Azotobacter vinelandii; identical to SEQ ID NO: 38383
  CDS (1)..(654)

SEQ ID NO: 71868 - protein, 217 aa, Azotobacter vinelandii; identical to SEQ ID NO: 38384

SEQ ID NO: 71869 - DNA, 606 bp, Desulfitobacterium hafniense DCB-2; identical to SEQ ID NO: 38385
  CDS (1)..(606)

SEQ ID NO: 71870 - protein, 201 aa, Desulfitobacterium hafniense DCB-2; identical to SEQ ID NO: 38386

SEQ ID NO: 71871 - DNA, 579 bp, Desulfitobacterium hafniense DCB-2; identical to SEQ ID NO: 38387
  CDS (1)..(579)

SEQ ID NO: 71872 - protein, 192 aa, Desulfitobacterium hafniense DCB-2; identical to SEQ ID NO: 38388

SEQ ID NO: 71873 - DNA, 774 bp, Desulfitobacterium hafniense DCB-2; identical to SEQ ID NO: 38389
  CDS (1)..(774)

SEQ ID NO: 71874 - protein, 257 aa, Desulfitobacterium hafniense DCB-2; identical to SEQ ID NO: 38390

SEQ ID NO: 71875 - DNA, 618 bp, Desulfitobacterium hafniense DCB-2; identical to SEQ ID NO: 38391
  CDS (1)..(618)

SEQ ID NO: 71876 - protein, 205 aa, Desulfitobacterium hafniense DCB-2; identical to SEQ ID NO: 38392

SEQ ID NO: 71877 - DNA, 621 bp, Desulfitobacterium hafniense DCB-2; identical to SEQ ID NO: 38393
  CDS (1)..(621)

SEQ ID NO: 71878 - protein, 206 aa, Desulfitobacterium hafniense DCB-2; identical to SEQ ID NO: 38394

SEQ ID NO: 71879 - DNA, 1230 bp, Nostoc punctiforme PCC 73102; identical to SEQ ID NO: 38395
  CDS (1)..(1230)

SEQ ID NO: 71880 - protein, 409 aa, Nostoc punctiforme PCC 73102; identical to SEQ ID NO: 38396

SEQ ID NO: 71881 - DNA, 1212 bp, Anabaena variabilis ATCC 29413; identical to SEQ ID NO: 38397
  CDS (1)..(1212)

SEQ ID NO: 71882 - protein, 403 aa, Anabaena variabilis ATCC 29413; identical to SEQ ID NO: 38398

SEQ ID NO: 71883 - DNA, 771 bp, Ralstonia eutropha JMP134; identical to SEQ ID NO: 38399
  CDS (1)..(771)

SEQ ID NO: 71884 - protein, 256 aa, Ralstonia eutropha JMP134; identical to SEQ ID NO: 38400

SEQ ID NO: 71885 - DNA, 720 bp, Ralstonia eutropha JMP134; identical to SEQ ID NO: 38401
  CDS (1)..(720)

SEQ ID NO: 71886 - protein, 239 aa, Ralstonia eutropha JMP134; identical to SEQ ID NO: 38402

SEQ ID NO: 71887 - DNA, 636 bp, Methylobacillus flagellatus KT; identical to SEQ ID NO: 38403
  CDS (1)..(636)

SEQ ID NO: 71888 - protein, 211 aa, Methylobacillus flagellatus KT; identical to SEQ ID NO: 38404

SEQ ID NO: 71889 - DNA, 597 bp, Dechloromonas aromatica RCB; identical to SEQ ID NO: 38405
  CDS (1)..(597)

SEQ ID NO: 71890 - protein, 198 aa, Dechloromonas aromatica RCB; identical to SEQ ID NO: 38406

SEQ ID NO: 71891 - DNA, 606 bp, Burkholderia cepacia R18194; identical to SEQ ID NO: 38407
  CDS (1)..(606)

SEQ ID NO: 71892 - protein, 201 aa, Burkholderia cepacia R18194; identical to SEQ ID NO: 38408

SEQ ID NO: 71893 - DNA, 642 bp, Burkholderia cepacia R1808; identical to SEQ ID NO: 38409
  CDS (1)..(642)

SEQ ID NO: 71894 - protein, 213 aa, Burkholderia cepacia R1808; identical to SEQ ID NO: 38410

SEQ ID NO: 71895 - DNA, 573 bp, Bacillus cereus G9241; identical to SEQ ID NO: 38411
  CDS (1)..(573): transl_table=11

SEQ ID NO: 71896 - protein, 190 aa, Bacillus cereus G9241; identical to SEQ ID NO: 38412

SEQ ID NO: 71897 - DNA, 609 bp, Pseudomonas fluorescens PfO-1; identical to SEQ ID NO: 38413
  CDS (1)..(609)

SEQ ID NO: 71898 - protein, 202 aa, Pseudomonas fluorescens PfO-1; identical to SEQ ID NO: 38414

SEQ ID NO: 71899 - DNA, 633 bp, Pseudomonas fluorescens PfO-1; identical to SEQ ID NO: 38415
  CDS (1)..(633)

SEQ ID NO: 71900 - protein, 210 aa, Pseudomonas fluorescens PfO-1; identical to SEQ ID NO: 38416

SEQ ID NO: 71901 - DNA, 654 bp, Rhodospirillum rubrum; identical to SEQ ID NO: 38417
  CDS (1)..(654)

SEQ ID NO: 71902 - protein, 217 aa, Rhodospirillum rubrum; identical to SEQ ID NO: 38418

SEQ ID NO: 71903 - DNA, 729 bp, Ralstonia metallidurans CH34; identical to SEQ ID NO: 38419
  CDS (1)..(729)

SEQ ID NO: 71904 - protein, 242 aa, Ralstonia metallidurans CH34; identical to SEQ ID NO: 38420

SEQ ID NO: 71905 - DNA, 615 bp, Burkholderia fungorum LB400; identical to SEQ ID NO: 38421
  CDS (1)..(615)

SEQ ID NO: 71906 - protein, 204 aa, Burkholderia fungorum LB400; identical to SEQ ID NO: 38422

SEQ ID NO: 71907 - DNA, 660 bp, Burkholderia fungorum LB400; identical to SEQ ID NO: 38423
  CDS (1)..(660)

SEQ ID NO: 71908 - protein, 219 aa, Burkholderia fungorum LB400; identical to SEQ ID NO: 38424

SEQ ID NO: 71909 - DNA, 702 bp, Thermobifida fusca; identical to SEQ ID NO: 38425
  CDS (1)..(702)

SEQ ID NO: 71910 - protein, 233 aa, Thermobifida fusca; identical to SEQ ID NO: 38426

SEQ ID NO: 71911 - DNA, 648 bp, Geobacter metallireducens GS-15; identical to SEQ ID NO: 38427
  CDS (1)..(648)

SEQ ID NO: 71912 - protein, 215 aa, Geobacter metallireducens GS-15; identical to SEQ ID NO: 38428

SEQ ID NO: 71913 - DNA, 633 bp, Microbulbifer degradans 2-40; identical to SEQ ID NO: 38429
  CDS (1)..(633)

SEQ ID NO: 71914 - protein, 210 aa, Microbulbifer degradans 2-40; identical to SEQ ID NO: 38430

SEQ ID NO: 71915 - DNA, 567 bp, Pediococcus pentosaceus ATCC 25745; identical to SEQ ID NO: 38431
  CDS (1)..(567)

SEQ ID NO: 71916 - protein, 188 aa, Pediococcus pentosaceus ATCC 25745; identical to SEQ ID NO: 38432

SEQ ID NO: 71917 - DNA, 594 bp, Moorella thermoacetica ATCC 39073; identical to SEQ ID NO: 38433
  CDS (1)..(594)

SEQ ID NO: 71918 - protein, 197 aa, Moorella thermoacetica ATCC 39073; identical to SEQ ID NO: 38434

SEQ ID NO: 71919 - DNA, 687 bp, Polaromonas sp. JS666; identical to SEQ ID NO: 38435
  CDS (1)..(687)

SEQ ID NO: 71920 - protein, 228 aa, Polaromonas sp. JS666; identical to SEQ ID NO: 38436

SEQ ID NO: 71921 - DNA, 624 bp, Agrobacterium tumefaciens; identical to SEQ ID NO: 38437
  CDS (1)..(624): transl_table=11

SEQ ID NO: 71922 - protein, 207 aa, Agrobacterium tumefaciens; identical to SEQ ID NO: 38438

SEQ ID NO: 71923 - DNA, 660 bp, Xanthomonas maltophilia; identical to SEQ ID NO: 38439
  CDS (1)..(660): transl_table=11

SEQ ID NO: 71924 - protein, 219 aa, Xanthomonas maltophilia; identical to SEQ ID NO: 38440

SEQ ID NO: 71925 - DNA, 660 bp, Xanthomonas maltophilia; identical to SEQ ID NO: 38441
  CDS (1)..(660): transl_table=11

SEQ ID NO: 71926 - protein, 219 aa, Xanthomonas maltophilia; identical to SEQ ID NO: 38442

SEQ ID NO: 71927 - DNA, 633 bp, Pseudomonas fluorescens; identical to SEQ ID NO: 38443
  CDS (1)..(633): transl_table=11

SEQ ID NO: 71928 - protein, 210 aa, Pseudomonas fluorescens; identical to SEQ ID NO: 38444

SEQ ID NO: 71929 - DNA, 639 bp, Erwinia amylovora; identical to SEQ ID NO: 38445
  CDS (1)..(639): transl_table=11

SEQ ID NO: 71930 - protein, 212 aa, Erwinia amylovora; identical to SEQ ID NO: 38446

SEQ ID NO: 71931 - DNA, 660 bp, Xanthomonas maltophilia; identical to SEQ ID NO: 38447
  CDS (1)..(660): transl_table=11

SEQ ID NO: 71932 - protein, 219 aa, Xanthomonas maltophilia; identical to SEQ ID NO: 38448

SEQ ID NO: 71933 - DNA, 645 bp, Proteus mirabilis; identical to SEQ ID NO: 38449
  CDS (1)..(645): transl_table=11

SEQ ID NO: 71934 - protein, 214 aa, Proteus mirabilis; identical to SEQ ID NO: 38450

SEQ ID NO: 71935 - DNA, 651 bp, Klebsiella pneumoniae; identical to SEQ ID NO: 38451
  CDS (1)..(651): transl_table=11

SEQ ID NO: 71936 - protein, 216 aa, Klebsiella pneumoniae; identical to SEQ ID NO: 38452

SEQ ID NO: 71937 - DNA, 651 bp, Enterobacter aerogenes; identical to SEQ ID NO: 38453
  CDS (1)..(651): transl_table=11

SEQ ID NO: 71938 - protein, 216 aa, Enterobacter aerogenes; identical to SEQ ID NO: 38454

SEQ ID NO: 71939 - DNA, 633 bp, Pseudomonas putida; identical to SEQ ID NO: 38455
  CDS (1)..(633): transl_table=11

SEQ ID NO: 71940 - protein, 210 aa, Pseudomonas putida; identical to SEQ ID NO: 38456

SEQ ID NO: 71941 - DNA, 642 bp, Pseudomonas putida; identical to SEQ ID NO: 38457
  CDS (1)..(642): transl_table=11

SEQ ID NO: 71942 - protein, 213 aa, Pseudomonas putida; identical to SEQ ID NO: 38458

SEQ ID NO: 71943 - DNA, 663 bp, Escherichia coli; identical to SEQ ID NO: 38459
  CDS (1)..(663): transl_table=11

SEQ ID NO: 71944 - protein, 220 aa, Escherichia coli; identical to SEQ ID NO: 38460

SEQ ID NO: 71945 - DNA, 633 bp, Neisseria gonorrhoeae; identical to SEQ ID NO: 38461
  CDS (1)..(633): transl_table=11

SEQ ID NO: 71946 - protein, 210 aa, Neisseria gonorrhoeae; identical to SEQ ID NO: 38462

SEQ ID NO: 71947 - DNA, 576 bp, Bacillus subtilis; identical to SEQ ID NO: 38463
  CDS (1)..(576): transl_table=11

SEQ ID NO: 71948 - protein, 191 aa, Bacillus subtilis; identical to SEQ ID NO: 38464

SEQ ID NO: 71949 - DNA, 25 bp, Primer
atggcacgaaaaaccaaacaagaag

SEQ ID NO: 71950 - DNA, 23 bp, Primer
ttattcgttagtggcaggattac

SEQ ID NO: 71951 - protein, 36 aa, consensus; identical to SEQ ID NO: 38467
  MISC_FEATURE (1)..(36): consensus for the disclosure of xaa see table XV

SEQ ID NO: 71952 - protein, 47 aa, consensus; identical to SEQ ID NO: 38468
  MISC_FEATURE (1)..(47): consensus for the disclosure of xaa see table XV

SEQ ID NO: 71953 - DNA, 2200 bp, Escherichia coli K12; identical to SEQ ID NO: 17198
  CDS (776)..(2200)

SEQ ID NO: 71954 - protein, 474 aa, Escherichia coli K12; identical to SEQ ID NO: 17199

SEQ ID NO: 71955 - DNA, 3053 bp, Arabidopsis thaliana (mouse-ear cress); identical to SEQ ID NO: 17200
  CDS (1)..(2556)

SEQ ID NO: 71956 - protein, 851 aa, Arabidopsis thaliana (mouse-ear cress); identical to SEQ ID NO: 17201

SEQ ID NO: 71957 - DNA, 1422 bp, Salmonella enterica subsp. enterica serovar Typhi; identical to SEQ ID NO: 17202
  CDS (1)..(1422)

SEQ ID NO: 71958 - protein, 473 aa, Salmonella enterica subsp. enterica serovar Typhi; identical to SEQ ID NO: 17203

SEQ ID NO: 71959 - DNA, 1497 bp, Mycobacterium leprae; identical to SEQ ID NO: 17204
  CDS (1)..(1497)

SEQ ID NO: 71960 - protein, 498 aa, Mycobacterium leprae; identical to SEQ ID NO: 17205

SEQ ID NO: 71961 - DNA, 2829 bp, Arabidopsis thaliana (mouse-ear cress); identical to SEQ ID NO: 17206
  CDS (1)..(2829)

SEQ ID NO: 71962 - protein, 942 aa, Arabidopsis thaliana (mouse-ear cress); identical to SEQ ID NO: 17207

SEQ ID NO: 71963 - DNA, 1491 bp, Methanobacterium thermoautotrophicum; identical to SEQ ID NO: 17208
  CDS (1)..(1491)

SEQ ID NO: 71964 - protein, 496 aa, Methanobacterium thermoautotrophicum; identical to SEQ ID NO: 17209

SEQ ID NO: 71965 - DNA, 1392 bp, Sinorhizobium meliloti; identical to SEQ ID NO: 17210
  CDS (1)..(1392)

SEQ ID NO: 71966 - protein, 463 aa, Sinorhizobium meliloti; identical to SEQ ID NO: 17211

SEQ ID NO: 71967 - DNA, 1503 bp, Mycobacterium tuberculosis; identical to SEQ ID NO: 17212
  CDS (1)..(1503)

SEQ ID NO: 71968 - protein, 500 aa, Mycobacterium tuberculosis; identical to SEQ ID NO: 17213

SEQ ID NO: 71969 - DNA, 2091 bp, Saccharomyces cerevisiae; identical to SEQ ID NO: 17214
  CDS (233)..(1720)

SEQ ID NO: 71970 - protein, 495 aa, Saccharomyces cerevisiae; identical to SEQ ID NO: 17215

SEQ ID NO: 71971 - DNA, 5981 bp, Saccharomyces cerevisiae; identical to SEQ ID NO: 17216
  CDS (2282)..(5578)

SEQ ID NO: 71972 - protein, 1098 aa, Saccharomyces cerevisiae; identical to SEQ ID NO: 17217

SEQ ID NO: 71973 - DNA, 2358 bp, Kluyveromyces marxianus var. lactis, Candida sphaerica; identical to SEQ ID NO: 17218
  CDS (722)..(2188)

SEQ ID NO: 71974 - protein, 488 aa, Kluyveromyces marxianus var. lactis, Candida sphaerica; identical to SEQ ID NO: 17219

SEQ ID NO: 71975 - DNA, 3170 bp, Saccharomyces cerevisiae; identical to SEQ ID NO: 17220
  CDS (147)..(2837)

SEQ ID NO: 71976 - protein, 896 aa, Saccharomyces cerevisiae; identical to SEQ ID NO: 17221

SEQ ID NO: 71977 - DNA, 1500 bp, Synechocystis sp; identical to SEQ ID NO: 17222
  CDS (1)..(1500)

SEQ ID NO: 71978 - protein, 499 aa, Synechocystis sp; identical to SEQ ID NO: 17223

SEQ ID NO: 71979 - DNA, 2586 bp, Arabidopsis thaliana (mouse-ear cress); identical to SEQ ID NO: 17224
  CDS (1)..(2586)

SEQ ID NO: 71980 - protein, 861 aa, Arabidopsis thaliana (mouse-ear cress); identical to SEQ ID NO: 17225

SEQ ID NO: 71981 - DNA, 2388 bp, Arabidopsis thaliana (mouse-ear cress); identical to SEQ ID NO: 17226
  CDS (1)..(2388)

SEQ ID NO: 71982 - protein, 795 aa, Arabidopsis thaliana (mouse-ear cress); identical to SEQ ID NO: 17227

SEQ ID NO: 71983 - DNA, 2676 bp, Schizosaccharomyces pombe; identical to SEQ ID NO: 17228
  CDS (1)..(2676)

SEQ ID NO: 71984 - protein, 891 aa, Schizosaccharomyces pombe; identical to SEQ ID NO: 17229

SEQ ID NO: 71985 - DNA, 2550 bp, Schizosaccharomyces pombe; identical to SEQ ID NO: 17230
  CDS (1)..(2550)

SEQ ID NO: 71986 - protein, 849 aa, Schizosaccharomyces pombe; identical to SEQ ID NO: 17231

SEQ ID NO: 71987 - DNA, 2835 bp, Schizosaccharomyces pombe; identical to SEQ ID NO: 17232
  CDS (1)..(2835)

SEQ ID NO: 71988 - protein, 944 aa, Schizosaccharomyces pombe; identical to SEQ ID NO: 17233

SEQ ID NO: 71989 - DNA, 2580 bp, Schizosaccharomyces pombe; identical to SEQ ID NO: 17234
  CDS (52)..(2505)

SEQ ID NO: 71990 - protein, 817 aa, Schizosaccharomyces pombe; identical to SEQ ID NO: 17235

SEQ ID NO: 71991 - DNA, 1993 bp, Schizosaccharomyces pombe; identical to SEQ ID NO: 17236
  CDS (266)..(1705)

SEQ ID NO: 71992 - protein, 479 aa, Schizosaccharomyces pombe; identical to SEQ ID NO: 17237

SEQ ID NO: 71993 - DNA, 2621 bp, unidentified; identical to SEQ ID NO: 17238
  CDS (25)..(2487)

SEQ ID NO: 71994 - protein, 820 aa, unidentified; identical to SEQ ID NO: 17239

SEQ ID NO: 71995 - DNA, 2640 bp, Helianthus annuus; identical to SEQ ID NO: 17240
  CDS (171)..(2510)

SEQ ID NO: 71996 - protein, 779 aa, Helianthus annuus; identical to SEQ ID NO: 17241

SEQ ID NO: 71997 - DNA, 1913 bp, Selaginella lepidophylla; identical to SEQ ID NO: 17242
  CDS (111)..(1913)

SEQ ID NO: 71998 - protein, 600 aa, Selaginella lepidophylla; identical to SEQ ID NO: 17243

SEQ ID NO: 71999 - DNA, 4351 bp, Caenorhabditis elegans; identical to SEQ ID NO: 17244
  CDS (112)..(3996)

SEQ ID NO: 72000 - protein, 1294 aa, Caenorhabditis elegans; identical to SEQ ID NO: 17245

SEQ ID NO: 72001 - DNA, 2637 bp, Debaryomyces hansenii; identical to SEQ ID NO: 17246
  CDS (1)..(2637)

SEQ ID NO: 72002 - protein, 878 aa, Debaryomyces hansenii; identical to SEQ ID NO: 17247

SEQ ID NO: 72003 - DNA, 1443 bp, Debaryomyces hansenii; identical to SEQ ID NO: 17248
  CDS (1)..(1443)

SEQ ID NO: 72004 - protein, 480 aa, Debaryomyces hansenii; identical to SEQ ID NO: 17249

SEQ ID NO: 72005 - DNA, 2403 bp, Yarrowia lipolytica; identical to SEQ ID NO: 17250
  CDS (1)..(2403)

SEQ ID NO: 72006 - protein, 800 aa, Yarrowia lipolytica; identical to SEQ ID NO: 17251

SEQ ID NO: 72007 - DNA, 3447 bp, Kluyveromyces lactis; identical to SEQ ID NO: 17252
  CDS (1)..(3447)

SEQ ID NO: 72008 - protein, 1148 aa, Kluyveromyces lactis; identical to SEQ ID NO: 17253

SEQ ID NO: 72009 - DNA, 2631 bp, Kluyveromyces lactis; identical to SEQ ID NO: 17254
  CDS (1)..(2631)

SEQ ID NO: 72010 - protein, 876 aa, Kluyveromyces lactis; identical to SEQ ID NO: 17255

SEQ ID NO: 72011 - DNA, 1437 bp, Acinetobacter sp; identical to SEQ ID NO: 17256
  CDS (1)..(1437)

SEQ ID NO: 72012 - protein, 478 aa, Acinetobacter sp; identical to SEQ ID NO: 17257

SEQ ID NO: 72013 - DNA, 1476 bp, Candida glabrata; identical to SEQ ID NO: 17258
  CDS (1)..(1476)

SEQ ID NO: 72014 - protein, 491 aa, Candida glabrata; identical to SEQ ID NO: 17259

SEQ ID NO: 72015 - DNA, 3198 bp, Candida glabrata; identical to SEQ ID NO: 17260
  CDS (1)..(3198)

SEQ ID NO: 72016 - protein, 1065 aa, Candida glabrata; identical to SEQ ID NO: 17261

SEQ ID NO: 72017 - DNA, 3345 bp, Candida glabrata; identical to SEQ ID NO: 17262
  CDS (1)..(3345)

SEQ ID NO: 72018 - protein, 1114 aa, Candida glabrata; identical to SEQ ID NO: 17263

SEQ ID NO: 72019 - DNA, 2673 bp, Candida glabrata; identical to SEQ ID NO: 17264
  CDS (1)..(2673)

SEQ ID NO: 72020 - protein, 890 aa, Candida glabrata; identical to SEQ ID NO: 17265

SEQ ID NO: 72021 - DNA, 2013 bp, Cryptococcus neoformans var; identical to SEQ ID NO: 17266
  CDS (1)..(2013)

SEQ ID NO: 72022 - protein, 670 aa, Cryptococcus neoformans var; identical to SEQ ID NO: 17267

SEQ ID NO: 72023 - DNA, 1302 bp, Picrophilus torridus; identical to SEQ ID NO: 17268
  CDS (1)..(1302)

SEQ ID NO: 72024 - protein, 433 aa, Picrophilus torridus; identical to SEQ ID NO: 17269

SEQ ID NO: 72025 - DNA, 1482 bp, Rhodopseudomonas palustris; identical to SEQ ID NO: 17270
  CDS (1)..(1482)

SEQ ID NO: 72026 - protein, 493 aa, Rhodopseudomonas palustris; identical to SEQ ID NO: 17271

SEQ ID NO: 72027 - DNA, 1440 bp, Corynebacterium diphtheriae; identical to SEQ ID NO: 17272
  CDS (1)..(1440)

SEQ ID NO: 72028 - protein, 479 aa, Corynebacterium diphtheriae; identical to SEQ ID NO: 17273

SEQ ID NO: 72029 - DNA, 2589 bp, Oryza sativa; identical to SEQ ID NO: 17274
  CDS (1)..(2589)

SEQ ID NO: 72030 - protein, 862 aa, Oryza sativa; identical to SEQ ID NO: 17275

SEQ ID NO: 72031 - DNA, 2812 bp, Oryza sativa; identical to SEQ ID NO: 17276
  CDS (53)..(2527)

SEQ ID NO: 72032 - protein, 824 aa, Oryza sativa; identical to SEQ ID NO: 17277

SEQ ID NO: 72033 - DNA, 2208 bp, Thermoproteus tenax; identical to SEQ ID NO: 17278
  CDS (1)..(2208)

SEQ ID NO: 72034 - protein, 735 aa, Thermoproteus tenax; identical to SEQ ID NO: 17279

SEQ ID NO: 72035 - DNA, 1479 bp, Mycobacterium paratuberculosis; identical to SEQ ID NO: 17280
  CDS (1)..(1479)

SEQ ID NO: 72036 - protein, 492 aa, Mycobacterium paratuberculosis; identical to SEQ ID NO: 17281

SEQ ID NO: 72037 - DNA, 1461 bp, Geobacter sulfurreducens; identical to SEQ ID NO: 17282
  CDS (1)..(1461)

SEQ ID NO: 72038 - protein, 486 aa, Geobacter sulfurreducens; identical to SEQ ID NO: 17283

SEQ ID NO: 72039 - DNA, 3333 bp, Ashbya gossypii; identical to SEQ ID NO: 17284
  CDS (1)..(3333)

SEQ ID NO: 72040 - protein, 1110 aa, Ashbya gossypii; identical to SEQ ID NO: 17285

SEQ ID NO: 72041 - DNA, 1485 bp, Ashbya gossypii; identical to SEQ ID NO: 17286
  CDS (1)..(1485)

SEQ ID NO: 72042 - protein, 494 aa, Ashbya gossypii; identical to SEQ ID NO: 17287

SEQ ID NO: 72043 - DNA, 3498 bp, Oryza sativa; identical to SEQ ID NO: 17288
  CDS (176)..(2875)

SEQ ID NO: 72044 - protein, 899 aa, Oryza sativa; identical to SEQ ID NO: 17289

SEQ ID NO: 72045 - DNA, 3048 bp, Neurospora crassa; identical to SEQ ID NO: 17290
  CDS (1)..(3048)

SEQ ID NO: 72046 - protein, 1015 aa, Neurospora crassa; identical to SEQ ID NO: 17291

SEQ ID NO: 72047 - DNA, 1572 bp, Neurospora crassa; identical to SEQ ID NO: 17292
  CDS (1)..(1572)

SEQ ID NO: 72048 - protein, 523 aa, Neurospora crassa; identical to SEQ ID NO: 17293

SEQ ID NO: 72049 - DNA, 2730 bp, Neurospora crassa; identical to SEQ ID NO: 17294
  CDS (1)..(2730)

SEQ ID NO: 72050 - protein, 909 aa, Neurospora crassa; identical to SEQ ID NO: 17295

SEQ ID NO: 72051 - DNA, 1488 bp, Synechococcus sp; identical to SEQ ID NO: 17296
  CDS (1)..(1488)

SEQ ID NO: 72052 - protein, 495 aa, Synechococcus sp; identical to SEQ ID NO: 17297

SEQ ID NO: 72053 - DNA, 1350 bp, Thermus thermophilus; identical to SEQ ID NO: 17298
  CDS (1)..(1350)

SEQ ID NO: 72054 - protein, 449 aa, Thermus thermophilus; identical to SEQ ID NO: 17299

SEQ ID NO: 72055 - DNA, 3862 bp, Caenorhabditis elegans; identical to SEQ ID NO: 17300
  CDS (30)..(3722)

SEQ ID NO: 72056 - protein, 1230 aa, Caenorhabditis elegans; identical to SEQ ID NO: 17301

SEQ ID NO: 72057 - DNA, 1590 bp, Magnaporthe grisea; identical to SEQ ID NO: 17302
  CDS (1)..(1590)

SEQ ID NO: 72058 - protein, 529 aa, Magnaporthe grisea; identical to SEQ ID NO: 17303

SEQ ID NO: 72059 - DNA, 1485 bp, Bradyrhizobium japonicum; identical to SEQ ID NO: 17304
  CDS (1)..(1485)

SEQ ID NO: 72060 - protein, 494 aa, Bradyrhizobium japonicum; identical to SEQ ID NO: 17305

SEQ ID NO: 72061 - DNA, 1449 bp, Corynebacterium efficiens; identical to SEQ ID NO: 17306
  CDS (1)..(1449)

SEQ ID NO: 72062 - protein, 482 aa, Corynebacterium efficiens; identical to SEQ ID NO: 17307

SEQ ID NO: 72063 - DNA, 2774 bp, Arabidopsis thaliana; identical to SEQ ID NO: 17308
  CDS (102)..(2690)

SEQ ID NO: 72064 - protein, 862 aa, Arabidopsis thaliana; identical to SEQ ID NO: 17309

SEQ ID NO: 72065 - DNA, 2583 bp, Oryza sativa; identical to SEQ ID NO: 17310
  CDS (1)..(2583)

SEQ ID NO: 72066 - protein, 860 aa, Oryza sativa; identical to SEQ ID NO: 17311

SEQ ID NO: 72067 - DNA, 1458 bp, Corynebacterium glutamicum; identical to SEQ ID NO: 17312
  CDS (1)..(1458)

SEQ ID NO: 72068 - protein, 485 aa, Corynebacterium glutamicum; identical to SEQ ID NO: 17313

SEQ ID NO: 72069 - DNA, 2358 bp, Xanthomonas campestris; identical to SEQ ID NO: 17314
  CDS (1)..(2358)

SEQ ID NO: 72070 - protein, 785 aa, Xanthomonas campestris; identical to SEQ ID NO: 17315

SEQ ID NO: 72071 - DNA, 1368 bp, Xanthomonas axonopodis; identical to SEQ ID NO: 17316
  CDS (1)..(1368)

SEQ ID NO: 72072 - protein, 455 aa, Xanthomonas axonopodis; identical to SEQ ID NO: 17317

SEQ ID NO: 72073 - DNA, 2574 bp, Solanum tuberosum; identical to SEQ ID NO: 17318
  CDS (1)..(2574)

SEQ ID NO: 72074 - protein, 857 aa, Solanum tuberosum; identical to SEQ ID NO: 17319

SEQ ID NO: 72075 - DNA, 1380 bp, Encephalitozoon cuniculi; identical to SEQ ID NO: 17320
  CDS (1)..(1380)

SEQ ID NO: 72076 - protein, 459 aa, Encephalitozoon cuniculi; identical to SEQ ID NO: 17321

SEQ ID NO: 72077 - DNA, 1398 bp, Ralstonia solanacearum; identical to SEQ ID NO: 17322
  CDS (1)..(1398)

SEQ ID NO: 72078 - protein, 465 aa, Ralstonia solanacearum; identical to SEQ ID NO: 17323

SEQ ID NO: 72079 - DNA, 1674 bp, Ralstonia solanacearum; identical to SEQ ID NO: 17324
  CDS (1)..(1674)

SEQ ID NO: 72080 - protein, 557 aa, Ralstonia solanacearum; identical to SEQ ID NO: 17325

SEQ ID NO: 72081 - DNA, 2214 bp, Pyrobaculum aerophilum; identical to SEQ ID NO: 17326
  CDS (1)..(2214)

SEQ ID NO: 72082 - protein, 737 aa, Pyrobaculum aerophilum; identical to SEQ ID NO: 17327

SEQ ID NO: 72083 - DNA, 3001 bp, Arabidopsis thaliana; identical to SEQ ID NO: 17328
  CDS (204)..(2306)

SEQ ID NO: 72084 - protein, 700 aa, Arabidopsis thaliana; identical to SEQ ID NO: 17329

SEQ ID NO: 72085 - DNA, 3272 bp, Oryza sativa; identical to SEQ ID NO: 17330
  CDS (247)..(2985)

SEQ ID NO: 72086 - protein, 912 aa, Oryza sativa; identical to SEQ ID NO: 17331

SEQ ID NO: 72087 - DNA, 1681 bp, Amanita muscaria; identical to SEQ ID NO: 17332
  CDS (101)..(1552)

SEQ ID NO: 72088 - protein, 483 aa, Amanita muscaria; identical to SEQ ID NO: 17333

SEQ ID NO: 72089 - DNA, 1344 bp, Thermoplasma volcanium; identical to SEQ ID NO: 17334
  CDS (1)..(1344)

SEQ ID NO: 72090 - protein, 447 aa, Thermoplasma volcanium; identical to SEQ ID NO: 17335

SEQ ID NO: 72091 - DNA, 1563 bp, Rhizobium loti; identical to SEQ ID NO: 17336
  CDS (1)..(1563)

SEQ ID NO: 72092 - protein, 520 aa, Rhizobium loti; identical to SEQ ID NO: 17337

SEQ ID NO: 72093 - DNA, 2637 bp, Oryza sativa; identical to SEQ ID NO: 17338
  CDS (1)..(2637)

SEQ ID NO: 72094 - protein, 878 aa, Oryza sativa; identical to SEQ ID NO: 17339

SEQ ID NO: 72095 - DNA, 1326 bp, Thermoplasma acidophilum; identical to SEQ ID NO: 17340
  CDS (1)..(1326)

SEQ ID NO: 72096 - protein, 441 aa, Thermoplasma acidophilum; identical to SEQ ID NO: 17341

SEQ ID NO: 72097 - DNA, 1389 bp, Streptomyces coelicolor; identical to SEQ ID NO: 17342
  CDS (1)..(1389)

SEQ ID NO: 72098 - protein, 462 aa, Streptomyces coelicolor; identical to SEQ ID NO: 17343

SEQ ID NO: 72099 - DNA, 2635 bp, Arabidopsis thaliana; identical to SEQ ID NO: 17344
  CDS (1)..(2604)

SEQ ID NO: 72100 - protein, 867 aa, Arabidopsis thaliana; identical to SEQ ID NO: 17345

SEQ ID NO: 72101 - DNA, 2843 bp, Zygosaccharomyces rouxii; identical to SEQ ID NO: 17346
  CDS (24)..(2726)

SEQ ID NO: 72102 - protein, 900 aa, Zygosaccharomyces rouxii; identical to SEQ ID NO: 17347

SEQ ID NO: 72103 - DNA, 3197 bp, Drosophila melanogaster; identical to SEQ ID NO: 17348
  CDS (662)..(3091)

SEQ ID NO: 72104 - protein, 809 aa, Drosophila melanogaster; identical to SEQ ID NO: 17349

SEQ ID NO: 72105 - DNA, 1503 bp, Pseudomonas anguilliseptica; identical to SEQ ID NO: 17350
  CDS (1)..(1503)

SEQ ID NO: 72106 - protein, 500 aa, Pseudomonas anguilliseptica; identical to SEQ ID NO: 17351

SEQ ID NO: 72107 - DNA, 1503 bp, Synechococcus sp; identical to SEQ ID NO: 17352
  CDS (1)..(1503)

SEQ ID NO: 72108 - protein, 500 aa, Synechococcus sp; identical to SEQ ID NO: 17353

SEQ ID NO: 72109 - DNA, 1395 bp, Rhizobium sp; identical to SEQ ID NO: 17354
  CDS (1)..(1395)

SEQ ID NO: 72110 - protein, 464 aa, Rhizobium sp; identical to SEQ ID NO: 17355

SEQ ID NO: 72111 - DNA, 1437 bp, Candida albicans; identical to SEQ ID NO: 17356
  CDS (1)..(1437)

SEQ ID NO: 72112 - protein, 478 aa, Candida albicans; identical to SEQ ID NO: 17357

SEQ ID NO: 72113 - DNA, 1515 bp, Emericella nidulans; identical to SEQ ID NO: 17358
  CDS (1)..(1515)

SEQ ID NO: 72114 - protein, 504 aa, Emericella nidulans; identical to SEQ ID NO: 17359

SEQ ID NO: 72115 - DNA, 2695 bp, Pichia angusta; identical to SEQ ID NO: 17360
  CDS (793)..(2220)

SEQ ID NO: 72116 - protein, 475 aa, Pichia angusta; identical to SEQ ID NO: 17361

SEQ ID NO: 72117 - DNA, 1542 bp, Schizosaccharomyces pombe; identical to SEQ ID NO: 17362
  CDS (1)..(1542)

SEQ ID NO: 72118 - protein, 513 aa, Schizosaccharomyces pombe; identical to SEQ ID NO: 17363

SEQ ID NO: 72119 - DNA, 1520 bp, Yarrowia lipolytica; identical to SEQ ID NO: 17364
  CDS (27)..(1436)

SEQ ID NO: 72120 - protein, 469 aa, Yarrowia lipolytica; identical to SEQ ID NO: 17365

SEQ ID NO: 72121 - DNA, 1645 bp, Zygosaccharomyces rouxii; identical to SEQ ID NO: 17366
  CDS (77)..(1534)

SEQ ID NO: 72122 - protein, 485 aa, Zygosaccharomyces rouxii; identical to SEQ ID NO: 17367

SEQ ID NO: 72123 - DNA, 3069 bp, Saccharomyces cerevisiae; identical to SEQ ID NO: 17368
  CDS (1)..(3069)

SEQ ID NO: 72124 - protein, 1022 aa, Saccharomyces cerevisiae; identical to SEQ ID NO: 17369

SEQ ID NO: 72125 - DNA, 1554 bp, Aspergillus niger; identical to SEQ ID NO: 17370
  CDS (1)..(1554)

SEQ ID NO: 72126 - protein, 517 aa, Aspergillus niger; identical to SEQ ID NO: 17371

SEQ ID NO: 72127 - DNA, 25 bp, Primer
atgagtcgtttagtcgtagtatcta

SEQ ID NO: 72128 - DNA, 24 bp, Primer
ttacgcaagctttggaaaggtagc

SEQ ID NO: 72129 - protein, 98 aa, consensus; identical to SEQ ID NO: 18676
  MISC_FEATURE (1)..(98): consensus for the disclosure of xaa see table XV

SEQ ID NO: 72130 - protein, 47 aa, consensus; identical to SEQ ID NO: 18677
  MISC_FEATURE (1)..(47): consensus for the disclosure of xaa see table XV

SEQ ID NO: 72131 - protein, 117 aa, consensus; identical to SEQ ID NO: 18678
  MISC_FEATURE (1)..(117): consensus for the disclosure of xaa see table XV

SEQ ID NO: 72132 - protein, 75 aa, consensus; identical to SEQ ID NO: 18679
  MISC_FEATURE (1)..(75): consensus for the disclosure of xaa see table XV

SEQ ID NO: 72133 - DNA, 2145 bp, Escherichia coli
  CDS (1)..(2145)
atggaaatgacatcagcgtttacccttaatgttcgtctggacaacattgccgttatcaccatcgacgtaccgggtgagaaaatgaataccctgaaggcggagtttgcctcgcaggtgcgcgccattattaagcaactccgtgaaaacaaagagttgcgaggcgtggtgtttgtctccgctaaaccggacaacttcattgctggcgcagacatcaacatgatcggcaactgcaaaacggcgcaagaagcggaagctctggcgcggcagggccaacagttgatggcggagattcatgctttgcccattcaggttatcgcggctattcatggcgcttgcctgggtggtgggctggagttggcgctggcgtgccacggtcgcgtttgtactgacgatcctaaaacggtgctcggtttgcctgaagtacaacttggattgttacccggttcaggcggcacccagcgtttaccgcgtctgataggcgtcagcacagcattagagatgatcctcaccggaaaacaacttcgggcgaaacaggcattaaagctggggctggtggatgacgttgttccgcactccattctgctggaagccgctgttgagctggcaaagaaggagcgcccatcttcccgccctctacctgtacgcgagcgtattctggcggggccgttaggtcgtgcgctgctgttcaaaatggtcggcaagaaaacagaacacaaaactcaaggcaattatccggcgacagaacgcatcctggaggttgttgaaacgggattagcgcagggcaccagcagcggttatgacgccgaagctcgggcgtttggcgaactggcgatgacgccacaatcgcaggcgctgcgtagtatcttttttgccagtacggacgtgaagaaagatcccggcagtgatgcgccgcctgcgccattaaacagcgtggggattttaggtggtggcttgatgggcggcggtattgcttatgtcactgcttgtaaagcggggattccggtcagaattaaagatatcaacccgcagggcataaatcatgcgctgaagtacagttgggatcagctggagggcaaagttcgccgtcgtcatctcaaagccagcgaacgtgacaaacagctggcattaatctccggaacgacggactatcgcggctttgcccatcgcgatctgattattgaagcggtgtttgaaaatctcgaattgaaacaacagatggtggcggaagttgagcaaaattgcgccgctcataccatctttgcttcgaatacgtcatctttaccgattggtgatatcgccgctcacgccacgcgacctgagcaagttatcggcctgcatttcttcagtccggtggaaaaaatgccgctggtggagattattcctcatgcggggacatcggcgcaaaccatcgctaccacagtaaaactggcgaaaaaacagggtaaaacgccaattgtcgtgcgtgacaaagccggtttttacgtcaatcgcatcttagcgccttacattaatgaagctatccgcatgttgacccaaggtgaacgggtagagcacattgatgccgcgctagtgaaatttggttttccggtaggcccaatccaacttttggatgaggtaggaatcgacaccgggactaaaattattcctgtactggaagccgcttatggagaacgttttagcgcgcctgcaaatgttgtttcttcaattttgaacgacgatcgcaaaggcagaaaaaatggccggggtttctatctttatggtcagaaagggcgtaaaagcaaaaaacaggtcgatcccgccatttacccgctgattggcacacaagggcaggggcgaatctccgcaccgcaggttgctgaacggtgtgtgatgttgatgctgaatgaagcagtacgttgtgttgatgagcaggttatccgtagcgtgcgtgacggggatattggcgcggtatttggcattggttttccgccatttctcggtggaccgttccgctatatcgattctctcggcgcgggcgaagtggttgcaataatgcaacgacttgccacgcagtatggttcccgttttaccccttgcgagcgtttggtcgagatgggcgcgcgtggggaaagtttttggaaaacaactgcaactgacctgcaataa

SEQ ID NO: 72134 - protein, 714 aa, Escherichia coli
MEMTSAFTLNVRLDNIAVITIDVPGEKMNTLKAEFASQVRAIIKQLRENKELRGVVFVSAKPDNFIAGADINMIGNCKTAQEAEALARQGQQLMAEIHALPIQVIAAIHGACLGGGLELALACHGRVCTDDPKTVLGLPEVQLGLLPGSGGTQRLPRLIGVSTALEMILTGKQLRAKQALKLGLVDDVVPHSILLEAAVELAKKERPSSRPLPVRERILAGPLGRALLFKMVGKKTEHKTQGNYPATERILEVVETGLAQGTSSGYDAEARAFGELAMTPQSQALRSIFFASTDVKKDPGSDAPPAPLNSVGILGGGLMGGGIAYVTACKAGIPVRIKDINPQGINHALKYSWDQLEGKVRRRHLKASERDKQLALISGTTDYRGFAHRDLIIEAVFENLELKQQMVAEVEQNCAAHTIFASNTSSLPIGDIAAHATRPEQVIGLHFFSPVEKMPLVEIIPHAGTSAQTIATTVKLAKKQGKTPIVVRDKAGFYVNRILAPYINEAIRMLTQGERVEHIDAALVKFGFPVGPIQLLDEVGIDTGTKIIPVLEAAYGERFSAPANVVSSILNDDRKGRKNGRGFYLYGQKGRKSKKQVDPAIYPLIGTQGQGRISAPQVAERCVMLMLNEAVRCVDEQVIRSVRDGDIGAVFGIGFPPFLGGPFRYIDSLGAGEVVAIMQRLATQYGSRFTPCERLVEMGARGESFWKTTATDLQ

SEQ ID NO: 72135 - DNA, 1986 bp, Archaeoglobus fulgidus DSM 4304
  CDS (1)..(1986): transl_table=11
gtgatggttttggagataaggaacgttgccgttataggcgccggctcgatggggcatgcaattgccgaggttgttgcaatacacggattcaacgtgaaactgatggacgtgagcgaggatcagctgaagagggcgatggaaaaaattgaggaggggctcaggaagagctacgagagaggctacatttcagaagatcctgaaaaggtgctgaaaagaattgaggccacagctgatctaatagaggttgcaaaggatgcggacctcgtcatcgaagcaattccggagatattcgacctcaaaaagaaggttttcagcgagatagagcagtactgccctgaccacacaatattcgccaccaacacatcctctctgagcataacgaagctcgccgaagccaccaagagaccggagaagtttataggaatgcacttcttcaaccctcctaagattctgaagctcctcgaaatagtgtggggagagaagacgagcgaggaaacaataaggattgtggaggactttgcaagaaaaatcgacagaataatcatacacgtcaggaaggacgttccgggattcattgtaaacagaatcttcgtcacgatgtccaacgaggcttcttgggctgttgagatgggtgagggaacaatcgaggagatcgactcggcggtcaagtacagactcggccttcccatgggacttttcgagcttcacgacgttcttggtgggggcagcgttgatgtgagctaccacgtccttgagtactaccgccagactcttggagaatcataccgcccgtctccactattcgagaggcttttcaaggccggccattacggaaagaaaaccggtaagggcttctacgactggagcgagggtaaaacaaatgaagttcccctgagggcgggagcaaacttcgatttgctcaggctcgttgctccagcagtaaacgaggcggcatggctgatagagaagggcgttgcgagtgcggaggagatagacctcgccgttctgcacgggctaaactatccgaggggattgctgaggatggcagatgatttcggcatagacagcatcgtgaagaagctgaatgagctttacgaaaagtacaacggggaggagaggtacaaagtcaatccggttctgcagaaaatggttgaagaggggaagcttggcaggacgactggcgagggattctacaagtatggtgacggcaactacgagttcgtaaaggttgagaaggaagggaaagtaggggttctgaagctcaacagaccgaggagagccaacgcgctcaatccaaccttcctgaaggaggtggaggacgctcttgacctgctggaaagagatgaggaggtcagggcaatcgtgattgctggagagggtaagaacttctgcgcaggagcggacatagcgatgttcgcttcaggaagacctgagatggtcacggagttcagccagctcggacataaagtattcaggaagattgagatgctctccaagcccgtaatcgccgcaattcacggtgctgcggttggtgggggatttgagctggcgatggcttgcgacctaagggtgatgagcgaaagggcgtttctcggcttaccggagcttaacctcggaatcattccggggtggggaggaacgcagaggctggcctactacgtcggagtttcgaagctgaaagaggtcattatgctgaagaggaacataaagcctgaggaggcgaagaacctcggtctggttgccgaggtcttcccgcaggaaagattctgggatgaagtgatgaaactcgccagggaggttgcggagctgccgccgcttgcagtgaagtacctcaagaaggtaatagctctcggcacgatgccggcacttgagacgggcaaccttgccgagtcggaagctggtgcggtcattgccctgacagacgacgttgctgagggaatacaggcctttaactaccgcagaaagcctaatttcagggggaggtga

SEQ ID NO: 72136 - protein, 661 aa, Archaeoglobus fulgidus DSM 4304
MMVLEIRNVAVIGAGSMGHAIAEVVAIHGFNVKLMDVSEDQLKRAMEKIEEGLRKSYERGYISEDPEKVLKRIEATADLIEVAKDADLVIEAIPEIFDLKKKVFSEIEQYCPDHTIFATNTSSLSITKLAEATKRPEKFIGMHFFNPPKILKLLEIVWGEKTSEETIRIVEDFARKIDRIIIHVRKDVPGFIVNRIFVTMSNEASWAVEMGEGTIEEIDSAVKYRLGLPMGLFELHDVLGGGSVDVSYHVLEYYRQTLGESYRPSPLFERLFKAGHYGKKTGKGFYDWSEGKTNEVPLRAGANFDLLRLVAPAVNEAAWLIEKGVASAEEIDLAVLHGLNYPRGLLRMADDFGIDSIVKKLNELYEKYNGEERYKVNPVLQKMVEEGKLGRTTGEGFYKYGDGNYEFVKVEKEGKVGVLKLNRPRRANALNPTFLKEVEDALDLLERDEEVRAIVIAGEGKNFCAGADIAMFASGRPEMVTEFSQLGHKVFRKIEMLSKPVIAAIHGAAVGGGFELAMACDLRVMSERAFLGLPELNLGIIPGWGGTQRLAYYVGVSKLKEVIMLKRNIKPEEAKNLGLVAEVFPQERFWDEVMKLAREVAELPPLAVKYLKKVIALGTMPALETGNLAESEAGAVIALTDDVAEGIQAFNYRRKPNFRGR

SEQ ID NO: 72137 - DNA, 1977 bp, Archaeoglobus fulgidus DSM 4304
  CDS (1)..(1977): transl_table=11
atgaaggtaaagaaggtttgtgtgcttggagctggagcaatgggcagcggaattgcccaggtgtgtgcgaccgcaggctatgaggtatgggtgagagacataaagcaggagtttctggacagagggaaggcagcgattgagaagaacctccagaaggctgtgagcaagggcaaaatgaccgaagagaaggcaaaggaaattctcagcagaattcacttcaccctcgacatggaagaggctgttaaggacgctgatctggtcatcgaggcggtgcccgagataatggatctgaaaaagcaagttttcgctgaagttcagaagtacgccaagcctgagtgcatctttgcaagcaacacctcaggtttgagcataacagagcttggaaatgctaccgacagaccggaaaagttccttggtctgcacttcttcaaccctccgcctgtgatggctctcgttgaggtcattaagggagagaagacaagcgatgaaacgatcaagttcggcgtcgagttcgtaaaaagccttgggaaggttcctgttgtggttaagaaggatgttgctgggttcatagtgaacagaattctggtgccctaccttgtccttgcaattgacgacgttgagaagggagttgcgacaaaggaggaaatcgatgcgacgatgatgtacaagtacggcttcccgatggggcccatagagctttcagacttcgtcgggctggacattctctaccacgcaagccagcagtgggacattgttccgcaatcaaagcttcttgaggagaagttcaaggcaaacgagcttggaatgaagacgggcaagggattctatgactggagcgctggaaggccaaagattcctcaggagcttgctgggaagtacgacgcaatcagactcatagctccgatggtgaacatagctgcagacctaattgcaatgggtgttgcagatgcgaaggacatcgatactgcaatgaagctgggaaccaacatgcccaaagggccatgtgagcttggcgatgagattggtctggatgtaatccttgcaaaggtcgaggagctttacaaggagaagggattcgagattctcaagccctcagaacacctcaagaagatggtgtcagagggcaagctgggagagaagagcggtgagggcttttacagctatggcaagggagagatgaccttcaagaacatcgagattgttaaggacaccgagaacaagattgcaaagctcataataaaccgcccgcagagactgaacgccctctccctcgacacgctcgatgagatcttcgaggctctgagaatgcttgagaaggatgacgacgtgagagttgttgtaattaccggagccggagacaaggctttctcagcaggctttgacttgcaaaccgcaatgcaggtgccggacttcttggccccggcaaactcgatgatggtggcggcgaagggacagtgggtcttcacgcagattgagaggttcccgaagccggtcattgcagctataaacggatacgcctttggtggagggtgcgagcttgccttggcatgtgatttcagaataatgaagagaggtgccaagattgggctcacggagatcagcctcgccctcatccccggctggggcggaacgcagcgcttgccaaagctggttggacttacaaaggccaaggaaatgataatgctcgcaaagagaattgatgccgatgaggcagagagaattgggcttgtcaacaaggctgttgatccggagaagttcgaggaggaggttatggccctggcaaaggagctcgcagctggcccaccagtcagcctgagggcggcaaagtacgccattaacttcggagctgagcttccagcagagattggacagatgatcgaggccggaatgttcgctgttgcaacctcaactcaggatgttgtagagggtgtttcggccttcttccagaggaggaagcctgagttcaaaggaaagtaa

SEQ ID NO: 72138 - protein, 658 aa, Archaeoglobus fulgidus DSM 4304
MKVKKVCVLGAGAMGSGIAQVCATAGYEVWVRDIKQEFLDRGKAAIEKNLQKAVSKGKMTEEKAKEILSRIHFTLDMEEAVKDADLVIEAVPEIMDLKKQVFAEVQKYAKPECIFASNTSGLSITELGNATDRPEKFLGLHFFNPPPVMALVEVIKGEKTSDETIKFGVEFVKSLGKVPVVVKKDVAGFIVNRILVPYLVLAIDDVEKGVATKEEIDATMMYKYGFPMGPIELSDFVGLDILYHASQQWDIVPQSKLLEEKFKANELGMKTGKGFYDWSAGRPKIPQELAGKYDAIRLIAPMVNIAADLIAMGVADAKDIDTAMKLGTNMPKGPCELGDEIGLDVILAKVEELYKEKGFEILKPSEHLKKMVSEGKLGEKSGEGFYSYGKGEMTFKNIEIVKDTENKIAKLIINRPQRLNALSLDTLDEIFEALRMLEKDDDVRVVVITGAGDKAFSAGFDLQTAMQVPDFLAPANSMMVAAKGQWVFTQIERFPKPVIAAINGYAFGGGCELALACDFRIMKRGAKIGLTEISLALIPGWGGTQRLPKLVGLTKAKEMIMLAKRIDADEAERIGLVNKAVDPEKFEEEVMALAKELAAGPPVSLRAAKYAINFGAELPAEIGQMIEAGMFAVATSTQDVVEGVSAFFQRRKPEFKGK

SEQ ID NO: 72139 - DNA, 1953 bp, Archaeoglobus fulgidus DSM 4304
  CDS (1)..(1953): transl_table=11
atgaaggttcttgtggtcggtgcgggcacgatggggcacggaattgctgaagtttgtgcccttgctggaaatgaggtaattctctgcgacataaacgagaacattttgaaaaatgcgctctcaaggatagagtggagcgtcagaaagcttgaacaaaagggaaggataaaaggggcagatgatgtgctgaagaggctgaaaaccacaacggatttggttgaagctgctaaagaggctgatttcgtcatagaggctgttgtcgagaagaccgaagtgaagcatgaggtcttcaaaactcttgatgagaactgcagggatgacgtcattctcgccacgaacacctccaccattccaataacagacatagcgatggcaacaaagagaaaggacaaggttgtggggctgcacttcttcaaccctccaactctgataaggctggttgaaataataagggggagagacacgagcgatgaaactgtaaggaaaaccgttgagtttgccaaatcaattggaatggactacgttctcgttgagagggacgttcccgggtttttgattaacaggataaacataagggttttcgtggaggcgataaggctgcttgaggagggttttaaacctgagcagattgatgcagccgttaaatacagagcagggctgcctatgggcctcttcgaggttgttgacttcagcggagttgatacggtttacaatgtcctcaatgaagtgaggaagaggggctttgaggtggaggtgcctggactgctcgagagaatggttttagagggcaggctggggatgaagactggcaaaggcttctatgagtacagtggcttttacacgagggctaaaatctcaaaagaccttgcatacagcgtcaacccgataaatctgctggctccggggattaacgaggctgcgtggctgataagaaacggaatcgcaacgaaagaagacatagacaaggcaacggtgaagggaatgggctatccgaagggcattctggactttgccgacagctatggcatagacagggttgtttcggtgctggaaacgaggaaggggaagacgggactgaaggagtacgagccggatgagctgctgaaagagcttaaggagaatggaaagctcggaaagaagaccggagagggtttttacaagtggaactacgaacttgaggatatcgggccagtaaggtatgagaagaggcacaactatgcagttataaccatgagaagggctgagaagctgaatgccttaaacgaggagatgtgggttggtttgacaaaggctttcaggaaggcgaggcttgacagggatgttagggctgtaatcataactggagaggggagagccttctgcgctggagacgacatagctgtaatgggctcttggaaaagcttcagggatggcgttgagttcttcgagaacattgccatgcccctcgtttcggagcttgctgactacgacaagcccataatatctcttgtgaacggaaatgcgttcggtggagggatggagctcaacatgttctttgacatcgttatagccagcgaagatgcaagctttgccgttcctgaggggctgattggagctatcccgcctatcgcctcatccttcggatacgcccttttcggcaggaggatggcctactacgccctaactggagagacgatggatgctaaagaagctaaggagttcgggctggttgatttagttgtgccgaagcactgcttggaggatgcggggatagagcacgttgataaggtttgcagagttgctcccttagcggcgcagtcgataaagaggtcgatgaatgctgtaaggcagcttttcaggaacgccttagagcttgctggaaaggagattgagcttctaatcccaactgaggactttgctgagggaatggcggcctttgttcagaaaaggcgacctcagtggaagggcaggtaa

SEQ ID NO: 72140 - protein, 650 aa, Archaeoglobus fulgidus DSM 4304
MKVLVVGAGTMGHGIAEVCALAGNEVILCDINENILKNALSRIEWSVRKLEQKGRIKGADDVLKRLKTTTDLVEAAKEADFVIEAVVEKTEVKHEVFKTLDENCRDDVILATNTSTIPITDIAMATKRKDKVVGLHFFNPPTLIRLVEIIRGRDTSDETVRKTVEFAKSIGMDYVLVERDVPGFLINRINIRVFVEAIRLLEEGFKPEQIDAAVKYRAGLPMGLFEVVDFSGVDTVYNVLNEVRKRGFEVEVPGLLERMVLEGRLGMKTGKGFYEYSGFYTRAKISKDLAYSVNPINLLAPGINEAAWLIRNGIATKEDIDKATVKGMGYPKGILDFADSYGIDRVVSVLETRKGKTGLKEYEPDELLKELKENGKLGKKTGEGFYKWNYELEDIGPVRYEKRHNYAVITMRRAEKLNALNEEMWVGLTKAFRKARLDRDVRAVIITGEGRAFCAGDDIAVMGSWKSFRDGVEFFENIAMPLVSELADYDKPIISLVNGNAFGGGMELNMFFDIVIASEDASFAVPEGLIGAIPPIASSFGYALFGRRMAYYALTGETMDAKEAKEFGLVDLVVPKHCLEDAGIEHVDKVCRVAPLAAQSIKRSMNAVRQLFRNALELAGKEIELLIPTEDFAEGMAAFVQKRRPQWKGR

SEQ ID NO: 72141 - DNA, 2007 bp, Archaeoglobus fulgidus DSM 4304
  CDS (1)..(2007): transl_table=11
gtgccacggagagtgaagcaggtgattaatatggatgtaagggagagaataaaaaccgttgcagttctcggtgccgggctgatgggacacggaattgctgaagtctgcgcgatggcgggctacaacgtgacaatgagggacatcaagcaggagtttgttgacagaggaatgaacatgataaaggagagccttgcgaagctcgagcagaagggcaaaataaagagcgccgaagaagtcctttccagaataaagccaacagtagatctggaggaggctgttaaggatgccgacttggttatagaggcagttccagaagtggttgaaatcaagaagcaggtctgggaggaggttgacaagctggcaaagccggactgcatcttcacctccaacacctcaacaatgagaataaccatgctcgcagacttcacctcaaggccggagaagtttgcaggcctgcacttcttcaacccgccagtcttgatgaggctggttgaggttataaggggagagaagaccagcgacgaggtaatggatttgcttgttgagttcgtgaagagcattggtaagacgcctgtgagagtggagaaggacgtgccagggttcatagtcaacagagtgcaggctcccgcgagcgttctgctgatggccatcctcgagaagggcatagcgacacctgaggaagttgacgccaccgtaagaaggctcggacttccgatggggcccttcgagcttgttgactacacgggagttgacatcctctacaacgccctgaagtactacgcccagacaataagccccgactacgagccgccaaagttcctggaggagatggtgaaagcgaacaagctcggaagaaagaccggacagggattctacgactggagcaagggcagaccgcaaatcgactcgagcaaggcaacagacaaaatcaacccgatggacttcacctttgtcgaaatcaatgaagccgtaaagctcgtcgaaatgggtgttgccacaccccaggacatagacacggcgataaagctcggcctcaacagacccttcggcccctttgagctggcgaagcagtttggagcggagcagattgcgaagaggctcgaggagcttgcaaagcagttcggaaagaagattttcgagccagcaaagactctgaaggaggggaaacttgaggaactgttgaaggcgggaaaggctgaggctgaggagaaaaaagaggacgagttcaagaccatcaagattgaaaagctcgatggagggataacgaagctcgtgctgaacagacctgacaggctaaacacgatctccccagaagttctggatgagatcgatagggcgattacgcagctatggaacgataaagacacgagggtcatcgtcatcacaggtgctggagacagagccttctccgcaggagcagaccttggagggagcatcataacgcaccccttcgacttccttgagcacaacaggaagggagagagagttttcacaaggctaagggagattccgaaaccagtcattgcagcaataaacggctacgcccttggtggtggtttggagattgcgatgaactgcgacattaggctggctaagaagtctgctgttctcggccttccagaggttgggctgggcatactgcccggctggagcggaactcagagattggtgaagctcgttggcataagcagggcaatgcagcttgccttaaccggagagagaatcaccgcagaggaggcagagagatgggggctggttaacaaagtctttgatgacgacaagttcgaggaggaggtaatgaactacgccaagaacatcgcagagcgctgcgccccgatttcgatggccctcatcaagaggctcatcaacaagggcggagaggtgccgatggacatcggccttgagtgggagtgcactgcagcaggtctgcttttcgcaacagaggacatgagagagggaatctcagccttcctgaggaaggacaagccccagttcaaggggcgctaa

SEQ ID NO: 72142 - protein, 668 aa, Archaeoglobus fulgidus DSM 4304
MPRRVKQVINMDVRERIKTVAVLGAGLMGHGIAEVCAMAGYNVTMRDIKQEFVDRGMNMIKESLAKLEQKGKIKSAEEVLSRIKPTVDLEEAVKDADLVIEAVPEVVEIKKQVWEEVDKLAKPDCIFTSNTSTMRITMLADFTSRPEKFAGLHFFNPPVLMRLVEVIRGEKTSDEVMDLLVEFVKSIGKTPVRVEKDVPGFIVNRVQAPASVLLMAILEKGIATPEEVDATVRRLGLPMGPFELVDYTGVDILYNALKYYAQTISPDYEPPKFLEEMVKANKLGRKTGQGFYDWSKGRPQIDSSKATDKINPMDFTFVEINEAVKLVEMGVATPQDIDTAIKLGLNRPFGPFELAKQFGAEQIAKRLEELAKQFGKKIFEPAKTLKEGKLEELLKAGKAEAEEKKEDEFKTIKIEKLDGGITKLVLNRPDRLNTISPEVLDEIDRAITQLWNDKDTRVIVITGAGDRAFSAGADLGGSIITHPFDFLEHNRKGERVFTRLREIPKPVIAAINGYALGGGLEIAMNCDIRLAKKSAVLGLPEVGLGILPGWSGTQRLVKLVGISRAMQLALTGERITAEEAERWGLVNKVFDDDKFEEEVMNYAKNIAERCAPISMALIKRLINKGGEVPMDIGLEWECTAAGLLFATEDMREGISAFLRKDKPQFKGR

SEQ ID NO: 72143 - DNA, 2220 bp, Mesorhizobium loti MAFF303099
  CDS (1)..(2220): transl_table=11
atgagctacatcaatttcaccctcgacaccgacgccgacggcattgcgctcgtcacatggaacatgccggatcgctcgatgaacgtgttcaccgaggaggtgatgggcgaactcgacaagatcatcgaccaggtggtggccgacgccggcatcaagggtgcggtgattacctcgggcaaggacagcttctccggcggcgctgatctcaccatgctgcagaagatgcttgctgtgttcgccagggaaaagaccaaggatccggagaaggcggcaaagctgctgttcgacaatgccggccgcatgggcggtctgtggcgtaagctcgaaacatcaggcaagccctgggtatcggcgatcaacggcacctgcatgggcggcgctttcgaattgtcgctggcctgccacggacgcgtcgccgctgattcagacaaggtcaagatggccttgccggaagtcaaggtcggcatcttccccggcgctggcggcacccagcgcgtgccgcgcctgaccgatcagcagcaggcgctgcagatgctgacctccggccagaatctgtcgccgcagaaggcgaaggccatgggcctgatccacgagattgccgagccggccaagctggtcgagacggcaaaggccatgatcaggaacggactgaaagccgtccagccctgggacgagaagggcttcaaattgcccggcggtcagatctattcgccggccggcttcaatctctggccgccggccatcgccatcctgcgtcgcgagacctatggcaactatccggccgccgccgcgatcctgaaatgcgtctatgaaggcctgctggtgccgttcgacaccgcactcaggatcgaacagcgctatttcaccgagatcatgcagaccaaggaagcggcggcgatgatccgctcgctgttcgtctcgctgcaggaactgaacaagggcgcccgccgcccggccggcgtgccggaaaccaaattcaagaagatcggcattctcggcgccggcttcatgggcgccggtatcgcctatgtgacggccaaggccggcattccggtggtgctgctcgaccgcgacatggagtcggccgaaaagggcaaggcgcattcggacagcctcgtctcggatcaggtcaagaagggccgcgccaagccggaggagaaggaccagcttttgtcgctgatcacaccgacggccgattacgccgaccttgcgggctgcgacctcgtggtcgaagcggtgttcgaggactcagccgtcaagaaggccgccaccgaacaggcggaggccgtgctgaagtcgtcggcgatcttcgcgtcgaacacctcgaccattccgatcaccgcgctggcgaagaattcggcgcggccgaagaatttcgtcggcatccacttcttctcgccggtcgacaagatgatgctggtcgagatcatcctcggcaagaagaccggcgacaaggcgctggccaccgcgatcgactttgtccgcgccatcaggaagacgccgatcgtcgtcaacgacacgcgcggcttctacgtcaaccgctgcgtgctgcgctacatgtcggaagcctacaagatgctgatcgagggcgtgcccgcgccgatgatcgagaatgcggcgaaggccgccggcatgccggttggtccgctggcgctgaccgacgagacggccatcgaccttgcccagaagatcatgaagcagaccatccgggatctcggcgacaaggccgtcgaccccgagcagatggcgctgatcaacacaatggtcgacgatcatggccgcttcggccgcaagaacggcaagggtttctacgattatccggccaagcccgccaagaagaagctgtggccgggattgaaggacctctatccgcagcttgcggccgagaaggtcgactatgaggagttgcagcagcggctgctggtcaccatcgcgctggaagcggcgcgcgtgatggaggagggcatcgtcatcgatccgcgcgaggccgatgtcggctcgatcctggccttcggcttcgcgccctacactggcggcgcgctgtcctatatcgacggcatcggcgccaaggaattcgtcaagatcgccaagggactgcagaagaaatacggcgtcgagttcaaggcgcccaagctgctactcgacatggccgaaaagggcgaaaccttctaccagcgcttcgacccctacgccaagggcgacgtgaaacaggccgcctga

SEQ ID NO: 72144 - protein, 739 aa, Mesorhizobium loti MAFF303099
MSYINFTLDTDADGIALVTWNMPDRSMNVFTEEVMGELDKIIDQVVADAGIKGAVITSGKDSFSGGADLTMLQKMLAVFAREKTKDPEKAAKLLFDNAGRMGGLWRKLETSGKPWVSAINGTCMGGAFELSLACHGRVAADSDKVKMALPEVKVGIFPGAGGTQRVPRLTDQQQALQMLTSGQNLSPQKAKAMGLIHEIAEPAKLVETAKAMIRNGLKAVQPWDEKGFKLPGGQIYSPAGFNLWPPAIAILRRETYGNYPAAAAILKCVYEGLLVPFDTALRIEQRYFTEIMQTKEAAAMIRSLFVSLQELNKGARRPAGVPETKFKKIGILGAGFMGAGIAYVTAKAGIPVVLLDRDMESAEKGKAHSDSLVSDQVKKGRAKPEEKDQLLSLITPTADYADLAGCDLVVEAVFEDSAVKKAATEQAEAVLKSSAIFASNTSTIPITALAKNSARPKNFVGIHFFSPVDKMMLVEIILGKKTGDKALATAIDFVRAIRKTPIVVNDTRGFYVNRCVLRYMSEAYKMLIEGVPAPMIENAAKAAGMPVGPLALTDETAIDLAQKIMKQTIRDLGDKAVDPEQMALINTMVDDHGRFGRKNGKGFYDYPAKPAKKKLWPGLKDLYPQLAAEKVDYEELQQRLLVTIALEAARVMEEGIVIDPREADVGSILAFGFAPYTGGALSYIDGIGAKEFVKIAKGLQKKYGVEFKAPKLLLDMAEKGETFYQRFDPYAKGDVKQAA

SEQ ID NO: 72145 - DNA, 1980 bp, Thermoplasma volcanium GSS1
  CDS (1)..(1980): transl_table=11
ttggaaataagtaaagtaaccgtgattggatccgggataatgggtcacgggattgcggaaactatagcgcttgctggctatgatgttaatctggaggatatatctgatgatgttctggctaaagccaaagccgaaattgatgcaagtcttgaccggcttgtaaagtctggaaaactatcagacaaaacaaaggtgcttggaaggatacattacttcaccagcatacctgaatctgtaaaagatgccgatctcgtcatagaggctgtgccagagattctagatataaaaaggcaggttttcgcgcagttagatcagagcactaaagaggatgccatacttgctacgaatacttcgaacataaggctgacagagatagctgaaggtgtaaagaaaaagggaaaggtcgttggaatgcatttcttcaaccctccagtagtattgaaactggtagaagtaataaggagtgattatactgaagacgaagtatttgaagcagtttatgatttttccaagaaaattggaaagatacctataaaggtttacaaggataccccaggatttgttgtcaacaggataaacgcacccgaatcactttacttctgccttgtacttgataaagggatagcgaaacctgaggaagtagacagatttgctaggtctcagggacttcctatgggcccatacgagctaatggattacgttggcatcgatactgtataccattccctagaatactacgcgaaggaactttctcctgattatgctaaatgccaggtatacaacaaactctacaacgaaaagaagctgggcctaaagacaggagaaggtttctacaagtgggttaatggtaaggcccagataccagacgcccagcctactaaaaacgttgagcttatggacatatttgcgctcgagataaatgaggctgtgaaaataatagaggaaaagatcgtctcgcctgaagacatcgagataggcgtcaagttgggtatgaacaggccattcggccccataactgttgcaaaaggcctcacaaatgcggagataaaaagcaaattagaatctctatacaacaagttcggagtttcggtattccagcccgccaagtcaatatcagaaggtaggcttaaatcactcatatctgaaaaatttgagcccccagtgcgaggacaacagactgaacaggaaaagccctctatcgtagaatcatctgacccagttattcttgaaaggaatggaaagattgcagtgctccgccttaacaacacaaagaacaatctcataaactcggctgtcctagatgcactggagcagcagataaacgatctgtggcatgatagagagataaatgtcgtcgtaataactggaaatggatcagtattctcagccggcgcacagcttgactcatttttctccagtaccttcgatttccttgaattttctaggaaaggagaaaggatcttcaagcttctgagtgagatgccaaagataacaatagcagagatgaaagggtacgtgcttggtggtggcctggaactatcgcttgcctgcgatattcgagttgcaactgaagacgtgcagatcggtttccctgaagtgacgctaggtctcatacccggctggggaggctcgcagaagctgtctaagctgattggcgaatctagggcgtcttattacgttttaactgctgagcgctttgacggcaaaagggcttatgaaatcgggttagtatctagattatacaagccgcaggagatcgatgctgaaactttgaagtttgcaaaggacatatcggagagggttgcgccaatatctgccgctcttgctaagcgtctgttgcttagaagcgccaatacatcccttgacgatggtctagagatggaatctatggctatgggaactctgtacggtacagaagatctgaaggaaggcatatccgcattcctttcaaaaagaaagcctaattatcagggaaaataa

SEQ ID NO: 72146 - protein, 659 aa, Thermoplasma volcanium GSS1
MEISKVTVIGSGIMGHGIAETIALAGYDVNLEDISDDVLAKAKAEIDASLDRLVKSGKLSDKTKVLGRIHYFTSIPESVKDADLVIEAVPEILDIKRQVFAQLDQSTKEDAILATNTSNIRLTEIAEGVKKKGKVVGMHFFNPPVVLKLVEVIRSDYTEDEVFEAVYDFSKKIGKIPIKVYKDTPGFVVNRINAPESLYFCLVLDKGIAKPEEVDRFARSQGLPMGPYELMDYVGIDTVYHSLEYYAKELSPDYAKCQVYNKLYNEKKLGLKTGEGFYKWVNGKAQIPDAQPTKNVELMDIFALEINEAVKIIEEKIVSPEDIEIGVKLGMNRPFGPITVAKGLTNAEIKSKLESLYNKFGVSVFQPAKSISEGRLKSLISEKFEPPVRGQQTEQEKPSIVESSDPVILERNGKIAVLRLNNTKNNLINSAVLDALEQQINDLWHDREINVVVITGNGSVFSAGAQLDSFFSSTFDFLEFSRKGERIFKLLSEMPKITIAEMKGYVLGGGLELSLACDIRVATEDVQIGFPEVTLGLIPGWGGSQKLSKLIGESRASYYVLTAERFDGKRAYEIGLVSRLYKPQEIDAETLKFAKDISERVAPISAALAKRLLLRSANTSLDDGLEMESMAMGTLYGTEDLKEGISAFLSKRKPNYQGK

SEQ ID NO: 72147 - DNA, 1980 bp, Aeropyrum pernix K1
  CDS (1)..(1980): transl_table=11
gtgggcgccgggaccatgggccacgggatagctgagctcgcagccatagcgggcttcaaagtctacctggccgacatcaacatagacatcctgaacaacgccctccagaggataaggtggagcctcgaaaagctcgccgagaaggggaggataagggagtctgtcgaaaccgtcatgtcgaggatcacccccatagtcagcgtgagggatggcgagtacagcgaggacctggcgaaggcgctttcggagtccgacttcatgatagaggcgataccggagaagctggagctgaagcagcagctcttcgccttcgccgacaagcacgcgaaggagacagcgatactggcctcaaacacgagcagcctccctataacagagatagccgcggcgactagcaggcccgagaaggttgtgggaatgcacttcttcaaccccccagtcctgatgcccctagttgaggttgtcaagggcgagaagaccagcgaggagacggtggctgcaacggtggatctagccaagaagatggggaagcagactgtggttgtgaagaaggatgtgccggggttcatagtaaacaggatactgggccggctgatggagtctgcctgccttctggtcgagaggggcgggtataccgtggtgcaggttgacgccacggccaagtacctactaggcctgccgatgggtgttttcgagctcgccgactacagcgggatagacgtgttctactatgtcttcgaggccatgagcaggagggggttcaggagcgctaagtgcagcatattcgaggagaagttcaaggcgggggagtacggagtcaaggcgggcaaggggatctacagctaccccgccccgaacaagtatgtgaagcctaacatacctagggaggaggctaaggtagacccactcctcctaatggctctgcccataaacgaggctgcatggctgcttagggaagatgtggcgactagggaggatatagacaaggcggtcaagctcggcctgggatggccaaaaggcgttttcgagtatgccgacgagttcgggcttgaccgggtcgttgaggccctcgagaggataaaaagggatttcggggtggaccacgccgagcctgacccgctcctcaagaagatggtggaggaggggaggatagggaggaaggctggcaagggcttctacgagtacggtgaggtcgaggagaagaagatggagaccctcctcgtgagggtggaaaagcccatagcctggatagtgctcaacaggcccgacaagctcaacgccatatcccccaagatgataatggagctgtctcaggccctagacgagcttgaggagaggagcgacgtcagggctgtgatactgacgggcgcgggtagggcattcagcgccggggccgacgttacagccttcgcccaggtaacccccatcgacatactcaggttctcaaggaagttccaagagcttaccctgaagatccagttctacactaagccagtgatagttgctatcaagggctacgcactcggaggcggcctggagctggcgatgtcaggcgacatacggatagccagcgaggacgcgatgctaggccagcccgagataaacctgggcttcataccaggcgcaggcgggactcagaggcttgcgaggctcgccggccccgccagggccaaagagctgataatgacgggcgacatgatacctgccagtgatgctgagaagatgggcatagtcaacagagtggtgcccccagagctgctcgagcaggaagcaagtagcctggccttaaagcttgcggagaagcctccaatagcacttgcagccgctaaatacgccatagacttcggcctagaaagcaacatatgggcagggctgcagctcgaggcatccctcttcagcgtcctcttcagcaccgaagacgtgatagaaggggtcacagcgttcctggagaagaggaagccaaagttcaagggaagatag

SEQ ID NO: 72148 - protein, 659 aa, Aeropyrum pernix K1
MGAGTMGHGIAELAAIAGFKVYLADINIDILNNALQRIRWSLEKLAEKGRIRESVETVMSRITPIVSVRDGEYSEDLAKALSESDFMIEAIPEKLELKQQLFAFADKHAKETAILASNTSSLPITEIAAATSRPEKVVGMHFFNPPVLMPLVEVVKGEKTSEETVAATVDLAKKMGKQTVVVKKDVPGFIVNRILGRLMESACLLVERGGYTVVQVDATAKYLLGLPMGVFELADYSGIDVFYYVFEAMSRRGFRSAKCSIFEEKFKAGEYGVKAGKGIYSYPAPNKYVKPNIPREEAKVDPLLLMALPINEAAWLLREDVATREDIDKAVKLGLGWPKGVFEYADEFGLDRVVEALERIKRDFGVDHAEPDPLLKKMVEEGRIGRKAGKGFYEYGEVEEKKMETLLVRVEKPIAWIVLNRPDKLNAISPKMIMELSQALDELEERSDVRAVILTGAGRAFSAGADVTAFAQVTPIDILRFSRKFQELTLKIQFYTKPVIVAIKGYALGGGLELAMSGDIRIASEDAMLGQPEINLGFIPGAGGTQRLARLAGPARAKELIMTGDMIPASDAEKMGIVNRVVPPELLEQEASSLALKLAEKPPIALAAAKYAIDFGLESNIWAGLQLEASLFSVLFSTEDVIEGVTAFLEKRKPKFKGR

SEQ ID NO: 72149 - DNA, 2178 bp, Arabidopsis thaliana
  CDS (1)..(2178)
atggattcacgaaccaaggggaagacggtgatggaagttggtggcgatggcgttgccgtcataacactcatcaatcctcccgtcaattctctatccttcgacgtgctatacaatctcaaaagtaattacgaggaggccttgagcaggaatgatgttaaagctattgttattactggtgcaaaggggaggttctctggtggctttgatatatctggttttggtgaaatgcagaaggggaatgtcaaagagccaaaggctggttacatttcgattgacatcataaccgacttgcttgaagctgctaggaaaccgtctgtcgctgccattgatggacttgccttgggaggaggattagaacttgctatggcttgtcatgctaggatatcagctcctgctgcacagttaggcttgcctgagctgcaacttggtgttattcctggttttggaggaacgcagcgtctcccgcgtcttgttggtctcaccaaagcccttgaaatgattttgacatctaagccagttaaagctgaggaaggtcattctttgggtcttattgatgctgtggtgccacctgcggagttagtaaccactgctcgtcgctgggcccttgacatagtcgggaggagaaaaccatgggtatctagtgtttccaagactgataagttacctcctcttggagaggcaagggagatactgacgtttgccaaggcacagacactcaagcgtgcccccaatatgaaacaccctttaatgtgccttgacgctattgaagtaggtattgtttctggtccaagggctggtttagaaaaggaagctgaagtcgcctcacaagtggtaaaactggataccaccaaaggcttgatccacgtcttcttttctcagcgaggaactgctaaggttcctggagttactgatcgtgggttggtgccaaggaagattaagaaggtagccataattggaggcgggttgatgggatctggaatagctactgcgttgatcctaagtaactatccagtgattctcaaggaggtaaatgagaaattcctggaggctggaattggcagagttaaagctaatctccagagccgtgtaaggaagggaagcatgtctcaggaaaagtttgagaaaaccatgtctctccttaagggttctcttgattatgaaagctttagagatgtggacatggtcattgaggctgttattgagaatatatctttgaagcaacaaatttttgctgatctggagaaatactgtcctcagcattgtatccttgctagcaacacatcgaccattgacttgaacaaaattggggagcggaccaagtctcaggatcgaattgttggagcacattttttcagtccagcacatatcatgccgctacttgaaatagttcggaccaatcatacctctgcccaagtaattgttgacctgttagatgttgggaagaagattaagaaaacaccagttgtggtgggaaactgcacagggtttgcagtgaataggatgttcttcccttacacacaggcagctatgttccttgttgagtgtggagcagatccatatctaatcgacagggcaatcagcaagtttggaatgccaatgggtcccttcagactgtgtgacctggttggatttggtgtggcgattgcaaccgcaacgcagtttatcgagaacttctcagaacggacttacaaatcaatgattattccacttatgcaagaggacaagagagctggtgaagccactcgcaaaggtttctatttgtatgatgataagcgcaaggcgaaacctgatcctgagctaaagaaatatatcgaaaaggcaagaagcatatctggagtaaagcttgaccctaagttggcgaatttgtcggagaaggacattattgaaatgacattcttcccagtagtaaacgaggcgtgtagggtttttgctgaaggtatcgctgtcaaagcagcagaccttgacattgctggcataatgggaatgggttttccaccttacagaggaggaatcatgttctgggctgattccatcggatcgaaatacatttactcgaggctggatgagtggtcgaaggcttatggtgaattcttcaagccttgtgcttttttggctgagaggggatctaaaggagttcttttgagcgctcccgtgaaacaagccagctcacggttgtaa

SEQ ID NO: 72150 - protein, 725 aa, Arabidopsis thaliana
MDSRTKGKTVMEVGGDGVAVITLINPPVNSLSFDVLYNLKSNYEEALSRNDVKAIVITGAKGRFSGGFDISGFGEMQKGNVKEPKAGYISIDIITDLLEAARKPSVAAIDGLALGGGLELAMACHARISAPAAQLGLPELQLGVIPGFGGTQRLPRLVGLTKALEMILTSKPVKAEEGHSLGLIDAVVPPAELVTTARRWALDIVGRRKPWVSSVSKTDKLPPLGEAREILTFAKAQTLKRAPNMKHPLMCLDAIEVGIVSGPRAGLEKEAEVASQVVKLDTTKGLIHVFFSQRGTAKVPGVTDRGLVPRKIKKVAIIGGGLMGSGIATALILSNYPVILKEVNEKFLEAGIGRVKANLQSRVRKGSMSQEKFEKTMSLLKGSLDYESFRDVDMVIEAVIENISLKQQIFADLEKYCPQHCILASNTSTIDLNKIGERTKSQDRIVGAHFFSPAHIMPLLEIVRTNHTSAQVIVDLLDVGKKIKKTPVVVGNCTGFAVNRMFFPYTQAAMFLVECGADPYLIDRAISKFGMPMGPFRLCDLVGFGVAIATATQFIENFSERTYKSMIIPLMQEDKRAGEATRKGFYLYDDKRKAKPDPELKKYIEKARSISGVKLDPKLANLSEKDIIEMTFFPVVNEACRVFAEGIAVKAADLDIAGIMGMGFPPYRGGIMFWADSIGSKYIYSRLDEWSKAYGEFFKPCAFLAERGSKGVLLSAPVKQASSRL

SEQ ID NO: 72151 - DNA, 2166 bp, Arabidopsis thaliana
  CDS (1)..(2166)
atggcgaagaagattggagtaacgatggaagttgggaacgatggtgttgctgtcatcaccatttctaaccctcctgttaactctttagccagtccaattatttctgggttgaaggagaagtttcgtgacgccaatcaaaggaatgatgttaaggccatcgtgttgatcgggaacaatggaagattttcgggtggttttgatatcaatgtctttcagcaagttcataagactggggatttatcgcttatgcctgaagtatctgttgagcttgtgtgtaacctgatggaagactccaggaagccggttgttgctgcagttgaaggattagctcttggtggtggtttggaacttgcaatggcgtgtcatgccagagttgctgctccgaaagctcaattaggcttaccagaactgactcttggagtgattcctggttttggaggaacccaacgtcttccaaggttagtaggccttgcaaaagcaacggatatgatactgctttctaagtcaatatcctcagaagaggggcacaaactgggtctcattgatgccttggtgccacctggagatgtgttgagcacatccagaaagtgggctctagacattgcagagggacgtaaaccctttctgcagtcactgcacagaaccgacaaaattggttctttatctgaagctcgtgctatattgaagaattcaagacagctagccaagaagattgccccaaatatgcctcagcaccatgcttgcattgaggtgattgaagaaggaatcatccatggaggatacagtggggttctcaaggaagcagaagttttcaagcaactagtactgtcagacactgcaaagggtcttgttcatgttttctttgcacaacgtgcaacatcaaaagtgcctaatgtaactgacgttggattgaaaccaaggccgataaaaaaagttgcagttattggtggcggtctgatgggttcaggcatcgctacggctctacttctaagcaatataagagttgtgctcaaagaaataaactcagaattccttatgaagggaataaaatcagttgaagcaaatatgaaaagcttggtatctagggggaaactgacacaagataaagcaggaaaggccctctctttgttcaagggagtacttgattacacagaattcaatgatgtggacatggtcatagaggcagtgattgaaaacattcaattgaaacaaaacatattcaaagaaatcgaaaaggtttgttcaccccactgcattttggcgagtaatacatctactatcgacctcgatgtaattggtgaaaagactaactcaaaagatcgcattgttggcgcacatttcttcagtccggcccatctgatgccccttctcgagattgttcgttcaaagaatacttctgctcaggtgattctggatctcatggcggttggaaaggccataaagaaagttcccgtggtggttggaaactgcataggctttgcagtgaataggacattctttccttattcacaagctgcacatatgttggccaatctaggtgttgacttgttcagaattgacagcgttattacctctttcggcttgccattgggccctttccagcttggtgatttggctggacacgggattggattagcagttgggccgatatatgccaaggtctatggtgaccgcatgttcagatctccaatgacagagcttcttcttaagagcgggcgaaatggaaaaatcaacggaagaggatactatatatacgaaaagggaagcaaaccaaaacctgatccatcagtgctttcaattgttgagaaatcaaggaaactgaccaatatcatgcctggtgggaagcctatatcagtaactgataaagaaattgtagagatgatcttattccctgttgtcaacgaggcatgccgcgtcctagatgaaggagttgtgatccgagcctcagacttggacattgcgtctgtccttggaatgagttttccttcttaccggggaggaattgttttctgggcagacactgttggaccaaagtacatatatgagaggctcaagaaattgtcggagacttatggcagctttttcaaaccatcgaggtatctggaggaaagagcaatgaatggaatgcttttgagtgaatcgaaatcgtcgaggtccaaattgtga

SEQ ID NO: 72152 - protein, 721 aa, Arabidopsis thaliana
MAKKIGVTMEVGNDGVAVITISNPPVNSLASPIISGLKEKFRDANQRNDVKAIVLIGNNGRFSGGFDINVFQQVHKTGDLSLMPEVSVELVCNLMEDSRKPVVAAVEGLALGGGLELAMACHARVAAPKAQLGLPELTLGVIPGFGGTQRLPRLVGLAKATDMILLSKSISSEEGHKLGLIDALVPPGDVLSTSRKWALDIAEGRKPFLQSLHRTDKIGSLSEARAILKNSRQLAKKIAPNMPQHHACIEVIEEGIIHGGYSGVLKEAEVFKQLVLSDTAKGLVHVFFAQRATSKVPNVTDVGLKPRPIKKVAVIGGGLMGSGIATALLLSNIRVVLKEINSEFLMKGIKSVEANMKSLVSRGKLTQDKAGKALSLFKGVLDYTEFNDVDMVIEAVIENIQLKQNIFKEIEKVCSPHCILASNTSTIDLDVIGEKTNSKDRIVGAHFFSPAHLMPLLEIVRSKNTSAQVILDLMAVGKAIKKVPVVVGNCIGFAVNRTFFPYSQAAHMLANLGVDLFRIDSVITSFGLPLGPFQLGDLAGHGIGLAVGPIYAKVYGDRMFRSPMTELLLKSGRNGKINGRGYYIYEKGSKPKPDPSVLSIVEKSRKLTNIMPGGKPISVTDKEIVEMILFPVVNEACRVLDEGVVIRASDLDIASVLGMSFPSYRGGIVFWADTVGPKYIYERLKKLSETYGSFFKPSRYLEERAMNGMLLSESKSSRSKL

SEQ ID NO: 72153 - DNA, 2148 bp, Pseudomonas aeruginosa PAO1
  CDS (1)..(2148): transl_table=11
atgatttaccaaggtaaagccatcacggttaagcctcttgagggcggcatcgtcgagttgaatttcgatctcaagggcgagtccgtcaacaagttcaaccgtctcaccctcagtgagttgcgtgcggcagtcgatgcgatcaaggccgatgcatcggtcaagggcgtgatcgtgaccagcggcaaggacgtgttcatcgttggtgccgacatcaccgagttcgttgacaacttccagctgcccgacgaggaactgatggcgggcaacctcgaagccaacaagatcttcagcgacttcgaagacctggacgtacccaccgttgccgcgatcaacggcatcgccctcggcggcggcctggagatgtgcctggccgcggacttccgcgtgatgagcgcgaccgccaaggtcggcctgccggaagtcaagctgggcatctacccgggcttcggcggcaccgtccgcctgccgcgcctgatcggctgcgataacgccgtcgagtggatcgcctcgggcaaggaaaacaaggccgaggacgccctgaaggtcggcgccgtcgatgccgtggtcgctcccgagcaactgcaggccgctgccctcgacctggccaagcgcgccgtcgccggcgagctggaccacaaggcacggcgccagccgaagctggaaaagctgaagctgaatgcaatcgagcagatgatggccttcgaaaccgccaagggcttcgtcgccggccaggccggtccgaactacccggcgccggtggaagccatcaagagcatccagaaggccgccaacttcggccgcgacaaggcgctggaagtcgaagccgccggcttcgtcaagctggccaagacctcggtcgcgcagagtctgatcggcctgttcctgaatgaccaggaactgaagaagaaagccaagaaatacgacgaagtcgccaaggacgtgaaactggccgccgtgctcggcgccggcatcatgggcggcggcatcgcctatcagtcggcgctcaagggcaccccgatcctgatgaaggatatccgcgaagagggtatccagatgggcctgaacgaggccgccaagctgctcggcaagcgcgtcgagaagggtcgcctgaccccggcgaagatggccgaggcgctcaatggcatccgtccgaccatgtcctatggcgacttcggcaacgtcgacatcgtcgtcgaagccgtcgtcgagaaccccaaggtcaagcaagccgtgctcgccgaagtggaaggcgcggtgaaggaagacgcgatcatcgcctccaacacttcgaccatctccatcagcctgctggcccaggcgctgaagcgtccggaaaacttctgcggcatgcatttcttcaacccggtgcacatgatgccgctggtggaagtgatccgtggcgagaagaccggtgaaaccgccatcgccaccaccgtcgcctacgccaagaagatgggcaagagcccgatcgtggtcaacgattgcccaggcttcctggtcaaccgtgtgctgttcccgtacttcggcggcttcgccaagctgctgagcttcggcgtcgacttcgtgcgcatcgacaaggtgatggagaagttcggctggcccatgggcccggcctacctgtccgacgtggtcggcatcgacaccggccaccatggccgcgacgtcatggccgagggcttcccggaccgcatggcggtcgagggcaagaccgccgtcgacgtgatgtacgaggccaaccgcctgggccagaagaacggcaagggcttctacgcctacgagaccgacaagcgcggcaagccgaagaaggtcaccgatccgcaggcctacgaagtgctcaagccgatcgtggtcgagcagcgcgaagtgaccgacgaggacatcgtcaacttcatgatgatcccgctgtgcctggaaaccgtgcgttgcctggaagacggcatcgtcgagaccgctgccgaggccgatatgggcctgatctacggcatcggcttcccgcccttccgtggtggtgctctgcgctacatcgattcgatcggtgtcgccgagttcgtggccctggccgacaagtacgccgagctgggcgcgctgtaccacccgaccgcgaagctgcgtgaaatggccaagaacggtcagaaattcttcggttaa

SEQ ID NO: 72154 - protein, 715 aa, Pseudomonas aeruginosa PAO1
MIYQGKAITVKPLEGGIVELNFDLKGESVNKFNRLTLSELRAAVDAIKADASVKGVIVTSGKDVFIVGADITEFVDNFQLPDEELMAGNLEANKIFSDFEDLDVPTVAAINGIALGGGLEMCLAADFRVMSATAKVGLPEVKLGIYPGFGGTVRLPRLIGCDNAVEWIASGKENKAEDALKVGAVDAVVAPEQLQAAALDLAKRAVAGELDHKARRQPKLEKLKLNAIEQMMAFETAKGFVAGQAGPNYPAPVEAIKSIQKAANFGRDKALEVEAAGFVKLAKTSVAQSLIGLFLNDQELKKKAKKYDEVAKDVKLAAVLGAGIMGGGIAYQSALKGTPILMKDIREEGIQMGLNEAAKLLGKRVEKGRLTPAKMAEALNGIRPTMSYGDFGNVDIVVEAVVENPKVKQAVLAEVEGAVKEDAIIASNTSTISISLLAQALKRPENFCGMHFFNPVHMMPLVEVIRGEKTGETAIATTVAYAKKMGKSPIVVNDCPGFLVNRVLFPYFGGFAKLLSFGVDFVRIDKVMEKFGWPMGPAYLSDVVGIDTGHHGRDVMAEGFPDRMAVEGKTAVDVMYEANRLGQKNGKGFYAYETDKRGKPKKVTDPQAYEVLKPIVVEQREVTDEDIVNFMMIPLCLETVRCLEDGIVETAAEADMGLIYGIGFPPFRGGALRYIDSIGVAEFVALADKYAELGALYHPTAKLREMAKNGQKFFG

SEQ ID NO: 72155 - DNA, 1980 bp, Halobacterium salinarum NRC-1
  CDS (1)..(1980): transl_table=11
atggacgtcgatgacatccacagcatcgcggtgcttggcgccggaaacatgggccacgggatcgcggaagtggccgcgatggccggatacacagtgcggctccgggacatctccgcggagctcgtccaggacggctacgaccagatcgagtggtcgctggggaagctcgcggaatccgaccagctcaccgaggccgcggccgacgccgcactcgaccgcatcagcacgcacgtcgaggtgagcgacgccgtcgacgacgtggacgtcgtcatcgaggcggtccccgagaagatggagatcaaaaccgacgtgtacaccgaggtcgaggcgcacgcccccgccgacgcggtgttcgccaccaacacctccagtctctccatcacggacctctcggaggtcaccgagcgccccgcgcggttctgcggcatgcacttcttcaatccgcccgtcaggatggagctggtggaagtcatctccggggcgcacaccgacgacgcggtgctcgaatgcatcgagtcgctggccgcggacttcgggaagacgccggtgcgggtgcgcaaggactcccccgggttcgtggtcaaccgcatcctcgtgccgttgctgaacgaggccgcgtggctcgtccacgacgacgaggcgaccatcgccgaggtcgactccacgaccaaatacgacatggggctgccgatgggggcgttcgagctcgccgaccaggtgggcatcgacgtctcccacgacgtcctcgattacatgcaggacgtgttgggcacggcctacgagccgtgtccggtgctcgtcgaccacgtcgaggccggcgacctcgggcggaagagcggcgctggcttctacgactacggcgatgacgcggccggcgcggacgtgccgaccgacgcgatccgggccgacatcgccgaccggctcaccgccgtgatggccaacgaggtcgcgaagctcgtcggcggcggcgtcgccgaccccgcggagatcgacgaggctgtgatgctgggcgcgggctaccccgaaggccccgcgaagatggccgacgcagcgggcatcacgtacctccacgagacgctggttgcggcccacgaggcgaccgggcaggcgcgctacgagcccgccgacaccctcgccgagatggcggcggccggcgagtcgttccacgggcgcggcgacgaggacgcggacggccgccgggagttcgacgccgtcagcgtctccgtcgacggcaacgtcggccacatcgaactcgaccgcccgcaccgcatgaacaccatcagcggcgagttgctggccgatctgtcggacgcgatcgacgtgctcggcgacgacgacgacgtgcgcgccgtcctcctgaccggcgcgggtgagaaagcgttctcggccggcgcggacgtcacgtcgatggcgggcaacgccgaccccgtagaggcggtggagctctcccggatgggccagcagacgttcggcaagctcgaagccgccgacgagccggtggttgcggccatcgacggctactgtctcggcggcgggatggagctggcgacctgcgcggacatgcgcctcgccagcgagcgcagcgagctcggccagcccgaacacgatctcggcctcctcccgggctggggcggcacgcagcgcctcaagcacatcgtcggcgagggccgcgccaaggagatcatcttcaccgccgaccgcttcgcccccgagacactggccgactacggcttcatcaacgaggtcgtcaccaccgaggcgttcgaggagcgcgcctgggagctcgcccgcgacctcgccgccggcccgccgatcgccatgaagtacacgaagcgcgcgatgcgtgccggccgcgacgacaccgacgccggcctggagatcgaggcgcagtcgttcggccagctgatgaacacccaagacctgatggagggcgtcagcgcgttctccgcggaccgggagccggagttcaacggggagtag

SEQ ID NO: 72156 - protein, 659 aa, Halobacterium salinarum NRC-1
MDVDDIHSIAVLGAGNMGHGIAEVAAMAGYTVRLRDISAELVQDGYDQIEWSLGKLAESDQLTEAAADAALDRISTHVEVSDAVDDVDVVIEAVPEKMEIKTDVYTEVEAHAPADAVFATNTSSLSITDLSEVTERPARFCGMHFFNPPVRMELVEVISGAHTDDAVLECIESLAADFGKTPVRVRKDSPGFVVNRILVPLLNEAAWLVHDDEATIAEVDSTTKYDMGLPMGAFELADQVGIDVSHDVLDYMQDVLGTAYEPCPVLVDHVEAGDLGRKSGAGFYDYGDDAAGADVPTDAIRADIADRLTAVMANEVAKLVGGGVADPAEIDEAVMLGAGYPEGPAKMADAAGITYLHETLVAAHEATGQARYEPADTLAEMAAAGESFHGRGDEDADGRREFDAVSVSVDGNVGHIELDRPHRMNTISGELLADLSDAIDVLGDDDDVRAVLLTGAGEKAFSAGADVTSMAGNADPVEAVELSRMGQQTFGKLEAADEPVVAAIDGYCLGGGMELATCADMRLASERSELGQPEHDLGLLPGWGGTQRLKHIVGEGRAKEIIFTADRFAPETLADYGFINEVVTTEAFEERAWELARDLAAGPPIAMKYTKRAMRAGRDDTDAGLEIEAQSFGQLMNTQDLMEGVSAFSADREPEFNGE

SEQ ID NO: 72157 - DNA, 2190 bp, Escherichia coli O157:H7 EDL933
  CDS (1)..(2190): w means a or t/u
atgctttacaaaggcgacaccctgtaccttgactggctggaagatggcattgccgaactggtatttgatgccccaggttcagttaataaactcgacactgcgaccgtcgccagcctcggcgaggccatcggcgtgctggaacagcaatcagatctaaaagggctgctgctgcgttcgaacaaagcagcctttatcgtcggtgctgatatcaccgaatttttgtccctgttcctcgttcctgaagaacagttaagtcagtggctgcactttgccaatagcgtgtttaatcgcctggaagatctgccggtgccgaccattgctgccgtcaatggctatgcgctgggcggtggctgcgaatgcgtgctggcgaccgattaccgtctggcgacgccggatctgcgcatcggtctgccggaaaccaaactgggcatcatgccgggctttggcggttctgtacgtatgccacgtatgctgggcgctgacagtgcgctggaaatcattgccgccggtaaagatgtcggcgcggatcaggcgctgaaaatcggtctggtggatggcgtagtcaaagcagaaaaactgattgaaggggcgatggcgattttacgccaggccattaacggcgacctcgactggaaagcgaaacgtcagccgaagctggaaccgctaaaactgagcaagattgaagccaccatgagcttcaccatcgctaaagggatggtcgcacaaacggcaggaaaacattacccggcccccatcaccgcagtaaaaaccattgaagctgcggctcgttttggtcgtgaagaagccttaaacctagaaaacaaaagctttgtcccgctggcgcataccaacgaagctcgcgcactggtcggcattttccttaacgatcaatatgtaaaaggcaaagcgaagaaactcaccaaagacgttgaaaccccgaaacaggccgccgtgctgggcgcaggcattatgggtggcggcatcgcttaccagtctgcgtggaaaggcgtgccggtgattatgaaagatattaacgacaagtcgttagccctcggcatgactgaagccgcgaaactactgaacaagcagcttgagcgcggcaagatcgatggtctgaaactggctggcgtgatctccacgatccacccaacgctcgactacgccggatttgagcgcgtggatgttgtggtagaagcgattgttgaaaacccgaaagtgaaaaaagccgtgctggcagaaaccgagcagaaagtacgcccggataccgtgctggcgtctaacacttcaaccattcctatcagcgaactggccaacgcgctggaacgtccggaaaacttctgcgggatgcacttctttaacccggtccaccgaatgccgttggtggaaattattcgcggcgagaaaagctccgacgaaactattgcgaaagtcgtcgcctgggcgagcaagatgggtaaaacgccgattgtggttaacgattgccccggcttcttcgtcaaccgcgtgctgttcccgtatttcgccggtttcagccagttgctgcgcgacggcgcggatttccgcaagatcgacaaagtgatggaaaaacagtttggctggcctatgggtccggcatatctgctggacgttgtgggcattgacaccgcgcatcacgcccaggcagtcatggcagcgggcttcccacagcggatgcagaaagattatcgcgatgccatcgacgcgctgtttgatgccaaccgctttggtcagaagaacggcctcggtttctggcattataaagaagacagcaaaggtwagccgaagaaagaagaagacgccgctgttgacgacctgctggcagaagtgagccagccgaagcgcgatttcagcgaagaagagattatcgcccgcatgatgatcccgatggtcaacgaagtggtgcgctgtctggaagaaggcattatcgccactccggcagaagcggatatggcgctggtctacggcctgggcttccctccgttccacggcggcgcgttccgctggctggacaccctcggcagcgcaaaatacctcgatatggcacagcaatatcagcacctcggcccgctgtacgaagtgccggaaggtctgcgtaataaagcgcgtcataacgaaccgtactatcccccggttgagccagcccgtccggttggcgacctgaaaacggcttaa

SEQ ID NO: 72158 - protein, 729 aa, Escherichia coli O157:H7 EDL933
  misc_feature (599)..(599): Xaa can be any amino acid
MLYKGDTLYLDWLEDGIAELVFDAPGSVNKLDTATVASLGEAIGVLEQQSDLKGLLLRSNKAAFIVGADITEFLSLFLVPEEQLSQWLHFANSVFNRLEDLPVPTIAAVNGYALGGGCECVLATDYRLATPDLRIGLPETKLGIMPGFGGSVRMPRMLGADSALEIIAAGKDVGADQALKIGLVDGVVKAEKLIEGAMAILRQAINGDLDWKAKRQPKLEPLKLSKIEATMSFTIAKGMVAQTAGKHYPAPITAVKTIEAAARFGREEALNLENKSFVPLAHTNEARALVGIFLNDQYVKGKAKKLTKDVETPKQAAVLGAGIMGGGIAYQSAWKGVPVIMKDINDKSLALGMTEAAKLLNKQLERGKIDGLKLAGVISTIHPTLDYAGFERVDVVVEAIVENPKVKKAVLAETEQKVRPDTVLASNTSTIPISELANALERPENFCGMHFFNPVHRMPLVEIIRGEKSSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFDANRFGQKNGLGFWHYKEDSKGXPKKEEDAAVDDLLAEVSQPKRDFSEEEIIARMMIPMVNEVVRCLEEGIIATPAEADMALVYGLGFPPFHGGAFRWLDTLGSAKYLDMAQQYQHLGPLYEVPEGLRNKARHNEPYYPPVEPARPVGDLKTA

SEQ ID NO: 72159 - DNA, 2127 bp, Deinococcus radiodurans R1
  CDS (1)..(2127): transl_table=11
atgggccgacaccacaaacaggaggctctccccatgacccaagacaccccgaaccgtgtggaccagtcgcgtgacggcgacgttttcattctcaccatcaacaacccccccgtgaacgccttcggccccggcgtgcccgagggcctcaaggccgggctcgacgccgccgctgccgacgacagtgtcaaggccgtggtcatcatcggcggcgggcgcaccttcgtggcgggcgccgacatcaagggcttcggccttccgcgcgagcaggcccctgatctgcgcggcaccgtcgccaagctcgacgccttcgagaagcccaccgtcgcggctattcacggcaccgcgctcggcggcggcctcgaactcgcgctcggctgcacctaccgtgtggcggtaaaagacgcgcagctcggcctccccgaagtcaagctcggcgtgcttcccggtgcgggcggcacccagcgcttgccgcgtgtggtcggcgcccagaaagcgctggaaatgatgctctcgggcaaccccatcaaggcgcccgccgccaaggagctcgggctggtggacgaaatcgtggacggtgacctgctcgccggagcggtggcctttgcccgcgcccacgccgacgcccgcccactgccccgcgtcagcgagcgctcggtggaaggcggcagccccgaagtctttgccgctgcccgcgaaggcctgaaaaagacccaccgcggccagcattcgccctcgcacatcgtggacctcgcggaaatggccgcgaccaagccctttcaggaaggctgggacgccgaggccgaccgcttcgtggattcgctcaacagcccgcagtcgcgtggcctgcgccacatcttcttcgccgagcgtgaagcaggcaagattcgcggcctgagcaaggacacgcccaccaccgacatcaagtcggcgggcatcatcggcgccggcaccatgggcggcggcatcgccatgaacttcctcaacgtcggtattcccgtcaccatcgtggaaaccagccaggaagcgctcgaccgcggcctcggcgtcatccgcaagaactacgagaacacggcgaaaaagggccgcatgacccaggacgacgtggaaaagcgcatgggcctgctgacccccacgctcaagatggaagacctcgcgggcgccgacatcatcatcgaggctgtcttcgagaacatggacgtgaagaaggacatcttcacccggctcgacaagatcgccaagcccggcgcgattctggcgagcaacaccagcacgctcgacgtcaacgagatcgccagcgtgacgggccgccccgaacaggtcatcggcctgcactttttcagccccgccaacgtgatgaaactgctcgaaatcgtccgcgcggacaagaccagcgacagcgtgctggcgaccagcctcgcgctcgccaagcgcatcaagaaagtcggtgtggtcgtcggcgtctgtgacggtttcgtcggtaaccgcatggtgcaccgctacggtgacgaagcccgcaagatcgtggaagaaggcgcgcgccccgaggacgtggacgccgccatgaacgccctcggcctgccgatgggccccttccagatgagcgacatggccggactcgacatcggctactccatccgccagcaccaggccaaggtgcgcggcgagcccgagcccgacggctggctcgaccgcatcgtcaagaccgggcgcaagggccagaagacgcagggcggcatctacgactacggcgaggaccgcaagcccaagcccaacgccgacgtgcaaaagctcatcgaggactaccgcgccgagcagggcacgcagtcgcgcgaaatcagccaggaagaaatcaccaagcgtctcgcctactcgctcgtcaacgagggcgccaagattctggaagagggcatcgctcagcgggcgagcgacattgacgtcatctacatctacggctacggcttccccgcctaccgtggcggcccgatgcagtacgccagcgagcagggcctgaagaacgtcgccgccgacctcgaaaaatacggccagacgcccgcgccggtgctgaagcagctcgccgacgaaggcaagaccttcagcgactacgaccgcgagcacgctggggcgtaa

SEQ ID NO: 72160 - protein, 708 aa, Deinococcus radiodurans R1
MGRHHKQEALPMTQDTPNRVDQSRDGDVFILTINNPPVNAFGPGVPEGLKAGLDAAAADDSVKAVVIIGGGRTFVAGADIKGFGLPREQAPDLRGTVAKLDAFEKPTVAAIHGTALGGGLELALGCTYRVAVKDAQLGLPEVKLGVLPGAGGTQRLPRVVGAQKALEMMLSGNPIKAPAAKELGLVDEIVDGDLLAGAVAFARAHADARPLPRVSERSVEGGSPEVFAAAREGLKKTHRGQHSPSHIVDLAEMAATKPFQEGWDAEADRFVDSLNSPQSRGLRHIFFAEREAGKIRGLSKDTPTTDIKSAGIIGAGTMGGGIAMNFLNVGIPVTIVETSQEALDRGLGVIRKNYENTAKKGRMTQDDVEKRMGLLTPTLKMEDLAGADIIIEAVFENMDVKKDIFTRLDKIAKPGAILASNTSTLDVNEIASVTGRPEQVIGLHFFSPANVMKLLEIVRADKTSDSVLATSLALAKRIKKVGVVVGVCDGFVGNRMVHRYGDEARKIVEEGARPEDVDAAMNALGLPMGPFQMSDMAGLDIGYSIRQHQAKVRGEPEPDGWLDRIVKTGRKGQKTQGGIYDYGEDRKPKPNADVQKLIEDYRAEQGTQSREISQEEITKRLAYSLVNEGAKILEEGIAQRASDIDVIYIYGYGFPAYRGGPMQYASEQGLKNVAADLEKYGQTPAPVLKQLADEGKTFSDYDREHAGA

SEQ ID NO: 72161 - DNA, 2145 bp, Mycobacterium leprae TN
  CDS (1)..(2145): transl_table=11
atggcagacactgcaattcagtggagtaaggacgccgacggtattgtcacgctgacaatgaacgacccgtccaggtcggccaacgttatgaacgagatttacatcgaatcgatgggcaatgcggtggatcgcattgttgcggaaaaagattcgattaccggtgtggttataaccagcgctaaaaggactttctttgccggcggtgacctcaccgcgatgatcaatactggatcagaagaggccgggcaatgcttcgacactgtcgagacggtcaagaaacaattgcgcaccctggaaacgctgggcaagccggtcgttgccgccatcaacggtgccgcgctgggcggcggtctggagatcgcgctcgcatgtcatcaccggatcgctgccgacgtcaagggcagtcagctcggcttgcctgaagtgacgctggggctgttgcccggcggcggtggggtgacccgcacggtgcggatgtttggcatccagaacgcgttcgtcaacattctgtcacagggcacccgctttaagcctgccaaggctaaggagatcgggctggtcgacgagctgttgtcaacagtcgaggagctggtgcccgcggctaaggcgtggatcaaggccaacccggaagcgcacgagcagccgtgggacaagaagagctacgagatgcccggtggtactccgacctcgccagggttggcggccattctgccgtcattcccgtcgctgttacgcaagcagctcaagggcgcgccgatgccggccccgagggccatcttggccgccgcggtcgagggcgcgcaggtcgacttcgacaccgccagccgtattgagagccgctacttcgtttcgctggtcaccggccaggtcgccaagaacatgatccaagcgtttttcttagatctgcagcacatcaattccggtgggtctcgacccgacggcattggtaaaaccccgatcaagaagatcggtgtgctgggtgcgggtatgatgggcgccggtatagcctacgtctcggccaaggcgggctacaacgtggtgcttaaggatgtgagtcttgaggccgcgcagaagggcaagagctactcggagaagctggaagccaaggcgctagagcggggccgcactacgcaggagaagagcgacgttctgctggcgtgcatcgccccgacaggcgaccctactgatctcaagggcgttgacttcgtgatcgaagccgtcttcgagaaccaggaactcaagcacaaggtgttccaggagatcgaagacatcgtcgaccccaatgcggtactcgggtcgaacacctcgacgttgccgattaccggtctggcgaccggcgtcaagcggcaggaggactttatcgggatccacttcttctctccggtcgacaagatgccgctggtcgaaatcatcaagggcgagaagacctcggacgaggcactggcccgggtgttcgactacgccctggctattggcaagaccccgattgtggtcaacgacagccgcggcttcttcacttcgcgggtgatcggcacttttgtcaacgaggcgctggcgatgctcggtgagggggtggaaccatccagcattgaacaggcaggtgcgcaggctggctacccggcgccgccgctgcagttgtccgacgagctgaatctggagctcatgcacaagatcgcgatcgctacccgcaagggtgtcgaggatgccggcggcatgtatgagtcgcacccggcagaaaccgtggtggagaagatgattaagctcggccggtccgggcgcttgaagggtgccggcttttacgagtacgttgacggcaagcggtccgggttgtggctcggtctgcgggagacgttcaagtcgggctcgtcgcagccgccgttgcaggacatgatcgaccggatgctgttcgccgaggcgctggaaactcagaagtgcctcgatgagaacgtgctgacgtccactgccgacgccaatatcgggtccatcatgggtatcggtttcccgccgtggaccggtggcagcgcgcagtttatcgccggctactctggcccggccggtaccggccagcaggccttcgtgtcccgagcccgtgagctggtggccaagtacggcgatcgctttctgccgccggagtcgctgctatag

SEQ ID NO: 72162 - protein, 714 aa, Mycobacterium leprae TN
MADTAIQWSKDADGIVTLTMNDPSRSANVMNEIYIESMGNAVDRIVAEKDSITGVVITSAKRTFFAGGDLTAMINTGSEEAGQCFDTVETVKKQLRTLETLGKPVVAAINGAALGGGLEIALACHHRIAADVKGSQLGLPEVTLGLLPGGGGVTRTVRMFGIQNAFVNILSQGTRFKPAKAKEIGLVDELLSTVEELVPAAKAWIKANPEAHEQPWDKKSYEMPGGTPTSPGLAAILPSFPSLLRKQLKGAPMPAPRAILAAAVEGAQVDFDTASRIESRYFVSLVTGQVAKNMIQAFFLDLQHINSGGSRPDGIGKTPIKKIGVLGAGMMGAGIAYVSAKAGYNVVLKDVSLEAAQKGKSYSEKLEAKALERGRTTQEKSDVLLACIAPTGDPTDLKGVDFVIEAVFENQELKHKVFQEIEDIVDPNAVLGSNTSTLPITGLATGVKRQEDFIGIHFFSPVDKMPLVEIIKGEKTSDEALARVFDYALAIGKTPIVVNDSRGFFTSRVIGTFVNEALAMLGEGVEPSSIEQAGAQAGYPAPPLQLSDELNLELMHKIAIATRKGVEDAGGMYESHPAETVVEKMIKLGRSGRLKGAGFYEYVDGKRSGLWLGLRETFKSGSSQPPLQDMIDRMLFAEALETQKCLDENVLTSTADANIGSIMGIGFPPWTGGSAQFIAGYSGPAGTGQQAFVSRARELVAKYGDRFLPPESLL

SEQ ID NO: 72163 - DNA, 1992 bp, Sulfolobus solfataricus P2
  CDS (1)..(1992): transl_table=11
atgaaagtagaagatattaaaaagattctcgtagtaggagcaggaacaatgggacacggaatagctgaaattgctgcaatttctgggtataaggtgtacttaagtgatatatctcaagatatattaaacaatgctttggaaagaataagatggagtttaagtaagttacaagagagagggcagataaaagaaagtgttgataccataatgtctagaataaccactatagtgggattagataagacagtaagtgatgctgacttctctatagaggcttcgactgaaagaatggatataaaaaggcaagttttctcaaaacttgacgaattattaccaccccatgcaatattagctacaaatacgagtagtctaccaatatctaaaatagctgaagctactaaaagacaagataaagttgtgggaatgcacttcttcaacccgccagtactaatgcaacttgtagaagtaatgaaaggagataaaactagtgatgagactgcaaaaataacttatgatttagccaagaagtttggcaaacaaccaataatgataaataaggatgtgccaggttatgtcgtaaatagaatattaggtcaaataaatatcgcctcatgcatattagtggagaagaaagtagcagactacagagaagttgatgcagtagctagatacaaactagggtttccaatgggggtatttgaattaatagactatacaggggtagatgttgcgtactacgtttcgaagtctagagaagaactaggaataagagatgatataccgatatgcagtctgatagagcaaaagtttaagaataacgaactaggtgtgaaaactggtaaaggtttctacacttatccagctccaggcaaatatgttaaaccggaattgcctaaggaattagctgataaattaaacccagcattaattttagctggaggcgtaaatgaggctactagactattgagagaaggaatagcaagtagggatgatatagatttaggtgtgagattgggattagggcttccaaagggaatattccaatatgcggatgagttaggagttgatacagtacttaaggctttggaagatctaaaagcgttatctggttataacaccttcaatccagatcccatgataactcaaatgataagagagaataagttaggaataaagacgggaagtggattctaccagtatgggaaggtcgaggaaaagaaaatgaacacccttatcatacgtattgaaccaccgctagcgtggatcatactaaatagaccagaacgattgaacgcactaaatccagagttagtaagtgaacttgacaagagtctagatgaattagaaagtagaagtgatgtaagggtagtcataattactggtaacggtagggctttctcagctggggcagacgttagctcgttcattacgctaagaccaatagacgtgataaggttgaggactttaagaaatgttgtgaacaaaattgctctctacactaagccgataattgcgggaataaatgggtttgcattaggtggtggacttgagttggccatggcttgtgatataaggatagcttctgaggttgcacaactaggacaaccggaaatcaatataggtataatacccggagctgggggaacgcagaggctacccagactagttggaaaaggaaaggctaagttaatgatatataccggtgatatggtttccgctgaggatgcgtataagatgggattagtggatttagtagttccaagtaatagatttgaggaagaagtaagaagagtagcattgaaaatagctgaaaaatcaccaatatcactattggcagctaaattagcaatagagttaggatacgaatctaatatctggactggacaaactctagagtcaacattatttgggcttttattcacaactaaagatgtagaagaaggagtgaaagctttcttagaaaaaagaaaaccccaatttaaaggagaataa

SEQ ID NO: 72164 - protein, 663 aa, Sulfolobus solfataricus P2
MKVEDIKKILVVGAGTMGHGIAEIAAISGYKVYLSDISQDILNNALERIRWSLSKLQERGQIKESVDTIMSRITTIVGLDKTVSDADFSIEASTERMDIKRQVFSKLDELLPPHAILATNTSSLPISKIAEATKRQDKVVGMHFFNPPVLMQLVEVMKGDKTSDETAKITYDLAKKFGKQPIMINKDVPGYVVNRILGQINIASCILVEKKVADYREVDAVARYKLGFPMGVFELIDYTGVDVAYYVSKSREELGIRDDIPICSLIEQKFKNNELGVKTGKGFYTYPAPGKYVKPELPKELADKLNPALILAGGVNEATRLLREGIASRDDIDLGVRLGLGLPKGIFQYADELGVDTVLKALEDLKALSGYNTFNPDPMITQMIRENKLGIKTGSGFYQYGKVEEKKMNTLIIRIEPPLAWIILNRPERLNALNPELVSELDKSLDELESRSDVRVVIITGNGRAFSAGADVSSFITLRPIDVIRLRTLRNVVNKIALYTKPIIAGINGFALGGGLELAMACDIRIASEVAQLGQPEINIGIIPGAGGTQRLPRLVGKGKAKLMIYTGDMVSAEDAYKMGLVDLVVPSNRFEEEVRRVALKIAEKSPISLLAAKLAIELGYESNIWTGQTLESTLFGLLFTTKDVEEGVKAFLEKRKPQFKGE

SEQ ID NO: 72165 - DNA, 1959 bp, Sulfolobus tokodaii str. 7
  CDS (1)..(1959): transl_table=11
atgaaattagaaaaagtgttagttgtaggagcaggtactatgggacacggtattgctgaactattcgcaatagcgggatatgaggtatatttaagtgatataagtcaagaaattctggataatgcattaaacaaaattaagtggagtttagataaactccaagaaaaagggcagttaaaggaaagtacgagtaatataatttctaggataaagactgttgtaggattgaatgaaagtgtgaatgatgctgattttgcaattgaggctgcgatagaaagactggatttaaagaggcaaatattctctaaacttgatgaattattacctactcatgcaatattagctactaatacgagcagtttatctatatctaaaatagctgaagctacgaaaagaccggaaaaagttgttgggatgcatttctttaatcccccagtattaatgcagttagttgaagtaatgaagggtgagaagactagtgatgagactgcaaagacaacttatgagttagctaaaaagctaggtaaaattcctataatgataaataaagatgttccagggtatgtagtaaatagaattttaggagaaataatttcagcatcgtgtattatattacaaaaaggtattgctgattacctaacaattgacgctgtagcgaaatacaaactgggatttccaatgggtgtttttgagctgttagactatactggtattgatgttaattattatgtttctaaatctttagaggaatacgggataaaatctccttgttcagctttatttgaggagaaggtcaaaaagaatgagcttggagttaagagcggaaagggattttattcttatcctgccccagggaagtactcaaagcccgaaatacctaaagagttggctgataagttagatccagtgttaatcatagcactaggagttaatgaggcttcaaggctgtttagacaaggaatagtgagtaaagaagacatagatttgggtgtcaaactgggattgggatttcctaagggaattttccagtatgctgacgaattaggaatagataatgtggttaaagcaattaattcactttcagtcgaggagccagatcgtttattattagatatggtcaatgaaggaaagttaggtataaagagtggttctggattttatgagtatggtaaagttgaggagaaaaaattaaatacgttaatagttcgtgttgaaccgcccttagcatggattatattaaatagaccggagaggcttaacgcactaagtatggaattgataggggaattaaacaaagcattagatgagttagaaaatgacagtagagtaagggttataatcttgtccggaagtggtagggctttttctgctggagctgatgtaacgtctttcttaacgttaaaaccaatagacgtaataagatttagaagcttacgtgaactaaccaataagattcagttttatacaaaaccagttattgctgcaataaatggttatgctttaggtggaggattagagattgcattagcgtgtgatattagaattgcgtctgaaaattctatgcttggtcaaccggaaataaatctaggtataattcccggtgctggtggtactcaaagattgcctaagttagtagggaagggaagagctaaattacttatttataccggtgatatgatacctgcgaaggatgcatacgaaatgggattagttgatatagttgtacctacaggcaggtttgaggatgaagtgagaaggatagcccttaaaatagctgaaaaatctcctctttcattacttgctgcaaaattagctatagaattaggctatgatgcaaatatatttagtggagagtatttagagtcgagtttatttggcttactctttacgactaaggatgtgcaagagggagtaagagctttcttagaaaagagaaaacccgaatttaaaggagaataa

SEQ ID NO: 72166 - protein, 652 aa, Sulfolobus tokodaii str. 7
MKLEKVLVVGAGTMGHGIAELFAIAGYEVYLSDISQEILDNALNKIKWSLDKLQEKGQLKESTSNIISRIKTVVGLNESVNDADFAIEAAIERLDLKRQIFSKLDELLPTHAILATNTSSLSISKIAEATKRPEKVVGMHFFNPPVLMQLVEVMKGEKTSDETAKTTYELAKKLGKIPIMINKDVPGYVVNRILGEIISASCIILQKGIADYLTIDAVAKYKLGFPMGVFELLDYTGIDVNYYVSKSLEEYGIKSPCSALFEEKVKKNELGVKSGKGFYSYPAPGKYSKPEIPKELADKLDPVLIIALGVNEASRLFRQGIVSKEDIDLGVKLGLGFPKGIFQYADELGIDNVVKAINSLSVEEPDRLLLDMVNEGKLGIKSGSGFYEYGKVEEKKLNTLIVRVEPPLAWIILNRPERLNALSMELIGELNKALDELENDSRVRVIILSGSGRAFSAGADVTSFLTLKPIDVIRFRSLRELTNKIQFYTKPVIAAINGYALGGGLEIALACDIRIASENSMLGQPEINLGIIPGAGGTQRLPKLVGKGRAKLLIYTGDMIPAKDAYEMGLVDIVVPTGRFEDEVRRIALKIAEKSPLSLLAAKLAIELGYDANIFSGEYLESSLFGLLFTTKDVQEGVRAFLEKRKPEFKGE

SEQ ID NO: 72167 - DNA, 2214 bp, Sinorhizobium meliloti 1021
  CDS (1)..(2214): transl_table=11
atgtcttacacgaacttcaagatcgaaaccgacgccgacggcattgcgctggtcacctgggacatgcccgacaagtcgatgaacgtcttcaccgaagaggtgatgaaggaactcgacgccattatcgatcagacgaccgcagatcctgccgtcaagggcgtggtcatcacctccggcaaatcctccttctccgggggtgccgacctttcgatgatcaagtcgatgttcaccttccaggccgaggaaaggaagaaggacccggacaacgcggcccggaaactcttcgacctcgtgggccggatgacgggtctcttccgcaagctcgaaacctcgggcaagccctgggtgtcggccatcaacggcacctgcatgggcggcgccttcgagatgtcgctcgcctgccacggccgtgtcgcctccaatgcgaaatcggtgaagatcgcgcttcccgaggtcaaggtcggcattttcccgggcgccggcggcacccagcgcgttccgcggctgaccaatacgcaggacgcgctgcagatgatgacgaccggctcctcgctcacgccggcgcgggcaaaggccatggggctcgtccacgaggtggtcgatccggacaagctgatcgaggctgccaaggcgatgatcaagaacggcctgaagccggttcagccctgggacgagaagggcttcaagctgccgggcggcggcatctggacgcccgcctccgcgcagctctggccggccgcctccggcatcctgcgccgcgagacctacggcaattaccccggcgcgatcgcgatcctgaaatgcgtctatgaggggctgcaggttcccttcgatacggctttgaagatcgagcagcgctatttcaccgaaatcctgcagacgaccgaagccttctcgatgatccggtcgctgttcgtctcgatgcaggaactcggtaagggcgcgcgccggccggccggtgtaccgaagaccgagctcaagaaagtcggcgtcgtcggcgccggtttcatgggcgcctcgatcgcctatgtaaccgcggcgggcggcatccccgtcaccctcatcgaccgcgacatggaagctgccgaaaagggcaagacgcattcggaaggcctggtcaaggacgcgatcggtaagggacgcttgaccaaggaggaaggcgaagcgctgctttcgcgcatcacaccttcggcggactatggcgatctcagggatgccggcctcgtcatcgaggcggtcttcgaggaccggcaggtcaagaaggacgtgatcgagaaggtcgaagcggtgatcgccgaggacgcgatcttcgcctccaacacctcgacgctgccgatcaccggcctcgccaggaattccaaacgcccggaccggttcatcggcattcatttcttctcgccggtcgagaaaatgatgctgaccgaggtgatcctcggcaaggagaccggagaccgtgcgctcgcggccgcgctcgactatgtcgcggcgatcaggaagacgccgatcgtcgtcaacgacacgcgcggcttctacgtcaatcgctgcgtcttccgctatatccacgaagcctatgacatgctgatcgagggcgtaccgccggcgatgatcgagaacgccgccaagatggccggcatgccggtcggaccgctgtcgctcaacgacgaggtggcgatcgacctcagccagaagatcctgaaggcggccgttgccgatctcggcgacaaggccgtcgatctcaggcacatggcgctgatcgacaagatggtcgacgagctcgaccggcgcggccgcaagaacggcaagggtttctacgagtatccggcaaagccggccaggaaatatctctggccgggcctgaaggagctctacccgcagaaggatgccggcgagatcgaggtcggtgtgctcaagcagcgcctgctcgtgacgatcgcactcgaagccgcgcgtacgatcgaggagggcatcgtcaccgacccgcgcgaagccgatgtcggctcgatcctcggcttcggctttgcgccctacaccggcggcacgctctcctacatcgacggcatgggtgcgaaagccttcgtcgagctttgcgaaaagctcgccgcggaccatggcgaccacttccggccgacgccgcttttgaaggagatggcggaaaagggcgaaaccttctacgggcgcttcgacccgtatggcgcggggcagaaggcggcataa

SEQ ID NO: 72168 - protein, 737 aa, Sinorhizobium meliloti 1021
MSYTNFKIETDADGIALVTWDMPDKSMNVFTEEVMKELDAIIDQTTADPAVKGVVITSGKSSFSGGADLSMIKSMFTFQAEERKKDPDNAARKLFDLVGRMTGLFRKLETSGKPWVSAINGTCMGGAFEMSLACHGRVASNAKSVKIALPEVKVGIFPGAGGTQRVPRLTNTQDALQMMTTGSSLTPARAKAMGLVHEVVDPDKLIEAAKAMIKNGLKPVQPWDEKGFKLPGGGIWTPASAQLWPAASGILRRETYGNYPGAIAILKCVYEGLQVPFDTALKIEQRYFTEILQTTEAFSMIRSLFVSMQELGKGARRPAGVPKTELKKVGVVGAGFMGASIAYVTAAGGIPVTLIDRDMEAAEKGKTHSEGLVKDAIGKGRLTKEEGEALLSRITPSADYGDLRDAGLVIEAVFEDRQVKKDVIEKVEAVIAEDAIFASNTSTLPITGLARNSKRPDRFIGIHFFSPVEKMMLTEVILGKETGDRALAAALDYVAAIRKTPIVVNDTRGFYVNRCVFRYIHEAYDMLIEGVPPAMIENAAKMAGMPVGPLSLNDEVAIDLSQKILKAAVADLGDKAVDLRHMALIDKMVDELDRRGRKNGKGFYEYPAKPARKYLWPGLKELYPQKDAGEIEVGVLKQRLLVTIALEAARTIEEGIVTDPREADVGSILGFGFAPYTGGTLSYIDGMGAKAFVELCEKLAADHGDHFRPTPLLKEMAEKGETFYGRFDPYGAGQKAA

SEQ ID NO: 72169 - DNA, 1977 bp, Thermoplasma acidophilum DSM 1728
  CDS (1)..(1977): transl_table=11
atggagatcaacaaggtaactgtcataggatccggaataatggggcatgggatagcagaagtcatagctcttgctggcattgacgtcaacatcgaagatatttcaaacgaggttctggacaaggcgaaggcttccataaattccagtctggacaggttagtcagttctgggaaattgaaaaataaggatgaagttttatcgcgtattcactatttcacggatataccttcatctgtgaaagatgcggacctggtaatagaggccgttccggaagtattggatataaagaagagtgttttcgaccagctggacaagagcacaaaggacagcgccatacttgccacaaacacatccaacatcaggctcacagagatcgcggagggaataaagaaaaagggcaaggttgtcggcatgcacttcttcaacccaccggttgtgctaaagctggttgaggtcataagatctcagtacactgaagatgaagtattcgaaacggtttacgaattctcgaagaggattggaaagacacctataaaggtctacaaggacaccccgggttttgtggttaacaggataaacgctccggaatcactgtacttttgcctggtgatagataataatctggcgaagccggaggaggttgacagattcgcacgatcacagggactgcccatgggaccgtacgagcttatggactacgtcggcatagataccgtctatcattctctacagtactacgcaaaggagctatctccagattattctaagtgccaagtgtacacgaagctcttcaatgagaagaagcttgggctgaagaccggcgaaggtttctacaaatgggtgaatggtaaggcgcagatacctgaggcaaagcccacaaaggccgtggagcttatggacatcttcgctctggagataaacgaggcggtgaagataatagaggacggtgttgcctcgcccgatgatatagagacgggtgtaaagctcggaatgaacagaccattcggcccgataactgtggcaaagggcttaaccaatgctgaggtaaaggctaagctggaggcactctaccagaaattcagcgtggaggtcttcaaaccggcgaagtccatagctgaggggaagctcaagacggttatatcgatgcaggtagcgctctccaaggccgaagagaagaaggaggcagcatcagcatacatttcatccagcgatccagtaataatggagacgaagggcaggatcgccatacttcgtataaataatacgaagaataatctgataaatgcagcggtaatggatggtctcgagaaggcccttacggatctttggaacaaccgtgagatatctgttatcgtattgactggaaatggcccggtcttctcagctggagcacagctggactcgttcttcagcagcacctttgacttcatggagttctccaggcgtggagagcgtgtttttaaactgctaagtgagataccgaaggttacaatagccgagttgaagggctacacactcggcggaggattcgagatggcactcgcctgtgatataagggttgccaccgaggatgtgcagatagggttcccagaggttacacttggccttgttcccggatggggtggcacacagaggctctcacgtacagctggacagtccagagctgcttactatatactcacaggtgagaggttcacaggcaaagaggcttatgagatgggcatcgtcgcgaagatattcagcaaggacacaatcgactcggagacgctgaacctggctcagaacatagctgataaggttgcaccaatatctgctgcactggctaagaggcttgttctcaggagcacgaacacatccctggatgatgggctggagatggaagccatatcgatgggcctgctctacggtacagaggatctcaaggagggcatctcggcattcctgggtaagagaaaaccaaattatcagggtaaatga

SEQ ID NO: 72170 - protein, 658 aa, Thermoplasma acidophilum DSM 1728
MEINKVTVIGSGIMGHGIAEVIALAGIDVNIEDISNEVLDKAKASINSSLDRLVSSGKLKNKDEVLSRIHYFTDIPSSVKDADLVIEAVPEVLDIKKSVFDQLDKSTKDSAILATNTSNIRLTEIAEGIKKKGKVVGMHFFNPPVVLKLVEVIRSQYTEDEVFETVYEFSKRIGKTPIKVYKDTPGFVVNRINAPESLYFCLVIDNNLAKPEEVDRFARSQGLPMGPYELMDYVGIDTVYHSLQYYAKELSPDYSKCQVYTKLFNEKKLGLKTGEGFYKWVNGKAQIPEAKPTKAVELMDIFALEINEAVKIIEDGVASPDDIETGVKLGMNRPFGPITVAKGLTNAEVKAKLEALYQKFSVEVFKPAKSIAEGKLKTVISMQVALSKAEEKKEAASAYISSSDPVIMETKGRIAILRINNTKNNLINAAVMDGLEKALTDLWNNREISVIVLTGNGPVFSAGAQLDSFFSSTFDFMEFSRRGERVFKLLSEIPKVTIAELKGYTLGGGFEMALACDIRVATEDVQIGFPEVTLGLVPGWGGTQRLSRTAGQSRAAYYILTGERFTGKEAYEMGIVAKIFSKDTIDSETLNLAQNIADKVAPISAALAKRLVLRSTNTSLDDGLEMEAISMGLLYGTEDLKEGISAFLGKRKPNYQGK

SEQ ID NO: 72171 - DNA, 2325 bp, Yersinia pestis CO92
  CDS (1)..(2325)
atgagcaaggaaaatatcgttacccgtgaaaatacagctgtcagtgaaaatgcagtcagtgaacctacagtgaataatgatgtgggcgcatcggccacgaattcagttacccatcccgcatttaccctcaacgtaaggccggacaatattggcattatcaccattgatgttgttggtgacaaagtgaataccctaaaggctgaatttgctgatcaaattgccactatattgcaacaagcgcacgctctaccaaaattacagggactcgtcattgtttctggcaaaccagactccttcattgccggtgcggatatcacgatgatcgcggcttgtcgtaccgctcacgacgcccgcgtattagcacaaaaaggccaatcaattttggcgcaaattgccgctttccctgtgccggttgtggctgcgattcatggcgcttgtctggggggagggctagagctggcgctggcttgccatagccgcatatgttctctggatgataaaaccgttctcgggctaccggaggtgcaactggggttactgcctggctccggcgggacgcaacgtctgccgcgtttagtgggggtcagtaaagcactggatatgatattgaccggtaaacagatacggccccgtcaggcactaaaaatggggctggtggatgatgttgtgccacgcgatatcttattggatgtggcgattcagcgcgcgaaagcggggtggcttaatcgacgagcattaccatggcaggagcgtttactcagtgggccgttgggtaaagctttattattccgtattgtccgtaaaaaaacgctagctaaaacgcgggggcactacccggcggctgaacgtattattgatgtggtgcgtaaaggattagatcagggcgggccaagtggttatgaggcagaagccagagcatttggcgagttggcgatgtcgcctcagtcagccgcattacgcagcctgttttttgccacgacgtcactgaaaaaagagaccggaagtgcagccacagcgcgtgcaattcatcgggtcggcgtattgggcggtggcttgatgggcggaggtattgccaacgtaacggctacccgagcgggcttgccagtgcgtatcaaagatatcaatccgcaaggaattaatcaggcgctgaaatatacctgggacgcattgggtaaacgggttcgtagtaagcggatgcgcccaactgaacagcagcggcagatgatgttgatctctggtagtacggattaccgtggttttgaacgtgtcgatattgtggtggaagcggtatttgaggatttatcactgaagcagcaaatggttgctgacatcgaacgatttggtgccgcccatactatttttgcctccaatacatcatcactccccatcagccagattgctgctttggcgcaacggccagagcaggttattggcctgcactattttagtccagtagataaaatgccactggttgaagtcatcccccatgaaaaaaccagtgaagagaccatcgctaccaccgttgctttagcccggaaacagggtaaaacagccattgtggtggctgatcgcgctgggttctatgtaaaccgcattttggcaccttatattaatgaagctgcccgttgcctgctcgacggagagcctatcgaatcagttgataacgcgttggtcgattttggtttccccgtaggccccatgatgctgcttgatgaggttgggattgatgttgcgaccaaaataatgccgattctggtcgagcaattagggccgcgttttgctgcgcccccgtcatttgacgttattttgaaggatggacgtaaagggcgcaaaaatggccgtggcttttatttatattcaaaccccacaaaaaattcatctccaacaaaaaatgggaattctccggcgaagcgtaatagctttaagtggagaaaaaacaaagtaaaaccagtcgatgccagtatctataccttgttgggggtgacacctaaagcccatcttggtgcaggcgtgattactcaacgttgtaccatgctgatgttgaacgaagcggtacgctgtctggatgaatcgatcattcgtaacccgcgcgatggtgatattggtgcagtgtttgggatcggttttccgcctttcctcggtggtccgttccgctatttggatagcctgggagccgataaggtggtacaagcactcagattattggtacagcaatacggtgagcgtttcgaaccttgccagcggttggtaacaatggctgaacaacaacaacaattctatcccgtggacgccaatatagatgaggtgacggacgtggcaagctga

SEQ ID NO: 72172 - protein, 774 aa, Yersinia pestis CO92
MSKENIVTRENTAVSENAVSEPTVNNDVGASATNSVTHPAFTLNVRPDNIGIITIDVVGDKVNTLKAEFADQIATILQQAHALPKLQGLVIVSGKPDSFIAGADITMIAACRTAHDARVLAQKGQSILAQIAAFPVPVVAAIHGACLGGGLELALACHSRICSLDDKTVLGLPEVQLGLLPGSGGTQRLPRLVGVSKALDMILTGKQIRPRQALKMGLVDDVVPRDILLDVAIQRAKAGWLNRRALPWQERLLSGPLGKALLFRIVRKKTLAKTRGHYPAAERIIDVVRKGLDQGGPSGYEAEARAFGELAMSPQSAALRSLFFATTSLKKETGSAATARAIHRVGVLGGGLMGGGIANVTATRAGLPVRIKDINPQGINQALKYTWDALGKRVRSKRMRPTEQQRQMMLISGSTDYRGFERVDIVVEAVFEDLSLKQQMVADIERFGAAHTIFASNTSSLPISQIAALAQRPEQVIGLHYFSPVDKMPLVEVIPHEKTSEETIATTVALARKQGKTAIVVADRAGFYVNRILAPYINEAARCLLDGEPIESVDNALVDFGFPVGPMMLLDEVGIDVATKIMPILVEQLGPRFAAPPSFDVILKDGRKGRKNGRGFYLYSNPTKNSSPTKNGNSPAKRNSFKWRKNKVKPVDASIYTLLGVTPKAHLGAGVITQRCTMLMLNEAVRCLDESIIRNPRDGDIGAVFGIGFPPFLGGPFRYLDSLGADKVVQALRLLVQQYGERFEPCQRLVTMAEQQQQFYPVDANIDEVTDVAS

SEQ ID NO: 72173 - DNA, 2130 bp, Caulobacter crescentus CB15
  CDS (1)..(2130): transl_table=11
atgaacaccctgaccgcgtcggtcatcaaggaaatcggcgagatcgtcgagcgcatcaagtccgacgccgagatcaagggcgtcgtcatcacctcgggcaagaccaccggcttctgcgccggcgcggacctgggcgaactgggcggcggcggcggcatggccggcggcgcggcgggcggtgaagcggcgctgaaggcggccttcgacgccggcttcgccctcaacaaggccttccgtggcctggagacctgcggcaagccggtcgccgccgcgatcaacggcctggccatgggcggcggtctcgagatcgcgctcgcctgccactatcgcgtggtcgccgaccacccgaagatccagctggccctgcccgaagccaaggtcggcctcctgcccggcgccggcggcacccagcgcctgccgcgcctgatgggcgtgatggccgctgcgccgtacctgctggaaggcaagtcgatgaagccggccgaggccctggccaacaaggtcgtgcacgaggtcgtgccggtcgaccaagtggtcgaagccgccaagacctgggtcaagaccaaaggtgatccggtggcgccgtgggacaagaaggacttcaagctgcccggcggcggtccctacaccccgaccggcggtcaggtgttcatcatgggcaacgccatgctgcgcaagcagacctatggcaactatccggcccagctgaacatcctgaaggcggtctatgaaggcacccaggtgccgttcgacgcggccatccgcatcgagacccgctacttcctgaagacgatgatgtcgccgcaggccaagggcatgatccgcaccctgttcctcagcttgcaggaactgggcaagggctcgggccgtccggccgatgtgccgccgtcggaagccaagaaggtcgccgttctgggcgcgggcatgatgggcgcgggcatcgcctatgtccaagccatggccggcatcgagaccgtgctgatcgaccaaagccaagaggcggccgagaagggcaagggctacgccgagaacctgctgaagaaggcggtgtcgcgcggcaagatgactcaggacaaggccgacgcggtcctggccctgatcaccccgaccaccgactacgcccacgtcaagggcagcgacctcgtcatcgaggcggtgttcgagagccgcgagatcaaggccgacgtcacccagaaggccgaggcccagctggccgaagacgccatcttcggctccaacacctcgaccctgccgatcaccggcctggccaaggcgtcggtgcgtccgaagaacttcatcggcatccacttcttctcgccggtcgacaagatgggcctggttgagatcatcatgggcgaggaaacgtcggacgaggccctggccaagtcgatcgactacgtcctgaagatcaagaagacgccgatcgtcgtcaacgacagccgcgggttctacaccagccgctgcttcggcaccttcgtgcaggaaggcctcgagatgctggccgacggcatcgccccggccatcatcgacaatgtcggccgcgccaccggcatgccgcgcggtccgctggagatgaacgacgacgtcgctctggacctcggctacaaggtcacccagcagaccaagaaggacctcggcgacaagttcgaggaccgtccgttcgccccgatcatcgaaaagatggtcgtcgagctgcagcgctttggccgcaagaacggcaagggcttctacgactatccggaaaccggccccaagaccctgtggaagggcctctcggagctggcgccggtgacgatcgccgaggccgaccaggcgctgatccaggagatccgcacccgcctcctgtaccgccaggccgtcgaggccgcgcgctgcttcgaggaaggcgtgatcaccgatccgcgcgaagccgatgtcggcgcgatcctgggctggggcttcgcgccctggaccggcggtccgatcagcctgatcgacggcgtcggggccaaggcctttgtcgagacctgcgaccagctggcccagaagtacggcaagcgcttcgcaccgccggcgctgctgcgcgagatggccgagaagggcgaaaccttctacggccgcttcggcgccaaggccaaggcggcggcgtaa

SEQ ID NO: 72174 - protein, 709 aa, Caulobacter crescentus CB15
MNTLTASVIKEIGEIVERIKSDAEIKGVVITSGKTTGFCAGADLGELGGGGGMAGGAAGGEAALKAAFDAGFALNKAFRGLETCGKPVAAAINGLAMGGGLEIALACHYRVVADHPKIQLALPEAKVGLLPGAGGTQRLPRLMGVMAAAPYLLEGKSMKPAEALANKVVHEVVPVDQVVEAAKTWVKTKGDPVAPWDKKDFKLPGGGPYTPTGGQVFIMGNAMLRKQTYGNYPAQLNILKAVYEGTQVPFDAAIRIETRYFLKTMMSPQAKGMIRTLFLSLQELGKGSGRPADVPPSEAKKVAVLGAGMMGAGIAYVQAMAGIETVLIDQSQEAAEKGKGYAENLLKKAVSRGKMTQDKADAVLALITPTTDYAHVKGSDLVIEAVFESREIKADVTQKAEAQLAEDAIFGSNTSTLPITGLAKASVRPKNFIGIHFFSPVDKMGLVEIIMGEETSDEALAKSIDYVLKIKKTPIVVNDSRGFYTSRCFGTFVQEGLEMLADGIAPAIIDNVGRATGMPRGPLEMNDDVALDLGYKVTQQTKKDLGDKFEDRPFAPIIEKMVVELQRFGRKNGKGFYDYPETGPKTLWKGLSELAPVTIAEADQALIQEIRTRLLYRQAVEAARCFEEGVITDPREADVGAILGWGFAPWTGGPISLIDGVGAKAFVETCDQLAQKYGKRFAPPALLREMAEKGETFYGRFGAKAKAAA

SEQ ID NO: 72175 - DNA, 2079 bp, Caulobacter crescentus CB15
  CDS (1)..(2079): transl_table=11
atggccgcgatcaacgccgtcaccgatttctctgtcgaaggcgacatcggcgtcgtcacgctcaactcgccgccggtcaatgcgctgtcggccgctgtccgcgagggtctgcagggcgcgttcgacgccgcgatcgccgacgccgccgtcaaggccatcgtgctgatctgcgacggcaagaccttcatcgccggcgccgacatcactgagttcggcaaggccatgaccggcccgtccctgcaggacgtgcagaacgtcatcgagaactcgcccaagccggtgatcgccgcgatccacggcacggcactgggcggcggcctggaagtggcgctggtggccaactaccgcgtcgccgttccctcggccaaggccggtctgccggaagtgaacatcggcctcttgcccggcgccggcggcacccagcgcctgccgcgcatcgtcggcgtcgagaaggcgctggagatggtcaccaccggccagcatgtgccggccaaggccgcacacgccatgggcctgttcgacgagctggtcgaggagggcaagctgcgcgagggcgccatcgctttcgccaaggccgtcgtcgccgagaaccgtccgctcaagaaggtccgtgacctgaacgagaaggtcgaggccgcgcgtggcaagcccgagatcttcgaagccttccgcaaagccaacgccaagaagttccgcggcttcatggcgccggagaacaacatcaagtgcatcgaggcggcggtgaacctgcccttcgacgagggcctgaaggccgagcgcaaactgttcatggagctgatgaccggcagccagtcggccgcccagcgctatgtgttcttcgccgagcgccaggccgccaagatcccggacgtgccggacgacaccccgacgatccccgtcaagaaggtcggcgtcatcggcgccgggaccatgggcggcggcatcgccatgaacttcctcaacgccggcatcccggtgacgatcatcgaggccaagcaggagaacctcgaacgcggcgtcggcatcatccgcaagaactatgagaacaccgccaagaagggccgtctgacccaggacgacgtcgaaaagcgcatggcgctgctgaccccctccatggagatggaggccctggccgactgcgacatgatcatcgaggccgtgtttgagctgatggagatcaagaaggaggtcttcaccaagctggacaagatcgccaagcccggcgcgatcctggccaccaacacctcctatctcgacgttgatgcgatcgcggccgtgaccagccgtcccgagagcgtgatcggcacccacttcttctcgccggccaatgtcatgcgcctcttggaactggtgcgcggcgacaagaccagcaaggacgtcatcgccacctgcatgaagctgtccaagaccatcggcaaggtgccggtgctggtcggcgtctgctacggctttgtcggcaaccgcatgctggcccagcgtcagcgcgaggcccagaagctgattctggaaggcgcgatgccctgggacgtcgaccgggtgctgtacgacttcggcctgccgatggggccgttcgcgatgagcgacctggccggcctcgacatcggctgggatccagccaagaccagctcctcgaccgtgcgcgaggtgctctgcgagatggaccgtcgcggccagaagaacggcaagggcttctacgactacgacgagaaccgcaacgccaagccttcgccggtcgtcgaggaggtgatccgcgacttcgccgagaagcgtcagatccagcgccgcgagatcaccgaccaggagatcctggagcgctgcctctatccgatggtcaacgagggcgcgaagatcctcgaggaaggcaaggccatccgggcctcggacatcgatatcgtctggatcaacggctacggctggccggtctatagcggcggcccgatgttctggggcgagctggtgggcctcgacaaggtcctggccaagatgaagcagttccacgccgagctcggcgacgacttcaagccctcggccctgctcgagcgcctggtcgccgaaggcaagggcttcaaggacgcttga

SEQ ID NO: 72176 - protein, 692 aa, Caulobacter crescentus CB15
MAAINAVTDFSVEGDIGVVTLNSPPVNALSAAVREGLQGAFDAAIADAAVKAIVLICDGKTFIAGADITEFGKAMTGPSLQDVQNVIENSPKPVIAAIHGTALGGGLEVALVANYRVAVPSAKAGLPEVNIGLLPGAGGTQRLPRIVGVEKALEMVTTGQHVPAKAAHAMGLFDELVEEGKLREGAIAFAKAVVAENRPLKKVRDLNEKVEAARGKPEIFEAFRKANAKKFRGFMAPENNIKCIEAAVNLPFDEGLKAERKLFMELMTGSQSAAQRYVFFAERQAAKIPDVPDDTPTIPVKKVGVIGAGTMGGGIAMNFLNAGIPVTIIEAKQENLERGVGIIRKNYENTAKKGRLTQDDVEKRMALLTPSMEMEALADCDMIIEAVFELMEIKKEVFTKLDKIAKPGAILATNTSYLDVDAIAAVTSRPESVIGTHFFSPANVMRLLELVRGDKTSKDVIATCMKLSKTIGKVPVLVGVCYGFVGNRMLAQRQREAQKLILEGAMPWDVDRVLYDFGLPMGPFAMSDLAGLDIGWDPAKTSSSTVREVLCEMDRRGQKNGKGFYDYDENRNAKPSPVVEEVIRDFAEKRQIQRREITDQEILERCLYPMVNEGAKILEEGKAIRASDIDIVWINGYGWPVYSGGPMFWGELVGLDKVLAKMKQFHAELGDDFKPSALLERLVAEGKGFKDA

SEQ ID NO: 72177 - DNA, 2148 bp, Salmonella typhimurium LT2
  CDS (1)..(2148): transl_table=11
atgactaccacatcagcttttatgcttaacgtgcgtctggataatgtcgcggttgtcgctattgatgtccctggagaaaaggtgaacaccctgaaagcggagtttgccacgcaggtacgcgccatcctgaagcagatccgggaaaataaagcgttgcagggcgttgtttttatctcagccaaagcagataactttattgctggcgctgatatcaacatgataggtcactgccaaaacgcgcaggaagcggaaacgctggcgcgtcagggacagcaactgatggcggagatccaggcgttgcctgttccggttatcgccgccattcacggcgcctgtctggggggcggccttgaaatggcgctggcctgccatcggcgcatctgtaccgacgacgttaaaaccgttctcggactgccggaggtacagttagggcttttaccgggatcgggcggaacgcagcgacttccgcggctggtgggggtcagtaccgcgctggatatgatcctgacaggtaaacagcttcgcgccagacaggcgcttaaagccgggctggttgatgatgtggtgccgcaaactattttactggaagcggctgtcgagctggctaaaaaagaacgcctggcgcagcggacattaccggtccgtgaacgtatcctggcggggccgctggggcgcgcgctgttatttcgcctggtgcgtaaaaagacagcgcaaaaaacgcagggtaattatccggcgacggagcggatcattgatgtgattgaaactggactggcgcagggcagcagtagcggctatgacgcggaagcgcgcgctttcggcgagctggcgatgacgcctcaatcgcaggcgctgcgcgctattttctttgccagtaccgaggtgaaaaaagatcccggtagcgatgcgccgcccggcccgctgaacagcgtgggcatcttaggcggcgggttaatgggcggcggtatcgcctgggttacggcctgtaaaggcggcttgccagtacgaattaaggatataaatactcaggggatcaatcatgctctgaagtacagctgggatctgcttgaaacaaaagtacgccgccgccatatcaaagccagcgaacgcgataaacagttggcgttgatatcaggttcgaccgattaccgtggtttcagtcatcgtgatctggtcattgaagcggtgtttgaagatctgccgttaaaacaacagatggtggcggaagtggagcaaaattgcgctgctcacaccatttttgcctccaatacttcttccctgccgattggcgatattgcggcgaatgcggccagaccggaacaggtgattggattgcacttttttagcccggtcgaaaaaatgccgctggttgaggttattcctcatgcgtctacttccgcgcagaccatcgccacgaccgttaagctggcgaaaaaacagggtaaaaccccgatagtcgtcagtgataaagccgggttttatgttaaccgaattcttgcgccatatatcaatgaggcgattcggatgctgactgaaggcgaacgcgtcgaacatattgacgccgccctggtaaaatttggttttccggtggggccaatccaacttttggatgaggtaggaatcgacacgggcactaaaattattcctgtgcttgaggcggcgtatggagaacgttttagcgcgcctgcaaatgttgtcgcttcaattttgaatgacgatcgcaaaggtagaaaaaatggtcgcggtttctatctttatggcgaaaaagggcgtaaaagcaaaaaacaggttgaccctgctatttataagcttattggcgtgcaagggcagagtcgattgtctgcgcagcaggtggcagagcgctgtgtcatgttaatgcttaacgaagcggcgcgctgtttcgacgaaaaagtgattcgcagcgcgcgcgatggcgatatcggcgccgtgtttggtatcggttttccgccgtttctcggtggcccgttccgctatatggatgctctcgggccgggtgaaatggtggcgacattacagcgcctggccgcactttacggtcctcgttacgcgccttgtgaacaattagtgcgcatggcggagcgcagggagcatttctggacgaatggggaaactgaccagggaaattga

SEQ ID NO: 72178 - protein, 715 aa, Salmonella typhimurium LT2
MTTTSAFMLNVRLDNVAVVAIDVPGEKVNTLKAEFATQVRAILKQIRENKALQGVVFISAKADNFIAGADINMIGHCQNAQEAETLARQGQQLMAEIQALPVPVIAAIHGACLGGGLEMALACHRRICTDDVKTVLGLPEVQLGLLPGSGGTQRLPRLVGVSTALDMILTGKQLRARQALKAGLVDDVVPQTILLEAAVELAKKERLAQRTLPVRERILAGPLGRALLFRLVRKKTAQKTQGNYPATERIIDVIETGLAQGSSSGYDAEARAFGELAMTPQSQALRAIFFASTEVKKDPGSDAPPGPLNSVGILGGGLMGGGIAWVTACKGGLPVRIKDINTQGINHALKYSWDLLETKVRRRHIKASERDKQLALISGSTDYRGFSHRDLVIEAVFEDLPLKQQMVAEVEQNCAAHTIFASNTSSLPIGDIAANAARPEQVIGLHFFSPVEKMPLVEVIPHASTSAQTIATTVKLAKKQGKTPIVVSDKAGFYVNRILAPYINEAIRMLTEGERVEHIDAALVKFGFPVGPIQLLDEVGIDTGTKIIPVLEAAYGERFSAPANVVASILNDDRKGRKNGRGFYLYGEKGRKSKKQVDPAIYKLIGVQGQSRLSAQQVAERCVMLMLNEAARCFDEKVIRSARDGDIGAVFGIGFPPFLGGPFRYMDALGPGEMVATLQRLAALYGPRYAPCEQLVRMAERREHFWTNGETDQGN

SEQ ID NO: 72179 - DNA, 2268 bp, Caenorhabditis elegans
  CDS (1)..(2268)
atgttatcacgtgttgttcatagatcgtcttcggtgtttcgaacaaatctctcgtttcgtttgttctcacagtctgcattcgccgtgcacagtactcatcgcgttgagaaacaaggtgacgtggctgtcatgaaaattgatttgccaaacacaacagaaaatgtgctcaataaagcgttgttcgcggaaatgaacgaaacattggataggcttcaatctgatcaaagtgtcaaagctattgttgtcatgtccggaaaaccaaatagttttgttgctggagctgatattcaaatgtttaaagcagaaaaaacagccgctggagtttcaaaccttcttcgtgagggccagaaacaattattgaccatcgagctgagccagaaaccaatagtcgctgcaatcatgggaagctgtatgggaggtggacttgaaatcgcccttgcttgtcactaccgcattgctgtgaacgacaaaaagacactcttgggacttccagaagtgactcttgggataatgccaggagacggtggaactcaaagactaccaaagctaactactgttcagaatgttctcgacttgacattgactggcaagagaatcaaggcaaataaggctatgaaaattggaattgttgatcgtgttattcaaccacttggggatggaatttgtacatcaaccgaaaccactcataaatatcttgaagaaatcgcagtgcaatcggcacgggagcttgccaatggaaaactcaaaattaacagagacaaaggatttgtgcacaatgctacgcaagcagtcatgactagcaaatttgtactggacaatgtgattctcaagatggctaagaataagcttattaaactgaccaatgggaactatccggctccactcaagattcttgacgttgtccggacggcatacctagacccaaaaaatggatatgaagctgaggctaaggcatttggtgaactttcacaaactttccaatcaaaagcactttttggactgttcgaaggatcgactaatgctaaaaagaacaaatacggaaaaggacttccggtcaatgaaatcgctgtcgtcggagctggattcatgggagcagggattgcgaatgtaactatcaataagggtattcgaacagttcttttggatgccaaccaggcaggcgttgaacgaggacaaaatcacgtggctacacatttgaatagacagctcaagagacaaaagatttcgaaattggaaagagaaaaaatctacaaccatcttgtgccaacaattgattattccgccatgaagaatgctgatgtagttattgaggcggttttcgaagatcttcctctgaagcataaagttattaggcaaatcgaaaacgtcgttggaccaaacacaatcattgcatccaatacttctgctcttccaatcaaggatattgccgctgcgtcttctcggtcagataaagttattgggatgcactatttctctccagttgaaaagatgcagttacttgaaattatcactcatgatggaacatctaaagaaacccttgcaactgctgctcagctaggactaaagcaaggaaaactcgtcgtcgtcgtcaaggattgtcccggcttcttcgtcgtccgatgcctaagcccaatgatgtcggaaatagtccgtctcctccaggaaggtgtcgaaccatctgaacttgacaaactcacaacgaaattcggattccctgtgggagctgcgacgttggccgacgaagctggactcgacgtcgcagaacacgtggctcgatatctcggaaccgctttaggtccacgtgttcatggaggatcggttgatttgttgtccgaattggtgcgcgctggacataaggggcgtaagacttcaaagggaatctttgtgtacggagatggggcaaaaggcagcaagaaagtaaaccaagaggcggcaaagctgtttgaaaagtataaattgacaccaatcaaatctgtctcatctcctgaggaccgtcaacttcgtctcgtctctcgatttgtcaatgaggcacttctttgtcttgaagaaggtgttattagctcaccatctgacggagatatagcctctgtatttggtctcggtttcccaccattctggggaggcccattccggtttgtcgatctttatggagcgggcaagttggttgcggcgatggacaggtttgccggagtgtacgaatctgtccaatttgagccatgccaacttctcagaaatcatgcgaagagtggaggacaattttatagctaa

SEQ ID NO: 72180 - protein, 755 aa, Caenorhabditis elegans
MLSRVVHRSSSVFRTNLSFRLFSQSAFAVHSTHRVEKQGDVAVMKIDLPNTTENVLNKALFAEMNETLDRLQSDQSVKAIVVMSGKPNSFVAGADIQMFKAEKTAAGVSNLLREGQKQLLTIELSQKPIVAAIMGSCMGGGLEIALACHYRIAVNDKKTLLGLPEVTLGIMPGDGGTQRLPKLTTVQNVLDLTLTGKRIKANKAMKIGIVDRVIQPLGDGICTSTETTHKYLEEIAVQSARELANGKLKINRDKGFVHNATQAVMTSKFVLDNVILKMAKNKLIKLTNGNYPAPLKILDVVRTAYLDPKNGYEAEAKAFGELSQTFQSKALFGLFEGSTNAKKNKYGKGLPVNEIAVVGAGFMGAGIANVTINKGIRTVLLDANQAGVERGQNHVATHLNRQLKRQKISKLEREKIYNHLVPTIDYSAMKNADVVIEAVFEDLPLKHKVIRQIENVVGPNTIIASNTSALPIKDIAAASSRSDKVIGMHYFSPVEKMQLLEIITHDGTSKETLATAAQLGLKQGKLVVVVKDCPGFFVVRCLSPMMSEIVRLLQEGVEPSELDKLTTKFGFPVGAATLADEAGLDVAEHVARYLGTALGPRVHGGSVDLLSELVRAGHKGRKTSKGIFVYGDGAKGSKKVNQEAAKLFEKYKLTPIKSVSSPEDRQLRLVSRFVNEALLCLEEGVISSPSDGDIASVFGLGFPPFWGGPFRFVDLYGAGKLVAAMDRFAGVYESVQFEPCQLLRNHAKSGGQFYS

SEQ ID NO: 72181 - DNA, 2217 bp, Agrobacterium tumefaciens str. C58
  CDS (1)..(2217): transl_table=11
atgagcacttataccaatttcaccatcgagacggacgcagacggcattgccctcgtcacctgggacatgccggaaaaatccatgaacgtcttcacggcagaggttcttgaggaactgaacgccattgtcgatgccaccgttgccgatggcgcggttaagggtgtcgtcttcacttcgggcaaaagcagcttttccggcggtgccgatctgtcgatgctgaagtccatgttcgccctttataatgacgaaaaggcgaaaagccccgacgctgccgcggcgaagctgttcgaactcgtcggtcgcatgacgggcctgttccgcaagatcgagaccaatggcaagccgtgggtctcggccatcaacggcacctgcatgggtggcgcatttgagctttcgcttgcctgccatggccgcgtggcctccagtgccaagagcctcaagatcgcactgccggaagtcaaggtcggcatcttccccggtgccggcggtacccaacgcgtatcgcgcctgaccgacgcgcaatcggcgttgcagatgatgacgacagggcaatccctgaccggcgcgcgcgccaaggccatggggctggtgcaccaggtggtcgagccggatcaactggtcgcaaccgcaaagcagatgatcaaggacggcctgaagccggtggcaccctgggatgagaagggcttcaaggcccccggcggcggcatctggacgccggccgcagcccagctctggcctgccgctcccgccatcctgcgccgcgaaagcgccggcaactacccggctgcacttgccatcctgaaatgtgtttatgaaggcctgcaattgcccttcgacacggcgttgaaggtggagcagcgttatttcaccgaaatccttcgctcgaaggaagccttcggcatgatccgctcgctgttcatttccatgcaggaactgaacaagggtgcgcgccgcccggcaggccagccgaagacggagttcaagaaggtcggcgtcgtcggcgcgggcttcatgggcgctgccgtggcttacgtcaccgccgcagccggcattcccgtgacgctggtggatcgtgaccaggacgcggccgacaagggcaagggccattgcgaggagagtgtgaaggccgccatcggcaagggcaggctgacgcaggaagagggtaaggccctgctcgacctcgttaccccgacatccgattacgccacactcgccgatgccgatctcgtcatcgaagccgtcttcgaggatcgtgacgtgaagaaggccgtcatcgaggccgtggaagccgtgttgcccgaaggtgcgatctttgcctccaacacctccactttgccaatcacgggcctcgcgaagaactcgaagcgcccggcggatttcatcggcatccatttcttctcgccggtcgagaagatgatgctgacggaagtgatcctcggcaaggaaaccggtgacaaggcgctggccgtcgcgctggattacgtggcgaagatcaggaaaacgccgatcgtggtcaacgatacgcgcggtttcttcgtcaatcgctgcgtgctgcgctatatggcggaaagctacgacatgctgatcgaaggcgtgcccgccgccatgatcgaaaatgccgcgaaatttgccggcatgccggtcggtccactggcgctgaatgacgaggtggcgatcgatctttcctacaagatcctgaaagccactgtcgccgatctcggcgaaaaggccgtcgatccgcgtcatatggaactggtgaagaagctggtggaaggcgacggccgctttggccgcaagaacgccaagggcttttacgactacccgccaaagcccgccaagaaatccctctggcccggcctgaaggacctctatccgcagcagaagcctgaagacgtggatatggatgtgctgaaacagcgcttcctcgtcaccgtggcgctcgaagccgcccgcacggtggaagaaggcatcgtcaccgatccgcgtgaggcggatgtcggctccatcctcggtttcggcttcgcgccctataccggcggtgcgctgtcctacatcgacggcatgggcgtgaagaatttcgtcgctctggccgagaagctcagcgaagcctatggcccgcgcttccagccgacgccgctcctgaaggacatggcggccaagggcgagaccttctacggtcgcttcgacccctatgccagcgccgcgaaggcggcataa

SEQ ID NO: 72182 - protein, 738 aa, Agrobacterium tumefaciens str. C58
MSTYTNFTIETDADGIALVTWDMPEKSMNVFTAEVLEELNAIVDATVADGAVKGVVFTSGKSSFSGGADLSMLKSMFALYNDEKAKSPDAAAAKLFELVGRMTGLFRKIETNGKPWVSAINGTCMGGAFELSLACHGRVASSAKSLKIALPEVKVGIFPGAGGTQRVSRLTDAQSALQMMTTGQSLTGARAKAMGLVHQVVEPDQLVATAKQMIKDGLKPVAPWDEKGFKAPGGGIWTPAAAQLWPAAPAILRRESAGNYPAALAILKCVYEGLQLPFDTALKVEQRYFTEILRSKEAFGMIRSLFISMQELNKGARRPAGQPKTEFKKVGVVGAGFMGAAVAYVTAAAGIPVTLVDRDQDAADKGKGHCEESVKAAIGKGRLTQEEGKALLDLVTPTSDYATLADADLVIEAVFEDRDVKKAVIEAVEAVLPEGAIFASNTSTLPITGLAKNSKRPADFIGIHFFSPVEKMMLTEVILGKETGDKALAVALDYVAKIRKTPIVVNDTRGFFVNRCVLRYMAESYDMLIEGVPAAMIENAAKFAGMPVGPLALNDEVAIDLSYKILKATVADLGEKAVDPRHMELVKKLVEGDGRFGRKNAKGFYDYPPKPAKKSLWPGLKDLYPQQKPEDVDMDVLKQRFLVTVALEAARTVEEGIVTDPREADVGSILGFGFAPYTGGALSYIDGMGVKNFVALAEKLSEAYGPRFQPTPLLKDMAAKGETFYGRFDPYASAAKAA

SEQ ID NO: 72183 - DNA, 2217 bp, Brucella melitensis 16M
  CDS (1)..(2217): transl_table=11
atggcttatgtaaatttcaaggttgaaaccgacgccgacggcattgctctcgttacatgggacatgcccgaaaagtcgatgaatgtcttcaccgtcgatgcgatgcaggaactgaatgcaatcatcgatgcggtgatagctgacgacaagatcaagggtgttgtcatcacctccggcaaggaaaccttctccggcggtgccgacctgaccatgctggaaggcatgttcaaggaattccagaagcagaaggtcaaggaccccgaaggcgcggtccagaccctgttcgacaatgtcggcaagatgagcggcctgttccgtaagcttgaaacctgcggcaaaccgtgggtttcggccatcaacggcacctgcatgggcggcgcatttgaaatgtcgctcgcctgccatgcgcgtgcggcgtccgatgcgccgggcgtgaagatggccctgccggaagtgaaggtcggccttttccccggtgctggcggcacgcagcgcgttccgcgccttgccaaccagcaggacgcgcttcagatgatgacgacgggttcaagcctcaccgcgcagcgcgccaaggctatgggccttgtcaccgagattgctccggccaagaagctggtcgaaacagccaagaagctcatcaagggtggcctcaagccggttcagccctgggatgaaaagggcttcaagctgccgggcggcgcgatttattcggctgccggtgcaaacctctggcctgccgcgaccgccatcctgcgtcgcgaaacatcgggtaattatccggcggcactcgccattttgaagtcggtttatgagggccttctggtgcctttcgacaccggcctcaagattgaacagcgctatttcaccgaaatcctccagacgaccgaagcgggcatgatgatccgctcgctcttcgtgtcgttgcaggagttgaacaagggtgcgcgccgtccggttgacgaaaagccgaccaggctcaagaagatcggcgtcatcggcgcgggcttcatgggtgcaggcattgcctatgtgacggcgaaggccggtattccggtcgtgctgatcgaccgcgatcaggaatctgccgacaagggcaaggcccacacggcagacctaatcaccaaggaaatgcagaagggccgtgccaccgaggccgacaaggaaaaacttctgtcgctcatcacagcaacgccggattatgcccagcttgaaggtgctgatctggtgattgaagccgtgttcgaggaccgcgaagtcaagcgcgttgcgaccgagaaggccgaggaagtgctgaaatcttccgcagtcttcgcctccaacacctcgaccctgccgatcaccggtcttgccaaagtgtcgaagcgtccgaagaattttatcggcatccacttcttctcgcctgtcgacaagatgatgctggtggaagtgatcctcggcaagaagacctctgacaaggcattggccgtagcactcgattatgtccgtgcgatcaagaagacgccgatcgtcgtcaacgatacgcgcggcttctacgtcaaccgttgcgtgctgcgctatatgtcggaagcctacaacatgcttgttgaaggcgtcccggcggcgatgatcgaaaatgccgcccgcatggccggtatgccggtcggcccgcttgcgctcaacgacgaaacggccatcgacctgtcgcagaagatcctgaaagccacgcttgccgatcttggtccgaaggccgttgacccgcgccatgtggaattggtggacaagcttgtcaacgagttcgaccgcaagggccgcaagaatggcaagggcttctacgattatccggcaaagcctgccaagaagcatttgtggccgggtctgaaagacctctatccgcagcagaacccggacaagatcgatgtgaaggagcttaaagagcgcttcctcgtcaccatcgctctggaagctgcccgcgtgatggaagaaggcattgtgaccgatccgcgtgaagccgatgtcggctccatcctcgccttcggtttcgcgccttatacgggcggcacgctctcctatatcgacggtatgggcgcgaagaaattcgtccagctcgccaaggatttgcagaagaaatatggcgcacagttcaaggcgccgaagcttctgctcgatatggccgagaacggcgaaaccttctaccagcgtttcaatccctataagggcgaaacgaaaaaagcagcctga

SEQ ID NO: 72184 - protein, 738 aa, Brucella melitensis 16M
MAYVNFKVETDADGIALVTWDMPEKSMNVFTVDAMQELNAIIDAVIADDKIKGVVITSGKETFSGGADLTMLEGMFKEFQKQKVKDPEGAVQTLFDNVGKMSGLFRKLETCGKPWVSAINGTCMGGAFEMSLACHARAASDAPGVKMALPEVKVGLFPGAGGTQRVPRLANQQDALQMMTTGSSLTAQRAKAMGLVTEIAPAKKLVETAKKLIKGGLKPVQPWDEKGFKLPGGAIYSAAGANLWPAATAILRRETSGNYPAALAILKSVYEGLLVPFDTGLKIEQRYFTEILQTTEAGMMIRSLFVSLQELNKGARRPVDEKPTRLKKIGVIGAGFMGAGIAYVTAKAGIPVVLIDRDQESADKGKAHTADLITKEMQKGRATEADKEKLLSLITATPDYAQLEGADLVIEAVFEDREVKRVATEKAEEVLKSSAVFASNTSTLPITGLAKVSKRPKNFIGIHFFSPVDKMMLVEVILGKKTSDKALAVALDYVRAIKKTPIVVNDTRGFYVNRCVLRYMSEAYNMLVEGVPAAMIENAARMAGMPVGPLALNDETAIDLSQKILKATLADLGPKAVDPRHVELVDKLVNEFDRKGRKNGKGFYDYPAKPAKKHLWPGLKDLYPQQNPDKIDVKELKERFLVTIALEAARVMEEGIVTDPREADVGSILAFGFAPYTGGTLSYIDGMGAKKFVQLAKDLQKKYGAQFKAPKLLLDMAENGETFYQRFNPYKGETKKAA

SEQ ID NO: 72185 - DNA, 1989 bp, Pyrobaculum aerophilum str. IM2
  CDS (1)..(1989): transl_table=11
atgcctaaagtggcagtaataggcgcgggcacaatgggccacggcattgccgagctctttgccatagccgggtacgaggtagcccttgtcgacgtggcggaggatttcttaaagagagctttgcaaaacattgagtggtcgcttaaaaaactcgcagagaaggggcagataaaggaagatgttggcgttattctcgggaggattaagcccatagttaatgacgtgtgtaaggccgttgagggggccgagcttatggttgaggctgtggtcgaggatattgaaattaagaggaaggtctttgcagaggctgaccgctgcgctcctcccagcgctattttggccacgaatacctcctctttgccaattacggagatagctgaggccgtgaagcccgagaggaggccgctggtggtggggatgcactttttcaacccgcctgtattaatgccgctggtagagataataaaaggcgcttacactagcgacgagactgtcaaaaaaacggcggagtacgcctcaaagctggggaagcagacagtagttgtgaataaagacgtcccgggctttattgtaaatagaatactcgccagattaaacgaggcggcttgttggatggtggctaggggggaggcaactatccaagaggtggactctgcgttaatatataaggcaggtctgccgatgggcgcctttatattaatggactacacgggcatagacgtcgtctgctttataggagacgccatggttaagagggggtttaagacccacccatgccccgtaatagctgagaagtgcaaggagaagaaatacggcgttaagagcggagagggcttttacaaatacccagcgcctggtaaattccagtggcccgaggtgcccaaggcggctggggacaaggtagacgtcacatacctactcgctcccgcgataaacgaggctgcgtatctattacgtgagagtattgccagcagagaagatattgacaaagcgatcagattaggccttaactggccaaaagggccattggaatacgcagatgaattaggcatagacacagtggtgaaggcgctggaggagtggaagaataagactggatttgaggagtacgagccagatcccctcttgagggacatggcggctaaagggaaattgggtaagaaaagcggcgagggcttttatacatatgtcaaggctgaggagaaaaagctcgagactttaattgtgcgctacgagcctggcattgcctggattattctcaacagacccgagaggctcaacgccataaacccgaaaatgatagaagagctgtggaaagtcctcgatgaaattgagcaaatggattacgacaaagtgagagtagtagtaattacgggatctggcagggcattctcagctggggcggacgtcacggggtttatgggcgccactccggtgacgatatttaaagtgtctaggaaattacaaatgctgtatgagcggctggagttactggacaggcctgtgatatgcggcctcaacggctacaccctcggaggcggcttggagctggccatggcctgcgacttcagaatcgcggcagagacggcggaactaggacagcccgaaataaacctcggctttatacccggggccggaggcacgcagagattggctaggctaataggcagagacaaggcgaaggagctcatctttaccggagatagaataccggctagagaggccgagaggctcggcttagtacacaaggtagttccgccggatagacttgagcaagagctcagggcttttgctaacaaactggcggaaaagccgccattggcgctggccatggcaaaatacgccataaacttcggcttagaggcgccgcagtgggtgggcatgatgttagaggcctccaacttcgggctactcttcagcacagaggacgtaattgagggcgtctccgccttcttgcagaaaaggaagccccagttcaagggcaaatag

SEQ ID NO: 72186 - protein, 662 aa, Pyrobaculum aerophilum str. IM2
MPKVAVIGAGTMGHGIAELFAIAGYEVALVDVAEDFLKRALQNIEWSLKKLAEKGQIKEDVGVILGRIKPIVNDVCKAVEGAELMVEAVVEDIEIKRKVFAEADRCAPPSAILATNTSSLPITEIAEAVKPERRPLVVGMHFFNPPVLMPLVEIIKGAYTSDETVKKTAEYASKLGKQTVVVNKDVPGFIVNRILARLNEAACWMVARGEATIQEVDSALIYKAGLPMGAFILMDYTGIDVVCFIGDAMVKRGFKTHPCPVIAEKCKEKKYGVKSGEGFYKYPAPGKFQWPEVPKAAGDKVDVTYLLAPAINEAAYLLRESIASREDIDKAIRLGLNWPKGPLEYADELGIDTVVKALEEWKNKTGFEEYEPDPLLRDMAAKGKLGKKSGEGFYTYVKAEEKKLETLIVRYEPGIAWIILNRPERLNAINPKMIEELWKVLDEIEQMDYDKVRVVVITGSGRAFSAGADVTGFMGATPVTIFKVSRKLQMLYERLELLDRPVICGLNGYTLGGGLELAMACDFRIAAETAELGQPEINLGFIPGAGGTQRLARLIGRDKAKELIFTGDRIPAREAERLGLVHKVVPPDRLEQELRAFANKLAEKPPLALAMAKYAINFGLEAPQWVGMMLEASNFGLLFSTEDVIEGVSAFLQKRKPQFKGK

SEQ ID NO: 72187 - DNA, 2169 bp, Rattus norvegicus
  CDS (1)..(2169)
atggctgagtatctgaggctgccccactccctggcgatgatccgcctctgcaacccgccagtcaacgccgtcagtccaactgtaatcagggaagtaagaaatggactccagaaagctggatcagaccacacggttaaagccattgtgatctgtggcgcaaacggaaacttctgtgcaggtgctgatatccatggctttagtgcttttacccctggccttgcattaggaagcttggtagatgaaatacagagataccagaagccggtgttggccgctatccaaggtgtggctctcggaggaggactggagctggccttgggctgtcactatcggattgccaatgcaaaggctcgtgtcggcttgccagaagtcacactggggattcttcctggtgcaagaggaacccagcttctccccagggtcgttggagttcctgttgctcttgacctaattacctcaggaaaatatctttcagcagatgaagcactcaggcttggaattctggatgcagtcgtgaagtcagacccagttgaagaagccatcaaatttgctcagaagattatagataaacccatagaaccccgcaggatctttaacaagccagttccaagcttgcccaacatggacagtgtttttgcagaagccatcgccaaggtacgaaaacagtaccctggtgtcctggctccggagacgtgtgtccgctcaatccaggcctctgtgaagcatccctacgaagtaggcatcaaggaagaggaaaagctgtttatgtacctccgggcatccgggcaggctaaagccctacagtatgccttctttgctgaaaagtctgcaaataagtggtcaactccctcaggagcgtcttggaaaacagcctctgctcaacccgtctcctcagttggcgttcttggcttgggaacgatgggccgaggcatcgccatttcttttgcgagagtggggatctctgtggttgctgtggagtcagacccaaagcagctagatgctgcaaagaagataatcactttcaccttggagaaggaagcatccagagcgcatcagaacggccaagcttcggcaaaaccaaaactcaggttctcctcatccacaaaggaactttcaactgtggatttggtggttgaagcagtgttcgaagacatgaacctgaagaaaaaggtctttgctgagctgtcagccctgtgcaagccaggagcctttctgtgcaccaatacctcggcgctgaacgtggacgacattgcttcttccacagatcgccctcagctggtgattggcacccacttcttctcaccagcccatgtcatgaggttgctagaggtcattcctagccgatactcttcccctactaccatcgccacggttatgagcttgtccaaaaagatcggaaagattggagtagtggttggcaactgctatggatttgttgggaatcggatgttggctccctattacaaccaggggtttttcttgttagaggaaggtagcaagccagaggatgtagacggggtcttggaagagtttggttttaaaatgggacccttcagagtgtcagacctcgcagggctagatgtgggttggaaaattcgcaaggggcaaggccttactggaccatcattgccaccagggacccccgtccgaaagaggggcaacagcaggtactccccacttggcgatatgctctgtgaagctgggcggtttggtcagaagacaggtaaaggctggtatcagtatgacaagccactgggtcgcatccacaaacctgatccctggctttctacgttcctgtcacaatatagagaggttcaccacatcgagcagcgcaccatcagcaaggaggagatcctggagcgttgcttatattccctcatcaatgaggcgttccgcatcttggaggaggggatggctgctcgcccagagcacattgatgtcatctacttgcacgggtacgggtggccaaggcacaagggcgggcccatgttctatgctgcctcagttgggttgcccacagttctagagaaactgcagaaatattacaggcagaaccctgacatcccccagctggagcccagtgactacctcagaaggctggtagcccagggaagccctcctctgaaggaatggcaaagcttggcagggccccacggcagcaaactgtga

SEQ ID NO: 72188 - protein, 722 aa, Rattus norvegicus
MAEYLRLPHSLAMIRLCNPPVNAVSPTVIREVRNGLQKAGSDHTVKAIVICGANGNFCAGADIHGFSAFTPGLALGSLVDEIQRYQKPVLAAIQGVALGGGLELALGCHYRIANAKARVGLPEVTLGILPGARGTQLLPRVVGVPVALDLITSGKYLSADEALRLGILDAVVKSDPVEEAIKFAQKIIDKPIEPRRIFNKPVPSLPNMDSVFAEAIAKVRKQYPGVLAPETCVRSIQASVKHPYEVGIKEEEKLFMYLRASGQAKALQYAFFAEKSANKWSTPSGASWKTASAQPVSSVGVLGLGTMGRGIAISFARVGISVVAVESDPKQLDAAKKIITFTLEKEASRAHQNGQASAKPKLRFSSSTKELSTVDLVVEAVFEDMNLKKKVFAELSALCKPGAFLCTNTSALNVDDIASSTDRPQLVIGTHFFSPAHVMRLLEVIPSRYSSPTTIATVMSLSKKIGKIGVVVGNCYGFVGNRMLAPYYNQGFFLLEEGSKPEDVDGVLEEFGFKMGPFRVSDLAGLDVGWKIRKGQGLTGPSLPPGTPVRKRGNSRYSPLGDMLCEAGRFGQKTGKGWYQYDKPLGRIHKPDPWLSTFLSQYREVHHIEQRTISKEEILERCLYSLINEAFRILEEGMAARPEHIDVIYLHGYGWPRHKGGPMFYAASVGLPTVLEKLQKYYRQNPDIPQLEPSDYLRRLVAQGSPPLKEWQSLAGPHGSKL

SEQ ID NO: 72189 - DNA, 2202 bp, Streptomyces coelicolor A3(2)
  CDS (1)..(2202)
atggacaccaccgcacggccctccaccatccgctgggaggagtccgaggacggcgtcgtcaccctcgtcctggacgatccgggccagtccgccaacaccatgaacgccgcgttcatcgactcgctcgacgccgtcgcgcagcggctcgtggaacgccgtgacgacatccgcggcgtcgtcgtcacctcggccaagaagagcttcttcgccggcggcgacctgcgcgacctgatctccgtcaccccggcgaccgcacagcagtccttcgaggcgggcatgcgcgtcaagcgctcgctgcgcgccctggagaccctgggcaggcccgtcgtcgccgcgatcaacggcgccgccctcggcggcggttacgagatcgcgttggcctgccaccaccgcgtggtcctcgacaccccggccgcccgggtggggctccccgaagtcaccctgggcctgttgccgggcggcgggggagtgacccgcaccgtccggatgttcggcgtcgtggacgcgctgcggaccgtcctcctggagggcacccagtacgggccggtcgacgccctggaagccggactggtcgacgagatcgccgccgacccggacgaactcctcgccaaggcacgggcgttcgtggccgcccatccggagtccgcccagccctgggaccggcccggccaccgcatccccggcggtacgccctcgcacccgaacctcgcggcccagctctccgcccttcccgcgctgctcaggaagcggaccggcggcgccccgggcccggccccgcgcaacatcctcgccgcggccgtggagacggcccaggtcgacctggacacggccttcgtcgtggaggcccggtacctgacggaactcgtcaccggtcagatcaccaagaacatgatccaggcgttcttcttcgacctgcaggcggtcaattccggtgccaaccgtccgaagggtgtggagccggggaaggtcgccaaggtggccgtgctaggtgcggggatgatgggtgcgggtatcgcctactcgtgtgcgcgtgcgggcatcgacgtggtgctgaaggacgtctccctggagtcggcgctcaaggggaaggcgtattcggagaagctgtgcgccaaggccgtcgcgaagggccgtacgattcaggagaaggcggacgcgctgctggcgcggatcacgccgacggccgaggcggccgatctggcggggtgcgacgcggtgatcgaggcggtgttcgaggacacctcgctcaagcacaaggtgttccaggagatcgagcacgtcgtcgcccccgacgccctgctgtgctcgaacacctccacgctgccgatcacggcgctggccgagggggtggagcggcagggcgacttcatcgggctgcacttcttctcacccgtggacaggatgccgctggtggagatcatcaagggcgagcggaccggggacgaggccctggcccgcgccttcgacctggtccggcagatcaacaagacgccgatcgtggtcaacgactcgcggggcttcttcacctcccgggtcatcggccacttcatcaacgagggcgtggcgatggtgggggagggcatcgagcccgcctcggtggagcaggcggcggcccaggcgggttacccggccaaggtgctgtccctgatggacgagctgaccctcaccctcccccggaagatccgcgaggagacgaagcgggccgtccaggaggccgggaggacttgggagccgcaccccgcggaccacatcgtcgaccgcatgatcgacgagttcgagcgccccggacgcagtggcggcgccgggttctacgagtacggcgaggacggcaggcgggccgggctgtggccggggctgcgcgagcacttcacgaagccggggtacgagatccccttcgctgacatgcgggagcggatgctcttctcggaggcgctggacaccgtccggctcctggaggagggggtgctgacctccgtcgccgacgccaacatcggctcgatcttcggcatcggcttccccggctggaccggcggcgtcctccagtacatcaacggctacgacggcggcgccggggcaggcgcgggcctgcccggtttcgtcgcccgcgcccgcgagctggccgaccgctacggcgagcgcttcaccccgcctccgctgctgctgcgcaaggcggaacgcggtgagaccttcacggacttctga

SEQ ID NO: 72190 - protein, 733 aa, Streptomyces coelicolor A3(2)
MDTTARPSTIRWEESEDGVVTLVLDDPGQSANTMNAAFIDSLDAVAQRLVERRDDIRGVVVTSAKKSFFAGGDLRDLISVTPATAQQSFEAGMRVKRSLRALETLGRPVVAAINGAALGGGYEIALACHHRVVLDTPAARVGLPEVTLGLLPGGGGVTRTVRMFGVVDALRTVLLEGTQYGPVDALEAGLVDEIAADPDELLAKARAFVAAHPESAQPWDRPGHRIPGGTPSHPNLAAQLSALPALLRKRTGGAPGPAPRNILAAAVETAQVDLDTAFVVEARYLTELVTGQITKNMIQAFFFDLQAVNSGANRPKGVEPGKVAKVAVLGAGMMGAGIAYSCARAGIDVVLKDVSLESALKGKAYSEKLCAKAVAKGRTIQEKADALLARITPTAEAADLAGCDAVIEAVFEDTSLKHKVFQEIEHVVAPDALLCSNTSTLPITALAEGVERQGDFIGLHFFSPVDRMPLVEIIKGERTGDEALARAFDLVRQINKTPIVVNDSRGFFTSRVIGHFINEGVAMVGEGIEPASVEQAAAQAGYPAKVLSLMDELTLTLPRKIREETKRAVQEAGRTWEPHPADHIVDRMIDEFERPGRSGGAGFYEYGEDGRRAGLWPGLREHFTKPGYEIPFADMRERMLFSEALDTVRLLEEGVLTSVADANIGSIFGIGFPGWTGGVLQYINGYDGGAGAGAGLPGFVARARELADRYGERFTPPPLLLRKAERGETFTDF

SEQ ID NO: 72191 - DNA, 2073 bp, Xanthomonas campestris pv. campestris str. ATCC 33913
  CDS (1)..(2073): transl_table=11
atgcttccaggtttcgacgggctccgattcagccattggcaggcagacctgcgcgaggacggcgtgctcgtgctcagcctcgaccgccagggcgcagcggtcaatgccttctcgcaggacgtgctgctcgaactgggcgatgtcatcgaacgcctggcactggatccgcccaagggcgtggtgctgcgctcggccaaggccaatggcttcatcgccggcgccgacctgaaggaattccaggaattcgaccgccgcggcaccgtcaacgacgcaattcggcgcggccagcaggtgttccagaaactggccgagctgccctgccccacggtggccgccatccacggcttctgcatgggcggcggcaccgagattgcactggcctgccgctaccgggtggcctccgacgatggcagcacgcgcatcgggctgccggaaaccaagctcggcatctttcccggctggggcggcagcgcccgcttgccgcgcctgatcggggcaccggcggcaatggacttgatgctcaccgggcgcacggtgtcggccaaggctgcgcgggcgatgggcctggtcgacaaggttgccgcaccggcggtgctggtggatgtggctgcggcgctggcattggccggcaccacgcgcccgttcaagcaacgcgccaccgcctgggcgaccaacactctgctcgcacgcaagctgctggcaccgcagatgcgcaagcaggtcgcgcgcaaggcccgcaaggaacactatcccgcgccgtatgcgttgatcaccacgtgggagcgcgccggtggcggcgggatccaggcccgcctggcggccgagcgcaaggcagtggtcaagcttgccagtacgccggcagcgcgcaatctgatccgcatcttcttcctgaccgagcggctcaaggcccttggcggcaaggacaccggcttgcccgccatccgccacgtgcatgtcgtcggtgccggcgtgatgggcggtgatatcgcggcgtgggccgcctacaagggctttgaagtcacgctgcaggaccgcgaacagcgcttcatcgataccgcccttgcgcgcggcggcgaactatttggcaagcgcgtaaaggacgagaccaagcgccccgccgtggccgcacgtctgcgcggcgatctggccggcagcggcgtggcgcaggcggatctgatcattgaagcgatcatcgaaaacccgcaagccaagcgcgacctgtatcagagcatcgagccgcacctcaagccggatgcgctactcaccaccaacacctcctcgatcccgttgaccgaattgcgtgggcacatccagcgcccggcacagtttgccggcctgcactatttcaacccggtggcgatgatgccgctggtggaaatcgtgcagcacgacgggctggatccggccaacgtggcgcggctggccgcgttctgcaaggcgctggacaaattcccggtgccggtcgccggcacgccggggttcctggtcaaccgcgtgctgttcccgtacttgctggaagcgtccaccgcgtatgccgagggcattcccgggccggtgctggacaagaccgcggtgaagttcggcatgccgatggggccgatcgaattgatcgacaccgtgggcctggacgtggccgccggcgtcggtgcggagctcgccccgttcctgggcctgccgatcccggcagcactggccacggtggaggccggcaagcgcggcaagaaggacggccagggcttgtacaaatgggaaaacggccgcgcggtcaaacccgaagttgccagcggctacgaggtgccgacagacctggaagaccgcctgatcctgccattgctcaacgaagcggtggcctgcctgcacgaaggcgtggtggccgatgcggacctgctcgatgccggcgtgatcttcggcaccggctttgcgcccttccgcggcggcccgatccagcacatccgcagcgtcggtgcagacgcgctgctggcccgcctgcatgccttgcaggcgcggtatggcgagcggtttgtaccgcggccgggttgggagtcgccagtgttgcgggagccggtggcataa

SEQ ID NO: 72192 - protein, 690 aa, Xanthomonas campestris pv. campestris str. ATCC 33913
MLPGFDGLRFSHWQADLREDGVLVLSLDRQGAAVNAFSQDVLLELGDVIERLALDPPKGVVLRSAKANGFIAGADLKEFQEFDRRGTVNDAIRRGQQVFQKLAELPCPTVAAIHGFCMGGGTEIALACRYRVASDDGSTRIGLPETKLGIFPGWGGSARLPRLIGAPAAMDLMLTGRTVSAKAARAMGLVDKVAAPAVLVDVAAALALAGTTRPFKQRATAWATNTLLARKLLAPQMRKQVARKARKEHYPAPYALITTWERAGGGGIQARLAAERKAVVKLASTPAARNLIRIFFLTERLKALGGKDTGLPAIRHVHVVGAGVMGGDIAAWAAYKGFEVTLQDREQRFIDTALARGGELFGKRVKDETKRPAVAARLRGDLAGSGVAQADLIIEAIIENPQAKRDLYQSIEPHLKPDALLTTNTSSIPLTELRGHIQRPAQFAGLHYFNPVAMMPLVEIVQHDGLDPANVARLAAFCKALDKFPVPVAGTPGFLVNRVLFPYLLEASTAYAEGIPGPVLDKTAVKFGMPMGPIELIDTVGLDVAAGVGAELAPFLGLPIPAALATVEAGKRGKKDGQGLYKWENGRAVKPEVASGYEVPTDLEDRLILPLLNEAVACLHEGVVADADLLDAGVIFGTGFAPFRGGPIQHIRSVGADALLARLHALQARYGERFVPRPGWESPVLREPVA

SEQ ID NO: 72193 - DNA, 2082 bp, Xanthomonas axonopodis pv. citri str. 306
  CDS (1)..(2082): transl_table=11
atgcttccaggtttcgacgggctccgattcagccattggcaggccgatctgcgcgaggacggcgtggtcgtgctcagcctcgatcggcagggcgcaccggttaacgcattttcgcaggaggtactgctggagctgggcgccttggtcgaacggctggcgctggatccgccaacgggtgtggtgctgcgttcgggcaagcccaacggcttcatcgccggtgccgatctgaaggaattccaggaattcgaccgcaagggcacggtcaacgatgcgatccatcgtggacagcaggtcttccagaagctagccgaactaccgtgccccaccgtcgcggcgattcacggcttctgcatgggcggcggcaccgaaatcgcgctggcctgccgctaccgcgtggcttccgacgatggcagtacgcgcatcggactgccggaaaccaagctcggcatcttccctggttggggcggcagcgcccgcttgccgcgcctgatcggtgcgccggcggcgatggatctgatgctcaccggccgcacggtgtcggccaaggccgcgcgcgcgatgggcctggtcgacaaggtcgccgcgcctgccgtgctggtggatgcggccgccagcctggcgctcgccggcaccacccgtgcgttcaagcaacgcgccaccgcatgggccaccaacaccttgctggcgcgcaaactgctggcgccgcagatgcgcaagcaggtggggcgcaaggcgcgcaaggagcattacccggcgccctatgccttgatcaacgtctgggagcgggcgggcggtagcggcatccaggcgcgcctggcggccgaacgcaaggcggtggtcaaactcgccagcacgccgaccgcacgcaacctgatccggatcttcttcctgaccgagcgtctgaaagggctgggcggcaaggacgcagccggcgtggccgtagccccaattcgccatgtgcatgtgatcggcgtcggcgtcatgggcggcgatatcgccgcctgggcggcttacaagggcttcgacgtcacattgcaggaccgcgagcagcgttttatcgatacggcgctgacacgcggtggcgagctgttcgccaagcgcgtcaaggacgatgccaagcggccggcagtggcggcgcgtctgcgcggcgacctggccggcgcgggcgtgacgcaggccgacctggtgatcgaggcgatcatcgaaaacccgcaggccaagcgcgatctgtatcaatcgatcgagccgcaactcaagccggatgcattgctgacgaccaatacctcgtcgattccgctgaccgacttgcgtggccacatccagcgcccggcgcaatttgccggcctgcactacttcaacccggtggcgatgatgccgctggtggaaatcgtgcagcacgatggcctggatccggccaacgtcgcgcgcctggctgcgttctgcaagaccttggacaagttcccggtgccggtggccggcacgccgggtttcctggtcaaccgggtgctgttcccctacctgctcgaagcggccaccgcgtatgccgagggcattcccggccccgtgctggacaagacggcagtgaagttcggcatgccgatggggccgatcgaattgatcgacaccgtgggcctggatgtggcggccggcgtgggtgccgagttggcgccattcctgcgtttgcccatcccggcggcactggcgaccgtggaagccggcaagcgcggcaagaaggacggccagggcctgtacaagtgggagaacggacgcgccgtcaaacccgaggttgccagcggttacgctgcaccggcggatttggaagatcgcttgatcctgccgctgctcaacgaagcggtagcgtgcctgcacgacggcgtggtggccgacgcagacctgctggacgccggcgtcatcttcggcacaggtttcgcacctttccgtggcggcccgatccaatacatccgcagcgtcggcgcagacgcgctactggagcgcctgcaggccttgcatgcccgttatggcgaacgcttcgcgccgcgcccggggtgggactcaccgttgttacgggaagcggtggcctga

SEQ ID NO: 72194 - protein, 693 aa, Xanthomonas axonopodis pv. citri str. 306
MLPGFDGLRFSHWQADLREDGVVVLSLDRQGAPVNAFSQEVLLELGALVERLALDPPTGVVLRSGKPNGFIAGADLKEFQEFDRKGTVNDAIHRGQQVFQKLAELPCPTVAAIHGFCMGGGTEIALACRYRVASDDGSTRIGLPETKLGIFPGWGGSARLPRLIGAPAAMDLMLTGRTVSAKAARAMGLVDKVAAPAVLVDAAASLALAGTTRAFKQRATAWATNTLLARKLLAPQMRKQVGRKARKEHYPAPYALINVWERAGGSGIQARLAAERKAVVKLASTPTARNLIRIFFLTERLKGLGGKDAAGVAVAPIRHVHVIGVGVMGGDIAAWAAYKGFDVTLQDREQRFIDTALTRGGELFAKRVKDDAKRPAVAARLRGDLAGAGVTQADLVIEAIIENPQAKRDLYQSIEPQLKPDALLTTNTSSIPLTDLRGHIQRPAQFAGLHYFNPVAMMPLVEIVQHDGLDPANVARLAAFCKTLDKFPVPVAGTPGFLVNRVLFPYLLEAATAYAEGIPGPVLDKTAVKFGMPMGPIELIDTVGLDVAAGVGAELAPFLRLPIPAALATVEAGKRGKKDGQGLYKWENGRAVKPEVASGYAAPADLEDRLILPLLNEAVACLHDGVVADADLLDAGVIFGTGFAPFRGGPIQYIRSVGADALLERLQALHARYGERFAPRPGWDSPLLREAVA

SEQ ID NO: 72195 - DNA, 2217 bp, Brucella suis 1330
  CDS (1)..(2217): transl_table=11
atggcttatgtaaatttcaaggttgaaaccgacgccgacggcattgctctcgttacatgggacatgcccgaaaagtcgatgaatgtcttcaccgtcgatgcgatgcaggaactgaatgcaatcatcgatgcggtgatagctgacgacaagatcaagggtgttgtcatcacctccggcaaggaaaccttctccggcggtgccgacctgaccatgctggaaggcatgttcaaggaattccagaagcagaaggtcaaggaccccgaaggcgcggttcagaccctgttcgacaatgtcggcaagatgagcggcctgttccgtaagcttgaaacctgcggcaaaccgtgggtttcggctatcaacggcacctgcatgggcggcgcatttgaaatgtcgctcgcctgccatgcgcgtgtggcgtccgatgcgccgggcgtgaagatggccctgccggaagtgaaggtcggccttttccccggtgctggcggcacgcagcgcgttccgcgccttgccaaccagcaggacgcgcttcagatgatgacgacgggttcaagcctcaccgcgcagcgcgccaaggctatgggccttgtcaccgagattgctccggccaagaagctggtcgaaacagccaagaagctcatcaagggtggcctcaagccggttcagccctgggatgaaaagggcttcaagctgccgggcggcgcgatttattcggctgccggtgcaaacctctggcctgccgcgaccgccatcctgcgtcgcgaaacatcgggtaattatccggcggcactcgccattttgaagtcggtttatgagggccttctggtgcctttcgacaccggcctcaagattgaacagcgctatttcaccgaaatcctccagatgaccgaagcgggcatgatgatccgctcgctcttcgtgtcgttgcaggagttgaacaagggtgcgcgccgtccggttgacgaaaagccgaccaggctcaagaagatcggcgtcatcggcgcgggcttcatgggtgcaggcattgcctatgtgacggcgaaggccggtattccggtcgtgctgatcgaccgcgatcaggaatctgccgacaagggcaaggcccacacggcagacctaatcaccaaggaaatgcagaagggccatgccaccgaggccgacaaggaaaaacttctgtcgctcatcacagcaacgccggattatgcccagcttgaaggtgctgatctggtgattgaagccgtgttcgaggaccgcgaagtcaagcgcgttgcgaccgagaaggccgaggaagtgctgaaatcttccgcagtcttcgcctccaacacctcgaccctgccgatcaccggtcttgccaaagtgtcgaagcgtccgaagaattttatcggcatccacttcttctcgcctgtcgacaagatgatgctggtggaagtgatcctcggcaagaagacctctgacaaggcattggccgtagcactcgattatgtccgtgcgatcaagaagacgccgatcgtcgtcaacgatacgcgcggcttctacgtcaaccgttgcgtgctgcgctatatgtcggaagcctacaacatgcttgttgaaggcgtcccggcggcgatgatcgaaaatgccgcccgcatggccggtatgccggtcggcccgcttgcgctcaacgacgaaacggccatcgacctgtcgcagaagatcctgaaagccacgcttgccgatcttggtccgaaggccgttgacccgcgccatgtggaattggtggacaagcttgtcaacgagttcgaccgcaagggccgcaagaatggcaagggcttctacgattatccggcaaagcctgccaagaagcatttgtggccgggtctgaaagacctctatccgcagcagaacccggacaagatcgatgtgaaggagcttaaagagcgcttcctcgtcaccatcgctctggaagctgcccgcgtgatggaagaaggcattgtgaccgatccgcgtgaagccgatgtcggctccatcctcgccttcggtttcgcgccttatacgggcggcacgctctcctatatcgacggtatgggcgcgaagaaattcgtccagctcgccaaggatttgcagaagaaatatggcgcacagttcaaggcgccgaagcttctgctcgatatggccgagaacggcgaaaccttctaccagcgtttcaatccctataagggcgaaacgaaaaaagcagcctga

SEQ ID NO: 72196 - protein, 738 aa, Brucella suis 1330
MAYVNFKVETDADGIALVTWDMPEKSMNVFTVDAMQELNAIIDAVIADDKIKGVVITSGKETFSGGADLTMLEGMFKEFQKQKVKDPEGAVQTLFDNVGKMSGLFRKLETCGKPWVSAINGTCMGGAFEMSLACHARVASDAPGVKMALPEVKVGLFPGAGGTQRVPRLANQQDALQMMTTGSSLTAQRAKAMGLVTEIAPAKKLVETAKKLIKGGLKPVQPWDEKGFKLPGGAIYSAAGANLWPAATAILRRETSGNYPAALAILKSVYEGLLVPFDTGLKIEQRYFTEILQMTEAGMMIRSLFVSLQELNKGARRPVDEKPTRLKKIGVIGAGFMGAGIAYVTAKAGIPVVLIDRDQESADKGKAHTADLITKEMQKGHATEADKEKLLSLITATPDYAQLEGADLVIEAVFEDREVKRVATEKAEEVLKSSAVFASNTSTLPITGLAKVSKRPKNFIGIHFFSPVDKMMLVEVILGKKTSDKALAVALDYVRAIKKTPIVVNDTRGFYVNRCVLRYMSEAYNMLVEGVPAAMIENAARMAGMPVGPLALNDETAIDLSQKILKATLADLGPKAVDPRHVELVDKLVNEFDRKGRKNGKGFYDYPAKPAKKHLWPGLKDLYPQQNPDKIDVKELKERFLVTIALEAARVMEEGIVTDPREADVGSILAFGFAPYTGGTLSYIDGMGAKKFVQLAKDLQKKYGAQFKAPKLLLDMAENGETFYQRFNPYKGETKKAA

SEQ ID NO: 72197 - DNA, 2190 bp, Shigella flexneri 2a str. 301
  CDS (1)..(2190): transl_table=11
atgctttacaaaggcgacaccctgtaccttgactggctggaagatggcattgccgaactggtatttgatgccccaggttcagttaataaactcgacactgcgaccgtcgccagcctcggcgaggccatcggcgtgctggaacagcaatcagatctaaaagggctgctgctgcgttcgaacaaagcagcctttatcgtcggtgctgatatcaccgaatttttgtccctgttcctcgttcctgaagaacagttaagtcagtggctgcactttgccaatagcgtgtttaatcgcctggaagatctgccggtgccgaccattgctgccgtcaacggctatgcgctgggtggtggctgcgaatgcgtgctggcgaccgattatcgtctggcgacgccggatctgcgcatcggtctgccggaaaccaaactgggcatcatgccgggctttggcggttctgtacgtatgccacgtatgctgggcgctgacagtgcactggaaatcattgccgccggtaaagatgtcggcgcggatcaggcgctgaaaatcggtctggtggatggcgtagtcaaagcagaaaaactgattgaaggggcgatggcgattttacgccaggccattaacggcgacctcgactggaaagcgaaacgtcagccgaagcaggaaccgctaaaactgagcaagattgaagccaccatgagcttcaccatcgctaaaggaatggtcgcgcaaacggcggggaaacattatccggcccccatcaccgcagtaaaaaccattgaagctgcggcccgttttggtcgtgaagaagccttaaatctggaaaacaaaagttttgtcccgctggcgcataccaacgaagctcgcgcactggtcggcattttccttaacgatcaatatgtaaaaggcaaagcgaagaaactcaccaaagacgttgaaaccccgaaacaggctgctgtgctgggcgcaggcatcatgggtggcggtatcgcttaccagtccgcgtggaaaggcgtgccggttgtcatgaaagatatcaacgacaagtcgttaaccctcggcatgaccgaagccgcgaaactgctgaacaagcagcttgagcgcggcaaaatcgatggtctgaaactggctggcgtgatctccacgatccacccaacgctcgactacgccggatttgaccgcgtggatattgtggtagaagcggttgttgaaaacccgaaagtgaaaaaagccgtactggcagaaaccgaacaaaaagtacgccaggataccgtgctggcgtctaacacttcaaccattcctatcagcgaactggccaacgcgctggaacgcccggaaaacttctgcgggatgcacttctttaacccggtccaccgaatgccgttggtagaaattattcgcggcgagaaaagctccgacgaaaccatcgcgaaagttgtcgcctgggcgagcaagatgggcaagacgccgattgtggttaacgactgccccggcttctttgttaaccgcgtgctgttcccgtatttcgccggtttcagccagctgctgcgcgacggcgcggatttccgcaagatcgacaaagtgatggaaaaacagtttggctggccgatgggcccggcatatctgctggacgttgtgggcattgataccgcgcatcacgctcaggctgtcatggcagcaggcttcccgcagcggatgcagaaagattaccgcgatgccatcgacgcgctgtttgatgccaaccgctttggtcagaagaacggcctcggtttctggcgttataaagaagacagcaaaggtaagccgaagaaagaagaagacgccgccgttgaagacctgctggcagaagtgagccaaccgaagcgcgatttcagcgaagaagagattatcgcccgcatgatgatcccgatggtcaacgaagtggtgcgctgtctggaagagggcattatcgccactccggcggaagcggatatggcgctggtctacggcctgggcttccctccgttccacggcggcgcgttccgctggctggacaccctcggtagcgcaaaatacctcgatatggcacagcaatatcagcacctcggcccgctgtatgaagtgccggaaggtctgcgtaataaagcgcgtcataacgaaccgtactatcctccggttgagccagcccgtccggttggcgacctgaaaacggcttaa

SEQ ID NO: 72198 - protein, 729 aa, Shigella flexneri 2a str. 301
MLYKGDTLYLDWLEDGIAELVFDAPGSVNKLDTATVASLGEAIGVLEQQSDLKGLLLRSNKAAFIVGADITEFLSLFLVPEEQLSQWLHFANSVFNRLEDLPVPTIAAVNGYALGGGCECVLATDYRLATPDLRIGLPETKLGIMPGFGGSVRMPRMLGADSALEIIAAGKDVGADQALKIGLVDGVVKAEKLIEGAMAILRQAINGDLDWKAKRQPKQEPLKLSKIEATMSFTIAKGMVAQTAGKHYPAPITAVKTIEAAARFGREEALNLENKSFVPLAHTNEARALVGIFLNDQYVKGKAKKLTKDVETPKQAAVLGAGIMGGGIAYQSAWKGVPVVMKDINDKSLTLGMTEAAKLLNKQLERGKIDGLKLAGVISTIHPTLDYAGFDRVDIVVEAVVENPKVKKAVLAETEQKVRQDTVLASNTSTIPISELANALERPENFCGMHFFNPVHRMPLVEIIRGEKSSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFDANRFGQKNGLGFWRYKEDSKGKPKKEEDAAVEDLLAEVSQPKRDFSEEEIIARMMIPMVNEVVRCLEEGIIATPAEADMALVYGLGFPPFHGGAFRWLDTLGSAKYLDMAQQYQHLGPLYEVPEGLRNKARHNEPYYPPVEPARPVGDLKTA

SEQ ID NO: 72199 - DNA, 2151 bp, Shewanella oneidensis MR-1
  CDS (1)..(2151): transl_table=11
atgatctaccaaagtcctacaattcaggttgagttactcgaggataatattgccaagctgtgctttaacgcacccggttcggtgaacaaattcgatagagaaacactcgcctcactcgatgccgcattagacagcatcaaacaacaatcaaacattcaggcattagtgctcacatcaggtaaagatacctttatcgtcggcgctgacattactgaatttttaggcttattcgcacaagatgatgcagtactgctctcttgggttgaacaggccaacgccgtattcaataaactcgaagatttacctttcccaactgcttcagccattaaaggttttgccttaggcggcggttgtgaaaccattttagcgacagatttccgtattgctgacaccacggcaaaaatcggcttacctgaaaccaaactgggtattatcccaggctttggcggtactgtacgtctaccacgcgtgattggtgctgacaacgctctcgagtggatcaccacaggcaatgagcagcgcgctgaagatgcattaaaagtcggtgccgttgacgccgttgttgcaccagaagccttagaagttgcggcgattcaaatgctcaaagatgctgtcgcagaaaagcttgattggcaagcgcgtcgccaacgcaaattatcgccactgacactgcctaaactcgaagccatgatgtctttcactacggctaaaggcatggttttctctgtcgcaggcaaacattacccagcaccaatggcagcggtaaacgtagttgagcaagcagcaaccaaaggccgcagcgacgcattacaaattgagcatcaggctttcatcaagttagctaagactgatgtggccaaggcgcttatcggtatcttccttaatgatcaattcgttaaaggcaaagccaagaaagctggcaagctggccaaagcagtaaatagcgccgccgtattaggtgcaggcatcatgggcggcggcatcgcttaccaaagcgccagcaaaggcacgccgatcgtgatgaaagatattgcccagccagcattagatttaggtctcaatgaagcggcaaaactgctatcagcgcaagttgcccgtggccgctctacccctgaaaaaatggcaaaggtactgaacaacatcaccccagctctagaatatgcaccagtgaaacatgccgacgtggttgttgaagccgtggttgagcatccaaaagtgaaagcacaggtactggcagaggttgaacaatacgtcagtgaagatgcgattatcgcttctaacacttcaacgatttcaatcagcttactcgctaagagcatgaagaagccagagcgtttctgcggtatgcacttcttcaaccctgtgcacaaaatgccattggttgaagttatccgtggcgagcacagctcagaagaaaccatcgcatcagttgtcgcttacgccagcaaaatgggtaaaaccccaatcgttgttaacgattgcccaggcttcttcgttaaccgcgtcctcttcccttactttgccggctttaatggtctactcgccgaaggtggcgactttgctgctatcgataaagtgatggaaaaacaattcggctggccaatgggccccgcttatctgctagacgttgtcggcctagatacaggtcaccacgcgcaagcagtaatggccgaaggcttccctgatcgtatgggcaaatctggcaatgacgcgattgacgtgatgtttgagaacaaacgtctcggccaaaagaacggtaagggtttctacgcttactcagtggatagccgcggcaagccaaagaaagatgtcgacccaaccagctatgagctgctgaaggccgcttttggtgagcaaaaagcattcgatgcggatgaaatcatcgcccgcactatgatcccaatgattatcgaaaccgttcgctgtttagaagaaggcattgtggcatcacctgccgaagcggatatgggcttagtctacggtttaggcttcccgccattccgtggtggtgtgttccgttacttagacaccatgggcgttgccaactttgtggctttagcagacaaatacgcgcatttaggtggtttgtatcaagtcaccgacgccatgcgtgcccttgcagccaacaacggtagctactaccaagcctaa

SEQ ID NO: 72200 - protein, 716 aa, Shewanella oneidensis MR-1
MIYQSPTIQVELLEDNIAKLCFNAPGSVNKFDRETLASLDAALDSIKQQSNIQALVLTSGKDTFIVGADITEFLGLFAQDDAVLLSWVEQANAVFNKLEDLPFPTASAIKGFALGGGCETILATDFRIADTTAKIGLPETKLGIIPGFGGTVRLPRVIGADNALEWITTGNEQRAEDALKVGAVDAVVAPEALEVAAIQMLKDAVAEKLDWQARRQRKLSPLTLPKLEAMMSFTTAKGMVFSVAGKHYPAPMAAVNVVEQAATKGRSDALQIEHQAFIKLAKTDVAKALIGIFLNDQFVKGKAKKAGKLAKAVNSAAVLGAGIMGGGIAYQSASKGTPIVMKDIAQPALDLGLNEAAKLLSAQVARGRSTPEKMAKVLNNITPALEYAPVKHADVVVEAVVEHPKVKAQVLAEVEQYVSEDAIIASNTSTISISLLAKSMKKPERFCGMHFFNPVHKMPLVEVIRGEHSSEETIASVVAYASKMGKTPIVVNDCPGFFVNRVLFPYFAGFNGLLAEGGDFAAIDKVMEKQFGWPMGPAYLLDVVGLDTGHHAQAVMAEGFPDRMGKSGNDAIDVMFENKRLGQKNGKGFYAYSVDSRGKPKKDVDPTSYELLKAAFGEQKAFDADEIIARTMIPMIIETVRCLEEGIVASPAEADMGLVYGLGFPPFRGGVFRYLDTMGVANFVALADKYAHLGGLYQVTDAMRALAANNGSYYQA

SEQ ID NO: 72201 - DNA, 2124 bp, Shewanella oneidensis MR-1
  CDS (1)..(2124): transl_table=11
atggcggtgggaaaaacatttaatttaactcgccgtgaagacggtatcgccattttaaccatggacgtacctggcgaaaccatgaataccctcaaggcggagtttggccctgagatcagtgagatcctgtctgagattaaacgcgattcgagtatccgtggcctagtgctgatttcgggcaaaaaagattcatttgttgccggtgccgatatctctatgctcgatgcttgccaaacggcgggcgatgccaaagcgttatcccagcaagggcatgtggtgtttaacgagttggaagcattaaacatccctgtggtcgctgcaattcatggtgcttgcttgggcggcggtttagagctagcgcttgcctgccatcaacgtgtgtgcagtgatgatggcaagaccatgctgggcgtacctgaagtgcagctcggtttattacccggtggcggtggtacccagcgtttgccacgcttggtggggattaccactgcgctggatatgatgttgacgggtaaacaaattcgcccgaaacaagcgttaaagatgggcttagttaacgatgtggtgccacaaacgattttgctgcaaaccgcagtggagatggcgctcgcgggtaaacaaatagctaagccagttaaaaaatcgctagtaaaccaattgcttgaaggtactggctttggtcgcaacattattttcgatcaagcggctaagcaagttgctaagaaaacccaaggtaactacccagcgccagcaaagattattgattgtgtgcgccaaggtattgccaaaggtatgcagaagggactggaagtcgaagccagccattttgctgagctggtggtgtcgaaagaatctgaagcgctgcgcagtattttctttgcaactacagagatgaagaaagaaaccggcgccgaaggtgcaacgccacgtaaagtcaaaaaagccgtgatcttaggtggcggtttgatgggaggtggtattgcctctgtcactacgactaaggctaaaattcctgcgcgagtaaaagacattaacgaaaagggcttaagcaacgcgctttcttacgcctataagttattggataaaggcgtgaaacgtcgtcatatgacgccagccgctcgcgacaatttaatggcgctgatgacaacgacgaccgaatataaaggtgttaaggatgccgatattgttgttgaagcggtatttgaggatttagcgcttaaacatcaaatggttaaagatattgagcgtgaatgcggtgagcacacgatttttgcgtctaacacctcatcgttacccattggtcaaattgcacaagcggcaagccgtcctgaaaatgtgattggcttacattacttctcaccggtagaaaaaatgccgctggtggaagtgattgcccacgctaaaacctcaccagaaaccattgccaccacagtcgcctttgcccgtaaacagggtaaaacgccaattgtggtacaagacggtgcggggttttatgttaaccgcatcctcgcgctttatatgaacgaagccgcacaattgctgctagaagggcaaagtgttgaacatctcgataaagcgttagtgaagtttggtttccccgttggcccaattaccttactcgatgaagtcggtattgatgtgggcgctaagatctctccaattcttgaaaaagagcttggtgaacgctttaaagcaccagcagccttcgacaagctattaagcgacgatagaaaaggtcgtaaaaatggcaaaggtttctatcagtatggcgctgccagcaagaaaaaagctgtggatgaaaccgtgtatggcgtattaggtatcaagcctggtgtcgataaagaaatgagcgcggtagcggaacgctgtgtagtgcaaatgctgaatgaagcagtgcgctgcttagatgcaggcattattgcctcgccgcgcgatggtgatattggcgctatctttggcatcggcttcccaccattcttgggtggaccattccattatatcgatactttaggcgcggataacttagtcaaaatacttgaacgttatcaaacacaatatggcgatcgatttgagccttgccaacggcttaaggctatggcggcagaaaaagctcgcttcttctaa

SEQ ID NO: 72202 - protein, 707 aa, Shewanella oneidensis MR-1
MAVGKTFNLTRREDGIAILTMDVPGETMNTLKAEFGPEISEILSEIKRDSSIRGLVLISGKKDSFVAGADISMLDACQTAGDAKALSQQGHVVFNELEALNIPVVAAIHGACLGGGLELALACHQRVCSDDGKTMLGVPEVQLGLLPGGGGTQRLPRLVGITTALDMMLTGKQIRPKQALKMGLVNDVVPQTILLQTAVEMALAGKQIAKPVKKSLVNQLLEGTGFGRNIIFDQAAKQVAKKTQGNYPAPAKIIDCVRQGIAKGMQKGLEVEASHFAELVVSKESEALRSIFFATTEMKKETGAEGATPRKVKKAVILGGGLMGGGIASVTTTKAKIPARVKDINEKGLSNALSYAYKLLDKGVKRRHMTPAARDNLMALMTTTTEYKGVKDADIVVEAVFEDLALKHQMVKDIERECGEHTIFASNTSSLPIGQIAQAASRPENVIGLHYFSPVEKMPLVEVIAHAKTSPETIATTVAFARKQGKTPIVVQDGAGFYVNRILALYMNEAAQLLLEGQSVEHLDKALVKFGFPVGPITLLDEVGIDVGAKISPILEKELGERFKAPAAFDKLLSDDRKGRKNGKGFYQYGAASKKKAVDETVYGVLGIKPGVDKEMSAVAERCVVQMLNEAVRCLDAGIIASPRDGDIGAIFGIGFPPFLGGPFHYIDTLGADNLVKILERYQTQYGDRFEPCQRLKAMAAEKARFF

SEQ ID NO: 72203 - DNA, 2235 bp, Drosophila melanogaster
  CDS (1)..(2235)
atgtccacgaatcccgcaccggttgccaacaagcatctccacaccaaggtggtcaatggagtgcttgtgatcaagatcgactcacccaatgccaaggtgaattccctgggctccgaagtgagcgatgagttcgagcgagtgattaaggacctggagacgaatcctgccgtcaattccgccgtgctgatctcgggcaaaccgggctgctttgtggccggagccgacatcgggatgctggaagcatgccagacggcggaggaggccacgctgatctcccacggcgcccaggtgatgttcgatcgcatggagcgcagcaagaagcccattgtggccgccatcagcggagtctgtctgggtggtggtctggaactcgcccttgcctgccattaccgcattgccaccaaggacagcaagaccaaactgggtctgcccgaggtcatgctgggtctcctgcccggcggcggtggcaccgtccgcctgcccaagcttacatccgtgcccacggctctggatatggagctgacaggcaaacaggtgcgcgccgatcgcgccaaacgactgggcatcgtggatctgttggtggatcccctaggtcctggactccagcctgctgagcaaaacactatcgagtacctggagaagaccgccgtgcaggtcgccaacgatctggctagtggtaaacttcgcgtaaatcgcgagaaaagcggtctcgtcagcaagatccagtccttcgtcatggacaccgactttgtgaagaacaagattttcgacactgccaggaaacaggtgctcaaggcctcgaacggtctctatcccgctcctctgaagattctcgatgtgatccgtgctggcgtggataagggaaccgatgccggttacgaggcggagcgcaagggcttcggcgagctatcggccacgcccgagtcgaagggtttgattgccctgttccgtggacaaacggagtgcaagaagaaccgatttggcaagccagagcgtccggttaagactgtgggtgtgctgggagctggtctgatgggcgccggtattgtacaggtctccgtcgataagggatatcaggtggtgatgaaggatgccaccgaagccggcctggctcgtggtattggacaagtgcagaagggtttggagacggctgtgaagcgcaagcgaatctctgcactggagcgcgatcagactcttgccagtctgcggcccactcttgattacagcgacttcaagaacgcagacatcatcatcgaagctgttttcgaggacatcaaggttaagcatcgagtgatcaaggagctggaagcagtggttccagagcactgcgtcattgccaccaacaccagcgccattcccatcaccaagattgctgctggaagctcgcgtcccgagaaggttgttggcatgcactacttctcgcccgtggacaagatgcagctgctggaaatcatcactcacccaggaacctccaaggacaccatcgcacaggccgtggccgtcggtctcaagcaaggcaaggtcgttatcactgttggtgacggacctggcttctataccacccgcatcctctccaccatgctgtcggaagccatcagactgctgcaggaaggcgtggaccccaaggatctggaccaatacacgaagaagtttggcttccccgtgggtgctgcgacccttgcggatgaggttggcattgacgtgggttcccacattgccgtcgacttggcaaaggcattcggcgaacgtttcagcggtggaaacttggaagtaatgaatgatctggtcctggctggtttcctcggacgcaagtccggcaagggtatcttcctgtacgatggccagaagaggggcactcgtccagtgaacaacgatgctctcgaaatcgtgaaacaaaagtacgctttagtctcaaagggagccaatgcccccgaggatctgacgctgcgtatggtatcccgcttcatcaacgaagccgtgctctgtctggaggagaagattctggacagtccgctggagggcgatgtcggagccgtgttcggcctgggcttcccgccattctccggtggtcccttccgctgggtcgatcagtatggagccggcaaactggtcagcaagatgcaatcctatgctgagctgtacggagctcccttcaagcccgctcagaccctgctcgacatggctaaggacccgtcgaagaagttctaccccaagactggctcctcgaagttgtag

SEQ ID NO: 72204 - protein, 744 aa, Drosophila melanogaster
MSTNPAPVANKHLHTKVVNGVLVIKIDSPNAKVNSLGSEVSDEFERVIKDLETNPAVNSAVLISGKPGCFVAGADIGMLEACQTAEEATLISHGAQVMFDRMERSKKPIVAAISGVCLGGGLELALACHYRIATKDSKTKLGLPEVMLGLLPGGGGTVRLPKLTSVPTALDMELTGKQVRADRAKRLGIVDLLVDPLGPGLQPAEQNTIEYLEKTAVQVANDLASGKLRVNREKSGLVSKIQSFVMDTDFVKNKIFDTARKQVLKASNGLYPAPLKILDVIRAGVDKGTDAGYEAERKGFGELSATPESKGLIALFRGQTECKKNRFGKPERPVKTVGVLGAGLMGAGIVQVSVDKGYQVVMKDATEAGLARGIGQVQKGLETAVKRKRISALERDQTLASLRPTLDYSDFKNADIIIEAVFEDIKVKHRVIKELEAVVPEHCVIATNTSAIPITKIAAGSSRPEKVVGMHYFSPVDKMQLLEIITHPGTSKDTIAQAVAVGLKQGKVVITVGDGPGFYTTRILSTMLSEAIRLLQEGVDPKDLDQYTKKFGFPVGAATLADEVGIDVGSHIAVDLAKAFGERFSGGNLEVMNDLVLAGFLGRKSGKGIFLYDGQKRGTRPVNNDALEIVKQKYALVSKGANAPEDLTLRMVSRFINEAVLCLEEKILDSPLEGDVGAVFGLGFPPFSGGPFRWVDQYGAGKLVSKMQSYAELYGAPFKPAQTLLDMAKDPSKKFYPKTGSSKL

SEQ ID NO: 72205 - DNA, 2094 bp, Caenorhabditis elegans
  CDS (1)..(2094)
atgttttttcatgacgttcacgggcggtttcaccgggaagcacgtcagtgggcgcttcttcgattccatcaaaaggaaatgttgtcgcgtcttgtccatcagtcgtcgtcgacacttcgcacaaacctttcatttcgtctcttctcacagtcggcaccggccatgcaaactacgcatcgagttgagaaacaaggagatgttgccgtggtgaagattgacttgccaaacacaaaagaaaatgttctcaacaaggctcttttcgctgaaatgaaggccactttggataagctccaatccgatgaaagtatcaaatccattgttgtcatgtccggaaagccaaacagcttcgttgcaggagctgacatccaaatgatcaaggcagaaggaactgctacagcaactgagacactttcccgtgaaggacaagaacaattcttccgcattgaaaagagtcagaagccagtcgttgcggctattatgggaagctgtatgggaggaggactcgaattggcacttgcatgtcactaccgtattgctgtaaatgacaagaagacacttttgtcccttccagaagttatgcttggattgttgccaggagctggaggtacccaaagacttccaaagttgactactgttcaaaatgttcttgatttgacattgactggaaagaagatcaaggctgataaagctaaaaagattggaattgtcgatcgtgttattcagccacttggagatggacttggaccagcagccgagaatacccataaatatttggaagaaattgcagtaaaagctgctcaggaacttgctaatggaaaactcaagatcaacagagacaagggattcatgcataaggctacgcaagcagttatgaccaactcgttgttccttgacaatgtggttctcaagatggcaaaagataagctgatgaagttaaccgctggaaattatccagctccactgaagattctcgacgttgttcgtaccgcctatgttgacccaaagaagggattcgaggccgaagcaaaggcttttggtgagctttctcaaactttccaatctaaagctctcattggtcttttcgatggatctactgatgcaaagaagaacaaatacggcaaaggacttccagtcaatgaaatcgcagtcgtcggtgctggactgatgggtgccggaattgcaaatgtgaccatcgataagggtatccgaacagttcttcttgatgccaacccggccggagtcgagcgaggacagaatcaaattgcaacacatttgaataaacaagtcaagagaagaaagatcaacaaattggaaaaagagcgaatctacaaccatcttgttccaacaattgattattcggccatgaagaatgctgatgttgttattgaagccgtcttcgaagatcttcaactcaaacacaaggttattaaacaaatcgagagcgtcgttggaccaaacacaattattgcatcaaacacttcagctcttccgatcaaggatattgctgcagcatcttcccgccctgataaggttattggaatgcattatttctcaccagtggagaagatgcaattgcttgaaattatcactcatgatggaacatccaaagaaacacttgccactgctgcccagcttggtcttaaacaaggaaaactcgttgtcgttgtcaaagattgtccaggattcttcgttgtccgttgtcttggaccaatgacagctgaaattatgcgtcttctccaagaaggtgttgatccagctgaacttgacaagctcacaaccaaattcggattcccagtcggagccgcgacattggctgatgaagttggactcgatgtcgccgagcatgtcgctcaattccttggaaaagctttgggaccacgacttggtggaggatccgctgatttgttgtccgaattggtgaaggctggtcacaagggacgtaaaactggaaagggtatctttgtatatggagacggaaagaagggaagcaagaaggttaacgatgaagccaccaagttgcttcaaaagtacaagttgacaccaaacgcatctgtaagaccgtcaaatccgtcttgtctctcgtttcgtcaatga

SEQ ID NO: 72206 - protein, 697 aa, Caenorhabditis elegans
MFFHDVHGRFHREARQWALLRFHQKEMLSRLVHQSSSTLRTNLSFRLFSQSAPAMQTTHRVEKQGDVAVVKIDLPNTKENVLNKALFAEMKATLDKLQSDESIKSIVVMSGKPNSFVAGADIQMIKAEGTATATETLSREGQEQFFRIEKSQKPVVAAIMGSCMGGGLELALACHYRIAVNDKKTLLSLPEVMLGLLPGAGGTQRLPKLTTVQNVLDLTLTGKKIKADKAKKIGIVDRVIQPLGDGLGPAAENTHKYLEEIAVKAAQELANGKLKINRDKGFMHKATQAVMTNSLFLDNVVLKMAKDKLMKLTAGNYPAPLKILDVVRTAYVDPKKGFEAEAKAFGELSQTFQSKALIGLFDGSTDAKKNKYGKGLPVNEIAVVGAGLMGAGIANVTIDKGIRTVLLDANPAGVERGQNQIATHLNKQVKRRKINKLEKERIYNHLVPTIDYSAMKNADVVIEAVFEDLQLKHKVIKQIESVVGPNTIIASNTSALPIKDIAAASSRPDKVIGMHYFSPVEKMQLLEIITHDGTSKETLATAAQLGLKQGKLVVVVKDCPGFFVVRCLGPMTAEIMRLLQEGVDPAELDKLTTKFGFPVGAATLADEVGLDVAEHVAQFLGKALGPRLGGGSADLLSELVKAGHKGRKTGKGIFVYGDGKKGSKKVNDEATKLLQKYKLTPNASVRPSNPSCLSFRQ

SEQ ID NO: 72207 - DNA, 2148 bp, Pseudomonas putida KT2440
  CDS (1)..(2148): transl_table=11
atgatttacgaaggtaaagccatcacggttaaggctcttgaaagtggcatcgtcgagctcaagttcgacctcaagggtgagtccgtcaacaagttcaaccgccttaccctgaacgagctgcgccaggccgtcgatgccatccgggccgatgcttcggtcaagggcgtgatcgtcaggagtggcaaggacgtgttcatcgtcggcgccgacatcaccgagttcgtcgacaacttcaagctgcctgaggccgaactggtcgctggcaacctggaagccaatcgcatcttcaacgcgttcgaagacctcgaagtgccgaccgttgccgccatcaacggcatcgcgctgggcggcggcctggaaatgtgcctggcggccgactaccgggtcatgtccaccagcgccaggatcggcctgccggaagtcaagctgggtatctacccgggctttggcggtaccgtgcgcctgccgcgcctgatcggctcggacaacgccatcgagtggatcgccgccggcaaggaaaaccgtgccgaagatgccctgaaagtgggggccgtcgacgccgtggtcgcccctgagctgctgctggccggtgccctcgacctgatcaagcgtgccatcagtggcgagctggactacaaggccaagcgccagccgaagctggaaaagctcaagctcaatgccatcgagcagatgatggccttcgagactgccaagggcttcgtcgctggccaggccggcccgaactacccggccccggtcgaagcgatcaagagcatccagaaagccgccaacttcggtcgcgacaaggccctggaagtcgaagccgcaggctttgccaagctggccaagacctctgtcgccgagagcctgatcggcttgttcctcaacgatcaggaactcaagcgcaaggccaaggcgcatgacgagatcgcccacgacgtgaagcaggccgccgtgctcggcgccggcatcatgggcggcggtatcgcctaccagtcggcggtcaaaggtacgccgatcctgatgaaggacatccgcgaggaagccattcagctgggtctgaacgaggcctccaagttgcttggcaaccgcgtcgagaagggccgcctgaccccggccaagatggccgaggccctcaacgccattcgcccgaccctgtcctatggcgatttcgccaatgtcgacatcgtcgtcgaggctgtggtcgagaacccgaaggtcaagcaagcggtactggcggaagtggaaggccaggtgaaggacgatgcgatcctcgcttccaacacctctaccatctccatcaacctgctggccaaggcgctcaagcgcccggaaaacttcgtcggcatgcacttcttcaacccggtgcacatgatgccgctggttgaagtgatccgtggcgagaagtccagtgacgtggcggtcgccaccaccgtggcctacgccaagaaaatgggcaagaacccgatcgtggtcaacgactgcccgggctttttggtcaaccgcgtgctgttcccgtactttggcggttttgccaagctggtcagcgccggtgtcgacttcgtgcgcatcgacaaggtcatggagaagttcggctggccgatgggcccagcctacttgatggacgtggtcggcatcgacaccggccaccacggccgtgacgtcatggccgaaggcttcccggatcgcatgaaggacgagcgccgctcggcagtcgacgcgttgtacgaggccaaccgcctgggccagaagaacggtaagggcttctacgcctacgaaaccgacaagcgcggcaagccgaagaaggtcttcgatgccaccgtgctcgacgtgctcaaaccgatcgtgttcgagcagcgtgaagtcactgacgaagacatcatcaactggatgatggtcccgctgtgccttgagaccgtgcgttgcctggaagacggcatcgtcgaaaccgctgccgaagccgacatgggcctggtctacggcattggtttccctcccttccgcggtggtgcgctgcgttacatcgactcgatcggtgtggccgaattcgtcgccctggccgatcagtatgccgacctggggccgctgtaccacccgaccgccaagctgcgtgaaatggccaagaacggccagcgcttcttcaactga

SEQ ID NO: 72208 - protein, 715 aa, Pseudomonas putida KT2440
MIYEGKAITVKALESGIVELKFDLKGESVNKFNRLTLNELRQAVDAIRADASVKGVIVRSGKDVFIVGADITEFVDNFKLPEAELVAGNLEANRIFNAFEDLEVPTVAAINGIALGGGLEMCLAADYRVMSTSARIGLPEVKLGIYPGFGGTVRLPRLIGSDNAIEWIAAGKENRAEDALKVGAVDAVVAPELLLAGALDLIKRAISGELDYKAKRQPKLEKLKLNAIEQMMAFETAKGFVAGQAGPNYPAPVEAIKSIQKAANFGRDKALEVEAAGFAKLAKTSVAESLIGLFLNDQELKRKAKAHDEIAHDVKQAAVLGAGIMGGGIAYQSAVKGTPILMKDIREEAIQLGLNEASKLLGNRVEKGRLTPAKMAEALNAIRPTLSYGDFANVDIVVEAVVENPKVKQAVLAEVEGQVKDDAILASNTSTISINLLAKALKRPENFVGMHFFNPVHMMPLVEVIRGEKSSDVAVATTVAYAKKMGKNPIVVNDCPGFLVNRVLFPYFGGFAKLVSAGVDFVRIDKVMEKFGWPMGPAYLMDVVGIDTGHHGRDVMAEGFPDRMKDERRSAVDALYEANRLGQKNGKGFYAYETDKRGKPKKVFDATVLDVLKPIVFEQREVTDEDIINWMMVPLCLETVRCLEDGIVETAAEADMGLVYGIGFPPFRGGALRYIDSIGVAEFVALADQYADLGPLYHPTAKLREMAKNGQRFFN

SEQ ID NO: 72209 - DNA, 2145 bp, Escherichia coli CFT073
  CDS (1)..(2145): transl_table=11
atggaaatggcatcagcgtttacccttaatgtccgtctggacaacattgctgttatcaccatcgacgtaccgggtgagaaaatgaataccctgaaggcggagtttgcctcgcaggtgcgcgccattattaaacaactccgcgaaaataaagatctgcgcggtgtggtgtttatctccgcgaaaccggacaactttatcgctggtgcagacatcaatatgatcgccaactgcaaaacggcgcaagaagcggaagcactggcgcggcagggtcaacagttaatggcggagattcatgctttgcccgttccggttatcgcggctattcatggcgcttgcctgggcggcgggctggagctggcgctggcgtgccacggtcgcgtgtgtactgatgatcctaaaacggtactcggtttgcctgaagtacaacttggattgttacccggttcaggcggcacccagcgtttaccgcgcctgataggtgtcagcacagcattagagatgatcctcaccggaaaacaacttcgggcgaaacaggcattaaagctggggctggtggatgacgttgttccgcactccattttgctggaagccgctgttgagctggcaaagcaggatcgtccatcttcacgccctctacctgtacgcgagcgtattctggcggggccgttaggtcgtgcgctgctgttcaaaatggtcggcaagaaaacagagcaaaaaactcagggtaactatccagcgacgaaacgcattcttgacgttattgaaaccggtttagcgcaggggaccagcagtggctatgacgccgaagctcgggcgtttggtgaactggcgatgacgccgcaatcacaggcgctgcgcaatatcttttttgccagtacggaagtgaaaaaagatcccggcagtgatgcgccgcctgcgccattaaacagcgtggggattctaggtggtggcttgatgggcggcggtattgcttatgtcactgcttgtaaagcggggcttccggtcagaattaaagatatcaacccgcagggcataaatcatgcattgaagtacagctgggatcagttggagggcaaagttcgccgtcgtcatctcaaagccagcgaacgtgacaaacagctggcattaatctccggaacgacggactatcgcggctttgcccatcgcgatctgattattgaagcggtgtttgaaaatctcgaattaaaacaacagatggtggcggaagtggagcaaaattgcgccgctcataccatctttgcttcgaatacgtcatctttaccgattgccgatatcgccgctcacgccgcgcgacctgagcaagttattggcctgcatttcttcagtccggtggaaaaaatgccgctggtggagattattcctcatgcggggacatcggcgcaaaccatcgctaccacagtaaaactggcgaaaaaacagggcaaaacgcccattgtcgtgcgtgacaaagccgggttttacgtcaatcgcattttagcgccttacattaatgaagctatccgcatgttgaccgaaggtgaacgggtagagcacattgatgccgcgctggtgaaatttggttttccggtaggcccaatccaacttttggatgaggtaggaatcgacaccgggactaaaattattcctgtactggaagccgcttatggagaacgttttagcgcgcctgcaaatgttgtttcttcaattttgaacgacgatcgcaaaggcagaaaaaatggccggggtttctatctttatggtcagaaagggcgtaaaagcaaaaaacaggtcgatcccgccatttacccgctcattggcgcacaagggcaggggcgactctccgcaccgcaggttgctgaacggtgtgtgatgttgatgctgaatgaagcagtacgttgtctggacgagcaggttatccgtagcgtgcgtgacggggatataggcgcggtatttggcattggttttccgccatttctcggtggaccgttccgctatatcgattctctcggcgcaggcgaagtggttgcaataatgcaacgactggccacgcagtatggttcccgttttaccccttgcgagcgtttagtcgagatgagcaagcgtggggaaagtttttggaaaacaactgcaactgacctgcaataa

SEQ ID NO: 72210 - protein, 714 aa, Escherichia coli CFT073
MEMASAFTLNVRLDNIAVITIDVPGEKMNTLKAEFASQVRAIIKQLRENKDLRGVVFISAKPDNFIAGADINMIANCKTAQEAEALARQGQQLMAEIHALPVPVIAAIHGACLGGGLELALACHGRVCTDDPKTVLGLPEVQLGLLPGSGGTQRLPRLIGVSTALEMILTGKQLRAKQALKLGLVDDVVPHSILLEAAVELAKQDRPSSRPLPVRERILAGPLGRALLFKMVGKKTEQKTQGNYPATKRILDVIETGLAQGTSSGYDAEARAFGELAMTPQSQALRNIFFASTEVKKDPGSDAPPAPLNSVGILGGGLMGGGIAYVTACKAGLPVRIKDINPQGINHALKYSWDQLEGKVRRRHLKASERDKQLALISGTTDYRGFAHRDLIIEAVFENLELKQQMVAEVEQNCAAHTIFASNTSSLPIADIAAHAARPEQVIGLHFFSPVEKMPLVEIIPHAGTSAQTIATTVKLAKKQGKTPIVVRDKAGFYVNRILAPYINEAIRMLTEGERVEHIDAALVKFGFPVGPIQLLDEVGIDTGTKIIPVLEAAYGERFSAPANVVSSILNDDRKGRKNGRGFYLYGQKGRKSKKQVDPAIYPLIGAQGQGRLSAPQVAERCVMLMLNEAVRCLDEQVIRSVRDGDIGAVFGIGFPPFLGGPFRYIDSLGAGEVVAIMQRLATQYGSRFTPCERLVEMSKRGESFWKTTATDLQ

SEQ ID NO: 72211 - DNA, 2316 bp, Escherichia coli CFT073
  CDS (1)..(2316): transl_table=11
gtgatttctgccgagcgtgatcagatcggcatttccttaatattttatttgcatatttttaacacaaaatacacacttcgatgcatctggtacgaccagatcaccttgcggattcaggagactgacatgctttacaaaggcgacaccctgtaccttgactggctggaagatggcattgccgaactggtatttgatgccccaggttcagttaataaactcgacactgccaccgtcgccagcctcggcgaggccatcggcgtgctggaacagcaatcagatctaaaagggctgctgctgcgttcgaacaaagcagcctttatcgtcggtgctgatatcaccgaatttttgtccctgttcctcgttcctgaagaacagttaagtcagtggctgcactttgccaatagcgtgtttaatcgcctggaagatctcccggtgccgaccattgctgccgtcaacggctatgcgctgggcggtggctgcgaatgcgtgctggcgaccgattatcgtctggcgacgccggatctgcgcatcggtctgccggaaaccaaactgggcatcatgccgggctttggcggttctgtacgtatgccacgtatgctcggtgctgacagtgcgctggaaatcattgccgccggtaaagatgtcggcgcggatcaggcgctgaaaatcggtctggtggatggtgtagtcaaagcagaaaaactggttgaaggggcgatggcgattttacgccaggccattaacggcgacctcgactggaaagcaaaacgtcagccgaagctggaaccgctaaaactgagcaagattgaagccgccatgagcttcaccatcgctaaagggatggtcgcgcaaacggcggggaaacattatccggcccccatcaccgcagtaaaaaccattgaagctgcggcccgttttggtcgtgaagaagccttaaacctggaaaacaaaagttttgtcccgctggcgcataccaacgaagcccgcgcactggtcggcattttccttaacgatcaatatgtaaaaggtaaagcgaagaaactcaccaaagatgttgaaaccccgaaacaggccgctgtgctgggcgcaggcattatgggcggcggcatcgcctaccagtctgcgtggaaaggcgtgccggttgtcatgaaagatatcaacgacaagtcgttaaccctcggcatgaccgaagccgcgaaactgctgaacaagcagcttgagcgcggcaagatcgatggtctgaaactggctggcgtgatctccacaattcacccaacgctcgactacgccgggtttgaccgcgtggatgttgtggtagaagcggttgttgaaaacccgaaagtgaaaaaagcagtgctggcagaaaccgagcagaaagtacgcccggataccgtactggcgtctaacacttcaaccattcctatcagcgaactggccaacgcgctggaacgtccggaaaacttctgcgggatgcacttctttaacccggtccaccgaatgccgttagtagaaattattcgcggcgagaaaagctccgacgaaaccatcgcgaaagtcgtcgcctgggcgagcaagatgggcaaaacgccgattgtggttaacgactgccccggcttcttcgtcaaccgtgtactgttcccctatttcgccggtttcagccagttgctgcgcgacggcgcggatttccgcaagatcgacaaagtgatggaaaaacagtttggctggccgatgggtccggcatatctgctggatgttgtgggcattgacaccgcgcatcacgcccaggctgtcatggcagcaggcttcccgcagcggatgcagaaagattatcgcgatgccatcgacgcgctgtttaatgccaaccgctttggtcagaagaacggcctcggtttctggcgttataaagaagacagcaaaggtaagccgaagaaagaagaagatgtcgtcgttgacgacctgctggcaaaagtgagccagccgaagcgcgatttcagcgaggaagagattatcgcccgcatgatgatcccgatggtcaacgaagtggtccgctgtctggaagagggcattatcgccactccggcagaagcggatatggcgctggtctacggcctgggcttccctccgttccacggcggcgcgttccgctggttggacaccctcggcagcgcaaaatacctcgatatggcacagcaatatcagcacctcggcccgctgtatgaagtaccggaaggtctgcgtaataaagcacgtcataacgaaccgtactatcccccggttgagccagcccgtccggttggcgacctgaaaacggcttaa

SEQ ID NO: 72212 - protein, 771 aa, Escherichia coli CFT073
MISAERDQIGISLIFYLHIFNTKYTLRCIWYDQITLRIQETDMLYKGDTLYLDWLEDGIAELVFDAPGSVNKLDTATVASLGEAIGVLEQQSDLKGLLLRSNKAAFIVGADITEFLSLFLVPEEQLSQWLHFANSVFNRLEDLPVPTIAAVNGYALGGGCECVLATDYRLATPDLRIGLPETKLGIMPGFGGSVRMPRMLGADSALEIIAAGKDVGADQALKIGLVDGVVKAEKLVEGAMAILRQAINGDLDWKAKRQPKLEPLKLSKIEAAMSFTIAKGMVAQTAGKHYPAPITAVKTIEAAARFGREEALNLENKSFVPLAHTNEARALVGIFLNDQYVKGKAKKLTKDVETPKQAAVLGAGIMGGGIAYQSAWKGVPVVMKDINDKSLTLGMTEAAKLLNKQLERGKIDGLKLAGVISTIHPTLDYAGFDRVDVVVEAVVENPKVKKAVLAETEQKVRPDTVLASNTSTIPISELANALERPENFCGMHFFNPVHRMPLVEIIRGEKSSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFNANRFGQKNGLGFWRYKEDSKGKPKKEEDVVVDDLLAKVSQPKRDFSEEEIIARMMIPMVNEVVRCLEEGIIATPAEADMALVYGLGFPPFHGGAFRWLDTLGSAKYLDMAQQYQHLGPLYEVPEGLRNKARHNEPYYPPVEPARPVGDLKTA

SEQ ID NO: 72213 - DNA, 2172 bp, Vibrio vulnificus CMCP6
  CDS (1)..(2172): transl_table=11
atgatttaccaagccgaaaccctacaggtaaaggaagtacaagatggagtggcagaaatccttttctgcgcgccaaattccgtcaataagctcgatctagcaacccttgcttcactcgacaaagcgcttgatgcgctcaccgctcactccggtctgaaaggcgtaatgcttacatcagacaaagaagcctttattgtcggagcagatatcactgagtttttaggactgtttgccaagccagaagaagagctcgaccaatggcttcaatttgccaatagcatcttcaataaattggaagatttgcccgttccgactgtcgcggttgtcaaagggcataccttaggcggtggatgtgagtgtgtacttgctaccgatttacgcattggtgataaaaccaccagcattggtcttcctgaaaccaaactcggcattatgcctggctttggcggttgtgtgcgtttgccgcgcgtgatcggcgcagacagcgccatggaaatcatcactcaaggcaaagcttgccgtgcagaggaagctctaaaaattggtttgcttgatgctgtcgtcgattccgatcgcctctacgcatccgccctgcaaacactcaccgatgccatcaatgaaaaaattgactggaaagcacgtcgccagcaaaaaacctcagcgttaacgctaagcaaactcgaagcgatgatgagtttcaccatggccaaaggcttggtggctcaagtagcagggccccactaccctgcaccaatgaccgccgttgtcacgattgaagaaggtgcccgttttgcacgcaatcaagcgttagacatcgaaagaaaacatttcgttaaactggcgaagtcagaagaagccaaggccttggtgggtcttttcctcaatgaccaatacatcaaaggcatcgcgaagaaagcagcaaaatccgccaataaagagacccaacgtgcagcagtgctgggcgcaggtattatggggggcggcatagcctaccaatctgctctcaaaggtgtgcccgtgatcatgaaagacatcgcccaagcatcactggatctgggcatgacggaagcgtcaaagctactcaataaacagcttgaacgtggcaagattgatggctttaaaatggccggcattctcgcttctattacaccaagccttcactacgcgggcatcgataacgccgatatcattgttgaagccgtggtcgaaaacccgaaagtgaaagcagccgtgttaagtgaagtggaagagcaagtgagcgaagagaccgttctcacctcgaacacctcgaccattccaattaacttgctggccaaatcactcaaacgaccagagaacttctgtggtatgcacttcttcaacccagtgcatcgcatgcctttagtcgaaatcattcgtggcgaacacacctccgatgaaaccatcaaccgtgtcgttgcttacgcagccaaaatgggcaaatccccaatagtggtcaatgactgcccagggttctttgtgaaccgcgtgctgttcccatactttggcggttttagcatgttgctgcgcgatggtgccgacttcactcaaatcgataaagtgatggaacgtaaattcggttggccaatgggccctgcttacttattggatgtggtcggtattgataccgcacaccacgctcaagccgtcatggcgcaagggttccctgagcgcatgggtaaacaaggtcgcgatgcgattgatgccttgtttgaagccaacaagtatggccagaaaaacggcagcggtttctacacgtacaccatggacaagaaaggcaaaccgaagaaagcattcagtgatgagatcgtaccgattcttgctcctgtttgtgccgctcaacaagcctttgatgatcaaaccattatccaacgcatgatgattccgatgatcaacgaagtggtgctttgcttgcaagaaggcatcatcgcctcagcgcaagaagcggatatggcgctggtgtatggccttggtttccctcctttccgtggtggtgtattccgctacttagatagtgttggtattgcaaactttgtcgcaatggcacagcagcatgttgaacttggcgctatgtatcaggttccacaaatgcttattgatatggctgaaaaagggcaaaccttttacggcgcgcaacagcaaggttctatctaa

SEQ ID NO: 72214 - protein, 723 aa, Vibrio vulnificus CMCP6
MIYQAETLQVKEVQDGVAEILFCAPNSVNKLDLATLASLDKALDALTAHSGLKGVMLTSDKEAFIVGADITEFLGLFAKPEEELDQWLQFANSIFNKLEDLPVPTVAVVKGHTLGGGCECVLATDLRIGDKTTSIGLPETKLGIMPGFGGCVRLPRVIGADSAMEIITQGKACRAEEALKIGLLDAVVDSDRLYASALQTLTDAINEKIDWKARRQQKTSALTLSKLEAMMSFTMAKGLVAQVAGPHYPAPMTAVVTIEEGARFARNQALDIERKHFVKLAKSEEAKALVGLFLNDQYIKGIAKKAAKSANKETQRAAVLGAGIMGGGIAYQSALKGVPVIMKDIAQASLDLGMTEASKLLNKQLERGKIDGFKMAGILASITPSLHYAGIDNADIIVEAVVENPKVKAAVLSEVEEQVSEETVLTSNTSTIPINLLAKSLKRPENFCGMHFFNPVHRMPLVEIIRGEHTSDETINRVVAYAAKMGKSPIVVNDCPGFFVNRVLFPYFGGFSMLLRDGADFTQIDKVMERKFGWPMGPAYLLDVVGIDTAHHAQAVMAQGFPERMGKQGRDAIDALFEANKYGQKNGSGFYTYTMDKKGKPKKAFSDEIVPILAPVCAAQQAFDDQTIIQRMMIPMINEVVLCLQEGIIASAQEADMALVYGLGFPPFRGGVFRYLDSVGIANFVAMAQQHVELGAMYQVPQMLIDMAEKGQTFYGAQQQGSI

SEQ ID NO: 72215 - DNA, 2214 bp, Bradyrhizobium japonicum USDA 110
  CDS (1)..(2214)
atggcttacaagaatttcaaggttgaaaccgacgccgacggcatcgcgctcgtcacctgggacatcccgggccgttcgatgaacgtgctcgacgaaacctcgaccagcgagctcgacgcgatcgtcaaggcgaccaccgccgacgccgcggtgaagggcgtcgtcatcacctcggccaaggaggcgttctgcgccggcgccgatctgtcgatgctcgagggcatgaaccaggcctacgccaaggtcttcagggagcagggcgagaccgccgcgaaccagatgctgttcgagcagagccggcgcttctcgcaggtgctgcgctcgatcgagacctccggcaagccgtgggcggccgcgatcaacggcctcgcgctcggcggcggtttcgagatcacgctgtgctgccactatcgtgtggcagcggaaaatcccaagacgcgcctcggcctgcccgaggtcaaggtcggcctgttccccggcgccggaggcacgcagcgcgtgccgcgcctggtgccgccgcaggatgcgatgaccattctgctcaagggcgatccggtcacggtcgagaaggccaaggcactcaatctgatccacgccatcgttccggccgctgaccttatcaaggccgcgaaagactggatcaagggcggcggcaaggccgtcgcgccctgggacgagaagggcttcaagctgcccggcggtccggtgttctccaaggccggcatgatgatgttcccggccggcaacgcgatctatcgccgcgagacctacgacaactatcccgccgcgcgcgcgatcatgagctgcgtctatgaaggcctgcagctgccgatcgacgccgcgctgcgggtcgagtcgcgctacttcacctcggtgctgcgctccaaggaagcggccgcgatgatccgcagcctgttcctgtcgatgcaggagctcaacaagggcgcgcgccgtccgaaggacgtgcccgcaaccaaggtgaagaagatcgccgtgatcggcgccggcttcatgggcgcgagcgtcggctacgtctccgcgcgtgccggcctcgacgtcgtcctgatcgatcgcgaccaggacagcgccgacaagggcaaggcgcatgcgcagaaggtgatcgaggagcagatcaagaagggccgcgccaagcccaatgatgccgaagcgctgctcgcgcgcatcacgccgacggccgactatgcagctctgaaggacgtcgacctcgtcctcgaggccgtgttcgaggaccgcaaggtcaaggcggagacgtttgccaaggcgcaggaatatctgaagccggacgtagtcttcgcgtcgaacacctcgacgctgccgatcacctcgctcgcggaagccttcaaggaccagggcaagttcgtcggcatccatttcttctcgccggtcgagaagatgatgctggtcgagatcatcctcggcaagaacactggcgatgtcgcgctcgcgaccgcgctcgactatgtccggcagatcggcaagacgccgatcgtggtcaacgacagccgtggcttcttcgccaaccgttgcgtcggccgctacgtcgccgaaggcaacgagatgttcctcgaaggcgtgccgccggcgatgatcgagaactgcgccaagatggccggcatgccggtcggcccgctctcgctgtcggacgaagtggcgctcgacctcggcctcaagatcatgaaggcgaccgaagccgatctcggtccgaacgccatcaaccccgatcagaagaagctgatggtggagatggtcgagaagcagggccgactcggccgcaagaacagcaagggcttttacgactatcccgagaagggcaagggtcagaagagcctgtggccgggcctctcggcgctccagccgaagcagctcgaccccgacacgctcgacgtcgaggagctgaagcagcgcttcctggtggtgcaggcggtggaagccgcgcgcacggtggaggaccacgtcatcaccgatccgcgcgaagcggatgtcggctcgatcctcggcttcggcttcgcgccgttcaccggcggcacgctgtcctacatcgacttcatgggcacgaagaagttcgtcgagctctgccacaagctggaagcgaaatacggctcgcgcttcacgccgccgaagcttcttgaggagatggcggcgaagggcgaaaccttctacggccgcttcgcgccgaagaaggcggcggcctga

SEQ ID NO: 72216 - protein, 737 aa, Bradyrhizobium japonicum USDA 110
MAYKNFKVETDADGIALVTWDIPGRSMNVLDETSTSELDAIVKATTADAAVKGVVITSAKEAFCAGADLSMLEGMNQAYAKVFREQGETAANQMLFEQSRRFSQVLRSIETSGKPWAAAINGLALGGGFEITLCCHYRVAAENPKTRLGLPEVKVGLFPGAGGTQRVPRLVPPQDAMTILLKGDPVTVEKAKALNLIHAIVPAADLIKAAKDWIKGGGKAVAPWDEKGFKLPGGPVFSKAGMMMFPAGNAIYRRETYDNYPAARAIMSCVYEGLQLPIDAALRVESRYFTSVLRSKEAAAMIRSLFLSMQELNKGARRPKDVPATKVKKIAVIGAGFMGASVGYVSARAGLDVVLIDRDQDSADKGKAHAQKVIEEQIKKGRAKPNDAEALLARITPTADYAALKDVDLVLEAVFEDRKVKAETFAKAQEYLKPDVVFASNTSTLPITSLAEAFKDQGKFVGIHFFSPVEKMMLVEIILGKNTGDVALATALDYVRQIGKTPIVVNDSRGFFANRCVGRYVAEGNEMFLEGVPPAMIENCAKMAGMPVGPLSLSDEVALDLGLKIMKATEADLGPNAINPDQKKLMVEMVEKQGRLGRKNSKGFYDYPEKGKGQKSLWPGLSALQPKQLDPDTLDVEELKQRFLVVQAVEAARTVEDHVITDPREADVGSILGFGFAPFTGGTLSYIDFMGTKKFVELCHKLEAKYGSRFTPPKLLEEMAAKGETFYGRFAPKKAAA

SEQ ID NO: 72217 - DNA, 2148 bp, Bradyrhizobium japonicum USDA 110
  CDS (1)..(2148)
atgcatcggcggcgggctcggcggcgccatgctgatcgaggcggtgtgaccatggattccaggatcatgaccgcgctcggcgaccgcgtgctgacgctcgggcctcagcccgcggcagacagtccatacaagcacttcaagctcacacgcgatgccgacggtgtcgcctggctgctgttcgatcgcgccgatgcgagcgccaatacgctctcctccgacgtgatggaagagttcgacgcggtgctcgccgcgatcgagaccgaacgccccgcaggtctcgtgatccgctcggccaaaccgtccggcttcatcgccggcgccgacgtcaacgaattccgcggtgccagcgatcccgagatggtggagacgcgcatccgcgccgcgcatgccgtcgtcgaccatctggaggccttgaggctgccgacggtcgcggtcatccacggcttctgcctcggcggcgggctcgagatcgcgctcgcctgccagtcgcgcatcgccatcgagggtgcgcgcttcggcttcccggaggtgatgctcggcctgcatcccggtctcggcggcactgcccgtttcacggcgctggtcaatccgacccagtcgatggccttgatgctgaccggccgtaccatcgatgcgcgccgcgccaaatcgctaggcctcgtcgacaccgtgacgcaggaacgccacgtccgtggcgccgtgaaagacgtgctgttcggccggctgaagcgggccaagcctggcctgctgacgcgggcggccaatctcgggccggtgcgtggactgctggccaagcgcatgcgctcggaggcggcgaaggccgcaccgcgcgagcactatccggcgccttacgcgctgatcgatctctgggaaacgcatggcgacagcaaagccgcgatgctggcggccgagcaggcctcgttcgccaagctgatggtgacgcccaccgcgcagaatctgatccgcgtcttcttcctgcgcgagcagatgaagaaggcggcaggcgccggcaacgcggtgaagcatgtccatgtcatcggcgccggcgccatgggcggcgacatcgcagcatggtgtgcggggcaggggctgcgggtctcgctcgccgacatgaaggcggagccgatcgcaggggcggtgaagcgtgcggccgagctttacggcaagatcatccgaaaacccaccgaggtgcgcgacgcgctcgatcgcctgattccggacatggacggcgagggcgtccgcaacgccgatctcgtcatcgaggcggtgccggaaaagctggagctcaagcagaaagtctatgccggtctcgagccgaagatgaagccgggtgcgattcttgcgaccaacacctcgagcattccgcttcaggacctgcgcaccacgctggcgcggcccgatcggctggtcgggctgcactttttcaatccggtgtcgcggctgcaattggtcgaggtcgtcagccatgacggcaacgatgcacaggtcttgagggaggcactcgcctttgtcggtgcgatcgaccgcctgccgctcgccgtgaagagctcgcccggcttcctcgtcaaccgcgcgctgacgctctacatgctggaggcaatggtgatgctggacgagaagatcgaccagcgcctgatcgacgccgcggccgagcagttcggcatgccgatggggccgatcgagcttgccgaccaggtcgggctcgacatctgcctcgatgtcggcgacatgctgcgcaccaagttcggcgatctgctgccgccgacgccggcatggctgcgcgagaaggtcgccaaaggcgagctcggccgcaagaccggcaggggcttctacacctggaaggacggcaaggccgagaaggtgccgcttcccgagaccggcccgcgcgtgaccgaccagatgatcgaccgcctggtgctgccgatgtccaacgtctgcgtcgcggcgctgcgcgagggcattgtcgaggatcccgatgcggtcgacggcgccatgatcttcggcacagggtatgcgccgttccgcggcggcccgctgaactatgcgcgcacgcgcggcgtggataatgtcgtgtccaccttgcgcgagctcgccgatcggttcggcggtcgtttcgcgcccgatccgggctgggacaatttgaaatag

SEQ ID NO: 72218 - protein, 715 aa, Bradyrhizobium japonicum USDA 110
MHRRRARRRHADRGGVTMDSRIMTALGDRVLTLGPQPAADSPYKHFKLTRDADGVAWLLFDRADASANTLSSDVMEEFDAVLAAIETERPAGLVIRSAKPSGFIAGADVNEFRGASDPEMVETRIRAAHAVVDHLEALRLPTVAVIHGFCLGGGLEIALACQSRIAIEGARFGFPEVMLGLHPGLGGTARFTALVNPTQSMALMLTGRTIDARRAKSLGLVDTVTQERHVRGAVKDVLFGRLKRAKPGLLTRAANLGPVRGLLAKRMRSEAAKAAPREHYPAPYALIDLWETHGDSKAAMLAAEQASFAKLMVTPTAQNLIRVFFLREQMKKAAGAGNAVKHVHVIGAGAMGGDIAAWCAGQGLRVSLADMKAEPIAGAVKRAAELYGKIIRKPTEVRDALDRLIPDMDGEGVRNADLVIEAVPEKLELKQKVYAGLEPKMKPGAILATNTSSIPLQDLRTTLARPDRLVGLHFFNPVSRLQLVEVVSHDGNDAQVLREALAFVGAIDRLPLAVKSSPGFLVNRALTLYMLEAMVMLDEKIDQRLIDAAAEQFGMPMGPIELADQVGLDICLDVGDMLRTKFGDLLPPTPAWLREKVAKGELGRKTGRGFYTWKDGKAEKVPLPETGPRVTDQMIDRLVLPMSNVCVAALREGIVEDPDAVDGAMIFGTGYAPFRGGPLNYARTRGVDNVVSTLRELADRFGGRFAPDPGWDNLK

SEQ ID NO: 72219 - DNA, 2097 bp, Bradyrhizobium japonicum USDA 110
  CDS (1)..(2097)
atgagcgaagtggtcaagcttgagcgtcatgacgaagtcgggatcgtcacggtcaacagccctccggtcaatgcgctgagtgccgcagtccgcggtggcattttggagtgcatcaaggccgcggtcgccgatcccgcgatcaagggcatcgtgctgacctgcgccggccgcaccttcatcgccggtgccgatatcaccgaattcggcaagccgccgaaggcgcccgccctcaacgacgtgctgtccgagatcgagaactcgccgaagccggtcgttgccgcaattcacggcaccgcgctcggcggcggcctcgaggtcgcgctggcctgtcatttccgcgttgcggtgaaggaggccaagctcggcctgcccgaggtgaagctcggcctgctgccgggcgccggcggcacccagcgcctgccgcgcgcggtcggccccgaactcgccgtcaagatgatcgtcggcggcgatccgatcggtgcggcggaagcgctcaagaacggcctgatcgaggagatcgtcgagggtccggcctccggcggcgaagccttcgtccgcaaattgctggccgagaagcgtccgctgcgccgcctgcgcgacgacgattccaagctcgcggccgccaaggccgaccgctcgatcttcaccaatgcggtcgccgccatgaccaagaagtcgcgcgggctggaggcgccgttcgcggccgccgacgcggtcggctacgccatcgattttccgttcgacgagggcctgaagaaggaacgcgagggcttcctcaagctggtcgccagcgaccagtccaaggcgcagcgctacgccttcttcgccgagcgtgaggccgccaagatcgccggcgtgcccgagggcaccaagtcgcgccccgtcaaccgtgttgccattctcggcgccggcaccatgggcggcggcatcgcgatgtcgtttgccaatgccggggttcccgtcaccctgatcgagaccggcgaggagcagctcaagcgcggcctcggcatcatgcagaagaactgggaagcgaccgccgcgcgcggcggcatcccggcggacgcgcccgccaagcgcatggcgctgatcaccggcgtcgtcggcatcgagaatgtcggcgatgccgacctcgtcatcgaggccgtgttcgagaccatggcggtcaagaaggaagtgttcggcaagctcgaccagtttgcgaagcccggcgccgtgctcgcctccaacacctcgtatctcaacatcgacgagatcgcgaagtcgaccaagcgtccgcaggacgtgctcggcatgcacttcttctcgccggccaacgtcatgaagctgtgcgaaatcgtgcgcgccgacaagaccgcgccggatgcgctggtgaccgccgtcaccatcgcgcgcaagatcgcgaaggtgccggccgtggtcggcgtctgcgacggcttcgtcggcaaccgcatgctggcgcagcgcggcaagcagtccgagaagctgctgttcgaaggtgccttgccgcaacaggtcgacgcggtcgtcaccaagttcggcatgccgatggggccgttcgcgatgggcgatctcgccggcctcgacatcggctggcgctcgcggaaagaccgcggcatcaagtccgagatcgcggacgcgctctgcgaagccggccgcttcggccagaagaccggcaagggctactacaagtacgaagccggctcccgctcggcgctgcccgaccctgaggtcgagaagctgatcgacgagacgcttgcccgcctcggccgcaagaagcgcgccgtcagcgacgaggagatcctcgagcgcatgatgtatccgatgatcaacgagggcgcaaagatcctcgaagaaggcatcgcggcgcgcccctccgacatcgacgtggtctggctctatggctatggctggccgatctatcgcggcggcccgatgttctgggccgacaccgtcggcctcaagcacatcgccgatcgcctctcgttctacgccaaggaaaccaacgaccccagcctcgagcccgcgccgctgctgaagaagctcgcggcggagggcaagaccttcgcctcgcttgcggcggcgtcgaaggcggcgtga

SEQ ID NO: 72220 - protein, 698 aa, Bradyrhizobium japonicum USDA 110
MSEVVKLERHDEVGIVTVNSPPVNALSAAVRGGILECIKAAVADPAIKGIVLTCAGRTFIAGADITEFGKPPKAPALNDVLSEIENSPKPVVAAIHGTALGGGLEVALACHFRVAVKEAKLGLPEVKLGLLPGAGGTQRLPRAVGPELAVKMIVGGDPIGAAEALKNGLIEEIVEGPASGGEAFVRKLLAEKRPLRRLRDDDSKLAAAKADRSIFTNAVAAMTKKSRGLEAPFAAADAVGYAIDFPFDEGLKKEREGFLKLVASDQSKAQRYAFFAEREAAKIAGVPEGTKSRPVNRVAILGAGTMGGGIAMSFANAGVPVTLIETGEEQLKRGLGIMQKNWEATAARGGIPADAPAKRMALITGVVGIENVGDADLVIEAVFETMAVKKEVFGKLDQFAKPGAVLASNTSYLNIDEIAKSTKRPQDVLGMHFFSPANVMKLCEIVRADKTAPDALVTAVTIARKIAKVPAVVGVCDGFVGNRMLAQRGKQSEKLLFEGALPQQVDAVVTKFGMPMGPFAMGDLAGLDIGWRSRKDRGIKSEIADALCEAGRFGQKTGKGYYKYEAGSRSALPDPEVEKLIDETLARLGRKKRAVSDEEILERMMYPMINEGAKILEEGIAARPSDIDVVWLYGYGWPIYRGGPMFWADTVGLKHIADRLSFYAKETNDPSLEPAPLLKKLAAEGKTFASLAAASKAA

SEQ ID NO: 72221 - DNA, 2322 bp, Bos taurus
  CDS (1)..(2322)
atgagaaagatgcagaaagggctattctatttaatatgggtaacagatagaaatcccatcatatttcagaaagcttccctggttctcccacttctcaggtatatttgccgcagttttacaaggtcctctgctttgctgaccagaacccatattaactatggagtcagaggggatgtggcagttattcgaattaactcacccaattcaaaggtgaatactctaagtcaagaactgcattcagagttcatggaagtaatgaatgaagtctggtctagcagtcagatcagaagtgccgtccttatctcaacaaagcctggctgcttcattgcaggtgctgatctgaacatgttaaattcttgtacgacctctcaagaagtaacgcaaatatcacaagaagcacagaaaatgtttgagaaacttgagaagtccacaaagcctgtcgtggctgccatcaatggatcctgcttaggaggaggacttgagcttgccatttcatgccaatacagaatagcaacaaaagataagaaaacagtattaggttcccctgaggtcttgctgggaatcttaccaggagcaggagccacacaaaggctgcccaagatggtgggtagacctgctgcttttgacatgatgctgactggtagaggcattcgtgcagacagagcaaagaaaatgggactggttgaccaactggtggaaccactgggaccaggagtaaaacctccagaggaacggacaattgaatacttagaagaagttgcaattacttttgccaaaggactagctgataaaaagatcactccaaagagagacaagggattggtagaaaaattgacgtcatacgccttgagtattccatttgtcaggcaacagatttacaaaaaggtggaagaaaaagtacgaaagcagaccaaaggcctttatcctgcacccctgaaaataattgatgtagtgaaaactggaatcgagcaagggagtactgctggctatctctctgaatctcagacatttggagagcttgcaatgaccaaagaatcaaaagccttgatgggactttaccgtggtcaaacccaatgcaagaagaataaatttggagcgccgcagaaggaggttaagcagcttgccgttgttggtgcagggctgatgggagccggcattgctcaagtctccgtggataagggcctacagaccatacttaaggacactacactgcccgcgctgggtcgaggacagcagcaggtgttcaaaggattgaatgataaagtgaagaagaaaacactaacatcatttgaaagggatgccatgttcagcaacttgattgggcagcttgattaccggggttttgaaaaggctgacatggtgattgaagccgtttttgaggacctcaaccttaagcacagagtgctgaaggaggcagaagcggtgattccagatcactgtgtctttgccagcaacacgtctgctcttccgatcggtgagattgctactgtcagtaaaagacctgagaaggtgatcggcatgcactacttctctcccgtggacaagatgcagctgctggagattatcacaactgagaagacttcgaaggacacaactgcctctgctgtagatgttggcctcagacaagggaaggtcatcattgtggttaaggatggacctggcttctataccaccaggtgcctcacacccatgatgtctgaagtcatcagaattctccaggaaggagttggccctaagaacctggactccctgaccacaagcttcggcttccctgtgggcgccgctacactggtagatgaaggtggtgtggatgtcgcaaaacacgtagcagaaaatctcggcaaaatgtttggggagcggtttgcaggtggaagcctggaagtgctgatgcagatgatatccaagggcttcctgggtcgcaagtctgggaaaggcttttacatctaccaggagggtgtgaagaataagaatttgaattctgacatggacagtattttggcaagtctgaagatgccttctcagcctgacgtctcctcagacgaagacatccagtaccgcctagtgaccaggtttgtgaacgaagccatcctgtgcctgcaggaaggggttttggccacgccagcagagggagacatcggtgcggtctttgggcttggcttccccccatgtcttggagggcccttccactttgtggatctgtacggggcacagaaaatagtggaccggctccggaagtacgagactgcctatgagaaacagttcaccccgtgtcagctgcttgtggaccatgccaacaaccctaacaagaagttctaccaatga

SEQ ID NO: 72222 - protein, 773 aa, Bos taurus
MRKMQKGLFYLIWVTDRNPIIFQKASLVLPLLRYICRSFTRSSALLTRTHINYGVRGDVAVIRINSPNSKVNTLSQELHSEFMEVMNEVWSSSQIRSAVLISTKPGCFIAGADLNMLNSCTTSQEVTQISQEAQKMFEKLEKSTKPVVAAINGSCLGGGLELAISCQYRIATKDKKTVLGSPEVLLGILPGAGATQRLPKMVGRPAAFDMMLTGRGIRADRAKKMGLVDQLVEPLGPGVKPPEERTIEYLEEVAITFAKGLADKKITPKRDKGLVEKLTSYALSIPFVRQQIYKKVEEKVRKQTKGLYPAPLKIIDVVKTGIEQGSTAGYLSESQTFGELAMTKESKALMGLYRGQTQCKKNKFGAPQKEVKQLAVVGAGLMGAGIAQVSVDKGLQTILKDTTLPALGRGQQQVFKGLNDKVKKKTLTSFERDAMFSNLIGQLDYRGFEKADMVIEAVFEDLNLKHRVLKEAEAVIPDHCVFASNTSALPIGEIATVSKRPEKVIGMHYFSPVDKMQLLEIITTEKTSKDTTASAVDVGLRQGKVIIVVKDGPGFYTTRCLTPMMSEVIRILQEGVGPKNLDSLTTSFGFPVGAATLVDEGGVDVAKHVAENLGKMFGERFAGGSLEVLMQMISKGFLGRKSGKGFYIYQEGVKNKNLNSDMDSILASLKMPSQPDVSSDEDIQYRLVTRFVNEAILCLQEGVLATPAEGDIGAVFGLGFPPCLGGPFHFVDLYGAQKIVDRLRKYETAYEKQFTPCQLLVDHANNPNKKFYQ

SEQ ID NO: 72223 - DNA, 2166 bp, Pseudomonas syringae pv. tomato str. DC3000
  CDS (1)..(2166): transl_table=11
atgatttacgaaggtaaagccatcacggttaaggctcttgaaagtggcatcgtcgaattgaatttcgacctcaagggtgagtccgtcaacaagttcaaccgcctcaccctcaacgagttgcgtcaggcggtcgacgccgtcaaggccgacgcatcggtcaagggcgtgatcgtcaccagcggcaaggacgtgttcatcgtcggtgccgacatcaccgagttcgtcgacaacttcaagttgccggaagccgaactggttgcgggcaatctggaagccaacaggattttcagcgatttcgaagacctgggcgtgcccaccgttgtcgccatcaacggcattgcgctgggtggtggtctggaaatgtgcctggccgcagactatcgagtcatctccagcagcgcccgtgtcggcctgccggaagtcaagctgggcctgtatccaggtttcggcggtaccgtgcgcctgccgcgcatcatcggcgccgacaatgctatcgaatggatcgcatcgggcaaggaaaactccgcagaagacgcgcttaaagtcggtgttgtcgatgcaatagtggctcccgagaagcttcaggccgcagcgcttgaccttatccagcgcgctatttccggcgagttcgattacaaggccaagcgtcaaccaaagctggacaagctcaaactgaacgccatcgagcagatgatggcattcgagaccgccaagggttttgtcgcaggtcaagccgggccgaattacccggcgccggtcgaagccatcaagaccatccagaaagccgccatctttggccgtgacaaggcactggaaatcgaagccgccggtttcgtgaaaatggccaagacttcggccgcgcagagcctgatcggcctgttcctgaatgatcaggagctgaaaaagaaagccaagggctacgacgaagtggctcgcgacgtgaaacaggccgccgtgctgggggccgggatcatgggcggcggtattgcctatcagtctgcggtcaagggcacgccgatcctgatgaaggacatccgcgaagaagccattcaactgggcctgaacgaagcctccaagctgctgggcggtcgccttgaaaaaggccgtctgaccgctgcgaagatggcagaagcgctaaacgcgattcgtcctacgctgtcctacggcgatttcggcaatgtcgacctggtggttgaagcggttgtcgaaaaccccaaggtcaaacaggccgtactcgctgaagtcgaagccaacgtcggtgaaaacaccattctggcttccaacacctcgaccatttccatcagcctgttggcgcaagcgctcaagcgcccggaaaacttcgtcggcatgcacttcttcaatccggtgcacatgatgccgctggtggaagtgatccgtggcgagaagtccagcgaagaggctgtcgccaccaccgttgcctatgccaagaaaatgggcaagaacccgattgtggtcaacgactgcccgggctttctggtcaatcgcgtgctgttcccgtacttcggcggtttcgccagactggtcagcgcgggcgtggatttcgtgcgcatcgacaaggtcatggaaaaattcggctggccgatgggccctgcgtacctgatggacgttgtcggcatcgacaccggccaccacggccgtgacgtgatggctgaaggcttccccgaccgcatgaaagacgaccgtcgttctgccgttgacgcgttgtatgaagccaatcgtctgggccagaagaacggcaagggcttctatgtctacgagaccgacaagaagggcaagcccaagaaggtcaacgatccggcggtgctggacgtgctcaagccgattgtctacgagcagcgtgaagtcagcgatgaagacatcatcaactggatgatgatcccgctgtgcctggaaaccgttcgctgcctggaagacggcatcgtcgaaacggctgccgaagctgacatgggcctgatctacggtattggtttccctccattccgtggcggtgcgctgcgctacatcgattccatcggtgttgccgaattcgttgccctggccgatcgatatgccgagctgggtgccctgtatcaaccgaccgcaaagctgcgtgagatggccgccaatggccagagcttcttcggtcaagcgtcttccgaggtatga

SEQ ID NO: 72224 - protein, 721 aa, Pseudomonas syringae pv. tomato str. DC3000
MIYEGKAITVKALESGIVELNFDLKGESVNKFNRLTLNELRQAVDAVKADASVKGVIVTSGKDVFIVGADITEFVDNFKLPEAELVAGNLEANRIFSDFEDLGVPTVVAINGIALGGGLEMCLAADYRVISSSARVGLPEVKLGLYPGFGGTVRLPRIIGADNAIEWIASGKENSAEDALKVGVVDAIVAPEKLQAAALDLIQRAISGEFDYKAKRQPKLDKLKLNAIEQMMAFETAKGFVAGQAGPNYPAPVEAIKTIQKAAIFGRDKALEIEAAGFVKMAKTSAAQSLIGLFLNDQELKKKAKGYDEVARDVKQAAVLGAGIMGGGIAYQSAVKGTPILMKDIREEAIQLGLNEASKLLGGRLEKGRLTAAKMAEALNAIRPTLSYGDFGNVDLVVEAVVENPKVKQAVLAEVEANVGENTILASNTSTISISLLAQALKRPENFVGMHFFNPVHMMPLVEVIRGEKSSEEAVATTVAYAKKMGKNPIVVNDCPGFLVNRVLFPYFGGFARLVSAGVDFVRIDKVMEKFGWPMGPAYLMDVVGIDTGHHGRDVMAEGFPDRMKDDRRSAVDALYEANRLGQKNGKGFYVYETDKKGKPKKVNDPAVLDVLKPIVYEQREVSDEDIINWMMIPLCLETVRCLEDGIVETAAEADMGLIYGIGFPPFRGGALRYIDSIGVAEFVALADRYAELGALYQPTAKLREMAANGQSFFGQASSEV

SEQ ID NO: 72225 - DNA, 2112 bp, Vibrio parahaemolyticus RIMD 2210633
  CDS (1)..(2112): transl_table=11
atgagcgagcaaaaagcatttagtcttaacgttgatgagcagaacattgcatggttagcgatcgacgtaccgaatgaaaagatgaacacgctacaggcagcttttgctgatgaaatgaaagaaatttttgctcagctaaaagactccagtggcatcaaagggatgatcattcactccttaaaaccggataattttgtggcaggtgccgatgttcgtatgttggaggcatgtaccacagcgaatgaagcacaagcattggcaaaacaaggtcaagagttgttccaacaactgtctgacttaccttaccctgtagttgcggctattcatggcccatgtttggggggcggtttagagcttgcgcttgcatgtgattaccgtgtttgtacggatttcgataagacacgcttaggcttaccagaagttcaactcggtctattaccgggctctggcggtactcagcgtttgccacgtttgattggtctgttaccgtcattggacttgatcctgacgggtaaacagcttcgcgcgaagaaagccaaaaaactgggcgttgtggacgcgtgtgtccctgacaccattttgctcgacgtcgcaaaacagtttatcgacaaaggcaagaacaagggcaagaaaaagcaatcgacgaaagagaagttgatgtcgggcagtgggttaggtcgtaagcttgttttcgaacaagctgcgaagaaaaccaaccagaagacccgtggcaactatccagcaacggtcgcgattcttgaagtgattcaacacggtctggaaaaaggctttgcacaagggcaagagcttgaagcgaaacgatttggtgagcttgtgatgagctccgaatcgaaagcattgcgctctatctttttcgcgactactgaaatgaagaaggaacacggcacggatgcacagccagcagcggtgaaaaaagtgggtgttcttggtggcggcttaatgggcgccgggatcagtcatgtaacggtagctaaagcaaaagtgcctgttcgaatcaaagatgtgagcaatgacggtgtgttgaatgcgcttaactacaactacaagttgtttgagaagcagcgtaaacgtcgcatcctgtcgaaagccgatttacaggcgaagatgttgcaactgtctggtggcgtagactttacaagttacaaccacattgatgttgtgatcgaagcggttttcgaagacttggatctaaaacaacagatggttgcggacattgaagcaaacgcaaaatctgaaactatttttgctacgaacacgtcttcgttaccaatccacaagattgcagaaaaggcagagcgaccagaaaacatcgtcggtttacattactttagcccagtagaaaaaatgccgctggtggaagtgattccgcatgaaacaacgtctgatgaaaccatttcgacagttgtcgcattggctaagaagcagggtaaaaccccaatcgttgtgaaggacaaagctggcttttacgtaaaccgcattcttgcgccttacatgaatgaagctgcgcatatcttgctggcaaatgagccgattgagaagttagatggtgcgttgttggatttcggcttccctgttgggccaatcacgttacttgatgaagttggtgttgatattggcgcgaagatcatgccgattctagtcaatgagttgggcgagcgattcaaaggtcctgatgtattcgatatcttattgaatgacggtcgcaaaggacgcaagagcgggaaaggtttctacacttacaaaggtaagaagaaagaagtcgataaatccatctacaagctactcaaactgacgccagaatcgaagctcagcgataacgatattgcgttgcgctgtgtactgccaatgcttaatgaagcagtacgatgcttggacgacggtattattcgctctccgcgcgatggcgatattggtgcgatttttggtattggcttccctccattccttggcgggccattccgttatatggatcaattcggtttgaaagaactggttgagaaaatgaacgaatttgcatcgaaatatggcgatcgttatgcgccatgcgacggactgctgactagagcgggtgaaggtcgtaccttctactaa

SEQ ID NO: 72226 - protein, 703 aa, Vibrio parahaemolyticus RIMD 2210633
MSEQKAFSLNVDEQNIAWLAIDVPNEKMNTLQAAFADEMKEIFAQLKDSSGIKGMIIHSLKPDNFVAGADVRMLEACTTANEAQALAKQGQELFQQLSDLPYPVVAAIHGPCLGGGLELALACDYRVCTDFDKTRLGLPEVQLGLLPGSGGTQRLPRLIGLLPSLDLILTGKQLRAKKAKKLGVVDACVPDTILLDVAKQFIDKGKNKGKKKQSTKEKLMSGSGLGRKLVFEQAAKKTNQKTRGNYPATVAILEVIQHGLEKGFAQGQELEAKRFGELVMSSESKALRSIFFATTEMKKEHGTDAQPAAVKKVGVLGGGLMGAGISHVTVAKAKVPVRIKDVSNDGVLNALNYNYKLFEKQRKRRILSKADLQAKMLQLSGGVDFTSYNHIDVVIEAVFEDLDLKQQMVADIEANAKSETIFATNTSSLPIHKIAEKAERPENIVGLHYFSPVEKMPLVEVIPHETTSDETISTVVALAKKQGKTPIVVKDKAGFYVNRILAPYMNEAAHILLANEPIEKLDGALLDFGFPVGPITLLDEVGVDIGAKIMPILVNELGERFKGPDVFDILLNDGRKGRKSGKGFYTYKGKKKEVDKSIYKLLKLTPESKLSDNDIALRCVLPMLNEAVRCLDDGIIRSPRDGDIGAIFGIGFPPFLGGPFRYMDQFGLKELVEKMNEFASKYGDRYAPCDGLLTRAGEGRTFY

SEQ ID NO: 72227 - DNA, 1929 bp, Coxiella burnetii RSA 493
  CDS (1)..(1929): transl_table=11
atgaatcgggaagtttttactgaatttaataaagtgctcgatgaaattgctgctcaaaatcccatagccgttatccttcaatcaggaaagaaaaaaggattcatcgccggtgcagacatcaaacaatttaccgatttaaaaaacaaaaatgaagcctttgatttaatccgccaagcgcagctcgtccttgataagctcgaagcgctgcccatgccaaccgtagcgatgattagcggattttgtttaggcggcggtttggaagtggcgcttgcctgtcgctatcgagtggcggaagataatgaatccacgctgattggattacccgaagtgaaattgggtattcatccagggtggggtggtaccgttcgattgtctaaattaatcggcgcgccgaaagcaatggaaattatgctgccaggtgcagcagttccggcgagaaaatctgctaagcttgggatggttgacgccgcagtaccgcttcgtaatttagaaaatgccgctcgttatttcgctttgcaaaagccccccgtccataaaccgaaaggatgggaaaaatacacgaatgtaagttatattcgcccgtggttagggcggttattttataaaaaactctctgcaaaagtggaaaaaacgcattacctggcgccatacgccatcgtccataattggatcaaagagggggttggcaaagaagcctacttcacagaagctcagtcgatcgcgcaattaatgatgaccgagagcagtcgcaacatggtgcgactgttttttttaagagaacgcttgaagtcgctcgctaaaaaaacgcgctatctgccgcaacaaattcacgttattggcgctggtgtgatgggcggcgatattgcagcttggtgtgcgcttcgcggcatccgcgtgactttacacgataaatcagcggaaaaaattgcgccggcgataaagcgggcgcatgctctttatgaaaaaaaattaaaaatcccgcgcttaattcaggcagcgatggaccgattagagccggatgtggaaggaacgggcgttaaaaaagcggatttaattattgaagctgtttttgaggatataaaagtaaagcaggaagttttaagtgctatcgaaccgcaattaaaacccgaggctattttagcgactaacacgtccagtctttctttagatgaattaagttcggtgttaaaaaaccctgagcgcttagtggctattcattttttcaatcccgttgctaaattaccgttggttgaagtggcaagcagtcagcagacatcggcggacattgctgaaaaagcgttagcgttcgtgggagctattgataaattgccgttggcggtgagcagcagtccaggatttttagtcaatcgggcattaatggcttatttattagaagcgaaccgttgtttagacgaagggttttccatggaacaaattgataaagcggcaactgattttgggatgcccataggtccgatcgagctagctgatcggattgggttagacatatgtttgtctgttgctcaacatctgaaaaacttttacaagcatgccgaagtttcagaacgattaaaaacattggttaaggaaggtcatctaggcgctaaaacgggtcaagggttttatcattatcaaaacggaagacgtgttgaatcaaagtctacagccgaatcaacgaatcctgatttaaccgaccggttaatattgcaactcgttaatgaagtcaagaaatgtttggatgagaaagtgattgacaaggaagatttagccgatgcagggatcgtatttggcacggggtttgcaccgtttcggggtggaccgatgcagtatgccaagagtcgtggagaggccgatgtcgtgaaaactttaaaacgcttagcaaaacaatacggtgaacgatttttgcctagcgaaggatggtccgcatga

SEQ ID NO: 72228 - protein, 642 aa, Coxiella burnetii RSA 493
MNREVFTEFNKVLDEIAAQNPIAVILQSGKKKGFIAGADIKQFTDLKNKNEAFDLIRQAQLVLDKLEALPMPTVAMISGFCLGGGLEVALACRYRVAEDNESTLIGLPEVKLGIHPGWGGTVRLSKLIGAPKAMEIMLPGAAVPARKSAKLGMVDAAVPLRNLENAARYFALQKPPVHKPKGWEKYTNVSYIRPWLGRLFYKKLSAKVEKTHYLAPYAIVHNWIKEGVGKEAYFTEAQSIAQLMMTESSRNMVRLFFLRERLKSLAKKTRYLPQQIHVIGAGVMGGDIAAWCALRGIRVTLHDKSAEKIAPAIKRAHALYEKKLKIPRLIQAAMDRLEPDVEGTGVKKADLIIEAVFEDIKVKQEVLSAIEPQLKPEAILATNTSSLSLDELSSVLKNPERLVAIHFFNPVAKLPLVEVASSQQTSADIAEKALAFVGAIDKLPLAVSSSPGFLVNRALMAYLLEANRCLDEGFSMEQIDKAATDFGMPIGPIELADRIGLDICLSVAQHLKNFYKHAEVSERLKTLVKEGHLGAKTGQGFYHYQNGRRVESKSTAESTNPDLTDRLILQLVNEVKKCLDEKVIDKEDLADAGIVFGTGFAPFRGGPMQYAKSRGEADVVKTLKRLAKQYGERFLPSEGWSA

SEQ ID NO: 72229 - DNA, 2208 bp, Streptomyces avermitilis MA-4680
  CDS (1)..(2208)
atgagcactgagcccaccaccatccgctgggaacaggacgagaccgggatcgtcaccctcgttctcgacgaccccaaccagtccgccaacaccatgaaccaggccttcagggcgtcgatcgcggcgatcgccgaccgcgccgaggccgagaaggactccatccgcgggatcatctacacctccgccaagaagaccttcttcgcgggcggcgacctcaaggacatgatgaaggccggcccgtcggacgcccagcgggcgttcgagaccggtacggcgatcaagaactccctgcgccgcatcgagaccctgggcaagccggtggtcgccgccatcaacggcgcggccctcggcggcggttacgagatcgctctcgcctcccaccaccgcatcgccctcgacgcgcccggctccaagatcggcctgcccgaggtcaccctcggtctgctcccggcgggcggcggcgtcacccgtaccgtacgcctcatgggcatcgccgacgccctcctgaaggtgctcctccagggcacccagtacgcgcccgcccgcgccctcgagaacggcctcgtccacgaagtcgccgcgacccacgaggagatgctcgcgggggcccgcgccttcatcgacgccaaccccgagtcccagcagccctgggacaagccgggctaccgcatcccgggcggtacccccgccaacccgaagttcgcggcgaacctgccggccttcccggccaacctgaagaagcagctgaacggcgccccctacccggccccgcgcaacatcctcgcggccgccgtcgagggctcccaggtcgacttcgagaccgccctggtgatcgaggcccgctacttcaccgagctggtcaccggacagaccgccaagaacatgatccaggcgttcttcttcgacctccaggccgtcaactccggcgccaaccgcccccagggcgtcgcaccgcgccaggtccgcaaggtcgccgtactcggcgccgggatgatgggcgcgggcatcgcctactcatgtgcccgcgcgggcatcgaggtcgtcctcaaggacgtgtccgcggaggccgcggccaagggcaggggctactccgagaagctgtgcgccaaggcggtctcccggggacgtacgactcaggagaaggcggacgcgctcctcgcccgcatcacgcccaccgccgaccctgccgacctggcgggctgcgacgcggtgatcgaggccgtcttcgaggacacggcgctcaagcacaaggtgttcgaggagatcgagcacatcgtcgagccggacgccctgctctgctccaacacctccaccctgcccatcaccgcactcgccgagggcgtggagcgccaggccgacttcatcgggctgcacttcttctcgcccgtcgacaagatgccgctcgtcgagatcatcaagggcgagcggaccggcgacgaggcgctggcgcgcgccttcgacctggtccgccagatcaacaagaccccgatcgtcgtcaacgactcgcgcggcttcttcacctcccgtgtcatcggccacttcatcaacgagggcgtggcgatggtcggtgagggcatcgagcccgcgtccatcgagcaggcggccgcgcaggcgggctatccggccaaggtcctgtccctcatggacgagttgacgctcaccctgccgcgcaagatccgggccgagtcgaagcgggcggtcgaggaggcgggcggcacgtgggtgacccacccggcggaggcggtcatcgaccgcatggtcgacgagttcggccgcacgggacgcggcggcggtgcgggcttctacgactacgtggacggcaagcgcgccaagctgtggcccgggctgcgcgagcacttcaccaagccgggccatgagatccccttcgaggacatgcaggagcgcatgctcttcgccgaggcgctggacaccgtccggctcctcgaggagggcgtgctgacgtccgtcgcggacgccaatatcgggtcgatcttcgggatcggtttcccgggctggaccggcggtgtcctccagtacatcaacgggtacgccggcgggccgggtgccggcgccggggcaggtgccggcctgcccggcttcgtggcacgggcgcgtgaactcgccgagcgctacggggagcggttcacgccgccggccctgctcgtggagaaggcggagaagggcgagcacttcagcgacgcgaagtag

SEQ ID NO: 72230 - protein, 735 aa, Streptomyces avermitilis MA-4680
MSTEPTTIRWEQDETGIVTLVLDDPNQSANTMNQAFRASIAAIADRAEAEKDSIRGIIYTSAKKTFFAGGDLKDMMKAGPSDAQRAFETGTAIKNSLRRIETLGKPVVAAINGAALGGGYEIALASHHRIALDAPGSKIGLPEVTLGLLPAGGGVTRTVRLMGIADALLKVLLQGTQYAPARALENGLVHEVAATHEEMLAGARAFIDANPESQQPWDKPGYRIPGGTPANPKFAANLPAFPANLKKQLNGAPYPAPRNILAAAVEGSQVDFETALVIEARYFTELVTGQTAKNMIQAFFFDLQAVNSGANRPQGVAPRQVRKVAVLGAGMMGAGIAYSCARAGIEVVLKDVSAEAAAKGRGYSEKLCAKAVSRGRTTQEKADALLARITPTADPADLAGCDAVIEAVFEDTALKHKVFEEIEHIVEPDALLCSNTSTLPITALAEGVERQADFIGLHFFSPVDKMPLVEIIKGERTGDEALARAFDLVRQINKTPIVVNDSRGFFTSRVIGHFINEGVAMVGEGIEPASIEQAAAQAGYPAKVLSLMDELTLTLPRKIRAESKRAVEEAGGTWVTHPAEAVIDRMVDEFGRTGRGGGAGFYDYVDGKRAKLWPGLREHFTKPGHEIPFEDMQERMLFAEALDTVRLLEEGVLTSVADANIGSIFGIGFPGWTGGVLQYINGYAGGPGAGAGAGAGLPGFVARARELAERYGERFTPPALLVEKAEKGEHFSDAK

SEQ ID NO: 72231 - DNA, 1806 bp, Streptomyces avermitilis MA-4680
  CDS (1)..(1806)
atggccactcccccgtttgacccctctctgtccccgctgaagaccgttgccgtgatcggcctcggcacgatgggcaccggcatcgccgaggtcctcgcccgggccggccgcgaggtcgtcggcatcgacatcagcgaggccgccgccggccacgccgtcaccgccctggaggcctcgaccgcccgcgccgtgcagcgtgagcggctgaccgagcaggagcgcggcgacatcctcgcccgcttccgcaccttcaccgaccttcaggccgcggccgacgccgacctggtcatcgaggtgaccccggagtcgtacgagatcaagcagcaggtcctccgcgccctcgacggcatcgtgcgtgcggacaccatcctcgccaccggcaccaacgccctctcggtcacgcgtctcgcggccgactcggcgcaccccgagcgcgtcctcgggctgcacttcttcaacccggcgcccgcgatgaagctggtcgaggtcgtctcgtccgtgctgaccgcgcccaccgccgtcgccgcggtcaccaacctcgcgctcgacctcggcaaggagcccgtcgcggtcggcgaccgccccggcttcgtcgccgacgggctgctgttcggctacctcaaccaggccgccgcgatgtacgaggcgaagtacgcctcccgcgaggacatcgacgccgcgatgaagctgggctgcggactgcccatgggcccgctcgccctgctcgacctgatcggcgtcgacaccgcgcgcaccgtcctggaggccatgtacgccgagtcccgcgaccgcctgcacgcccccgcgccgatcctcaagcagctcagcgaggcgggcctgaccggccgcaagtcgggacgcggcttctactcgtacgacgagcccggcagcgccaccgtcgtgcgggacgcgctgacgccgctctccggaggacccggggagcagggccgtacggtccgctcggtcggcgtcgccggctccggcaccatggcgtccggcatcgccgaggtcttcgcgaaggccgggtacgaggtcgtcctcgccgcccgcagcgaggagaaggcgcagacggccaaggcccggatcggcaagtccctgtcgcgttccgtcgacaagggccggctcacggccgaggccgcggccgagaccctggaccggatcaccccggcgggctcgtacgacgccttcgcggacgtcgatctcgccctggaggccgtcgccgaggacctggagatcaagcagcagctgttcgccacgttcgacaaggtctgcaagcccggcgcgatcctcgccaccaccacctcctcgctgcccgtcgtcgcctgcgcccgtgccacctcgcgcccgcaggacgtgatcggcatgcacttcttcaacccggctccggcgatgaagctggtcgaggtggtccgcacggtcctgaccggtgacgatgtgcacgccacggtccgcgaggtctgcgccaagatccgcaagcaccccgtggactgcggcgaccgggccggattcatcgtgaacgcgctgctgttcccgtacctgaacaacgcgatcaagatggtgcaggagcactacgcgacgctcgacgacatcgacgccgcgatgaagctgggcggcgggtacccgatgggacccttcgaactcctggacgtcgtcggcctcgacgtctccctggccatcgagaaggtcctgcaccgcgagttccgcgacccgggcctggccccggcgccgctcctggagcacctggtggccgcgggctgcctcggccgcaagaccggccgtggtttccgcgaatatgccaagcgctga

SEQ ID NO: 72232 - protein, 601 aa, Streptomyces avermitilis MA-4680
MATPPFDPSLSPLKTVAVIGLGTMGTGIAEVLARAGREVVGIDISEAAAGHAVTALEASTARAVQRERLTEQERGDILARFRTFTDLQAAADADLVIEVTPESYEIKQQVLRALDGIVRADTILATGTNALSVTRLAADSAHPERVLGLHFFNPAPAMKLVEVVSSVLTAPTAVAAVTNLALDLGKEPVAVGDRPGFVADGLLFGYLNQAAAMYEAKYASREDIDAAMKLGCGLPMGPLALLDLIGVDTARTVLEAMYAESRDRLHAPAPILKQLSEAGLTGRKSGRGFYSYDEPGSATVVRDALTPLSGGPGEQGRTVRSVGVAGSGTMASGIAEVFAKAGYEVVLAARSEEKAQTAKARIGKSLSRSVDKGRLTAEAAAETLDRITPAGSYDAFADVDLALEAVAEDLEIKQQLFATFDKVCKPGAILATTTSSLPVVACARATSRPQDVIGMHFFNPAPAMKLVEVVRTVLTGDDVHATVREVCAKIRKHPVDCGDRAGFIVNALLFPYLNNAIKMVQEHYATLDDIDAAMKLGGGYPMGPFELLDVVGLDVSLAIEKVLHREFRDPGLAPAPLLEHLVAAGCLGRKTGRGFREYAKR

SEQ ID NO: 72233 - DNA, 2127 bp, Streptomyces avermitilis MA-4680
  CDS (1)..(2127)
atgagcaccactgaactcctgaagggtgcggccgcgctgttccccgacgaggtcgtgacgtccgcgcacgtacgtcacctcgacctgccctccggcgccgggcgcttcgcgctcatcacgctggacaacggcttcgaccacaccaagccgaccaccttcggcccggcgtcgctggcgaacctcaacaccgccatcgaccaggtcgagaaggaggccgcggccggcgagatcgtcggtgtcggcatcaccggcaagccgttcatcttcgcggtcggcgcggacctcaagggcgtcgagctcctgaagaaccacgacgacgcgctcgccatcggcaagggcggccacgaggtcttcaagcgcctcgcgggcatagcggttccgaccttcgcgtactacaacggtgccgcgatgggcggcggtgtcgaggtcggtctgcactgccagtaccgcacggtctcggcggcgctgccggcgttctcgctccccgaggtcttcctcggtctggtccccggctggggcggctgcacgatcctgccgaacctgatcggcgcggacaaggccgtctcggtgatcatcgagaactcgctcaaccagaacaagcagctcaagggcgagcaggtctacgacctcggcatcgccgacgcgatcttcgagggcgcggacttcctggagcagtcgctgctctggacgacggccgtcctcaagggcgagatcgccgtggagcgtccggagatcgaccgcggcgaggcctgggaccaggccgtcgccaagggccgcttcatcgccgacagcaaggtgcacggtgcggccccggccgcctaccgcgcgctggacatcatcgccgccgccaagaacggcgacctccagcagggcttcgacgccgagaaccaggccctcgccgacctcatcatgggtggcgaactgcgctccggcatctacgccttcaacctggtccagaagcgcggcaagcgcccggcgggtgcgccggacaagtcgctcgcccgtccggtcaccaaggtcggcgtcgtgggcgcgggcctgatggcctcgcagctggcgctgctgttcctgcgccgcctcgaagtgcccgtcgtcctgacggacatcgaccaggagcgcgtcgacaagggtgtgggctacgtccacgccgagatcgacaagctgctgctcaagggccgcgtcaaccaggacaaggccaaccgcctcaaggcgctggtctccggtgtgctggacaaggccgagggcttctccgacgcggacttcgtcatcgaggccgtcttcgaggagatcggcgtcaagcagcaggtgttcgcggaggtcgaggcggtcgccccggcgcacgcgatcttcgccaccaacacctcgtccctctcggtcaccgagatggcgtcgaagctgaagcaccccgagcgggtcgtgggcttccacttcttcaacccggtcgcgatcctcccgctcctggagatcgtccgcggcgagcagacggacgacgcctccctggccacggccttcggtgtcgccaagaagctgaagaagaccgcggtgctggtgaaggacgccccggcgttcgtcgtcaaccgcatcctcacccgcttcatgggcgagatccagaacgtcatcgacgagggcacgccggtcgaggtcgcggagaaggcggtggagcccctgggcctgccgatgtccccgctcgtcctgctggagctggtcggcccggcgatcggtctgcacgtctcggagaccctcaaccgggccttcccggaccgcttcacggtctccccgaacctcgcggccgtcgtcaaggcgggcaagcgcggcttctacgtgtacgactccgggaagccggagctggaccccgaggtcgccgcgctcctcaagcagggcgatgtcgtcctcaccgaggagcaggtccgcgaccgcgtcctggacgcggtggcccaggagatcggtctgatgctcgacgagggcgtcgtcgccgaggcccaggacatcgacctgtgcctgatcaccggcgcgggctggcccttccacctgggcggcatcacgccgtacctggaccgtgagggcgtcagcgagcgggcgaacggcaagcggttcctcgaggccggggtggcttcggttcccgcgtaa

SEQ ID NO: 72234 - protein, 708 aa, Streptomyces avermitilis MA-4680
MSTTELLKGAAALFPDEVVTSAHVRHLDLPSGAGRFALITLDNGFDHTKPTTFGPASLANLNTAIDQVEKEAAAGEIVGVGITGKPFIFAVGADLKGVELLKNHDDALAIGKGGHEVFKRLAGIAVPTFAYYNGAAMGGGVEVGLHCQYRTVSAALPAFSLPEVFLGLVPGWGGCTILPNLIGADKAVSVIIENSLNQNKQLKGEQVYDLGIADAIFEGADFLEQSLLWTTAVLKGEIAVERPEIDRGEAWDQAVAKGRFIADSKVHGAAPAAYRALDIIAAAKNGDLQQGFDAENQALADLIMGGELRSGIYAFNLVQKRGKRPAGAPDKSLARPVTKVGVVGAGLMASQLALLFLRRLEVPVVLTDIDQERVDKGVGYVHAEIDKLLLKGRVNQDKANRLKALVSGVLDKAEGFSDADFVIEAVFEEIGVKQQVFAEVEAVAPAHAIFATNTSSLSVTEMASKLKHPERVVGFHFFNPVAILPLLEIVRGEQTDDASLATAFGVAKKLKKTAVLVKDAPAFVVNRILTRFMGEIQNVIDEGTPVEVAEKAVEPLGLPMSPLVLLELVGPAIGLHVSETLNRAFPDRFTVSPNLAAVVKAGKRGFYVYDSGKPELDPEVAALLKQGDVVLTEEQVRDRVLDAVAQEIGLMLDEGVVAEAQDIDLCLITGAGWPFHLGGITPYLDREGVSERANGKRFLEAGVASVPA

SEQ ID NO: 72235 - DNA, 2292 bp, Mus musculus
  CDS (1)..(2292)
atggtggcgtcccgggcgattggcagtctcagtcgcttctctgccttcaggatcctacgctccagaggctgcatttgccgcagctttacaacgtcttctgctctgctgaccagaacccatattaattatggcgtcaaaggggatgtggcagttattcggattaactcacccaattcaaaggtaaatacattgaataaagaagtacagtcagagttcatagaagtcatgaacgaaatctgggccaacgaccaaatcaggagtgctgtccttatctcatcaaagcctggctgctttgtcgcaggggctgacatcaacatgctatcctcttgtacaaccccccaagaagcaacacgaatatcacaggaaggtcagagaatgtttgagaaacttgaaaagtccccaaagcccgttgtggccgccatcagtggatcctgcttgggaggaggacttgagcttgccatagcatgccaatacagaatagcaacaaaagacagaaaaacagtattaggtgtccctgaagtgttgctggggatcttaccaggagccggaggtacccagagactgcccaaaatggtgggtgtgcctgctgcatttgacatgatgctgactggcaggaacattcgtgcagacagagcaaagaaaatgggactggttgaccagttggtggaaccgctgggaccaggaataaaatcaccagaagaaaggacaattgaatacctagaggaagttgcagttaattttgccaaaggcctggctgatcggaaagtctctgcaaagcagagcaaaggccttgtggaaaagctgacaacgtatgccatgactgtcccatttgtcagacaacaggtttacaaaacagttgaagaaaaagtgaagaagcagactaaaggcctttatcctgcccctttgaaaataattgatgctgtgaaggctggacttgagcaaggcagtgacgctggttatcttgctgaatcgcagaaatttggagagcttgcattgaccaaagaatcgaaggccctgatggggctttataacggccaggtcctgtgcaagaaaaataaatttggagcaccacagaagaacgttcagcagctagccatccttggcgcagggctgatgggggctggcattgcccaggtctctgtggataagggactgaaaactcttcttaaagacaccacagtgacggggctgggccggggacagcagcaagtgttcaaagggctgaacgacaaagtgaagaagaaagctctcacatcatttgaaagggattccatcttcagcaacttgattgggcagctggattacaaaggctttgagaaggccgacatggtgattgaggctgtgtttgaggacctcggtgtaaagcacaaagtgttaaaggaagtggaaagcgtgactccagaacactgtatctttgccagcaacacatctgctctcccaatcaatcaaattgctgctgtcagcaaaaggcctgagaaggtgatcggcatgcactacttctcccccgtggacaagatgcagctcctagaaatcatcaccactgacaaaacctccaaggacacaacggcctctgccgtggccgtggggctcaggcaagggaaggtcatcattgtggtcaaggacggacccggcttctacaccaccaggtgtcttgcacccatgatgtctgaagtcatgcgaatcctccaggaaggagttgaccctaagaagctggacgccttgaccacaggtttcggcttccctgtgggtgctgccacgctggcagacgaagtgggtgtggatgtagcacagcacgtagcagaagatctaggcaaagcctttggggagcgatttggaggtggcagcgtagaactgctgaaacagatggtctccaagggcttcttaggtcgcaagtctgggaagggcttttacatctatcaggagggctcaaagaataagagtttgaattctgaaatggataatatcttggcaaatctgaggctgcctgccaagcccgaggtctcctctgatgaagacgtccaataccgtgtgataacaaggttcgtgaacgaggcagtcctgtgcctacaggaagggatcctggccacaccggcagagggagacatcggagctgtctttgggcttggctttcccccttgtctcggagggcccttccgctttgtggatctgtatggtgctcagaaggtagtggaccggctacggaagtacgagtctgcctatggaacacagtttaccccatgccagctgctcctcgaccacgctaacaactctagcaagaagttctaccagtga

SEQ ID NO: 72236 - protein, 763 aa, Mus musculus
MVASRAIGSLSRFSAFRILRSRGCICRSFTTSSALLTRTHINYGVKGDVAVIRINSPNSKVNTLNKEVQSEFIEVMNEIWANDQIRSAVLISSKPGCFVAGADINMLSSCTTPQEATRISQEGQRMFEKLEKSPKPVVAAISGSCLGGGLELAIACQYRIATKDRKTVLGVPEVLLGILPGAGGTQRLPKMVGVPAAFDMMLTGRNIRADRAKKMGLVDQLVEPLGPGIKSPEERTIEYLEEVAVNFAKGLADRKVSAKQSKGLVEKLTTYAMTVPFVRQQVYKTVEEKVKKQTKGLYPAPLKIIDAVKAGLEQGSDAGYLAESQKFGELALTKESKALMGLYNGQVLCKKNKFGAPQKNVQQLAILGAGLMGAGIAQVSVDKGLKTLLKDTTVTGLGRGQQQVFKGLNDKVKKKALTSFERDSIFSNLIGQLDYKGFEKADMVIEAVFEDLGVKHKVLKEVESVTPEHCIFASNTSALPINQIAAVSKRPEKVIGMHYFSPVDKMQLLEIITTDKTSKDTTASAVAVGLRQGKVIIVVKDGPGFYTTRCLAPMMSEVMRILQEGVDPKKLDALTTGFGFPVGAATLADEVGVDVAQHVAEDLGKAFGERFGGGSVELLKQMVSKGFLGRKSGKGFYIYQEGSKNKSLNSEMDNILANLRLPAKPEVSSDEDVQYRVITRFVNEAVLCLQEGILATPAEGDIGAVFGLGFPPCLGGPFRFVDLYGAQKVVDRLRKYESAYGTQFTPCQLLLDHANNSSKKFYQ

SEQ ID NO: 72237 - DNA, 2163 bp, Mycobacterium bovis AF2122/97
  CDS (1)..(2163): transl_table=11
atgccagacaacacaatccagtgggacaaggatgccgacggcatcgtcacgctgaccatggacgatccctccgggtcaaccaacgtgatgaacgaggcctacatcgagtcgatgggcaaggccgtcgatcgccttgtcgccgaaaaggattcgatcaccggagtggtagtcgccagcgcgaagaaaaccttcttcgccggcggcgacgtcaagacgatgatccaggccaggcccgaggacgccggcgatgtattcaacaccgtcgagaccatcaagcggcagctgcgcaccttggagacattgggtaagccggtcgtcgcggccatcaacggggcggcgttgggcggcggcctggagatcgcgctggcgtgtcatcaccggatcgccgccgacgtcaagggcagccagctcggtctgccggaggtgacgctgggtctgctgccgggtggcggtggggtgacccgcacggtacggatgttcggcatccagaacgcgttcgtgagcgtgctggcgcaaggtacccggttcaagccggccaaggccaaggagatcggtctggtcgacgagctggtggcaacggtcgaggagctggtgcccgccgccaaggcttggataaaggaggagctcaaggccaaccccgacggtgccggggtgcagccgtgggacaagaagggctacaagatgcccggcggcaccccgtcgtcgccgggtctggcggcgattttgccgtcgttcccgtcgaacctgcgcaagcagctcaagggtgccccgatgccggcgccgcgggccatcctggccgccgcggtcgagggggcacaggtcgacttcgacaccgccagccgcatcgagagccgctacttcgcgtcgttggtcaccggccaggtcgccaagaacatgatgcaggcgttcttcttcgacctgcaggccatcaatgccggcgggtctcggcccgaaggcatcggcaagaccccgatcaagaggatcggtgtgctgggtgcgggcatgatgggcgccggcatcgcctacgtctctgccaaggccggctatgaggtggtactcaaagatgtcagccttgaggccgccgctaaaggcaagggctactccgaaaagctggaggccaaggcgctggagcggggccgcaccacacaggagcgcagcgacgccctgctggcgcgcatcaccccgaccgccgacgccgccgatttcaagggcgttgatttcgtgatcgaggcggtttttgaaaaccaggagctcaagcacaaggtgttcggcgagatcgaagacatcgtcgagcccaacgcgatcctgggatccaacacctcgacgctgccgatcaccggtctggcgaccggcgtcaagcggcaggaagactttatcgggatccacttcttctcgccggtcgacaagatgccgctggtggagatcatcaagggcgagaagacttctgacgaggccctggcccgggtgttcgactacaccttggccatcggcaagaccccgatcgtggtcaacgacagccgcggctttttcacctcgcgggtcatcggcacgttcgtcaacgaggcgctggcgatgctcggtgagggtgtcgagccggcttctatcgagcaggcggggtcgcaggccgggtatccggcgccgccgctgcagctgtccgacgagctcaacttagagctgatgcacaagatcgccgtcgccacccgtaagggtgttgaggacgccggcggcacgtaccagccgcatccggcggaggccgtggtggagaagatgatcgagctcggccggtccggccggctgaagggcgcgggcttctacgagtacgccgacggcaagcgatccgggttgtggcccggcttgcgcgagacgttcaagtcgggctcgtcgcagccgccgctgcaggacatgatcgaccgcatgctgttcgccgaggcgctggaaacccagaagtgcctcgacgagggggtgctgacgtcgacggccgacgccaacatcggctcgatcatgggcatcggcttcccgccgtggacaggtggcagtgcccagttcatcgtcggctactccggcccggccggtaccggtaaggcggctttcgtggcccggacccgcgagctggcggccgcctacggcgaccgcttcctgccgccggagtcgctgctaagctga

SEQ ID NO: 72238 - protein, 720 aa, Mycobacterium bovis AF2122/97
MPDNTIQWDKDADGIVTLTMDDPSGSTNVMNEAYIESMGKAVDRLVAEKDSITGVVVASAKKTFFAGGDVKTMIQARPEDAGDVFNTVETIKRQLRTLETLGKPVVAAINGAALGGGLEIALACHHRIAADVKGSQLGLPEVTLGLLPGGGGVTRTVRMFGIQNAFVSVLAQGTRFKPAKAKEIGLVDELVATVEELVPAAKAWIKEELKANPDGAGVQPWDKKGYKMPGGTPSSPGLAAILPSFPSNLRKQLKGAPMPAPRAILAAAVEGAQVDFDTASRIESRYFASLVTGQVAKNMMQAFFFDLQAINAGGSRPEGIGKTPIKRIGVLGAGMMGAGIAYVSAKAGYEVVLKDVSLEAAAKGKGYSEKLEAKALERGRTTQERSDALLARITPTADAADFKGVDFVIEAVFENQELKHKVFGEIEDIVEPNAILGSNTSTLPITGLATGVKRQEDFIGIHFFSPVDKMPLVEIIKGEKTSDEALARVFDYTLAIGKTPIVVNDSRGFFTSRVIGTFVNEALAMLGEGVEPASIEQAGSQAGYPAPPLQLSDELNLELMHKIAVATRKGVEDAGGTYQPHPAEAVVEKMIELGRSGRLKGAGFYEYADGKRSGLWPGLRETFKSGSSQPPLQDMIDRMLFAEALETQKCLDEGVLTSTADANIGSIMGIGFPPWTGGSAQFIVGYSGPAGTGKAAFVARTRELAAAYGDRFLPPESLLS

SEQ ID NO: 72239 - DNA, 1944 bp, Bordetella parapertussis 12822
  CDS (1)..(1944)
atgaacacgcccgacctggcctacacccactggcgcctgcaccgtgaagccgacggcctggcatggctggcgctggcgcgcgccgacgccgccgcgaactcgctgtcggccgaggtcatggccgaactcgccgcggtgctcgacgccctgcaggcccagccgcccaaggaactggtcattctgtcgggcaaggagaacggcttcatcgtcggcgccgacatcaacgaattcggcgcgctgcagacgccgcagcaggcgcgcgaactggtcgcgcgcggctggcagctgttcaaccggctggcggcgacgccgtaccccacgctggcgctgatacgcggccactgcctgggcggcggcctggaactggcgctggcctgccgctaccgcatcgccgccgacgacgccgacaccgcgctggggctgccggaagccatgctgggcattttccccggctggggcggcatgcggcgcctgccggcgctgatcggcgcgccggccgcgctggacatgatgctgaccggacgccgggtcgacgcgcgccgcgccgcggcgctgggcctggtcgacgcgcgcgtgccgccgcggctgctgcaggccgccgcccgcgccaccgtgctgtcgggccgagcgccgcgccgcgcgcgcggcctgccggcctggctgaaccgctggccgctcaaggcgctggcggcgcgccgcgcgcgccagagcgtggccgccaaggatccgcagggccactaccccgccccgcgcgccatcatcgacatctgggcgcgccacggcggcaacgccctgcatgcgcccgacctgatagacggcatcctggcttcggacacggcgcgccagctgctgcgcgtgttccgcctgcaggaacggctcaagggctacggcaaggccgccgtcgacgcgcccgtgcggcgcgtgcacgtggtgggcgccggcgtcatgggcggcgatatcgccgcctggtgcgcctaccgcgggttgaccgtcacgctgcaggaccaggacatggcgcgcatcgcgccggcgctggcgcgcgccggcgccttcttcgcccgcaagctgaaggaccggcgcgccgcgcgcgccgccttcgaccgcctggttcccgacccccagggcgatggcgtggcgcaagccgacctggtcatcgaggccatcagcgagagcgcccaggccaagcaggccctctaccgccagctcgaaccgcgcctgaaaccgggcgccctgctggccaccaatacctccagcctgtcgctggccgggctggcccaggtcctcgaccagccgcagcggctggtcggcatccatttcttcaacccggtggcgcgcatgccgctggtcgaagtcgtgctcgccgccgacagcgatccgcgcgcgctggcgcgggcctgcgccttcgtcggccgcatcggcaagctgccgctgcccgtgcgcgacgcgccgggtttcctggtcaatgcggtgctggcgccctacatgctggaagcgatgcgctgcgtcgacgagggcatggcgccggcggccatcgacgccgccatggccgccttcggcatgccgatggagccgctcgagctggccgacaccgtcgggctggacatcgcggcggccgccggcgcccagctcaccggcgagcacgcgccgccgcgctgcctggccgaacgcctggcgcgcaaggaactgggccgcaagagcggccgcggcttttatgcctggcgcgacggcaaggcggtcaagccggccgcgcgcggcgtgccgccagggctggtcgaccgcctgctccagcccctgatcgacagcgcccgcgagcgcgtggccgccggcgtggtggccgatgcggacctggccgacgcgggcgcgattttcggcacgggctttgccccctacacgggcggcccgctgcaatacgcaagtcaacgagaagccgtccagcggccttag

SEQ ID NO: 72240 - protein, 647 aa, Bordetella parapertussis 12822
MNTPDLAYTHWRLHREADGLAWLALARADAAANSLSAEVMAELAAVLDALQAQPPKELVILSGKENGFIVGADINEFGALQTPQQARELVARGWQLFNRLAATPYPTLALIRGHCLGGGLELALACRYRIAADDADTALGLPEAMLGIFPGWGGMRRLPALIGAPAALDMMLTGRRVDARRAAALGLVDARVPPRLLQAAARATVLSGRAPRRARGLPAWLNRWPLKALAARRARQSVAAKDPQGHYPAPRAIIDIWARHGGNALHAPDLIDGILASDTARQLLRVFRLQERLKGYGKAAVDAPVRRVHVVGAGVMGGDIAAWCAYRGLTVTLQDQDMARIAPALARAGAFFARKLKDRRAARAAFDRLVPDPQGDGVAQADLVIEAISESAQAKQALYRQLEPRLKPGALLATNTSSLSLAGLAQVLDQPQRLVGIHFFNPVARMPLVEVVLAADSDPRALARACAFVGRIGKLPLPVRDAPGFLVNAVLAPYMLEAMRCVDEGMAPAAIDAAMAAFGMPMEPLELADTVGLDIAAAAGAQLTGEHAPPRCLAERLARKELGRKSGRGFYAWRDGKAVKPAARGVPPGLVDRLLQPLIDSARERVAAGVVADADLADAGAIFGTGFAPYTGGPLQYASQREAVQRP

SEQ ID NO: 72241 - DNA, 2184 bp, Oryza sativa (japonica cultivar-group)
  CDS (1)..(2184)
atggccgcggcggcggcggcgaaggggaggacggagatggaggtcggagcggacggcgtcgccgtcatcaccatctgcaacccgcccgtcaactcgctctccatcgatgtattgctaagcttaaaggaaaactatgctgaagctcttcggaggaatgatgtgaaagctattgttgttacagggaaaggaggaaaattttctggaggatttgatattagttcctttggtagtgttcagggtggcaaagttgaacagccaaaggttggttacatatcaatagatattatcactgataccctagaagctgcaacaaagccatcagtggctgcaattgatggtcttgctcttggtggaggattggaagttgctatggcatgccatgcacgcatttcaactcccacagctcaattaggacttccagaacttcaacttggagttattccaggatttggaggaacacaacgactcccgcgtcttgttggattgacaaaagcacttgaaatgatgctgctatctaagccaattaagggtgcagaggcacaccaattgggtcttgttgattccttggtttctgctgatgatttggttaatactgctcgtcgttgggctttggatatctgtgaattaaaaaggccatggatcaaaagtctttataagactgacaaactagaaccacttggtgaggctagggagattctcaagtttgcaagagctcaagctcgaaggcaggctgccaatcttgagcatccgcttgtttgtattgatgtcattgaagaaggtattgtttcgggaccccgagctgggctctggaaggaagcaaatgctttccagggtcttcttttcgcggatacatgtaaaaacttagttcatgtattcttttctcaacgggcaacatcaaaggttcctggtgctacagacttgggattgatgcctaggaaagttactaaagttgccattctaggtggtggacttatgggttcaggaattgcaactgcgatgatactgagtaattatcctgttatactcaaagaagtaaatgagaagtttctaaatgctggaattgacagaattaaagccaatttgcagagtcgtgtgaggaaagggaaaatgacagaggagagatatgagaaagccatgtctcttgtaacaggtgtcctcgattatgaaaggttcaaagacgtggatttagttattgaggctgttattgaaaatgtgaaattgaaacagcaaatattttctgacttggagaagtactgtccttcccattgtgtccttgctactaatacatctacaattgatcttaatctaattggtgagaaaacaaggtccaaagaccgtattgtcggtgcacacttctttagccctgcacatgtcatgccacttctggaaatagtccgcacccagcacacctcaccacaagttgtcgttgatttgcttgatgttgggaagaaaatcaagaagacaccaatagtggttgggaactgtaccggtttcgcagtcaacagaatgttctttccttacactcagtcagcactcctgttcgttgatcttggtatggatgtgtacaagatcgatcgtgcatgtaccaaatttggaatgcccatgggtccattcagactggcagacctcgttggttttggtgttgctgcggccactggtatgcagtaccttgagaacttcccagagagggtctacaagtcaatgttgattcctcttatgatggaggacaaaaggacaggtgaggcctctcggaagggcttttacaagtatgaggacaagaggaaggcaactcctgatcccgaaattatgaaatatattgaaaaatctaggagtatggctggagtaacaccagacactgagttgatgaagctaagtgagaaggacatagttgagatggtcttcttcccagtcataaatgaggcttgccgtgttcttgatgagggaattgcagtcaaggcttctgaccttgacattgcctcaatctttggcatgggattcccaccgtataggggaggaatcatgttctgggcagattccattggtgcaaagtacatccatgacaagttggaggtgtgggcgaagcggtatagcgacatcttcaagccttgttcctaccttgcagaaagagcagcaaatggggttcctctgagtgcaccagctaagcaagtcaaggcccgactatag

SEQ ID NO: 72242 - protein, 727 aa, Oryza sativa (japonica cultivar-group)
MAAAAAAKGRTEMEVGADGVAVITICNPPVNSLSIDVLLSLKENYAEALRRNDVKAIVVTGKGGKFSGGFDISSFGSVQGGKVEQPKVGYISIDIITDTLEAATKPSVAAIDGLALGGGLEVAMACHARISTPTAQLGLPELQLGVIPGFGGTQRLPRLVGLTKALEMMLLSKPIKGAEAHQLGLVDSLVSADDLVNTARRWALDICELKRPWIKSLYKTDKLEPLGEAREILKFARAQARRQAANLEHPLVCIDVIEEGIVSGPRAGLWKEANAFQGLLFADTCKNLVHVFFSQRATSKVPGATDLGLMPRKVTKVAILGGGLMGSGIATAMILSNYPVILKEVNEKFLNAGIDRIKANLQSRVRKGKMTEERYEKAMSLVTGVLDYERFKDVDLVIEAVIENVKLKQQIFSDLEKYCPSHCVLATNTSTIDLNLIGEKTRSKDRIVGAHFFSPAHVMPLLEIVRTQHTSPQVVVDLLDVGKKIKKTPIVVGNCTGFAVNRMFFPYTQSALLFVDLGMDVYKIDRACTKFGMPMGPFRLADLVGFGVAAATGMQYLENFPERVYKSMLIPLMMEDKRTGEASRKGFYKYEDKRKATPDPEIMKYIEKSRSMAGVTPDTELMKLSEKDIVEMVFFPVINEACRVLDEGIAVKASDLDIASIFGMGFPPYRGGIMFWADSIGAKYIHDKLEVWAKRYSDIFKPCSYLAERAANGVPLSAPAKQVKARL

SEQ ID NO: 72243 - DNA, 2151 bp, Oryza sativa (japonica cultivar-group)
  CDS (1)..(2151)
atggaggtccggcccggcggcgtcgccctcatcaccatctccaaccctcccgtcaatgccctctccatccacgtcttgtatagcttgaaggaccactatgaagaagcacttaggaggaatgatgttaaagctattgttgtcacaggaaaaggaggagtattttccgggggactagacattaatacatttggtgctattcagagaaacaaagcggagcagctaaaggttgattatgtgtccatagatgtcatgactaatactcttgaagctgctggaaagccatcagtagctgctatcaacggtcctgctcttggtggagggttagaaatttccatggtatgtcaagcacgcatttcgattccaacggctcaattaggtcttccagagcttcaacttggagtgatccctgcatttggaggaacacaacgacttccccgccttgttggactaacaaaagcacttgaaatgatgctgatgtccaagcctattaaagccgaagaggcccatcagctggccctcatcgatgccatagtttcacctaatgatttgctgaatactgcctgccgttgggccttggatatatccgaatctagaaggccatgggtccataccctcagtagaactgacaagctagagtctcctgatgaggccagggagatcctcaagtttgccagagctcaggttcagaagcaggctgccaatcttcggcacccacttgtctgtattgatgttatcgaggaaggtatagtttcaggaccccaagctgggctacggaaggaagccattgctttccaggaccttgttttctcagatacatgtaaaagcttggttcatgtctttttttcacagcgtgcgacatcaaaggttcctgggatcacagacttaggtttaatgcctaggaaggtatctaaagttgccattgttgggggtgggcttatgggttctgggattgcaactgcactgatgctgagtaattatcctgttgtactcaaagaagtaaacgacaaattcttggacgcaggaattgacaggatcaaagcaaatttgcagagtcgtgtgaggaatgggaaaatgaccaaggagatatacgaaaaaacgctctcacttcttacaggtgtcgttgattacgagagattcaaggacgtagatttagttattgaggaaattgtagagaatgtgaaggtgaagcagcaagtgtttgctgacttggagcggtactgtccttcccattgtgtacttgccactaacacttctaccattgatcttgacctgattggagagaagacaaactcccaagatcgcattgccggtgcgcacttttttagtccagctcatgtgatgccacttctggaaatagtccgctccaatcatacctcaccacaagtagttgttgatttgctggatgtggggaagaagatcaagaagacaccagtagtggttgggaattgtaccggctttgcggttaaccggatgttctctccctatactagtatagcgctcttgcttgttgatcgtggaatggatgtttacaagattgatcaagtttgtaccgaatttgggatgccaatgggtccattcagattgctagacctggttgggtttggagtagctcttgcctctggcatgcagtaccttgagaactcccccgggagtgtcgacaagtcaatgctaattcctctcatgtttgaagacaaaaggacaggcgaagcctctcaaaagggattttacaagtatgagggtaatcggaaggccatccctgatcctgatatcttcaagtatgttgagaagtcaaggagaatggctggaactgtgcctgatcttgagctactgaagcttgacgacaaggaaatagtggagatggtgttcttccctgttatcaacgaggcctgccaggtcctcagtgagggcattgccaacaaagcctcggacctcgacatcgcctcaatcttcggcatgggatttccaccatacaggggtggcatcgtgtactgggccgattccatcggcgcaaagcgcattcacgcaaggctatcagagtgggagatgaagcatggccagttgttcaggccttgctcatacctgtcagaaagggcagcagaaggtgttcctctgagctccaccgcgaagaacaatgccaaggcccggatgtga

SEQ ID NO: 72244 - protein, 716 aa, Oryza sativa (japonica cultivar-group)
MEVRPGGVALITISNPPVNALSIHVLYSLKDHYEEALRRNDVKAIVVTGKGGVFSGGLDINTFGAIQRNKAEQLKVDYVSIDVMTNTLEAAGKPSVAAINGPALGGGLEISMVCQARISIPTAQLGLPELQLGVIPAFGGTQRLPRLVGLTKALEMMLMSKPIKAEEAHQLALIDAIVSPNDLLNTACRWALDISESRRPWVHTLSRTDKLESPDEAREILKFARAQVQKQAANLRHPLVCIDVIEEGIVSGPQAGLRKEAIAFQDLVFSDTCKSLVHVFFSQRATSKVPGITDLGLMPRKVSKVAIVGGGLMGSGIATALMLSNYPVVLKEVNDKFLDAGIDRIKANLQSRVRNGKMTKEIYEKTLSLLTGVVDYERFKDVDLVIEEIVENVKVKQQVFADLERYCPSHCVLATNTSTIDLDLIGEKTNSQDRIAGAHFFSPAHVMPLLEIVRSNHTSPQVVVDLLDVGKKIKKTPVVVGNCTGFAVNRMFSPYTSIALLLVDRGMDVYKIDQVCTEFGMPMGPFRLLDLVGFGVALASGMQYLENSPGSVDKSMLIPLMFEDKRTGEASQKGFYKYEGNRKAIPDPDIFKYVEKSRRMAGTVPDLELLKLDDKEIVEMVFFPVINEACQVLSEGIANKASDLDIASIFGMGFPPYRGGIVYWADSIGAKRIHARLSEWEMKHGQLFRPCSYLSERAAEGVPLSSTAKNNAKARM

SEQ ID NO: 72245 - DNA, 2232 bp, Photorhabdus luminescens subsp. laumondii TTO1
  CDS (1)..(2232): transl_table=11
ttgtgctgctggcgggttgggcacagctatggtattggaggtggaataatgactcaagctcagcatgatgctgcacccatcactacgggtacaaaccaaactgcttctgttttcagttttgacgtcaggccagataagataggcatcatcaccattaatgtaccgggagaaaaggtcaatacgctgaaagcagaatttgttgatcaatttctgaatgttttcaagcaagctcagcaatcttctggtcttaaaggattaatattgatttccggtaaaccggatacgtttattgccggtgctgatatttctatgattgccggatgtaagaccaaagaagatgcgcgagatttggctgaaaaaggtcagaaactattttctcagatagccaattaccctttgcctgtcgtagcagcaattcatggcgcttgtttggggggcggtttggaattggcgcttgcatgtcattggcgtgtatgttcacaggatgataaaactcgtcttggattaccggaagttcaacttgggttattacctggctctggtggtactcagcggttgccaaggcttattggtgttagttcagcgttggatatcatgctgacaggtaaacagctacgggcgaaacaggcattacggctcggattggtggatgatgctgtgccgttggatattttgctggatattgctatcgaaaaagtcaaaaagggtattcctgtgcgtaagcctttgccgtggcaacagcggctattagttggccccgtcggaagatactttttgtttaatatcgttcgtaaaaagacactggcgaaaactcgtggacattatcctgcacctgaacgaattattgaagttgtcaaagaaggtcttgaaaaaggtatgagccagggtttacgggctgaggcggtggcatttggtgaattggcaatgacacgggaatctgctgctttacgtaatctgttttttgctgcaacttcgttgaagaatgaaacggggtcatcagagaagccggcgaagatcaagcacgttggtatattaggtggtggtttgatgggtggaggcattgccaatgtaacagccacccgaggcaaactaccggtgcggattaaagatattaatgaaaagggcattagtcaggtattgaaatatacttgggatttgttgtccaagcgggtgaagcaaaaacgactacgcccggcagagcgtgctcaacaaatgatgctgatttcaggaacgacggattatcgtggtttcgcacaaactgatattgttgttgaagcagtgtttgaggatttgtcactaaagcagaaaatggtggcagaaattgaaacgaatgctaaaccagaaaccatatttgcatctaatacctcttcactacctatccatcagattgctgaaaaagctcaacgaccagagcaggttattggtctgcattattttagtccagtggataagatgccgctggtggaagttattccacatcaagggaccagtgagaaaacgattgctacagccgtttctttggcgaagaagcagggtaaaaccgcgatcgtggtgggtgataaagccgggttttatgtaaaccggattcttgttccttatatcagtgaagccgcgcattgcttggtagcaggagaacctattgaccatatcgatggagctctggttaattttggttttccggtagggccgattaatttattggatgaagtaggtattgacgttggcaccaaaatcatgccagttctggtagaacaattaggcccgcgttttgctgcacctgaatctctcgatgctgtactgaaagatggtcgtaagggtaggaaaaatggccgtggtttctatttatatgccccagggcccagaaaattctggcagtttggtaagagagacaaaaaagttgatagctcagtgtataccttgctgaatataacgcctgagtcgcatatgctctcgtcagaaattgctcaacgttgtgtgatgctaatgcttaatgaagctgttcgttgcttggatgaaggcattatcagaagtccacgtgatggtgatattggggcggtatttggcattggttttccgccattctttggtggtccattccgttatattgatagccttggttgtgccagagtggtggagattctgcgcaggctggaaagccagtatggagacagatttgtaccttgtgagtgtttagtgaatatggctgaacagaataaaagtttttatccatag

SEQ ID NO: 72246 - protein, 743 aa, Photorhabdus luminescens subsp. laumondii TTO1
MCCWRVGHSYGIGGGIMTQAQHDAAPITTGTNQTASVFSFDVRPDKIGIITINVPGEKVNTLKAEFVDQFLNVFKQAQQSSGLKGLILISGKPDTFIAGADISMIAGCKTKEDARDLAEKGQKLFSQIANYPLPVVAAIHGACLGGGLELALACHWRVCSQDDKTRLGLPEVQLGLLPGSGGTQRLPRLIGVSSALDIMLTGKQLRAKQALRLGLVDDAVPLDILLDIAIEKVKKGIPVRKPLPWQQRLLVGPVGRYFLFNIVRKKTLAKTRGHYPAPERIIEVVKEGLEKGMSQGLRAEAVAFGELAMTRESAALRNLFFAATSLKNETGSSEKPAKIKHVGILGGGLMGGGIANVTATRGKLPVRIKDINEKGISQVLKYTWDLLSKRVKQKRLRPAERAQQMMLISGTTDYRGFAQTDIVVEAVFEDLSLKQKMVAEIETNAKPETIFASNTSSLPIHQIAEKAQRPEQVIGLHYFSPVDKMPLVEVIPHQGTSEKTIATAVSLAKKQGKTAIVVGDKAGFYVNRILVPYISEAAHCLVAGEPIDHIDGALVNFGFPVGPINLLDEVGIDVGTKIMPVLVEQLGPRFAAPESLDAVLKDGRKGRKNGRGFYLYAPGPRKFWQFGKRDKKVDSSVYTLLNITPESHMLSSEIAQRCVMLMLNEAVRCLDEGIIRSPRDGDIGAVFGIGFPPFFGGPFRYIDSLGCARVVEILRRLESQYGDRFVPCECLVNMAEQNKSFYP

SEQ ID NO: 72247 - DNA, 2187 bp, Photorhabdus luminescens subsp. laumondii TTO1
  CDS (1)..(2187): transl_table=11
atgctctatcaaagtgaaacaattcaagtaagctggctgaaagatggcattgctgaactggttttcaatgccccagccgcgattaataaactagataccaaaaccgttgcatctctcgacaaggctattgccagcctagagcaacaaactggattgaaaggcgttttattacgttctgaaaaaaccgcatttattgttggtgcagatattactgaattcctctctttattcgattcacctgtagaaaaactgcaagaatggcttaacttttcaaatagcatttttaaccggatagaagatttacctgtaccaaccatttcagcaataaacggttatgctcttggtggtggttgtgaatgcgttctatctacagatttccgtgtggcctccccggatatacgcattgggttaccagaaaccaaacttggtattatgcctggtttcggtggctcagttcgccttccacgcctgatcgggactgataatgcattggatatcattgccgcaggtaaagacattggtgcagaagaagcattgaaaaacggtttgattgatgctgttgttcccaaagaaaaactggttgattccgcagtatcaatgctggaacaagcaattgcagggaacctcgactggaaagccgcacgccagccaaaattagagcctttgaaactcaatgaaactgaacgaggcatgagttttagtgtggcaaaaggtatggtgatgaaagtcgccggccctcattatccagctcctatcaccgcagttaaatctatagaaaaagccgctacatttggtcgcgatgaagcattgaaacaagaaaccgccagcttcattcctttagcacagacaaatgttgcccgtgccttagtgggtatttttcttaatgaccagtacgtaaaaggactggcaaaaaaacatctgaaagaagtcacaatacctgaatatgccgcagttctaggtgctggaattatgggtggtggtatagcctatcaatccgcccgcaaagggattcctgtcatgatgaaagacatcagccagcaatcccttgaattaggtatgaatgaagccgcgaaacttctaaacaagcaatttgaacgtggccgtctagatgctataaaaatggcgagaaccctctcttctattcaacctaccttaaattatgccggtatcgaacaggcccaaatcgtggttgaagctgtagtagagaatcctaagatcaaagcggctgtactatcagaaactgaaactctggttaatgaagattgtgtcctagcttccaacacatcaacaattccaatttcagaattagctaagtccctaaaacgcccggaaaacttctgtggtatgcatttcttcaacccggtacaccgcatgccgttggttgaagtcattcgcggtgaaaaaacgtctgaaaagacaatttcaaccgtagtcgcctatgccagcaaaatgggtaaaaccccgatcgtcgttaacgactgtccagggttctttgtaaaccgagtactgcttccttatctccttggcttcggtctactattgcgtgatggtggtgatttccgccaaatagacaaaatcatggagaaagaatttggttggccaatgggccctgcttaccttatcgatgttattggtcttgatactgcacatcattctcaatccgtcatggcccaagggttcccagatcgtatgcatcgtgattataaagatgccattcatgttttatatgacaatcaacgttatgggcagaaaaacggccttggcttctataaatatacgcaagataagaaaggtaaacctaagaaagagcaagacgagcaaacagaccaactgctggcaactatctgccaacagaagagtaatttctccggtgaagagatcattgctcgtactatgatcccgatgatcaacgaagttgtccgttgtctggaagaaggtgtcattgccagcccagcagaagcagatatggctctggtttatggccttggcttccctccattccacggtggtgttttccgttatctggaaacaatgggaactgcggcttacgtaaaaatggctgaaaattatgctcacctaggtgcgctttatcaggtaccgcctggtctgaaagccaaagctgaacgtaatgaaagttactactctacagcagcaacgattgctgtcagcaccggaaaaacagcgtga

SEQ ID NO: 72248 - protein, 728 aa, Photorhabdus luminescens subsp. laumondii TTO1
MLYQSETIQVSWLKDGIAELVFNAPAAINKLDTKTVASLDKAIASLEQQTGLKGVLLRSEKTAFIVGADITEFLSLFDSPVEKLQEWLNFSNSIFNRIEDLPVPTISAINGYALGGGCECVLSTDFRVASPDIRIGLPETKLGIMPGFGGSVRLPRLIGTDNALDIIAAGKDIGAEEALKNGLIDAVVPKEKLVDSAVSMLEQAIAGNLDWKAARQPKLEPLKLNETERGMSFSVAKGMVMKVAGPHYPAPITAVKSIEKAATFGRDEALKQETASFIPLAQTNVARALVGIFLNDQYVKGLAKKHLKEVTIPEYAAVLGAGIMGGGIAYQSARKGIPVMMKDISQQSLELGMNEAAKLLNKQFERGRLDAIKMARTLSSIQPTLNYAGIEQAQIVVEAVVENPKIKAAVLSETETLVNEDCVLASNTSTIPISELAKSLKRPENFCGMHFFNPVHRMPLVEVIRGEKTSEKTISTVVAYASKMGKTPIVVNDCPGFFVNRVLLPYLLGFGLLLRDGGDFRQIDKIMEKEFGWPMGPAYLIDVIGLDTAHHSQSVMAQGFPDRMHRDYKDAIHVLYDNQRYGQKNGLGFYKYTQDKKGKPKKEQDEQTDQLLATICQQKSNFSGEEIIARTMIPMINEVVRCLEEGVIASPAEADMALVYGLGFPPFHGGVFRYLETMGTAAYVKMAENYAHLGALYQVPPGLKAKAERNESYYSTAATIAVSTGKTA

SEQ ID NO: 72249 - DNA, 2217 bp, Rhodopseudomonas palustris CGA009
  CDS (1)..(2217): transl_table=11
atggccttcaagaacttcaaagtcgagaccgacgccgacggcatcgcactggtgacctgggacctgcccggcaagtcgatgaacgtgctggacgctgcgacgatcgaggaactcggtgcgatcgcggaagccaccaccaaggacgcggcggtcaagggcgtggtgatcacctcggccaaggacgcgttctgcgccggcgccgatctgtcgatgctggagagcatgaaccagcagttcgcccagatccggaaagacaagggcgaagaagccgcccagaagatgctgttcgacgagagccggaagctgtcgcagatcctgcgcggcatcgagacctgcggtaagccgtgggtcgcggcgatcaacggtctggcgctcggcggcggcttcgaagtcacgctggcctgccactatcgcgtcgcagccgacaatccgaagacccgcctcggcctgcccgagatcaaggtcggcctgttcccgggcggcggcggcacccagcggattccgcgcatcgtcgatccgcagaacgcgatgacgatcctgctcaagggcgatcagatcaagctcgacaaggccaaggcgctgaagctggtcgacgcggtggtgccggcggccgatctgatcaagactgccaaggactggatcaagaacggcggcaaggcggtggcgccgtgggacgagaagggcttcaagctgcccggcggtcaggtgttctccaagcagggcatgatgatgttcccggccggcaacgccatctatcgccgcgagacctacgataactatccggccgcgcgcgcgatcatgagctgcgtctatgagggcctgttggtgccgatcgacgtcgcgctgcggatcgagtcgcgctacttcgcgcacgtgctgcagaccaaggaagcggcggcgatgatccgcagcctgttcctatcgatgcaggagctgaacaagggcgcgcgccgtccgcagggcgtgccgccgaccaaggtcaagaagctcgccatcatcggcgctggcttcatgggcgccagcgtcggctacgtctcggccaaggccggcatcgaggtggtgctgatcgatcgcgaccaggagagcgccgacaagggcaaggcacattgccagtcggtcatcgacggtctcatcaagaaaggccgcgccaaggaggccgaccgcgacgcgctgatgtcgcgcatcactgcgacgccggacttcaatgcaatctcggattgtgacctcgtcatcgaagcggtgttcgaggatcggaaagtgaaggccgagacctacgccaaggcgcagccgctgctgaaggaaggtgcgattttcgcatccaacacctccacgctgccgatcaattcgctggccgaggagttcaaggaccagtcgaagttcatcggcatccacttcttctcgccggtcgagaagatgatgctggtcgaagtgattctcggcaacaacaccagcgacgtcacgctcgccactgccctcgactacacccgccaaatcggcaagaccccgatcgtggtgaacgacagccgcggcttcttcgccaaccgttgcgtgctgcgcttcaccgccgagggcctcgagatgctgatggaaggcgtcccggcgccgatgatcgagaccgcggccaagatggccggcatgccggtcggcccgctgtcgctggccgacgaagtggcgctcgacctgatcctgaagatcatgaaggcgaccgaagccgatctcggcgaacaggcggtcgatcagcagcagaagaagctgatggtcgagctggtcgagaagcagggtcggttcggccgcaagaacggcaagggtttctacgtctatccggagaagggtaagggtcagaagagcctgtgggacggcatcgccgcactgcagccgaagcacctcgaccccgacaccatcgatgtcgaagagctgaagcagcgcttcctggcggtgcaggcggtggaagcggcccgcacggtcgaggacaacgtcatcgtcgacccgcgcgaggccgatgttggctcgatcctcggcttcggcttcgcgccgttcaccggcggcacgctgagctacatcgacttcatgggcaccaaggagttcgtcgcgctgtgccacaagctcgaaggcaagttcggctcgcgcttcacgccgccgaagctgctcgaagacatggccaagaccggcgacaccttctaccaccgcttcgccccgaagaagcaggcggcggcttaa

SEQ ID NO: 72250 - protein, 738 aa, Rhodopseudomonas palustris CGA009
MAFKNFKVETDADGIALVTWDLPGKSMNVLDAATIEELGAIAEATTKDAAVKGVVITSAKDAFCAGADLSMLESMNQQFAQIRKDKGEEAAQKMLFDESRKLSQILRGIETCGKPWVAAINGLALGGGFEVTLACHYRVAADNPKTRLGLPEIKVGLFPGGGGTQRIPRIVDPQNAMTILLKGDQIKLDKAKALKLVDAVVPAADLIKTAKDWIKNGGKAVAPWDEKGFKLPGGQVFSKQGMMMFPAGNAIYRRETYDNYPAARAIMSCVYEGLLVPIDVALRIESRYFAHVLQTKEAAAMIRSLFLSMQELNKGARRPQGVPPTKVKKLAIIGAGFMGASVGYVSAKAGIEVVLIDRDQESADKGKAHCQSVIDGLIKKGRAKEADRDALMSRITATPDFNAISDCDLVIEAVFEDRKVKAETYAKAQPLLKEGAIFASNTSTLPINSLAEEFKDQSKFIGIHFFSPVEKMMLVEVILGNNTSDVTLATALDYTRQIGKTPIVVNDSRGFFANRCVLRFTAEGLEMLMEGVPAPMIETAAKMAGMPVGPLSLADEVALDLILKIMKATEADLGEQAVDQQQKKLMVELVEKQGRFGRKNGKGFYVYPEKGKGQKSLWDGIAALQPKHLDPDTIDVEELKQRFLAVQAVEAARTVEDNVIVDPREADVGSILGFGFAPFTGGTLSYIDFMGTKEFVALCHKLEGKFGSRFTPPKLLEDMAKTGDTFYHRFAPKKQAAA

SEQ ID NO: 72251 - DNA, 2100 bp, Rhodopseudomonas palustris CGA009
  CDS (1)..(2100): transl_table=11
atgagcgaagtagtcacacgcgcaacgcaggatcaggtcgcgatcgtcacggtcgacagtccgccggtcaatgcgctcagtgcggctgttcgccgcggcattctggaaaacgtcaacgccgccgttgccgatcctgcggtgcaggcgatcgtgctggtgtgcgcgggccgcaccttcattgccggtgccgacatcaccgaattcggcaagccgccgcagccgccggcgctcaacgatgtcatcgccgcgctggagaattcgccgaagccgaccattgctgcgatccacggcaccgcgctcggcggcggcctcgaagtcgcgctcggctgccatttccgcgtcgccgtcaaggaagccaagctcggcctgccggaagtcaagctcggcctgctgccgggcgctggcggtacgcagcgcctgccgcgcgcggtcggtcctgaactcgccgtgcagatgatcgtcggtggcagcccgatcggcgccgctgaagcgctcaagcacggcctggtcgaagaggtcgtcgagaatctggtcgcgggcgcggtcgcgttcgccaagaaggtgctggccgagaagcgcccgctgcgccggctgcgcgacgacgattccaagctcgcggccgccaaggccgatcgctcgatcttcaccaatgcggttgcggcgatgaccaagaaggcgcgcggcctcgaagctccgttcgcctgcgccgacgcgatcggcgccgcgatcgatctgccgttcgaagaggggctgaagaaggagcgcgagggcttcatgaagctcgtcgtctccgatcagtcgaaggcgcagcgctacgcgttcttcgccgagcgtgaagccgccaaggtcgatggcgtgccggacggcaccaagccgcgtccggtgtcgcgcgtcgcgatcatcggtgccggtaccatgggcggcggcatcgcgatgtcgttcgccaatgccggtatcccggtgacgctgatcgagaccggcgaggagcagctgaagcgcggcctcggcatcatgcagaagaactgggaagcaaccgcggcgcgcggcggcctgccgccggatgcgccggccaagcgcatggcgctgatcaccggcctggtcggcctcgaaaacgtcaaggacgccgacctgatcatcgaggcggtgttcgaaaccatggcggtgaagaaggaagtgttcaccgccgtcgacgcccacgccaagccgggcgcggtgctggcgtcgaacacctcgtatctgtcgatcgacgagatcgccgctaccaccaagcgtccgcaggacgtgctcggcatgcacttcttctcgccggccaacgtgatgaagctgtgcgaaatcgtgcgcggcgccaagaccgcaccggacgcgctgctgaccgcggtgtcgatcgccaagaagatcgccaaggtgccggtcgtggtcggcgtctgcgacggcttcgtcggtaaccgtatgctcgcggcccgctccaagcagtccgagaagctgctgttcgaaggcgcgctgccgcagcaggtcgacgccgtcgtcaccaagttcggcatgccgatgggtccgttcgcgatgggcgatcttgccggcctggatatcggttggcgctcgcgcaaggaccgcggcatcaagtcggagatcgcggatgcgctgtgcgaagccggccgcttcggccaaaagaccggtaagggctactacaaatacgaacagggctcgcgcgccccgatgcccgatccggaagtcgagactctgatcaacgacacgctcgccaagctcggcctcaagcgccgcgacatcaccgacgaggagatcctcgagcggatggtgtacccgatgatcaacgagggcgcccgcatcctcgaagagaagatcgcggcgcgtccgagcgacatcgacgtggtctggctgtacggttacggctggccgatctatcgcggcggcccgatgcactacgccgacagcgtcggcctcaagcacatcgccgagcggctgtcggcctacgccaaggccaccaacgatccgtcgctggagccggcgccgctgctcgctcgtctcgctgccgaaggcaagaccttcgcgtcgctgacgcagccttccaaggccgcggcgtga

SEQ ID NO: 72252 - protein, 699 aa, Rhodopseudomonas palustris CGA009
MSEVVTRATQDQVAIVTVDSPPVNALSAAVRRGILENVNAAVADPAVQAIVLVCAGRTFIAGADITEFGKPPQPPALNDVIAALENSPKPTIAAIHGTALGGGLEVALGCHFRVAVKEAKLGLPEVKLGLLPGAGGTQRLPRAVGPELAVQMIVGGSPIGAAEALKHGLVEEVVENLVAGAVAFAKKVLAEKRPLRRLRDDDSKLAAAKADRSIFTNAVAAMTKKARGLEAPFACADAIGAAIDLPFEEGLKKEREGFMKLVVSDQSKAQRYAFFAEREAAKVDGVPDGTKPRPVSRVAIIGAGTMGGGIAMSFANAGIPVTLIETGEEQLKRGLGIMQKNWEATAARGGLPPDAPAKRMALITGLVGLENVKDADLIIEAVFETMAVKKEVFTAVDAHAKPGAVLASNTSYLSIDEIAATTKRPQDVLGMHFFSPANVMKLCEIVRGAKTAPDALLTAVSIAKKIAKVPVVVGVCDGFVGNRMLAARSKQSEKLLFEGALPQQVDAVVTKFGMPMGPFAMGDLAGLDIGWRSRKDRGIKSEIADALCEAGRFGQKTGKGYYKYEQGSRAPMPDPEVETLINDTLAKLGLKRRDITDEEILERMVYPMINEGARILEEKIAARPSDIDVVWLYGYGWPIYRGGPMHYADSVGLKHIAERLSAYAKATNDPSLEPAPLLARLAAEGKTFASLTQPSKAAA

SEQ ID NO: 72253 - DNA, 2148 bp, Mycobacterium avium subsp. paratuberculosis str. k10
  CDS (1)..(2148): transl_table=11
atggcagagaacaccatcaagtgggacaaggacgccgacggcattgtcacgctgacgctcgacgacccgaccgggtcggccaacgtgatgaacgagcactacaaggaatcgatgcacaacgccgtcgaacgccttgtggcagagaaggattcgatcaccggtgtggtgatcaccagcgccaaaaagacgttcttcgccggcggtgacctcaagagcatgatcaacctcggcccggagaacgccggtgaggcgttcgacaccgtcgaggccgtcaagcgcgacctgcgcgcgctggagacgctcggcaagccggtggtggccgccatcaacggcgcggcgctgggcggcgggctggagatcgcgctggcctgtcaccaccggatcgccgcggacatcaaggggctggtcgtcggcctgcccgaggtgaccctgggcctgctgcccggcggcggcggggtgacccgcaccgtgcggatgttcggcatccagaacgcgttcatgaacatcctgagccagggcacccggttcaagccggacaaggccaaggagatcggcctggtcgacgagctggtcggcagcgtcgaggaactggtgcccgccgccaaggcgtggatcaaggccaaccccgacgcccacgaacagccttgggacaaaaagggttacaagatgcctggcggcaccccgtccagccccgcgctggccggcatcctgccgtcgtttccggcgctgctcaagaagcagctcaagggcgccccgatgcccgcaccgcgtgccatcctggacgcggccgtcgagggcgctcaggtggacttcgacaccgccagccgcatcgagagccgctacttcacccagctggtcaccggccaggtcgccaagaacatgatccaggcgttcttcttcgacctccagcacatcaacggcggcggctcccgccccgagggcatcgagccggtcaagatcaacaagatcggtgtgctcggcgcgggcatgatgggcgccggcatcgcctacgtctcggccaaggccggcttcgacgtggtgctcaaggacgtcagcctcgaggccgcccagaagggcaagggctactcggaaaagcttgaggccaaagcacttcagcggggcaagaccaccgaggagaagagcaagtcgctgctggaccgcatcaccccgacggccgacgccgccgacttcaagggcgtcgacttcgtgatcgaggcggtgttcgagaaccaggaactcaagcacaaggtcttccaggagatcgaggacatcgtcgagcccaacgcgctgctcggctccaacacctcgacgctgccgatcaccggtctggccaccggcgtcaagcggcaggaggacttcatcgggatccacttcttctccccggtcgacaagatgccgctggtcgaaatcatcaagggcgagaagacttccgacgaggcgctggcccgcgtgttcgactacacgctggccagcggcaagaccccgatcgtggtcaacgacagccgcggcttcttcaccagccgcgtcatcggcaccttcgtcaacgaggcgctggccatgctcggtgagggcgtggcgccggccagcatcgagcacgccggctcgcaagccggctacccggcgccgccgctgcagctgtccgacgagctcaacctggagctgatgcacaagatcgccgtcgccacccgcaagggcatcgaggacgccggcggcacctacgagccgcaccctgccgaggcggtcgtcgagaagatgatcgaaatcggccggccgtcgcggttgaagggcgccggcttctacgagtacgtggacggcaagcgcacccgcttgtggcccggcctgcaggagacgttcaactccggcagcaccagtattccgttgcaggacatgatcgatcggatgctgttcgccgaggcgctggagacgcagaagtgcctggacgagggggtgctcacctccaccgccgacgcgaacatcggctcgatcatgggcatcggcttcccgccgtacaccggtggtagcgcgcagttcatcgtcggctacgagggtgcacacgggatcggcaaggaggccttcgtggcccgggccaaggagctggccgcccgctacggcgaccgcttcctgccgccggcgtcgctcaccagctag

SEQ ID NO: 72254 - protein, 715 aa, Mycobacterium avium subsp. paratuberculosis str. k10
MAENTIKWDKDADGIVTLTLDDPTGSANVMNEHYKESMHNAVERLVAEKDSITGVVITSAKKTFFAGGDLKSMINLGPENAGEAFDTVEAVKRDLRALETLGKPVVAAINGAALGGGLEIALACHHRIAADIKGLVVGLPEVTLGLLPGGGGVTRTVRMFGIQNAFMNILSQGTRFKPDKAKEIGLVDELVGSVEELVPAAKAWIKANPDAHEQPWDKKGYKMPGGTPSSPALAGILPSFPALLKKQLKGAPMPAPRAILDAAVEGAQVDFDTASRIESRYFTQLVTGQVAKNMIQAFFFDLQHINGGGSRPEGIEPVKINKIGVLGAGMMGAGIAYVSAKAGFDVVLKDVSLEAAQKGKGYSEKLEAKALQRGKTTEEKSKSLLDRITPTADAADFKGVDFVIEAVFENQELKHKVFQEIEDIVEPNALLGSNTSTLPITGLATGVKRQEDFIGIHFFSPVDKMPLVEIIKGEKTSDEALARVFDYTLASGKTPIVVNDSRGFFTSRVIGTFVNEALAMLGEGVAPASIEHAGSQAGYPAPPLQLSDELNLELMHKIAVATRKGIEDAGGTYEPHPAEAVVEKMIEIGRPSRLKGAGFYEYVDGKRTRLWPGLQETFNSGSTSIPLQDMIDRMLFAEALETQKCLDEGVLTSTADANIGSIMGIGFPPYTGGSAQFIVGYEGAHGIGKEAFVARAKELAARYGDRFLPPASLTS

SEQ ID NO: 72255 - DNA, 2154 bp, Bdellovibrio bacteriovorus HD100
  CDS (1)..(2154): transl_table=11
atgtctattcaggaaagtattaaaattgttcctcagggtgaggttgctgtagttgagtttgatctggtcggggagaaagttaataagttctctacgccggtgatgatgcgccttaaggaagttgttgaggagttgaagaagtcctcttacaaggctgttatttttaaatccaacaagcccaagatttttattgcgggtgcggatattgaagaaatcaagagcatgaccaaggcggaggaatttgaagctgctgtgaagggtggtcaggaagttatcagcatggttgaagacctgccgatgccgacgattgcggctgtgaatggcgcttgcatgggtgggggttgtgaattcatccttgcttgtgattaccgtattgcttctgaggattcttccacgaaaattggcctgccagagattcaactggggatcttgcctgggtttggtggctgtattcgtatgcctcgcgtgattggtttgcaggcggctttggatattatcctggctggtaagtctgtgaattccaaaaaggctcttaaaatcggtctggtggacaaagtcgttcacccgaacttgctggagtccttctctttgaaatgggcgaaagaaatcatcgctgatggcgctaaaaaacgccgtaaaacattcaagccacaaggcgcagtgaatgtgattttggaaagcgcattgggtcgcagcattgtctttaagaaagcccgtgagggtgttctgaaagcgaccaaaggtcattatccagcgccgcttcaggctttggaagtgattcagaaaacttatggcatgtctgatcgtgatgcggctttgcgcattgaacgtgagggcttctgtaagttgggtgtgacggatatttccaagaacctgatccacgtgttctatctaactgaaatggtgaaaaaacaaaacggtgtgccgggtgtggatgtgaaaccacgcgatgtgaaaggtctgggtgttttgggtgctggcaccatgggtggcggtatcgcctatgtggcggccgacaagggcattcaggttcgcatgaaggacttgaacacagatgcgctgggtaagggtttgaaacacgccagtgatctttggatgaaactggtgaaaagaaaatccatcgacaagtatcagttccagcaaaaaatggatctggtgtctgtttccacggattacgcaggtttcaaaaatctggatgtagttgttgaagccatcgttgaagacatgggcatcaaacaaaaagtgatcggcgagtgcgcgggtcaaatgcgtcctgatgcaattatcgcgactaacacaagctccctttctgtgactgaaatggccaaaggtcatccacgtccagaatatttcgcgggcatgcacttcttcaatccggtgaataaaatgcctcttatcgaggtcatccgtggtgaaaagacttccgatgaaaccattgcaactatctacgagctgtccaaaaaaatgggcaaaatgccggtggttgtgaaagacggcccgggtttcctggtgaaccgtttgcttcttccttacatgggtgaagcggcgttcttgcttcaggaaggcatgagcatcgaatttgtggataaagtttacgtgaaagaattcggcatgccgatgggtccatttgaattgatggacgaagtcggtttggatgtttgtttgaaggttcttaaaatcttcaaaaaagccttcggcgagcgtattgaacttgcgccttgtatggaagctctgggtaactccggtcgcctgggtcgtaagaacggcaaaggtttctatacttacagcgaagatggcaaacgtggtgccgtagaccaaacagtttacgcggcattgggcctgggtcagccaaccaatccgtatgattccaaagaatgcatcgagcgtggtgtctttgcgatgatcaatgagtgctctttggcgctggttgaagatcgtatcgtcgaaactccgcacgaagtggatctggcgatgatcatgggtacaggcttcccgccgttccgtgggggtctgatgaagtacacggacagcatcggcactcagtatgtggccgaccagctggcgatgtacgcttccagccgcaaggcagcccgcctgaaaccagcgactccgctgacgaacatggcgaaatcaaacagcaagttctataaataa

SEQ ID NO: 72256 - protein, 717 aa, Bdellovibrio bacteriovorus HD100
MSIQESIKIVPQGEVAVVEFDLVGEKVNKFSTPVMMRLKEVVEELKKSSYKAVIFKSNKPKIFIAGADIEEIKSMTKAEEFEAAVKGGQEVISMVEDLPMPTIAAVNGACMGGGCEFILACDYRIASEDSSTKIGLPEIQLGILPGFGGCIRMPRVIGLQAALDIILAGKSVNSKKALKIGLVDKVVHPNLLESFSLKWAKEIIADGAKKRRKTFKPQGAVNVILESALGRSIVFKKAREGVLKATKGHYPAPLQALEVIQKTYGMSDRDAALRIEREGFCKLGVTDISKNLIHVFYLTEMVKKQNGVPGVDVKPRDVKGLGVLGAGTMGGGIAYVAADKGIQVRMKDLNTDALGKGLKHASDLWMKLVKRKSIDKYQFQQKMDLVSVSTDYAGFKNLDVVVEAIVEDMGIKQKVIGECAGQMRPDAIIATNTSSLSVTEMAKGHPRPEYFAGMHFFNPVNKMPLIEVIRGEKTSDETIATIYELSKKMGKMPVVVKDGPGFLVNRLLLPYMGEAAFLLQEGMSIEFVDKVYVKEFGMPMGPFELMDEVGLDVCLKVLKIFKKAFGERIELAPCMEALGNSGRLGRKNGKGFYTYSEDGKRGAVDQTVYAALGLGQPTNPYDSKECIERGVFAMINECSLALVEDRIVETPHEVDLAMIMGTGFPPFRGGLMKYTDSIGTQYVADQLAMYASSRKAARLKPATPLTNMAKSNSKFYK

SEQ ID NO: 72257 - DNA, 2283 bp, Xenopus tropicalis
  CDS (1)..(2283)
atggcggctgcgcggctcgttggggttctggccaggctcggcggggctaacaggacaggttatacttgcaggcatctctccatgtcatcagcactactgacaagaacccacgtaaactatgagatcaaagatgatgttgctgttgttcgatttaacacccccaattccaaggtgaacacactgtccaagcagctgcagacagaattcagcgacgttatgaatgaaatctgggccaacgacgccgtccaaagtgccgtcctaatctcttccaaaccgggctgcttcatcgctggggctgatatcaacatgattgagtcctgtaagaccagccaggaagtcacgcagctgtcccaggaagggcagaaaatgtttgccaagctggagaagtcccccaaacccatagttgctgccatcaatggttcctgcctgggaggtggattagaggtggccattgcctgccagtacagagtggcaacgaaggacaagaagactgttctggggaccccagaggttttacttgggttgctgcccggggcaggaggaacacagaggctgcccagaatggtggggcttcccacagcgtttgacatgatgctgactggaagaaacatccgagccgacagggcaaagagaatgggattggtggatcagcttgttgatcctctcggaccaggcctgaaaagtccagaggatagaactatcgagtacctggaagaagtagctgtggactgtgcccgaggaatagccaagaagaagatctcattgaagaaagagaagggtctgatgcagaaggtcacagactatgtcatgtccgtgccgtttgtccggcaacaaatctacaaaacagtggagaaaaaagtgaataaacagacaaagggtctttaccctgcccccttgaagattattgaggtggtaaggactgggctggaccagggacaggaggctggctatctggccgaggcacagaaattcggggagctgggaacgaccccagagtccaaagcactaatcgggctgtaccacggacaggttatttgtaagaagaataagtttggcactccagaaagaccagtacagaaattggctatacttggggctggccttatgggagctggcattgctcaggtctctgtggataaagggttaaagaccattctgaaggacacgacagtggaaggcttaggaagagggcaacaacaagtctacaaagggcttaatgacaaggtgaagaagaagagtctgacttcgtttgagagagacagcattgtcagcaacctgacggggcagctggattataagggtttcgagacagccgacatggtgatcgaggccgtgtttgaggatatccgcattaaacacaaagttctacaggaggtggaagctgttgtccccccacactgtatatttgccagcaacacgtcggccctccccatctctcagatagcagccgccagcaaaaggccagaaaaagtgatcgggatgcactatttctcccctgtggataagatgcagctgctggaaataatcactactgacaaaacctctaaggacaccaccgctgccgctgtcgctgtcggcctcaagcagggcaaggtgatcattgtggtaaaggacgggccaggattctacactacccgctgccttggtcccatgatggctgaagttgtccgtgtcctgcaggaaggggtagatcccaagaaactggatgccctctctaccggctttggtttcccagtaggggcatctactctagctgacgaggtgggcatcgacgtggcggctcacgtggctgaggaccttggcaaagctttcggagagcgcttcgggggcgggaacattgagctcttgaaagctatggtggccaaaggattcttggggcgtaaatcaggaaaaggcttttacatttatcagcagggagtgaagaaccggtccattaactctggcactgaggagatactggagaagttcaagctacaggccaagcctgaagtctcctccaatgaagacatccagttgcgcttggtcactcgctttgtgaatgaggcagtgatgtgcctgcaggagggaatcctcgctaacccagtagagggagacattggggctgtgtttggccttgggttccccccatgtctgggcggcccattcaggtacgccgacgccttcggagcaaagcgcatagtggagaagatgcgcaagtacgagagtgtgtacggcagccagttcaccccgtgccagctgctgctcgaccacgccagcgaccccagcaagaagttccaccattaa

SEQ ID NO: 72258 - protein, 760 aa, Xenopus tropicalis
MAAARLVGVLARLGGANRTGYTCRHLSMSSALLTRTHVNYEIKDDVAVVRFNTPNSKVNTLSKQLQTEFSDVMNEIWANDAVQSAVLISSKPGCFIAGADINMIESCKTSQEVTQLSQEGQKMFAKLEKSPKPIVAAINGSCLGGGLEVAIACQYRVATKDKKTVLGTPEVLLGLLPGAGGTQRLPRMVGLPTAFDMMLTGRNIRADRAKRMGLVDQLVDPLGPGLKSPEDRTIEYLEEVAVDCARGIAKKKISLKKEKGLMQKVTDYVMSVPFVRQQIYKTVEKKVNKQTKGLYPAPLKIIEVVRTGLDQGQEAGYLAEAQKFGELGTTPESKALIGLYHGQVICKKNKFGTPERPVQKLAILGAGLMGAGIAQVSVDKGLKTILKDTTVEGLGRGQQQVYKGLNDKVKKKSLTSFERDSIVSNLTGQLDYKGFETADMVIEAVFEDIRIKHKVLQEVEAVVPPHCIFASNTSALPISQIAAASKRPEKVIGMHYFSPVDKMQLLEIITTDKTSKDTTAAAVAVGLKQGKVIIVVKDGPGFYTTRCLGPMMAEVVRVLQEGVDPKKLDALSTGFGFPVGASTLADEVGIDVAAHVAEDLGKAFGERFGGGNIELLKAMVAKGFLGRKSGKGFYIYQQGVKNRSINSGTEEILEKFKLQAKPEVSSNEDIQLRLVTRFVNEAVMCLQEGILANPVEGDIGAVFGLGFPPCLGGPFRYADAFGAKRIVEKMRKYESVYGSQFTPCQLLLDHASDPSKKFHH

SEQ ID NO: 72259 - DNA, 2157 bp, Danio rerio
  CDS (1)..(2157)
atggcccgatatgaacttgttaaacgatcagtagctctgatcactcttactaacccaccagtcaatgccttaagttctgcagtgcgtcatgccatctcgaagaccatggagcgagccctgagtgacccaaaggtcacggctgtggtgatctgtggagagaatgggcgattctgtggaggtgctgacatccgtgagtttgctggaccattgagaggacctccactggttcctttgttggatgccatagaggcaggagagaagcctgtggttgctgccatagaaggggttgctttaggtggaggctttgaattagccctagtctgtcattaccgcattgcacactacaaggcacgtcttggacttccagaggtgactttaggcattctgccagctgcggggggaacacagcgtctacccagactcattggaattcctgctgccttagaactgatcaccactggacgccacgtctcagcccaggaggctttgaagctgggcatggtggaccaggtcacagagcagaatacttgtgaggtggctctggagttcgctctgaaggctgtaggcaaaccactgtcttctcgaagactgagcatgctgaccacaccgtgtcctccaggtctggatggcatattcgaagcagccaccatgcaggtccaaaagaaggctcgaggtgtgatggcacctttggcttgtgttcaggcggtgcgggcagctacactgccttacagtgaggggataaaaagggaaggtgaactgatggccactctcttcagctcaggccaggctcaggctcttcagtacagcttctttgctcagaggacggctgagaagtggactttacccagtggagctcagtggaacaatagcaaacccagagagatccagagtgcggccgtcataggtctaggcactatgggaagggggatagttgtgtctttggcacgagtgggaatttctgtcatagctgtggagtcagaaaagaaactcttggagacgggcaggcagatggtgattggcatgctggagagagatgctaaaagacgaggagtgagtgcctccctcaatctcctcaagttctccctcagtctgcaggacctgaaggatgtggatctcgtcattgaagcggtctttgaagacatggcacttaagaagcagattttcagggaactctccagggtgtgtagaccagccactctgctttgctctaacacctctggtctggatgtggatgcgctggctgatgtgacggacagacctcagcttgttgctgggatgcacttcttttcgcctgctcacgtcatgaagctcctggaagtcgtatgcgggccgcgttcctcaaaggaagccatagctacagcgatgagccttgggaagaggatggggaaggtgagtgtggcagttggaaactgccctggttttgttggaaaccgcatgctgatgccttacctagagcaagccaccttcctgctggaagaaggggcaacgcctcaacaaatcgacaaggctctggaggactttggtttcgccatgggagtattcaggatgtctgatcttgcaggccttgacgttggttggagagtccggaaagaatcaggcttgaccgggcctgatgttgaccccaaagatcctccacgtagacgccaagggcgaaagtactgccccattccagacatggtctgccagcaaggccggtttggccagaagactggtcgtggatggtacatgtatgacaaaccaggggatacaaacgcaaagcctgacccactgatccagaaccttctggagacctacaggagcaggtatggaattcaaccacgcaaaatcacagatcaggagatcatcgagcgatgcctttttgccctggccaacgaaggctttagaattctgaaggataaaattgcaggccaacctgaagatatcgatgtcatctatctgttcggttatggctttccaaggcaccgaggaggacccatgttctacgccagcatggtgggcctggaaagagtgcttgagaggttggagtattaccaccatgcccttcctgatgtgcctcatttggagcccagtcctctgctgaaaaaacttgtggctcgcggaagtcctcctatccagaaatggagagagcatattaaaagcatgcacagtcatctctaa

SEQ ID NO: 72260 - protein, 718 aa, Danio rerio
MARYELVKRSVALITLTNPPVNALSSAVRHAISKTMERALSDPKVTAVVICGENGRFCGGADIREFAGPLRGPPLVPLLDAIEAGEKPVVAAIEGVALGGGFELALVCHYRIAHYKARLGLPEVTLGILPAAGGTQRLPRLIGIPAALELITTGRHVSAQEALKLGMVDQVTEQNTCEVALEFALKAVGKPLSSRRLSMLTTPCPPGLDGIFEAATMQVQKKARGVMAPLACVQAVRAATLPYSEGIKREGELMATLFSSGQAQALQYSFFAQRTAEKWTLPSGAQWNNSKPREIQSAAVIGLGTMGRGIVVSLARVGISVIAVESEKKLLETGRQMVIGMLERDAKRRGVSASLNLLKFSLSLQDLKDVDLVIEAVFEDMALKKQIFRELSRVCRPATLLCSNTSGLDVDALADVTDRPQLVAGMHFFSPAHVMKLLEVVCGPRSSKEAIATAMSLGKRMGKVSVAVGNCPGFVGNRMLMPYLEQATFLLEEGATPQQIDKALEDFGFAMGVFRMSDLAGLDVGWRVRKESGLTGPDVDPKDPPRRRQGRKYCPIPDMVCQQGRFGQKTGRGWYMYDKPGDTNAKPDPLIQNLLETYRSRYGIQPRKITDQEIIERCLFALANEGFRILKDKIAGQPEDIDVIYLFGYGFPRHRGGPMFYASMVGLERVLERLEYYHHALPDVPHLEPSPLLKKLVARGSPPIQKWREHIKSMHSHL

SEQ ID NO: 72261 - DNA, 2262 bp, Anopheles gambiae str. PEST
  CDS (1)..(2262)
atgcccggttttctcatccacccagcacttcaatcgcaaatggccatgcggtatctggccacggcagcgccggccggcaagcacatgaagacacgcatcgtggacaatgtgatggtgatcacgctggactcgcccggtgtcaaagtgaactcgctaaatgccgaggtacagtccgagttcgatgccgtcctgcgcgaggtggaaacaaacccggccgtcagctcggcggtgctgatctctggcaagccgggctgcttcgtggccggtgccgacattaccatgctcgagcagtgcaaaacggtcgaggcggcaacgaaggtgtcacacgagggccagattcagttcagcaagctggagaaatcccgcaaacctgtggtggccgccatcaacggcgtttgcttgggtggagggctagagttggcccttgcctgtcactaccgagtagcgcttaaggataagaaaacggtcgtaggattgcccgaagtgatgctgggtttgttgcccggagctggtggcactcagcgactgccaaaactgacctccatcccaaccgcattggacctcgcccttaccggcaagtcggtaaaggccgacaaggcaaagaagctgggaatcgtggacatgctggtgaacccgcttggtcccggactgaagccagccgatcaaaacacactcgagtacctggaacaagtggcgattcaagtcgcgaaggatcttgcctcggagaagctgaaggtaaaccgccaaaagactggcttggtggccaaggtgacggactttgcgttcggcatcgaatgggtcaagaacaaagtgttcgagaaggcacgcgaacaggtgatgaagatgtccggcggtctgtacccggctccgctcaagattctggacgtgatccgcgtcggtgtggacaagggccaggaagccgggtacgaggcggagcgtaaaggatttggcgaactgtcgcaaacgccccagtcgaagggtctgattggcctgttccgtggccaaaccgagtgcaaaaagaatcgcttcggcaagccggcgaacccaccgaaaacgattggcgtgctgggagcgggtctgatgggtgccggtatcgtgcaggtcagcatcgacaagggctatcaggtgataatgaaggacacgacggaggcgggactgggtcgcggtatcggccaggtccagaacggtctgcagggtgctatcaagcgcaagcgcatcagtgcgatcgaacgcgatcagatcctgtcgaaccttacctccacgctgagctacgaaccgttccgccagaccgatatcgtcattgaggccgtgttcgagaacatcgacattaagcaccgcgtcatcaaggagctggagcaggtggtgccgaagcactgcatcatcgccacgaacacgtccgctattccgatcactaagatcgctgccggcagttctcgaccggagaacgtcgttggcatgcactacttctcccccgttgacaagatgcaactgttggagattattacgcatccgggcacgtccaaggagacggcggctgctgccgtcgaggtgggcctgcgacagggcaaggtggtcatcaccgtgggtgacggacccggtttctacacgacccgcatcctctcgaccatgctgtcagaggcaatcagactgctgcaggagggtgtcgatccgaaggatctcgacaagatgaccaagacgttcggattcccggtcggtgcggccacgctcgcggacgaggtcggtatcgatgtgggagcgcacattgccgtcgatctggcgaaggcgttcggcgaccggttctccggtggcaatctgggcgttatggaggacctggttaaggccggcttcatgggacgcaagtcgggcaagggtgtgttcgtgtactcgggcggtcgcagcaagaaccgcgaggtgaaccaggacgctctcgccatcatgaagcagaagtacgccctgcagtcgcgcggtgctaacagcgtggaggacatgcagctgcgcatggtttcgcgctttgtgaacgaagccgtcctctgtctggaggagaaaatcctggacagccccctggagggtgatgttggtgccgtgttcggtctgggcttcccgccattcaccggtggaccgttccgctgggtggaccagtacggtgcggaacggctcgtcagcaagatgcgctcgtacgccgatctgtacggtgctccgttcgtgccggcccaaaccctgctcgacatggccaaggactcgagcaagaagttttacccgtag

SEQ ID NO: 72262 - protein, 753 aa, Anopheles gambiae str. PEST
MPGFLIHPALQSQMAMRYLATAAPAGKHMKTRIVDNVMVITLDSPGVKVNSLNAEVQSEFDAVLREVETNPAVSSAVLISGKPGCFVAGADITMLEQCKTVEAATKVSHEGQIQFSKLEKSRKPVVAAINGVCLGGGLELALACHYRVALKDKKTVVGLPEVMLGLLPGAGGTQRLPKLTSIPTALDLALTGKSVKADKAKKLGIVDMLVNPLGPGLKPADQNTLEYLEQVAIQVAKDLASEKLKVNRQKTGLVAKVTDFAFGIEWVKNKVFEKAREQVMKMSGGLYPAPLKILDVIRVGVDKGQEAGYEAERKGFGELSQTPQSKGLIGLFRGQTECKKNRFGKPANPPKTIGVLGAGLMGAGIVQVSIDKGYQVIMKDTTEAGLGRGIGQVQNGLQGAIKRKRISAIERDQILSNLTSTLSYEPFRQTDIVIEAVFENIDIKHRVIKELEQVVPKHCIIATNTSAIPITKIAAGSSRPENVVGMHYFSPVDKMQLLEIITHPGTSKETAAAAVEVGLRQGKVVITVGDGPGFYTTRILSTMLSEAIRLLQEGVDPKDLDKMTKTFGFPVGAATLADEVGIDVGAHIAVDLAKAFGDRFSGGNLGVMEDLVKAGFMGRKSGKGVFVYSGGRSKNREVNQDALAIMKQKYALQSRGANSVEDMQLRMVSRFVNEAVLCLEEKILDSPLEGDVGAVFGLGFPPFTGGPFRWVDQYGAERLVSKMRSYADLYGAPFVPAQTLLDMAKDSSKKFYP

SEQ ID NO: 72263 - DNA, 2412 bp, Trypanosoma brucei
  CDS (1)..(2412)
atgcgtcgcttggaaaccatatcaagccacgttggtttccgtcgcttttgccatctgcagcgccgtggtgatgcggtggttctcatattgcaccatgagctgctgaacgcgctaacggtagacatgcgggccgcgcttctacactttttcaacgaggccgataatgatagctctgtgaagtgtattataatcgccggtgagggtggagcattttcttgtggtatcgatattaatgattttgctgcctccttggttgacaccaccaaagaaaacggggtaaggatccccagcttgccgtcacttactaccagaatagaacaaagtgacaaggtagttattgcggcaacaagcgggatcacatattcaggcggcttggagttggcactcgcagcccactatagggttgcttcccccacttccgtgttttgtatgccggaggttaagttgggtattgtgccgtgtggtggagcgacgcagcgactgccgcggctgattggtgtgcgtgcagctctcgacattatcagcactggaaggaaggtgagtgcaaaggaggcattgcgtctaggtcttattgatcatctcacgtcatcaccccatgaagagaggcgagatcaagatgtgaatggagtaagtgcacaggggccgttctgttgtaccgatccgaatggaaatttggaaagtgccatcgaggcagccctgcggttgtccgcgcggtggaccaaaccgcgacgcatttcttgtgatgcgacgaagctgggcattatgctctacaattctattttattccggcgcgtgggaagtgagataacgaagaaggcccccaaagaggttagcgccccgctacagtgcctgcaggcaatccgggcggccaccaactctgcatcctttaaggaaggtcttgcagaggagacgagaatatttaagcaaacactacattcacctgaggcacatgcaatgcagcatttactccgctcatcctacactgtgcttagtgacacactcccaacactgccagtgagagctggaacgggactacagcagcagcggctccgcaagttggctgttgtcgggtgcggtgttgttggcattggcatcgtcattatggcactgcgtgctggttcgcaggtggtactcttgggtgaagacgacaatgagtgcgaatatgcgcttcatgtcataaagtcagaactgccgaacgatgccttgggttacaatattagcgcggattgtgtaaatatgtaccttaataatttgaaagttttgccgtatcatggcgaccttcagacagtgcttcaagatgtagatgtcatggcggagtgtattgttggtgatttggacactaaacggcaggtgttcaccatgttgactgatttgtgtcccccccattgtgtgttggcaacttgttgttcctcgctcgaactcagggagttcgtgaaggtttcacgaaggccagaaaaggttgttggaatgtactttgctccccctgtgcataatgtaccgttccttgaagttacacgggggtaccgaacagatcacacaacactacagcgggccattcatgttggaagattatttcacaaagcgacgatccttaccagggacgttggcttcagtattatttctcgaatattctttgcgattctttatcaggcgctctccatgttagagcaaggtgcatttcctgttgatatcgaccgcgcgatgaggcatttcggtttccggttaggcatatttgcgatggaggatcttgcaggacttcaagtagtgtcccagatacttaactctcttagggttcgagagggatgtagcggtgttcgctctccctgtccacccactgatgttttcaccattcaccgccggttggtggagatgggccattttggacaaaagacagggcggggttggtacacatatgaggaaggggatttgttttcgtctttggctgcatggcgacagcggttgattggctcagcatcaaatagcacgaagaacacgtatggggtttggtccaaaggaggagcctcgcttatgcgtcggccttatcaggatcgtgatgttgagttattgattctcgatgtgtgtcgtgagaaaaagataatgcgccgtgatataagtcggaaagagatgattgaacgcattctctttgccgctgtgaatgaggcagccatgcttttgcgtgaggaggcggttagtagttcatctgccattgatatcgcgacaacttttggacacggtttccctgcttggaggggtggactgtgttattacgcggacaaattcggtcttccgaatgttgtgcatcgcatgcgaatttacaacaaaacctttggtgatgccttgtttccactcccttgcgaggaactgcgtcaaatggcgtcatctcaacagacatttcgttccacgtggccgtaa

SEQ ID NO: 72264 - protein, 803 aa, Trypanosoma brucei
MRRLETISSHVGFRRFCHLQRRGDAVVLILHHELLNALTVDMRAALLHFFNEADNDSSVKCIIIAGEGGAFSCGIDINDFAASLVDTTKENGVRIPSLPSLTTRIEQSDKVVIAATSGITYSGGLELALAAHYRVASPTSVFCMPEVKLGIVPCGGATQRLPRLIGVRAALDIISTGRKVSAKEALRLGLIDHLTSSPHEERRDQDVNGVSAQGPFCCTDPNGNLESAIEAALRLSARWTKPRRISCDATKLGIMLYNSILFRRVGSEITKKAPKEVSAPLQCLQAIRAATNSASFKEGLAEETRIFKQTLHSPEAHAMQHLLRSSYTVLSDTLPTLPVRAGTGLQQQRLRKLAVVGCGVVGIGIVIMALRAGSQVVLLGEDDNECEYALHVIKSELPNDALGYNISADCVNMYLNNLKVLPYHGDLQTVLQDVDVMAECIVGDLDTKRQVFTMLTDLCPPHCVLATCCSSLELREFVKVSRRPEKVVGMYFAPPVHNVPFLEVTRGYRTDHTTLQRAIHVGRLFHKATILTRDVGFSIISRIFFAILYQALSMLEQGAFPVDIDRAMRHFGFRLGIFAMEDLAGLQVVSQILNSLRVREGCSGVRSPCPPTDVFTIHRRLVEMGHFGQKTGRGWYTYEEGDLFSSLAAWRQRLIGSASNSTKNTYGVWSKGGASLMRRPYQDRDVELLILDVCREKKIMRRDISRKEMIERILFAAVNEAAMLLREEAVSSSSAIDIATTFGHGFPAWRGGLCYYADKFGLPNVVHRMRIYNKTFGDALFPLPCEELRQMASSQQTFRSTWP

SEQ ID NO: 72265 - DNA, 2682 bp, Gallus gallus
  CDS (1)..(2682)
atgggttccaacccactttctccccacgtttcccttcctttgcgctacgctgcgggcacgttgctcacaccacctccatctccaccgagcgggaccacggagcaggggctgaccccatcggccgtcacaccagaaaaccacaacaactacggcaggcatttgttaataccgacgatggcagcgcggcaccggagcgtgcggagatgttccgacctgccgacggcctccgaagcgttccatccagacgggattacgacacagcgcagcctcagcaataatccgcttcggggctgcctgcagacaccagctgctgtcaagacattttcagagctcctgccctcctcagtggagcagttttaccacaacacgagcttgtacaatgcagcttccatgtttctcagaatgcccccgcggggtgccgccccgttccgccccgccggggcaggccgcgctgagggccgggatccgggcagaggcgcggggacggcggcagcgttcggcatggcgcagtacgcgaggggcgccgcggccgtggccgtcatccggctccgcaacccgccggtcaacgcgctgagtttgacagttctccaggcattagaggatggactgaaaagagcagacgcggatccttcagtgaaagctgtcacaatttgtggcgaaaatgggaagttcagtgcaggcgctgacattcgaggattttcttctccaaagaaacagggtcttggcttgggccccatagtttctctcatagaaaggagcgagaagcctgttgtggctgccattgaaggcattgccttgggaggaggcctggaggtggcacttggctgtcactatcgtatcgcacatgtgcaggcacggatgggcttacctgaagtcacaattgggttactcccaggtgctgaaggcactcagcggctccccagactggttggggttcctgctgctctggatataattactacaggaagacacattcctgcaactgaagcactgaagctgggcttggttgatgaagttgtggaagagaacacagttgaagcagcaatccgtttggcaaacaaattgattggccagcccttgggacaccgcaggctcagcctgaagccagtccccagattgcccaacatggaagcatttctcagtgaggctctcgtgaaggtgaagaaacgggcccaagggtgcctggcaccagagctgtgcttccaagcaatcaaagctgccacagagcagccatttgcagatggagtccggaaggagagagagctgtttaacatcctgctgacttcaggccaggccaaagcactgcagtatgctttctttgcagagagagcagtggagaagtggacaacacccagtggagcttcgtggaaaagtgcttcccctcagcccatccgcaaagcagctgtgatagggctgggaacaatgggccgaggcattgtgacttctctggttaaggccaagatacctgtggtggccctggagcagaatctggagtatctgaacacaggaagaaaagccgtgatgctccttttggaacgtgaggctatgaaaatggagcagggtgcccaaaccctggatttccataaccctgcacaactccagttcactgtggactttgatgtgttgcgggatgtagatctagttattgaagctgtcttcgagaacatggcactaaagaaggaaatattcagcaagctatcaagaatctgcaagccggaggcctttctgtgtacaaacacatcagccctgaatattgatgatatagcttctgtcaccggccgcccacagcaggtcattggcacacacttcttctcccctgctcatgtgatgaggctattagaaataatctatggccgtcacacgtcccccaacaccattgccacggccattcagctagctaaagtgatgaagaaagttggagtggtggtagggaactgtttcgggtttgttgggaaccgaatgatgtttccgtacgtacaacaggcagttttcctcttagaggaaggaagcagaccagaagacgtagatcaggttcttgaagattttgggtttaagatagggcccttccgaatgtctgatcttgctgggctggatgtgggctggaggtctcgaaaggaccagggccttactgggccctcactggctccaggaacacccgtccgccagcggcatggctatcgctacagcccgctgcctgaccttctgtgtgagaaaggcaggtttggccagaagacaggaaaaggctggtatcagtacgagaaggctgggggtaggacagccaaaccagacccatggattcacagctttctgcgtgagtacagggacacccatcaaatcaagacccgctttatagaccaggaggaaatcctggagcgttgcttgtttactcttattaatgaaggatttgacatcctggctgagggaatagcatcaggcccagaacaccttgatgtagtttatatcaatggttatggatggccaaagcacaggggtggccccatgttctatgcttccattgtggggctccctaacattctgactaagctgcagaaatactctgagatccaccctgatgttccccagctacgtcccagtgccttcctgaaaaagttggtggctgtggggaaccctcctctcaatgactggatgtcctacctacacaggcagagcaacaagctgtga

SEQ ID NO: 72266 - protein, 893 aa, Gallus gallus
MGSNPLSPHVSLPLRYAAGTLLTPPPSPPSGTTEQGLTPSAVTPENHNNYGRHLLIPTMAARHRSVRRCSDLPTASEAFHPDGITTQRSLSNNPLRGCLQTPAAVKTFSELLPSSVEQFYHNTSLYNAASMFLRMPPRGAAPFRPAGAGRAEGRDPGRGAGTAAAFGMAQYARGAAAVAVIRLRNPPVNALSLTVLQALEDGLKRADADPSVKAVTICGENGKFSAGADIRGFSSPKKQGLGLGPIVSLIERSEKPVVAAIEGIALGGGLEVALGCHYRIAHVQARMGLPEVTIGLLPGAEGTQRLPRLVGVPAALDIITTGRHIPATEALKLGLVDEVVEENTVEAAIRLANKLIGQPLGHRRLSLKPVPRLPNMEAFLSEALVKVKKRAQGCLAPELCFQAIKAATEQPFADGVRKERELFNILLTSGQAKALQYAFFAERAVEKWTTPSGASWKSASPQPIRKAAVIGLGTMGRGIVTSLVKAKIPVVALEQNLEYLNTGRKAVMLLLEREAMKMEQGAQTLDFHNPAQLQFTVDFDVLRDVDLVIEAVFENMALKKEIFSKLSRICKPEAFLCTNTSALNIDDIASVTGRPQQVIGTHFFSPAHVMRLLEIIYGRHTSPNTIATAIQLAKVMKKVGVVVGNCFGFVGNRMMFPYVQQAVFLLEEGSRPEDVDQVLEDFGFKIGPFRMSDLAGLDVGWRSRKDQGLTGPSLAPGTPVRQRHGYRYSPLPDLLCEKGRFGQKTGKGWYQYEKAGGRTAKPDPWIHSFLREYRDTHQIKTRFIDQEEILERCLFTLINEGFDILAEGIASGPEHLDVVYINGYGWPKHRGGPMFYASIVGLPNILTKLQKYSEIHPDVPQLRPSAFLKKLVAVGNPPLNDWMSYLHRQSNKL

SEQ ID NO: 72267 - DNA, 2181 bp, Oryza sativa (japonica cultivar-group)
  CDS (1)..(2181)
atggcgggggcgatccgcgtcaccatggaggtgggcgccgacggcgtcgcggtcgtcaccatctgcaacccgcccgtcaatgcgctgcatcccatcatcatccagggattgaaggagaagtacgcggaggcgatggatcgcgacgacgtcaaggccatcgtgctcaccggtgctggaggcaaattttgtggaggctttgatatcaatgtgttcacagaagttcacaagactggaaatgtatctcttatgcctgatgtatctgttgagcttgtgtcgaatttgatggaagcgggcaaaaagccttcagttgctgccattcaaggccttgctcttggtggcggtttggagttgaccatgggttgccatgctcggatatctacccctgaagctcaacttggactaccagagttgactctgggcataattcctggatttggaggaacccagcgtctgccaaggcttgtaggtctgcccaaagcaatagaaatgatgctgcaatcaaagttcatcacagcaaaggaagggaaagaaggtggtcttgttgatgccctgtgctcccctgatgagttgataaagatgtcacgcctttgggctctggagatagctaattaccgtaaaccttggataagatctcttgccagaacagataggcttggttcactgtctgaagctcgttctgtattaaatagtgcaagacagcaagcgaagaaggttgcagcaaacttgccacagcaccaggcctgcctagatgttatggaagaaggtgtactatgtggaggccatgctggtgttctgaaggaggccaaggttttcaaggagttggtgctatcaccaacatcaaaggcacttgtacatgctttctttgcccagcgtttaaccacaaaggtgccaggtgttactgatgttcaattgaaacctaggaaaataagaaaagttgctgttattggtggtggtttgatgggctctggaattgcaacagctcttcttgttagcaatacatccgttgtgcttaaggaagtaaatcctcaattcctgcaaaggggacagaagatgatagcagctaatcttgagggtctagtcaagaggggctcattgacaaaggacaagatgaacaaggccatgtcacttctcaagggtgcattggattattctgatttcaaggatgttgatatggtcatcgaggctgtcatagagaagattcctttgaaacaatcaatattttctgaccttgagaaagtatgcccaccccactgcatacttgcaacaaacacatctaccatcgatttgaatgttgtgggcgagaagacaaattctcaagatagaattataggggcacatttctttagccctgcccatattatgcctttgcttgaaattgtccggacggagaagacatcaccgcaagctattcttgatctcatcacagttgggaaaatgataaagaaagtccctgttgtggttgggaactgcacaggcttcgcagtcaatcgtacatttttcccttacacacagggttctcatcttctagttagtattgggatcgacgttttcagaattgatcgagtaataagcagctttggcatgccaatgggaccttttcaactgcaagatctggctggatatggagtggcattggcagtaaaggatatctatgcggctgcctttggaacaaggaatctggactctaatctggtggatttgatggtacagaatggacggcagggaaagagcaatggtaaaggttattacctttatgagaagggtgggaagccgaagcctgacccaagtgttcaggttgtgattgacgagtacagaagatgtgcaaagacaatgcctggtggaaagcctgttactttatctgatcaagatatattggagatgattttcttcccagttgttaatgaggcatgcagggtcatggatgaaaatgttgtgatccgagcttctgatcttgatattgcttctatccttgggatgggttttcccaagttcaggggtggtcttgtcttttgggctgacactattggagcaccttatatacattcaaagcttagcaagtggactgaaatttatggcgatttcttcaaaccatcatcctatttggaagatagagctaaaagaagcctaccattgagcgcaccaaacgcaacccagcaggcttcgtcgaggtcacgcatgtga

SEQ ID NO: 72268 - protein, 726 aa, Oryza sativa (japonica cultivar-group)
MAGAIRVTMEVGADGVAVVTICNPPVNALHPIIIQGLKEKYAEAMDRDDVKAIVLTGAGGKFCGGFDINVFTEVHKTGNVSLMPDVSVELVSNLMEAGKKPSVAAIQGLALGGGLELTMGCHARISTPEAQLGLPELTLGIIPGFGGTQRLPRLVGLPKAIEMMLQSKFITAKEGKEGGLVDALCSPDELIKMSRLWALEIANYRKPWIRSLARTDRLGSLSEARSVLNSARQQAKKVAANLPQHQACLDVMEEGVLCGGHAGVLKEAKVFKELVLSPTSKALVHAFFAQRLTTKVPGVTDVQLKPRKIRKVAVIGGGLMGSGIATALLVSNTSVVLKEVNPQFLQRGQKMIAANLEGLVKRGSLTKDKMNKAMSLLKGALDYSDFKDVDMVIEAVIEKIPLKQSIFSDLEKVCPPHCILATNTSTIDLNVVGEKTNSQDRIIGAHFFSPAHIMPLLEIVRTEKTSPQAILDLITVGKMIKKVPVVVGNCTGFAVNRTFFPYTQGSHLLVSIGIDVFRIDRVISSFGMPMGPFQLQDLAGYGVALAVKDIYAAAFGTRNLDSNLVDLMVQNGRQGKSNGKGYYLYEKGGKPKPDPSVQVVIDEYRRCAKTMPGGKPVTLSDQDILEMIFFPVVNEACRVMDENVVIRASDLDIASILGMGFPKFRGGLVFWADTIGAPYIHSKLSKWTEIYGDFFKPSSYLEDRAKRSLPLSAPNATQQASSRSRM

SEQ ID NO: 72269 - DNA, 2175 bp, Oryza sativa (japonica cultivar-group)
  CDS (1)..(2175)
atggcgagaggctccacctccgtggaggtccgccgcgacggcgtcgccgtcatcaccgtctccaacccccccgtgaacgcgctctccctcgacgtgatagccagcttgcagagagattatggggaagctctgaggaggagtgatgtcaaggcaattgttctcactggcgccaaagggaggttttctggaggctttgatataaacgcattcgacaagaagccaagtaaagattgtccagtgctctcatttgtcaacaagctgaatatttatgtcgttaagttcatgttgctgccagatgctccgaaaccatcagtggctgctatagatggcgttgctctaggtggcggcttagagcttgtaatggtttgtcacgctcgtgtttctacatcttcggctcaattaggattacctgaacttcaactgggcatcattcctgggttgggaggaacacaacgactgccccgccttgttggcctgccaaaagctcttgagatgttgttgatgtctaaacctctaaaaggagtggaggcacataaatttggtttagttgacgctgtagtttcagctgatgaattgatcagcacggcctgttcctgggctctggaaattgttgaagacaaacgcccatggttcaggagtctccatagaaccgatagacttccagctcttgaggaaacgaagaaaattctgaattttgcaagagttcaggcccaaaagcagtctgctagtctccaacatcccttagtttgcattgatgtcattgaggagggcataatttctggccctcgagctggcctaatgaaggaaacactttgtggaaaaatgcttgagatgtctcagataagcaaaagcttaaggcatgtcttttttgcacaacgtgcaacttcaaagattccaaatatcagcatattggggttgacaccacggagaatacacaaggtggctattgttgggggaggtctaatgggatctggaatagcaactgcattgatatcgaacaacctcctggtaatcctgaaagaagtcaatgagcagttcttagatgctggtattagcagagttaaagctaatctgcagagcttagtcaaaagggggcaaatgaccaaagaagattatgaaaataaactttctttactatctggtgttcttgactatgaacaatttagagaagctgatgtggtcattgaggcagttattgaggatttatcactaaagcagaaaatatttgctgaccttgaaaaatactgccactctaattgcatacttgccacgaatacttcaacaatagaccttcatttaattggccaaaagacatcttgccaggatcgaattgctggtgcacacttcttcagtccagcccatgcaatgccactgttggaaataatccgtactcatcggacttcctcacaagttgtcattgacttgctaaacgtggcaaaacagatacgaaaaacaccaatagttgttgggaactgcacaggttttgctgtgaatcggatgttctttcctttcacacaggtggcttattttcttgttgattatggtctggatgtctaccacatagaccatgtgattacaaagtttggaatgccaatgggacctttccgattagctgatcttgttggttttggagttgctattgcctccagaaagcaatatctccaaagttatcctgagcgatgttacaagtcaatgcttattcaaattatgcttgaggaaaacaggacaggtgaatcttcacgcaaaggattttatctttatgatgataagcgaaaggcttctccagatcctgaaatgaacaagtacattgagaaatcaagaagcatggctagtattgtacaagatcctaagctgccgaaattaacagatgatgaaatcgtggagatgatgctcttccccgtggtgaatgaggcctgtcgactgcttgacgagggggttgctatgaaagcatctgatcttgatgtagcatccattatggggaggggcttcccttcctacaggggcggagtgatgttctgggccgattcgtttggcgcgaaatacatttacgacagactgaaggattggtccaagtatcacggagggatctttgaaccctatgaatatttatcaacaagagctcgtcagggtttgtctctggccgccatggctgatggtgcaatgtcacggctctag

SEQ ID NO: 72270 - protein, 724 aa, Oryza sativa (japonica cultivar-group)
MARGSTSVEVRRDGVAVITVSNPPVNALSLDVIASLQRDYGEALRRSDVKAIVLTGAKGRFSGGFDINAFDKKPSKDCPVLSFVNKLNIYVVKFMLLPDAPKPSVAAIDGVALGGGLELVMVCHARVSTSSAQLGLPELQLGIIPGLGGTQRLPRLVGLPKALEMLLMSKPLKGVEAHKFGLVDAVVSADELISTACSWALEIVEDKRPWFRSLHRTDRLPALEETKKILNFARVQAQKQSASLQHPLVCIDVIEEGIISGPRAGLMKETLCGKMLEMSQISKSLRHVFFAQRATSKIPNISILGLTPRRIHKVAIVGGGLMGSGIATALISNNLLVILKEVNEQFLDAGISRVKANLQSLVKRGQMTKEDYENKLSLLSGVLDYEQFREADVVIEAVIEDLSLKQKIFADLEKYCHSNCILATNTSTIDLHLIGQKTSCQDRIAGAHFFSPAHAMPLLEIIRTHRTSSQVVIDLLNVAKQIRKTPIVVGNCTGFAVNRMFFPFTQVAYFLVDYGLDVYHIDHVITKFGMPMGPFRLADLVGFGVAIASRKQYLQSYPERCYKSMLIQIMLEENRTGESSRKGFYLYDDKRKASPDPEMNKYIEKSRSMASIVQDPKLPKLTDDEIVEMMLFPVVNEACRLLDEGVAMKASDLDVASIMGRGFPSYRGGVMFWADSFGAKYIYDRLKDWSKYHGGIFEPYEYLSTRARQGLSLAAMADGAMSRL

SEQ ID NO: 72271 - DNA, 2346 bp, Pan troglodytes
  CDS (1)..(2346)
atggccgagtatacgcggctgcacaacgccttggcgctgatccgcctccgaaacccgccggtcaacgcgatcagtacgactttactccgtgacataaaagaaggactacagaaagctgtaatagaccatacaataaaagccattgtgatttgtggagcagagggcaaattttctgcagaaaaagaaaaaaaaccaaaaaagatatttgatattgatgaagctgaagaaggtgtaaaggatcgtaagattgaaagtgatgttcaagaaccagctgaaccagaggatgaccttgacattatgcttggcaataaaaagaagaaaaagaagaatgtcaagttcccagatgaggatgaactactagagaaagatgaagctctagaagatgaagatagcaaaaaagatgatggtgctgatattcgtggcttcagtgctcctaggacatttggccttacactgggacatgtagtagatgaaatacagagaaatgagaagcccgtggtggcagcaatccaaggcatggctttcggagggggactagagctggccctgggctgtcactataggattgcccacgcagaggctcaagttggcttaccagaagttacactgggacttctccctggtgcaagaggaacccagcttctccccagactcactggagttcctgcttcacttgacttaattacctcaggaagacgtattttagcagatgaagcactcaagctgggcattctagataaagttgtaaactcagacccggttgaagaagcaatcagatttgctcagagagtttcagatcaacctctagaatcccgtagactctgcaacaagccaattcagagcttgcccaacatggacagcatttttagtgaggccctcttgaagatgcggaggcagcaccctgggtgtcttgcacaggaggcttgtgtccgtgcagtccaggctgctgtgcagtatccctatgaagtgggcatcaagaaggaggaggagctgtttctatatcttttgcaatcagggcaggctagagccctgcaatatgctttcttcgctgaaaggaaagcaaataagtggtcaactccctccggagcatcgtggaaaacagcatcagcgcggcctgtctcctcagttggtgttgttggcttgggaacaatgggccgaggcattgtcatttcttttgcaagggccaggattcctgtgattgctgtagactcggacaaaaaccagctagcaactgcaaacaagatgataacctctgtcttggaaaaagaagcctccaaaatgcaacagagcggccacccttggtcaggacctgaagcagtatttgaggaaatgagcctgaagaagcaggtctttgctgaactctcagctgtgtgcaaaccagaagcatttttgtgcactaatacttcagccctggatgttgatgagattgcttcttccactgatcgtcctcacttggtcattggcacccacttcttttcgccagctcatgtcatgaagttgttagaggttattcccagccaatactcttcccccactaccattgccactgttatgaacttatcaaaaaagattaaaaagattggagtcgttgtaggcaactgttttggatttgtggggaatcgaatgttgaatccttattacaatcaggcatatttcttgttagaagaaggcagcaaaccagaggaggtagatcaggtgctggaagagtttggttttaaaatggggccttttagagtgtctgatcttgctgggttggatgtgggctggaaatctagaaaggggcaaggtcttactggacctacattgcctccaggaactcctgcccgaaaaaggggtaataggaggtactgcccaattcctgatgtgctctgtgaattaggacgatttggccagaagacaggtaagggttggtatcaatatgacaagccattgggtaggattcacaaacctgatccctggctttccaaattcctatcacagtatagagaaacccatcacattgaaccacgtaccattagccaggatgagatcctcgagcgctgcttatattcacttatcaatgaagcattccgtatcttgggagaagggatagctgctagcccagagcacattgatgttgtctatttacatggatatggatggccaaggcacaagggcgggcccatgttctatgcttccacagttgggttgcccacagttctagagaaattgcagaaatattacaggcagaaccctgatattccccaactggagccaagtgactatctaaaaaaactggcttctcagggaaaccctcccctgaaagaatggcaaagcttggcaggctcccctagcagtaaattgtga

SEQ ID NO: 72272 - protein, 781 aa, Pan troglodytes
MAEYTRLHNALALIRLRNPPVNAISTTLLRDIKEGLQKAVIDHTIKAIVICGAEGKFSAEKEKKPKKIFDIDEAEEGVKDRKIESDVQEPAEPEDDLDIMLGNKKKKKKNVKFPDEDELLEKDEALEDEDSKKDDGADIRGFSAPRTFGLTLGHVVDEIQRNEKPVVAAIQGMAFGGGLELALGCHYRIAHAEAQVGLPEVTLGLLPGARGTQLLPRLTGVPASLDLITSGRRILADEALKLGILDKVVNSDPVEEAIRFAQRVSDQPLESRRLCNKPIQSLPNMDSIFSEALLKMRRQHPGCLAQEACVRAVQAAVQYPYEVGIKKEEELFLYLLQSGQARALQYAFFAERKANKWSTPSGASWKTASARPVSSVGVVGLGTMGRGIVISFARARIPVIAVDSDKNQLATANKMITSVLEKEASKMQQSGHPWSGPEAVFEEMSLKKQVFAELSAVCKPEAFLCTNTSALDVDEIASSTDRPHLVIGTHFFSPAHVMKLLEVIPSQYSSPTTIATVMNLSKKIKKIGVVVGNCFGFVGNRMLNPYYNQAYFLLEEGSKPEEVDQVLEEFGFKMGPFRVSDLAGLDVGWKSRKGQGLTGPTLPPGTPARKRGNRRYCPIPDVLCELGRFGQKTGKGWYQYDKPLGRIHKPDPWLSKFLSQYRETHHIEPRTISQDEILERCLYSLINEAFRILGEGIAASPEHIDVVYLHGYGWPRHKGGPMFYASTVGLPTVLEKLQKYYRQNPDIPQLEPSDYLKKLASQGNPPLKEWQSLAGSPSSKL

SEQ ID NO: 72273 - DNA, 1935 bp, Picrophilus torridus DSM 9790
  CDS (1)..(1935): transl_table=11
atgatcatgataaagaacataacagttattggtgccggcctcatgggccatggcataggcgaggtttttgcgctgaatggatacaacgttaatttatatgattcatttccggcggcaattgaaaatgcaaaaaaatccatagataacagcctttcaaggcttttaaactccggaaagatcaaaaaggaggatttaaacgagataaaatccagaataaaattccatggaaatcttgacgaggcattaatggactctgatctcgtaatagaggccgttcctgaaaggcttgatataaaaacatcggtgctatcagaggtatcaaagaaaacagattcaatcatagcaacgaacacatcaagtataagaatatcagagatagcggagcatatagacaaacccgagagattccttggcatgcacttctttaatccgccggttgtacttaaactcgtcgaagttataaggggagaaaaaacggcagaaagcgtattcaatgaggtttataaccttgcaaagtccattaaaaagataccaataaaggtcatgaaggataccccggggtttgttgtaaacaggatatccggaccggagacgctgctcttctgctttatataccagagcggccttgcaaaacctgaggaggtcgattcatatataaaggcccagggcatgcccatgggcccatatgagttgtttgattacgttggcctggacgtaataaaggatctctttgattactatggaaatgaattatctcaggattataagaaatgcactgttatatcagatcttgtaaactcagggaaaaagggcatgaagacaggccagggattttacaaatgggagaacggaaaggccttaattccaaagactaatccaagtgataaaataaatctaatggatatctttgcgcttgagataaatgaggcggttaagctcatagaggatggcgttgcaacacctgaggatattgaaaccggtgtaaagtacgggcttaacaggccattcgggccgataagcgtggcagagggcctttcaaacagggaggtaaaggatacactgctaaagctctatgaaatgtccaaatttgaaacgtttaaacctgcaaaatcaatagattccggcaatttaaaggccataatacataaaaagatctctgttccggaggttcaggaaaagaagaataaatatattattgaggaaaaaaacaacagggttttaaaattattacttaacaacggtaaaaacaatttaattacgaaggaacttgtcgatgagcttaatgatgagatagacatgatatcaaagaacgatgatataaatgtcgttgttataacaggaagggataccttttctgcaggtgccgatctatcacagttcttcagaaattcagcagattttatgaaaaatgccgagcgtgttgagagggtctttgacaggatacgaaaaacaggtaaaatatttattgcggcaataaagggatatgcccttggcggtggccttgagcttgcactggcctgtgacataagaatggcaaccaggtcttcaattcttggatttccggaaacatctcttggacttatacccggctacggcggtagccagcgtctttacaaattaataggcatgtccagggccgtttcaatgatacttacggcggagaggataacgggtgaaagggctcttgactatggcatagttaataaattatttgaaaatgatgatgaggtcatgacatatgccgttgaactttctgaaaggatcgcccctgtgtctgttaatctggcaaagaaattaatatactcagagatgaattttgattccggccttgattttgaggctgctgccgtgggtgttttgtactcaacagacgaccttagagagggtatctccgcatttctgtcaaaaagaaagcctgactataagggtcattaa

SEQ ID NO: 72274 - protein, 644 aa, Picrophilus torridus DSM 9790
MIMIKNITVIGAGLMGHGIGEVFALNGYNVNLYDSFPAAIENAKKSIDNSLSRLLNSGKIKKEDLNEIKSRIKFHGNLDEALMDSDLVIEAVPERLDIKTSVLSEVSKKTDSIIATNTSSIRISEIAEHIDKPERFLGMHFFNPPVVLKLVEVIRGEKTAESVFNEVYNLAKSIKKIPIKVMKDTPGFVVNRISGPETLLFCFIYQSGLAKPEEVDSYIKAQGMPMGPYELFDYVGLDVIKDLFDYYGNELSQDYKKCTVISDLVNSGKKGMKTGQGFYKWENGKALIPKTNPSDKINLMDIFALEINEAVKLIEDGVATPEDIETGVKYGLNRPFGPISVAEGLSNREVKDTLLKLYEMSKFETFKPAKSIDSGNLKAIIHKKISVPEVQEKKNKYIIEEKNNRVLKLLLNNGKNNLITKELVDELNDEIDMISKNDDINVVVITGRDTFSAGADLSQFFRNSADFMKNAERVERVFDRIRKTGKIFIAAIKGYALGGGLELALACDIRMATRSSILGFPETSLGLIPGYGGSQRLYKLIGMSRAVSMILTAERITGERALDYGIVNKLFENDDEVMTYAVELSERIAPVSVNLAKKLIYSEMNFDSGLDFEAAAVGVLYSTDDLREGISAFLSKRKPDYKGH

SEQ ID NO: 72275 - DNA, 2154 bp, Acinetobacter sp. ADP1
  CDS (1)..(2154): transl_table=11
atgatccacgctggcaatgccattaccgtccaaatgctttcggacggaattgcagaattccgctttgacttacaaggtgagtcggtcaacaaatttaaccgtgcaaccatcgaagactttcaagctgcgattgaagcagtcaaaaatcatcctgaagttaaaggcttgattgtcacttcagcaaaatctacgtttatcgtgggtgcagatattaccgagtttggacaaaactttgctcaaggcgaaaaagccattgttgaatgggctttacctgtacatgacatctttaatagctttgaagatttagacatccctaaagttgctgcgatcaatggcatggcgttgggtggtggttttgaaatgtgtttggtctgtgactaccgtgtgatgtcagatcaagcacaagtaggcctaccagaaattaaactgggaattttcccaggctttggcggtactgttcgtttaagccgtttgattggtattgacaatgccgttgaatggattgccatggcggcaccgaaaaaaccagcggcagcactcaaagatggtgccgtggatgctgtagtttcagcagacaaattacaggaagctgcaattgatctggtaaaacaggcgttggcaggtcgtgtcgactggaaagccaaacgtcaggaaaagctaaaccctgtgaagcttaatccacttgagcaaatgatggcttttaatacagcaaaaggtgctgtactagcaaaagccaatccggctcaatatcctgcaccgaaactcatgcttgattcattacaagcaggtgcaagcttgggtcgtgatgaagcactcaaagttgaaacagaaggttttgctaaagctgcaatcacaccacaggcagaagcattaattggtcttttcttgaatgatcagatcattaagaaaacctctaagaaacatgaaaaaggcgcgcatcctgtgaatcaggcagcggtactgggtgctggtatcatgggcggtggtattgcttatcaagcagcgagtaaaggcacgccaattatcatgaaagatattggtaatccgcagcttgcgttaggtatgcaagaagccaatggtctactcaccaaacaggtcgagcgcaaaaaacttacccctgcaaaaatgggcgaaactttggcgcgtatccgtccaactttaagctatgacgagtttaaagaagtggatatcgtgattgaagcggtcacagaaaatccaaaaatcaaggaagcagtcctggcagataccgaagcaaaagtgcgtgacaacaccattattgcctcaaatacctcaaccatttcaattacgcgtttagcaaaagcactcaagcgtccagaaaactttgtaggtatgcacttctttaatccagtacacatgatgccactggttgaagtcattcgtggtgaacagacttctgaagaagctgttgcaacgactgtggttctggctcagaagatgggtaaaaccccaatcgtggtcaatgattgccctggcttcttggtcaaccgcgtattgttcccttactttggggcctttgatctattactgaaagatggcgctgacttccagcaaatcgataaagtcatggaaaaatttggctggccaatgggccctgcttatctgatggacgtggtgggaattgacactggtgttcatggtgccgaagtcatggcagaaggtttcccagatcggatgaagccagattacaaaggttcaattcaaaccatgtatgaagccaagcgtctaggtcaaaaaaatgacgttggtttctacaaatatgaactcgacaaaaaaggcaagaaagcaaaaacggttgattcaaccgcatatgaagtcattgcaccagttgtgactagtgaaaaacgtgagtttgatgctcaggaaatcattgatcgtatgatgctggcgctttgcaatgaaaccgtacgctgccttgaagacaatatcgttgcaacacctgctgaagcagatatggcaatgattatggggattggtttcccaccatttcgtggtggcccatgtcgatatatcgatcaaacaggtgtggctgagtatgttgcgctttgcaacaagtacgcacatttgggtaaagcttatgaagcgccgcaactactgcgcgacatggctgaaaacaacaagaaattttacggttaa

SEQ ID NO: 72276 - protein, 717 aa, Acinetobacter sp. ADP1
MIHAGNAITVQMLSDGIAEFRFDLQGESVNKFNRATIEDFQAAIEAVKNHPEVKGLIVTSAKSTFIVGADITEFGQNFAQGEKAIVEWALPVHDIFNSFEDLDIPKVAAINGMALGGGFEMCLVCDYRVMSDQAQVGLPEIKLGIFPGFGGTVRLSRLIGIDNAVEWIAMAAPKKPAAALKDGAVDAVVSADKLQEAAIDLVKQALAGRVDWKAKRQEKLNPVKLNPLEQMMAFNTAKGAVLAKANPAQYPAPKLMLDSLQAGASLGRDEALKVETEGFAKAAITPQAEALIGLFLNDQIIKKTSKKHEKGAHPVNQAAVLGAGIMGGGIAYQAASKGTPIIMKDIGNPQLALGMQEANGLLTKQVERKKLTPAKMGETLARIRPTLSYDEFKEVDIVIEAVTENPKIKEAVLADTEAKVRDNTIIASNTSTISITRLAKALKRPENFVGMHFFNPVHMMPLVEVIRGEQTSEEAVATTVVLAQKMGKTPIVVNDCPGFLVNRVLFPYFGAFDLLLKDGADFQQIDKVMEKFGWPMGPAYLMDVVGIDTGVHGAEVMAEGFPDRMKPDYKGSIQTMYEAKRLGQKNDVGFYKYELDKKGKKAKTVDSTAYEVIAPVVTSEKREFDAQEIIDRMMLALCNETVRCLEDNIVATPAEADMAMIMGIGFPPFRGGPCRYIDQTGVAEYVALCNKYAHLGKAYEAPQLLRDMAENNKKFYG

SEQ ID NO: 72277 - DNA, 2136 bp, Acinetobacter sp. ADP1
  CDS (1)..(2136): transl_table=11
atgagcgctattaaatacgaaaaaaacgctgacaatattgtaattcttacccttgattcatcgggtcaatctgcaaataccatgaatgcagaatttcgtgatgctttaaatgatgtcagtcaaaagctcaaagctgaaactgacttgaaagggattattttccgttcagccaaaaaaaccttctttgctggtggcgacttagatgagctgattcaggttcaacctgaacatgccactgagttttttaaaatgattgaaaagctcaaagcagatttgcgaacaatcgagactctaggtgtacctgtggtcgcggctttaaatggcacagcacttggtggcggttgggagttagcactcggctgtcattatcgtattgccatcaatgatcctaaaagcaaatttggtttaccagaagtcactttaggtctacttccaggtgggggtggtatcgtccgtatggtacgtctactcggtttgcaaaatgcttttccattcttaatggaaggtaaacaatttggtgttgaccaagcaaaatctctgggattagtccatgacacggctgagaatcaacaagaactgttagataaagcaattgtttgggtcaaagccaatccgaaaagtcagcagcccttcgatgtcaaaggctacaaaattcctggtggtgatcctaaaacacctgctgttgcacaagtgcttgcgattgcccctgccatgctacgcgataaaaccaaaggctgttatcctgcacctgaagcgattatggcagcagcggttgaaggtgctcaagtggatgtcgataccgcgttacgtattgaatcccgttactttactcaattggctatcggtcaaattgcgaaaaatatgattggtacattctggcatggtctaaatgcgatcaagtcaggtgcaagccgccctgccgatgttgctagatggcaagccactaaagtcggtgtattgggcgcaggtatgatgggtgcaggtattgcctactcaaccgcgatcaaaggtattcctgtcatactcaaagatgtatctgtagaaaatgcagagaaaggcaaagcctattcgcaaaagctacttgataaacgtgtttcacaaggacgtatgacggcggaaaaacgtaatcaagtcttagcgctcattactgctaccgctgatgcagctgatttacaaggctgtgatctgatcattgaagctgtatttgagaatcaagaactcaaagccaaggtgacgcaagaagctgaacagtatttagctgaaggtggcatttttgcatcaaatacctccacactccccatcacaggattagcaacggcaagtaaagatgccaagaactttattgggctacatttctttagccctgtcgataaaatgcaattggtagaaatcattaaaggcaaacaaacttctgccgaaacattggctaaagcctatgactttgtccaacaaattgcgaaaacccccatcgtggtgaatgacagtcggggcttctttaccagtcgcgtttttggaacatttattcaagaaggtatgcgcttactggctgaaggtgtacacccagcaaaaattgaaatggcagcactcaaagcgggtatgcctgtggggccacttgcgattcaggatgaagtctctttaactttaactgaacatgttgcaagcgaaacgcgcaaagcactgcaagctgaagctaaagacttagcgaaaactcctgttgatgaagtggttcacaccatgattcacgagctcaatcgcaaaggtaaagctgctggtgcaggtttttatgagtatccagagcatggcaaaaagcacttatggcaaggtcttgaccgctggcaaaaagatcatgatatttccgaacaggagatgattgaccgcttcttgtttgttcaggcactggacactttacgctgctatgaagaaggtgtacttgagtctgtgattgatgccaatgtcggttcgatttttggcattggttttgccccatggacagggggtgctattcagttcttaaatcaaaacggaattgagaggtcactgcaacgttcagaggaattggctcaaaaatatggtgaacgttttaatccaccaccgtatctcaaagagaaagctcagcaaaaacaaatcattcaataa

SEQ ID NO: 72278 - protein, 711 aa, Acinetobacter sp. ADP1
MSAIKYEKNADNIVILTLDSSGQSANTMNAEFRDALNDVSQKLKAETDLKGIIFRSAKKTFFAGGDLDELIQVQPEHATEFFKMIEKLKADLRTIETLGVPVVAALNGTALGGGWELALGCHYRIAINDPKSKFGLPEVTLGLLPGGGGIVRMVRLLGLQNAFPFLMEGKQFGVDQAKSLGLVHDTAENQQELLDKAIVWVKANPKSQQPFDVKGYKIPGGDPKTPAVAQVLAIAPAMLRDKTKGCYPAPEAIMAAAVEGAQVDVDTALRIESRYFTQLAIGQIAKNMIGTFWHGLNAIKSGASRPADVARWQATKVGVLGAGMMGAGIAYSTAIKGIPVILKDVSVENAEKGKAYSQKLLDKRVSQGRMTAEKRNQVLALITATADAADLQGCDLIIEAVFENQELKAKVTQEAEQYLAEGGIFASNTSTLPITGLATASKDAKNFIGLHFFSPVDKMQLVEIIKGKQTSAETLAKAYDFVQQIAKTPIVVNDSRGFFTSRVFGTFIQEGMRLLAEGVHPAKIEMAALKAGMPVGPLAIQDEVSLTLTEHVASETRKALQAEAKDLAKTPVDEVVHTMIHELNRKGKAAGAGFYEYPEHGKKHLWQGLDRWQKDHDISEQEMIDRFLFVQALDTLRCYEEGVLESVIDANVGSIFGIGFAPWTGGAIQFLNQNGIERSLQRSEELAQKYGERFNPPPYLKEKAQQKQIIQ

SEQ ID NO: 72279 - DNA, 2190 bp, Erwinia carotovora subsp. atroseptica SCRI1043
  CDS (1)..(2190)
atgctttatcaaggtgaatccctctaccttaactggcttgaggacggcattgccgagctggtattttctgcccctggctccgtaaacacgctagatacccgcacggttgccagcctgggtaaggcgctggacgttctggcggaacagccgaacctgaagggcttactgctgcgatcagacaaacctgcatttattgtcggtgccgatatcacggaattcctttctctttttgccgcgccggccgaaaagctgcatgagtggcttgtcttcgccaacagcattttcaaccgtcttgaggatttacccgttcccacgctgtccgcgattaatagctatgcgctgggaggcggatgtgaatgcgtgctggcgaccgattttcgcttagcgacgccagatgcacgaatcgggttgcctgagactaaactcggaatcatgccgggctttggcggcacagtcaggctaccgcgtctgttaggtgcagacagcgcgctggagattatcgccgcaggtaaagacgtcagcgcagccgatgctttaaaagtggggctggtgcaggctgttgtcgctaatgaaaaactgattcccgccgccatcaagatgctaaagcaggccataaatggcgagctggactggctgggttaccgacgcccgaaacttgaggcgctgaagctcaataaaattgaagccatgatgagctttaccaccgccaaagcgatggtgctacaaaccgcggggaaacattatccagcgccgatgttagcggtaaaaaccatcgaagccgccgcaaccatgacacgtgatgaggcattgcagctcgaaacgcagcacttcgttcaactggcgcgttcaaatgaagctcgcgccctcgtcggcattttcctcaacgatcaatatgttaaaggcaaagcgaagaagctggttggcgagacacctgtaccgcaacaggccgctgtgctgggtgcgggcattatgggcggcggaattgcctatcaatccgcgttcaaaggcgtgccaattcggatgaaggatatcaacgagaagccactcgcgctggggatgaacgaggcagctaagctcctgaataaacagatggagcgaggcaaactagacggaatgaaaatggcgacgattttggcaaacattcacccgacgctggattacgccgggtttgaacgtaccgatatcgtcgttgaagctgtggtagaaaacccgaaaatcaaagcgagcgtattagcagaaaccgaatcgcacattagcgagagcacgattctcgcttctaatacctcaacgattccaattgctgtgctggctgcggcgttaaaacgaccgcaaaatttctgcggtatgcacttctttaacccagtacaccgtatgccgctggtcgaaattattcgcggccctaaaactagtgacagtaccatcgccagcgtagtggcctacgccagcaaaatgggcaagacaccaattgtcgtgaacgactgccctggtttcttcgtgaatcgcgttctgtttccctactttgcagccttcagtttactactcagagacggtgccgatttccgcgagatcgataacgccatggagaagaaattcggttggccgatggggccagcctatctgctggacgttgtcggcattgataccgctcaccatgcacaagccgtgatggcagaaggctttccacagcggatggcaaaagactatcgcgatgcgatcgacgtgttgtttgaacatcagcgctttgggcagaaaaatggtcagggtttctatcgttatcaaaccgatagcaaagggaagcagcgtaaagaacaggatgacgccgtagatgcactccttaaaaacatcagccaaccgaaaaaagcgttcagcgcagaagagattatcgctcggatgatgatcccgatgattaatgaagtcgcgcgctgtctggaagaaggtatcgtcgccagccctgccgaagcggacatggcgctggtatatggattaggtttccctcccttccacggcggagcctgccgctatttggatacgttgggcagcgagcgttatgtcgagatggcgcagcagttggctcacctcggcgccatctatcaggtgcctgacggcttacagcaaaaagccagaagcaatgaaggctattacccatcggtcgcgccacacgcggacgtttcccacggtcaaccggcatga

SEQ ID NO: 72280 - protein, 729 aa, Erwinia carotovora subsp. atroseptica SCRI1043
MLYQGESLYLNWLEDGIAELVFSAPGSVNTLDTRTVASLGKALDVLAEQPNLKGLLLRSDKPAFIVGADITEFLSLFAAPAEKLHEWLVFANSIFNRLEDLPVPTLSAINSYALGGGCECVLATDFRLATPDARIGLPETKLGIMPGFGGTVRLPRLLGADSALEIIAAGKDVSAADALKVGLVQAVVANEKLIPAAIKMLKQAINGELDWLGYRRPKLEALKLNKIEAMMSFTTAKAMVLQTAGKHYPAPMLAVKTIEAAATMTRDEALQLETQHFVQLARSNEARALVGIFLNDQYVKGKAKKLVGETPVPQQAAVLGAGIMGGGIAYQSAFKGVPIRMKDINEKPLALGMNEAAKLLNKQMERGKLDGMKMATILANIHPTLDYAGFERTDIVVEAVVENPKIKASVLAETESHISESTILASNTSTIPIAVLAAALKRPQNFCGMHFFNPVHRMPLVEIIRGPKTSDSTIASVVAYASKMGKTPIVVNDCPGFFVNRVLFPYFAAFSLLLRDGADFREIDNAMEKKFGWPMGPAYLLDVVGIDTAHHAQAVMAEGFPQRMAKDYRDAIDVLFEHQRFGQKNGQGFYRYQTDSKGKQRKEQDDAVDALLKNISQPKKAFSAEEIIARMMIPMINEVARCLEEGIVASPAEADMALVYGLGFPPFHGGACRYLDTLGSERYVEMAQQLAHLGAIYQVPDGLQQKARSNEGYYPSVAPHADVSHGQPA

SEQ ID NO: 72281 - DNA, 2196 bp, Erwinia carotovora subsp. atroseptica SCRI1043
  CDS (1)..(2196)
atgaacgatcaacagcctttctccgttacagcatcgcctacaacggaaaaaacatctgcattttccctcaccattcggccggacaatatcggtgtgatcagcattgatgtccccggcgagagggtgaacacgctaaagagtgaatttgcagaacagatcctctcggtctttgagttggcgcggcagcatgcgacgctcagggggctgatttttatttccgccaagcctgattcgtttattgctggtgcggatatcaccatgttgaataagtgcagcagcgccgagcaggccgaaaatctagccaagcaagggcaggaaacgtttgatcagattgcagcgttacctttccccgtggtggctgcgattcatggtgcttgtttaggtggtgggctggaattggcattagcctgcgactatcgcgtttgctctctggatgaaaaaacggtgctggggctaccggaagtgcagcttggcctccttcctggatcgggcggaacgcagcgtttgccacgcttgattggtctggatagcgcactggatcttattctgacgggtcgccatctccgggcgggtcaggcgctacggcaggggctggttgatgaggcggttccgcacgatattctgctggatacggcagtcgagattctcaaaaaaggaaaacgcaaagcggtgccgctgggctggcgttcgcgtctgctgaacagtccgggtattcgtcatttgcttttcaaaatggtgaaacgcaagactcgcgcgaaaacacatggcaactatcccgctactgaaaagatcattcaggtggtacgccggggaatagaaaaaggccgggaagaagggtatcggcatgaggcgcgagcgtttggaaaactggtgatgacgccggagtctgccgcactacgccacttgttttttgccactaacgcattaaagaaaacctccggtgcggcctctgaggcgaagccgatccatcgtgtcggcattctgggtggcgggttaatgggcggagggatcgccagcgtgacggcaacgcgcgggcagttgcctgtgcgtattaaagatatcaatgagcagggtattaaccatgcgttgaagtacaactggcaattattgaccaagcgtgttcagagtaaacggatgaagccgacggagcgccagcgtttgatgacgttgatttccggtagtacggactatcgtggttttgaacatgcagatatcgttattgaagcggtcttcgaagatctggcactgaagcggcaaatgattacggagattgaagatcatgccgcgccgcataccattttcgcatcaaatacctcctcgttgccgatccatcaaatcgcggagggcgcgcgtcgtccacaactggttgttggcctgcactattttagcccggtagataaaatgccgctggttgaagtcattccccacgcgcacaccagcgcggagacggttgcgacgacggttgccctggcgagaaaacaaggaaaaaccgcgatcgtcgtgggtgatagcgctggtttttatgtgaatcgtatattggcaccttacatcaacgaagcggcttactgcctgttagaaggggagccaattgaatcgattgactatgcgctggtgcgttttggtttccccgtcggcccgctagcgctgctggatgaagtcggtattgatgtcgcgaccaaaattgtaccggtgctgagtgaagaactcggcgatcgctttacctccccgccagcgtttgatgcgattctgaaagatgggcgcaaagggcgcaagaatggcaaagggttctatcggtacaataaaacgcgccgtttctggcactcggggaaagaagtcgacagctcggtttatccgttgttggatgtgacaccgaaggcgcatatcgatcctgcattaatcagccagcgtgccgtgatgatgatgttgaatgaggcggcgcgttgtctggatgaaggcgtgattcaatgtgctcgtgacggcgatatcggcgcggtatttggcattggcttcccgcctttcctcggcggtccgttccattatatggatcgtctggggatggaaacggtagtgaaaacgctattggtactgcaacaacagtatggcgatcggttcgcaccctgcgagcgtttactcacgatgcgggaaggccagcggacgttctatccgccagccgataaagacaatagcattagttga

SEQ ID NO: 72282 - protein, 731 aa, Erwinia carotovora subsp. atroseptica SCRI1043
MNDQQPFSVTASPTTEKTSAFSLTIRPDNIGVISIDVPGERVNTLKSEFAEQILSVFELARQHATLRGLIFISAKPDSFIAGADITMLNKCSSAEQAENLAKQGQETFDQIAALPFPVVAAIHGACLGGGLELALACDYRVCSLDEKTVLGLPEVQLGLLPGSGGTQRLPRLIGLDSALDLILTGRHLRAGQALRQGLVDEAVPHDILLDTAVEILKKGKRKAVPLGWRSRLLNSPGIRHLLFKMVKRKTRAKTHGNYPATEKIIQVVRRGIEKGREEGYRHEARAFGKLVMTPESAALRHLFFATNALKKTSGAASEAKPIHRVGILGGGLMGGGIASVTATRGQLPVRIKDINEQGINHALKYNWQLLTKRVQSKRMKPTERQRLMTLISGSTDYRGFEHADIVIEAVFEDLALKRQMITEIEDHAAPHTIFASNTSSLPIHQIAEGARRPQLVVGLHYFSPVDKMPLVEVIPHAHTSAETVATTVALARKQGKTAIVVGDSAGFYVNRILAPYINEAAYCLLEGEPIESIDYALVRFGFPVGPLALLDEVGIDVATKIVPVLSEELGDRFTSPPAFDAILKDGRKGRKNGKGFYRYNKTRRFWHSGKEVDSSVYPLLDVTPKAHIDPALISQRAVMMMLNEAARCLDEGVIQCARDGDIGAVFGIGFPPFLGGPFHYMDRLGMETVVKTLLVLQQQYGDRFAPCERLLTMREGQRTFYPPADKDNSIS

SEQ ID NO: 72283 - DNA, 2139 bp, Leifsonia xyli subsp. xyli str. CTCB07
  CDS (1)..(2139): transl_table=11
gtgaccgactacagcaagatcgacttctccccgctcgccgacctcacggacgacgaggtcgtcacccactcttacgtcaaggacgtgtccctgccgagcgggaagaccctcgccctggtcaccctggacaacggccgggaccacacgcgcccgaacacgatgggaccggccacgctgatcaagctgggcaagaccttcgacacgctgacggagcgcgccggacgcggcgagatcgacgcggtcgcggtgaccggcaaaccgttcatcctggccgcgggcgccgacctgagccgggtgggcgacatcccgagcgtcgaagtcgcgaagctgctcccccagctgggccactacgttctcggcaagcaggcgagcttcggcgtcccctcgttcgtcttcacgaacgggctcgcactcggcggcggcgtggagatcggcctgaacgccgactaccgcaccatcgaccggaacgcggcggcgtttgcgctgcccgaagtgttcctcggcctcatcccgggctggggcggcgcgaccatcctccccaacctgatcggcatcgagaacgccctgaaagtggtcatcgagaactcgctcaagcagaaccggatgctgaagccgcaggaggtcttcgacctcggcatcgccgacgcgatcttcgactcggcgaacttcctggaggactccctcaagtgggccgaccaggtgctgaccaagcaggtcgaggtcaagcgcccgaacgtccccggcaaggtcgagcggatggtcaagtgggatgctgccgtcggcatcgcccgcaagatgctggagagcagcatcggcaccgtcccggcatcgccgtacaaggcactcgacctgctgaaggctgccaagtcgaacgaccgtgccgccggcttcgagcgggaggacgacgcgctggccgagctcatctcgggcgaccagttccaggccagcatctacgccttcaacctcgtgcagaagcgggcgaagcgtcccgccggcgctcccgacaagaagctcgcgaagaaggtcacgaaggtcggcgtcatcggcgcgggctacatggccagccagttcgcgctgctgttcgtgcggcgactgcgggtgccggtcgtgatcaccgatctcgaccaggcgcacgtggacaagggcgtggcgtccatccacgatgagatcggcaaactgcgggagaaggggcgcatctcccccgacgaagcgaaccacttgcgcgctctggtcacgggcacgacggacaaggccgacttcgccgactgcgactgggtcatcgaggccgtgttcgaggagctgaacgtcaaacaagaggtcttcgcggaggtcgagcaatacctctccgacgaggctgtgctcgcaaccaacacctcctcgctctcggtcgaacagatcggcgcgaagctgaagcgtccggagcgcctggtcggcttccacttcttcaccccggtcgcggtcatgccgctcatcgaggtggtgaagacgaccaacaccgacgacgcgacgctctccaccgcgatggtcaccgccgcggcgctgaagaaaaacgcggtcatcaccgccgacacccccggcttcgtagtcaaccgtgtgctagcgaagatcctgggcgaagcgatgcacgccgtggacgacggcacacccttcgaaacggtcgaccgggcattcgcgccgctcggcctcccgatggccccctccgccctgctcaacctcgtcgggctgaaagtgggcgcacacgtcctcgacacccaccacaccgccttccccgaccggttctaccgcagcaagaacctgcaccacctcgccgaacacggcaccctgctcgagaaggacgccacaggcaaggtgaaagggctcgacaagggcgcagccaagatcctcgcgggcggcaagaacccgtggaacgaagcggacatcctccgccgcctcgaagacggcatcgccgacgagatccaccgcatgctcgtggacgaccgcgtggtcgaagcgccagaagacatcgacctctgcatgatccttggcgcgggcttcccgctccaaatgggcggcatcacaccctacctcgaccgggcgggcgcatcggagcgcgtcttcggcaacaccttccaccacccgcccattgccggcgtcgcctga

SEQ ID NO: 72284 - protein, 712 aa, Leifsonia xyli subsp. xyli str. CTCB07
MTDYSKIDFSPLADLTDDEVVTHSYVKDVSLPSGKTLALVTLDNGRDHTRPNTMGPATLIKLGKTFDTLTERAGRGEIDAVAVTGKPFILAAGADLSRVGDIPSVEVAKLLPQLGHYVLGKQASFGVPSFVFTNGLALGGGVEIGLNADYRTIDRNAAAFALPEVFLGLIPGWGGATILPNLIGIENALKVVIENSLKQNRMLKPQEVFDLGIADAIFDSANFLEDSLKWADQVLTKQVEVKRPNVPGKVERMVKWDAAVGIARKMLESSIGTVPASPYKALDLLKAAKSNDRAAGFEREDDALAELISGDQFQASIYAFNLVQKRAKRPAGAPDKKLAKKVTKVGVIGAGYMASQFALLFVRRLRVPVVITDLDQAHVDKGVASIHDEIGKLREKGRISPDEANHLRALVTGTTDKADFADCDWVIEAVFEELNVKQEVFAEVEQYLSDEAVLATNTSSLSVEQIGAKLKRPERLVGFHFFTPVAVMPLIEVVKTTNTDDATLSTAMVTAAALKKNAVITADTPGFVVNRVLAKILGEAMHAVDDGTPFETVDRAFAPLGLPMAPSALLNLVGLKVGAHVLDTHHTAFPDRFYRSKNLHHLAEHGTLLEKDATGKVKGLDKGAAKILAGGKNPWNEADILRRLEDGIADEIHRMLVDDRVVEAPEDIDLCMILGAGFPLQMGGITPYLDRAGASERVFGNTFHHPPIAGVA

SEQ ID NO: 72285 - DNA, 2124 bp, Burkholderia pseudomallei K96243
  CDS (1)..(2124): transl_table=11
atgatcgattacacgctcgatgacgacggcatcgcgaccttgagctggaacctgccggcgcgcagccagaacgtgctgaacggcgagagctgcgaggcgttcttcgcggcggcggcgcgcgcgttgcaggatgcggcggtgaagggaatgctcgtcacgtcggcgaagcccgacttcatcgcgggcggcgacctcgaatggctgcaggcgagcgacagcgccgagacgctcttcgcgcgcacgtgcgagctgcatcgcgcgctgcgcgcgctcgaaacaggcggcaagccggtggcgatcgcgatgccgggctcggcgctcggcggtgggctggagatcgcgctcgcgggccactatcgtgtcgcggccgacaatccgaaggcgcgcttcggcctgcccgaagtgacgctcggcctgctgccgggcggcggcggcacgcagcgcctgccgcgtctcgtcggcgtccaggcgtcgctgccgctgttgctcgaaggcaagcggctgaaggcggccgacgcgctggcggcgggcatcctgcatgcggtcgtgccggcgggcgaggagatcgcggccgcgcgcgcgtggctgctcgacgcgagccgccgcaccgcgacgcagccgtgggacgcgaagggcttccggattccgggcggcgcgctcacgcatccgtccgtccagcaggtgttcatggcggcgaacgcgctcgcgcggcagaagacgtatggcaactacccggccgtcgcgagcatcctgtcgtgcgtgtacgaagggctgctgaccgatctcgacacgggcttgaagaccgaggcgcgctatttcgtgaaggcggtgctgtcgccggaagcgaaggcgatgatccgcacgctgttcttcgggatgaacgaagcgaacaagctcgccgcgcggccggccggcgtgccgacgcagcgctaccggaaggtcggcgtgctcggcgcggggatgatgggcgcgggcatcgcgtacgtgagcgcgaaggcggggctcgacgtcgtgctgatcgataccggcgaagaggcggccgcgcgcggcaaggactattcgcgcaagctcgtcgacaagcaggtgcagcgcggccggctcgcgcgggaaaaggccgatgcattgctcgcgaagatcgtgccgacgaccgatttcgcgcggctcgacggcgcgcagctcgtgatcgaggcggtgttcgaggatcgcgcgatcaaggccgacgtcacgcgccggagcgaagcggtgctcgcgcccgacgcgcttttcgcgtcgaacacgtcgacgctgccgatcacggggctcgcgcaggcgagcgcgcggccggcgaacttcatcggcctgcatttcttctcgccggtggacaagatgccgctcgtcgaggtgatcgtcggccgcgacacgagcgaggcgacgctcgcgcgcgcgctcgactacgtgaagacgatcggcatgacgccgatcgtggtcaacgattcgcggggcttctacacgagccgcgtgttttcgacgtacgtgctcgaagggctcgcgatgctcgccgagggcgtcgcgcccgcgctgatcgagaacgccggattgctcgccggcatgccggtgggcccgctcgcgctgaccgacgaggtgtcgagcgagctgatccacaagatcaccaggcagacgcgcgccgatctcggcgacgcgtacgtcgcgcgccccggcgaggacgtggccgcgcgcatggtcgaactcggccggctcggccgcaaggcggggctcggctattacgactatccggcgagcggcggcaagaaggcgctgtggccggggctcgcgcaggagtttccgctcgcggccgagcagcccgacgtggcggcgctgatcgagcggctcgtgacggtgcaggcggtcgagaccgcgcgctgcctcgaagagcgcgtgctgacgacggcgcgcgatgcggacgtcggcgcgattctcggctggggtttcccggcgttccgcggcgggccggcgtcgtacattcacggcgtcggggtggacgcgttcgtcgcgacgtgcgatcgtcttgccgcgcggcacggcgcgcgtttcgccgcgccggcgttgctgcgcgagatggcggcgcaggggcgaagcttctattga

SEQ ID NO: 72286 - protein, 707 aa, Burkholderia pseudomallei K96243
MIDYTLDDDGIATLSWNLPARSQNVLNGESCEAFFAAAARALQDAAVKGMLVTSAKPDFIAGGDLEWLQASDSAETLFARTCELHRALRALETGGKPVAIAMPGSALGGGLEIALAGHYRVAADNPKARFGLPEVTLGLLPGGGGTQRLPRLVGVQASLPLLLEGKRLKAADALAAGILHAVVPAGEEIAAARAWLLDASRRTATQPWDAKGFRIPGGALTHPSVQQVFMAANALARQKTYGNYPAVASILSCVYEGLLTDLDTGLKTEARYFVKAVLSPEAKAMIRTLFFGMNEANKLAARPAGVPTQRYRKVGVLGAGMMGAGIAYVSAKAGLDVVLIDTGEEAAARGKDYSRKLVDKQVQRGRLAREKADALLAKIVPTTDFARLDGAQLVIEAVFEDRAIKADVTRRSEAVLAPDALFASNTSTLPITGLAQASARPANFIGLHFFSPVDKMPLVEVIVGRDTSEATLARALDYVKTIGMTPIVVNDSRGFYTSRVFSTYVLEGLAMLAEGVAPALIENAGLLAGMPVGPLALTDEVSSELIHKITRQTRADLGDAYVARPGEDVAARMVELGRLGRKAGLGYYDYPASGGKKALWPGLAQEFPLAAEQPDVAALIERLVTVQAVETARCLEERVLTTARDADVGAILGWGFPAFRGGPASYIHGVGVDAFVATCDRLAARHGARFAAPALLREMAAQGRSFY

SEQ ID NO: 72287 - DNA, 2151 bp, Nocardia farcinica IFM 10152
  CDS (1)..(2151): transl_table=11
gtgagcgaaaccaacatgatcggttgggagaaggattcggacggcatcgtcgtactgacgatggacgacccgaaccagggcgccaacacgatgaacgagctgtacaagaagtcgatgacggcgaccgtcgaccggctggaggccgagaaggacgacatcaccggtgtcgtgctgacctcggcgaagaagaccttcttcgccggtggcgacctgaagaacatgatgaaggtcggcccggacgacgcgcaggcgctgatggcggagctgaccgagatcaagtcggcgctgcgccggctcgagcagctcggcaagccggtcgtggccgccatcaacggcgccgcgctgggcggcggcctggagatcgcgctggcgacccaccaccgcatcgccgcggacgtgccgggctcgcagatcggcctgcccgaggtgaccctcggcctgctgcccgccggtggcggcatcatccgcaccgtgcgcatgctcggcctgcagaacgccctcatgcaggtgctgctgcagggccagcgcaacaagccggccaaggccaaggagatcggcctggtcgacgagctggtcggctcgatcgaggagctggtgcccgccgccaaggcgtggatcaaggccaaccccgacgccggtgtgcagccgtgggacaagaagggcttcaagatccccggcggcacccccgccagccccggcttcgcggccaacctgcccgccttcccggccaacctgcgcaagcagctcaagggcgccaacatgcccgccccgcgcgccatcatggcggccgcggtggagggttcgcaggtcgacatcgacaacgcgtcgctgatcgagtcgcgctacttcgtgcacctgctcaccggcccggtcgcgaagaacatgatccaggcgttcttcttcgacctgcaggcgatcaacaacggcggttcgcgtcccaaggacgtgcccaagcgggaaatcaagaaggtcggcgtgctcggcgcgggcatgatgggcgcgggcatcgcctacgtctcggccaaggccggctacgaggtcgtgctcaaggacgtctcgctggaggcggccgagcgcggcaagggctactcggagaagatcgaggccaaggccctctcccgcggcaagaccaccgaggagaagtccaaggcgctgctggaccggatcaagccgaccgcggacgcggccgacttcgccggtgtcgacttcgtcatcgaggccgtcttcgagaacaccgagctcaagcacaaggtgttccaggagatcgaggacatcgtcacccccgacgccctgctgggctccaacacctccaccctgccgatcaccggtctggcgaccggcgtgaagcgccaggaggacttcatcggcatccacttcttctcgccggtcgacaagatgccgctggtggagatcatcaagggtgagaagacctccgacgaggcgctggcccgggtgtacgactacaccctcgccatcaagaagaccccgatcgtcgtcaacgacagccgcggcttcttcacctcgcgcgtgatcggcaccttcgtcaacgaggcgatcgccatgctgggcgagggcatcgagcccgcgaccatcgagcaggccggttcgcaggcgggctacccggcgccgccgctgcagctgtccgacgagctcaacatgaagctcatgctcaagatcgccaaggagaccgaggaagcgatcaaggcgggcgacaccaagctgggcaccgagcggcacccggccatcgacgtcatcgagtggatggtcggcgagggtcgtccgggccgcctggagaaggccggcttctacgagtacgacgagaacggcaagcgcctcggcctgtggcagggcctgcgcgagcacttcaagaccaccgccggtttcgacgtgccgttgcaggatctgatcgaccgcatgctgttcgcggaggcgatcgagacccagaagtgcttcgacgagggcgtgctggagaccaccgccgacgccaacatcggctcgatcttcggcatcggcttcccggcctggaccggtggtgtgcaccagttcatcgtcggctacccgggcggccaggaggccttcgtggcccgcgcggacgagctggccgagaagtacggccagcgcttccaggtgcccgcgtcgctgcgtaaatag

SEQ ID NO: 72288 - protein, 716 aa, Nocardia farcinica IFM 10152
MSETNMIGWEKDSDGIVVLTMDDPNQGANTMNELYKKSMTATVDRLEAEKDDITGVVLTSAKKTFFAGGDLKNMMKVGPDDAQALMAELTEIKSALRRLEQLGKPVVAAINGAALGGGLEIALATHHRIAADVPGSQIGLPEVTLGLLPAGGGIIRTVRMLGLQNALMQVLLQGQRNKPAKAKEIGLVDELVGSIEELVPAAKAWIKANPDAGVQPWDKKGFKIPGGTPASPGFAANLPAFPANLRKQLKGANMPAPRAIMAAAVEGSQVDIDNASLIESRYFVHLLTGPVAKNMIQAFFFDLQAINNGGSRPKDVPKREIKKVGVLGAGMMGAGIAYVSAKAGYEVVLKDVSLEAAERGKGYSEKIEAKALSRGKTTEEKSKALLDRIKPTADAADFAGVDFVIEAVFENTELKHKVFQEIEDIVTPDALLGSNTSTLPITGLATGVKRQEDFIGIHFFSPVDKMPLVEIIKGEKTSDEALARVYDYTLAIKKTPIVVNDSRGFFTSRVIGTFVNEAIAMLGEGIEPATIEQAGSQAGYPAPPLQLSDELNMKLMLKIAKETEEAIKAGDTKLGTERHPAIDVIEWMVGEGRPGRLEKAGFYEYDENGKRLGLWQGLREHFKTTAGFDVPLQDLIDRMLFAEAIETQKCFDEGVLETTADANIGSIFGIGFPAWTGGVHQFIVGYPGGQEAFVARADELAEKYGQRFQVPASLRK

SEQ ID NO: 72289 - DNA, 2019 bp, Legionella pneumophila str. Paris
  CDS (1)..(2019): transl_table=11
atgaataattataaacattgggatttacaacgagataaagacgccattctgtggcttggattaaatagaagggatgctgctgttaatagcattaatgaagaagtcctggatgagttaaacagcttgctgcatgaaatatcgcatgataaaaaagcaatgggattaattatttattcgctcaaggaaaaagggtttattgcgggtgctgatgttaacgctttttcacaatttgagagctcttcacaagcggtcgattttttgcagaaaggacaaactgtatttgcccggttgcaaactttatcaattccaagtgtcgcaatgatcgatggtttttgcatgggcggtggttatgagttagctttagcctgcacctatcgaattgcaacggatgacaaagacacacgtattggtttgcctgaagtgatgctgggtattcatccagggtggggcggtactgtgcgtttgcctcagttaataggcggttttaaagctttatcacaagtcatattaactggtagtgcaatacctgctgtaaaagctaaaagccttggcatgattgatgaggtagtacctgttcgtcagctaagaagggctgctgtttatttcataaagaataaaccaccacgacacagggcatcatttattgaaagtttaacgaatagctctttgcttagaaaagctctcgcttatttgcttcgttataacgtagccaagcgagttcgaaaagaacattatcctgcaccatatgccgtgattgacctgtgggaaaaagaaggaggagtgggagagagggcttatcttaaagaagtggactctatagaaaaacttgtatcccaaaatgataccgccaagaatcttatcagagcatttttattgcgtgagcgattaaaaggatttgccaaagacagcaacttcaaagcgacacatgttcatgtgattggagctggagttatgggaggggatatcgcggcctggtgtgctttgcgaggtcttcaggtcacattacaggataaatcttatgaacaaattgcccctgcaatagggagagcgcataaactttatagtaaaaaattgcgtaagccgcgattgatccaggcagcaatggatagattaatcgcagatcccgaagggcatggggtaaaacgagcagatgtcattattgaggctgttttcgagaatttagccgttaaacaggaaataatgaaaattgtggaaaaaaatgccaaaaaggatgcgatcatagcgacaaacacctctagtatcccacttgatgaaatcagcagtgtaatgagtaaaccagagcgcttggtaggcattcatttctttaatcctgtagctaaaatggatttggtagaaatagtcagcagctcatctactgcaaaaaaaattcagcagagctcttgcgcgttcgtcaatcaaattggcaaattgcccttgcctgtcaaatcaagccctgggtttttaataaacagagtactcatgccttacctgatggagtgcgtacagttattggatgaaggatatagtgcggaaacaatagatgaggccgcattgcagtttggtatgtttatgggccctgttgaactggctgatacagtaggaatggatgtttgtcttgctgtggccgaaaatctgaccagtcactttggtggcactattccacaaagattacgtgatttagtaaaagaaggtaagctaggcagaaaaactggagaaggtttttataaatataaaaatggaaaagtaattaagaaaaaagccccgtcacatgtcgataaaactattgcagacaggctaattttacgcatggtgaatgaatctgcggcttgtatacgtgagaaagtggttgaagattctgacttgttggatgctgggatgatctttgccacaggttttgctccattccgtggagggcctatgaattacgcaaatgattttggtaaagataaactggaaactttatttaaaacatttgaatctaaatacggcgaacgttttaaggtagataccagcttataa

SEQ ID NO: 72290 - protein, 672 aa, Legionella pneumophila str. Paris
MNNYKHWDLQRDKDAILWLGLNRRDAAVNSINEEVLDELNSLLHEISHDKKAMGLIIYSLKEKGFIAGADVNAFSQFESSSQAVDFLQKGQTVFARLQTLSIPSVAMIDGFCMGGGYELALACTYRIATDDKDTRIGLPEVMLGIHPGWGGTVRLPQLIGGFKALSQVILTGSAIPAVKAKSLGMIDEVVPVRQLRRAAVYFIKNKPPRHRASFIESLTNSSLLRKALAYLLRYNVAKRVRKEHYPAPYAVIDLWEKEGGVGERAYLKEVDSIEKLVSQNDTAKNLIRAFLLRERLKGFAKDSNFKATHVHVIGAGVMGGDIAAWCALRGLQVTLQDKSYEQIAPAIGRAHKLYSKKLRKPRLIQAAMDRLIADPEGHGVKRADVIIEAVFENLAVKQEIMKIVEKNAKKDAIIATNTSSIPLDEISSVMSKPERLVGIHFFNPVAKMDLVEIVSSSSTAKKIQQSSCAFVNQIGKLPLPVKSSPGFLINRVLMPYLMECVQLLDEGYSAETIDEAALQFGMFMGPVELADTVGMDVCLAVAENLTSHFGGTIPQRLRDLVKEGKLGRKTGEGFYKYKNGKVIKKKAPSHVDKTIADRLILRMVNESAACIREKVVEDSDLLDAGMIFATGFAPFRGGPMNYANDFGKDKLETLFKTFESKYGERFKVDTSL

SEQ ID NO: 72291 - DNA, 2019 bp, Legionella pneumophila str. Lens
  CDS (1)..(2019): transl_table=11
atgaataattataaacattgggatttacaacgagataaagacgccattctgtggcttggattaaatagaagggatgctgctgttaatagcattaatgaagaagtcctggatgagttaaacagcttgctgcatgaaatatcgcatgataaaaaagcaatgggattaattatttattcgctaaaggaaaaagggtttattgcgggtgctgatgttaacgctttttcacaatttgagagttcttcacaagcggttgattttttgcagaaagggcaaactgtatttgctcggttgcaagctttatcaattccaagtgtcgcaatgatcgatggtttttgcatgggcggtggttatgagttagctttagcctgcacctaccgaatcgcaacggatgacaaagacacacgtattggtttgcctgaagtcatgctggggattcatccagggtggggcggtactgtgcgtttgcctcagttaataggtggttttaaagctttatcacaagtcatattaactggtagtgcaatacctgctgcaaaagctaaaagcctcggtatgattgatgaggtagtacctgttcgtcagctaagaagggctgctgtttatttcataaagaataaaccaccacgacacagagcatcatttattgaaagtttaacgaatagctctctgcttagaaaagctatcgcttatttactgcgttataacgtagccaagcgagttcgaaaagaacattatcctgcaccatatgccgtgattgacctgtgggaaaaagaagggggagtgggagagagggcttatcttaaagaagtggactctatagaaaaacttgtatcccaaaatgataccgccaagaaccttatcagagcatttttattgcgtgagcgattaaaagggtttgccaaagacagccatttcaaaatggcacatgttcatgtgattggagcaggggttatgggaggggatatcgctgcctggtgtgctttacgaggtcttcaggtcacattacaggataagtcttatgaacaaattgcccctgcaatagggagggcacataaactttatagcaaaaaacttcgtaagcctcgattgatccaggctgcaatggatagattaattgcagatccccatggacatggggtaaaacgagcagatgtcattattgaggctgttttcgagaatttggccgttaaacaggaaataatgaaaactgtggaaaaaaatgccaaaaaagatgcgatcatagcgacaaacacctctagtatcccacttgatgaaatcagcagtgtaatgagtaaaccagaacgcttggtaggcattcatttctttaatcctgtagctaaaatggatttggtagaaatagtcagcagctcatctactacaaaaaaagttcagcagagcgcttgcgcgttcgtcaatcaaattggcaaattgcctttgcctgtcaaatcaagtcctggatttttaataaatagagtgctcatgccttacctgatggagtgcgtacagttattggatgaaggatatagtgcggagacaatagatgaggccgcattacagtttggtatgtttatgggccctgttgaactggctgatacagtaggaatggatgtttgtcttgctgtggccgaaaatctgactggtcactttggtggtactattccacaaaggttacgtgatttagtaaaagaaggtaagctaggcagaaaaactggagaaggtttttataaatataaaaatggaaaagtaattaagaaaaaggctccgccacatgtcgataaaaccattgcagacagattaattttgcgcatggtgaatgaatctgcagcttgtatacgtgagaaagtggttgaagattctgacttgttggatgctggaatgatctttgccacaggttttgctccattccgtggagggcctatgaattacgcaaatgattttggtaaagataaactggaaactttatttaaaacatttgaatctaaatacggcgaacgttttaaggtagataccagcttataa

SEQ ID NO: 72292 - protein, 672 aa, Legionella pneumophila str. Lens
MNNYKHWDLQRDKDAILWLGLNRRDAAVNSINEEVLDELNSLLHEISHDKKAMGLIIYSLKEKGFIAGADVNAFSQFESSSQAVDFLQKGQTVFARLQALSIPSVAMIDGFCMGGGYELALACTYRIATDDKDTRIGLPEVMLGIHPGWGGTVRLPQLIGGFKALSQVILTGSAIPAAKAKSLGMIDEVVPVRQLRRAAVYFIKNKPPRHRASFIESLTNSSLLRKAIAYLLRYNVAKRVRKEHYPAPYAVIDLWEKEGGVGERAYLKEVDSIEKLVSQNDTAKNLIRAFLLRERLKGFAKDSHFKMAHVHVIGAGVMGGDIAAWCALRGLQVTLQDKSYEQIAPAIGRAHKLYSKKLRKPRLIQAAMDRLIADPHGHGVKRADVIIEAVFENLAVKQEIMKTVEKNAKKDAIIATNTSSIPLDEISSVMSKPERLVGIHFFNPVAKMDLVEIVSSSSTTKKVQQSACAFVNQIGKLPLPVKSSPGFLINRVLMPYLMECVQLLDEGYSAETIDEAALQFGMFMGPVELADTVGMDVCLAVAENLTGHFGGTIPQRLRDLVKEGKLGRKTGEGFYKYKNGKVIKKKAPPHVDKTIADRLILRMVNESAACIREKVVEDSDLLDAGMIFATGFAPFRGGPMNYANDFGKDKLETLFKTFESKYGERFKVDTSL

SEQ ID NO: 72293 - DNA, 2163 bp, Photobacterium profundum SS9
  CDS (1)..(2163): transl_table=11
atgatttaccaaggcgaaaccctatccgttcgttatctggatgatggcattgcggaactcaatctcaacgctccaggtgctgtaaataaattcgatctaaaaactctagagtgtcttaatgaagcattaaacgctctttatcaacaatccgatttaaaaggcttattaattacatctgataaagatgcctttattgtcggtgcagatatcacagagtttctcggtttatttgctaaaccagcagaagagttatcgcaatggctaacccgtgccaacgatattttcaataagctggaagatctgcctgtgccaacattgtcggcaattaatgggcatgcactgggtggtggttgtgagtgtgttctcgcaacagactttcgtttagctgatatcactgcgcgtattggcttaccagaaactcgccttggaattatgccaggatttggaggaacggttcgtttacctcgccttttaggtgcagactctgctatggagatcatcactgcaggtaaagacaaaaaagcccaagatgcactaaagcttggacttgtggatgccgtcgtagcaccaactgctttaaaagatgccgcgttatccatgataaaagacgcaattgcaggaaaactcgactggcaaaagcgtcgtgcacaaaagaaagcgccattaacactcaataaaattgaagcgacaatgagctttacgatggcaaaagcaatggtggctcaagtggcgggaaaacattacccagccccaatgaccgccgttattgcaatagaagccgctgcgcgtatgtctcgtgatgaagctctggtcgttgaaaataagcacttcatcacgttagccaaaacagatgtcgcccaatcgttagttggtattttccttaatgatcagtacatcaaaggcaaagctaaaaaagcagcgaaagaaggccagccaaccaagaaaggggttgtattaggtgccggtattatgggtggtggtattgcctaccagtcagccttaaaaggtgtacctgtattaatgaaagacatcgctgtaccgtcgcttgatctaggcatggcggaagcagcaaaattactgaacaagcaacttgaacgcggtcgaattgatggcgttaagatggctaaagtattatcagggattacccctagcctacattacgcaggtgcggaagacgccgatattgtggtagaagcggttgttgaaaatccaaaaattaaagccgcggttttagctgaagttgaaagcaatgtatctgatacaacggttatcgcttctaacacctcaacgatccctattaatttattggcacaatccctaaagcgtcctgaaaatttctgtggcatgcacttctttaaccccgttcatcgtatgccgctcgtcgaaattatccgtggtgaacacacttcagaagaaacaatttcacgcgttgtcgcttacgcagccaaaatgggtaaatcgccgattgttgtcaatgactgcccagggttctttgtaaaccgtgtgctattcccatactttgccggctttagcttattgttacgcgacggtgctgactttacccaagtcgataaagtgatggagaaacaattcggctggccaatgggccccgcttacttgctcgacgtggttggtattgataccgcccaccatgcgcaagcagtaatggctgaaggcttcccagatcgtatgggtaaaaattacaaagatgctgttgatgtaatgtttgaacaacaacgctttggtcagaaaaatgggaacggcttctttgcctactcggtagatcgccgaggtaagccgaaaaagaatgttgatccagcagtagctgaattacttgcccctgttttaggtgctgcgacagactttacgagcgatgaaattattgcgcgtatgatgattccaatgatcaatgaagttgttcgttgtttagaagaatgcattatagccacaccagcagaagctgatatggcactggtttatggcttaggcttccctcccttccgcggtggtgtattccgctatatcgacacactaggcttagcggaatatgtcgcaatggcagataagtttgctcaccttggtgccgtttatgaagtacctactggcttgcgagaaaaagccgcgaaaggtgaaagttactacacacagcaagtaaacgcttaa

SEQ ID NO: 72294 - protein, 720 aa, Photobacterium profundum SS9
MIYQGETLSVRYLDDGIAELNLNAPGAVNKFDLKTLECLNEALNALYQQSDLKGLLITSDKDAFIVGADITEFLGLFAKPAEELSQWLTRANDIFNKLEDLPVPTLSAINGHALGGGCECVLATDFRLADITARIGLPETRLGIMPGFGGTVRLPRLLGADSAMEIITAGKDKKAQDALKLGLVDAVVAPTALKDAALSMIKDAIAGKLDWQKRRAQKKAPLTLNKIEATMSFTMAKAMVAQVAGKHYPAPMTAVIAIEAAARMSRDEALVVENKHFITLAKTDVAQSLVGIFLNDQYIKGKAKKAAKEGQPTKKGVVLGAGIMGGGIAYQSALKGVPVLMKDIAVPSLDLGMAEAAKLLNKQLERGRIDGVKMAKVLSGITPSLHYAGAEDADIVVEAVVENPKIKAAVLAEVESNVSDTTVIASNTSTIPINLLAQSLKRPENFCGMHFFNPVHRMPLVEIIRGEHTSEETISRVVAYAAKMGKSPIVVNDCPGFFVNRVLFPYFAGFSLLLRDGADFTQVDKVMEKQFGWPMGPAYLLDVVGIDTAHHAQAVMAEGFPDRMGKNYKDAVDVMFEQQRFGQKNGNGFFAYSVDRRGKPKKNVDPAVAELLAPVLGAATDFTSDEIIARMMIPMINEVVRCLEECIIATPAEADMALVYGLGFPPFRGGVFRYIDTLGLAEYVAMADKFAHLGAVYEVPTGLREKAAKGESYYTQQVNA

SEQ ID NO: 72295 - DNA, 2148 bp, Photobacterium profundum SS9
  CDS (1)..(2148): transl_table=11
atgacacagcatgaatctgcaaattcacaaccttccgctttctcgttaacgtttggcgataacggcgttgcttggttgaaaattgatgtgcccaacgaaagaatgaacacgttacaatcagcatttgttgatcaagtaacagatgttcttgcacagttgaaagataagaaagacattaaaggcatggtggtgtattccggcaagcctgacaactttatcgctggtgctgatattcgcatgttggctgcatgccaaacggcagacgaagcacagcaattagccgcaaaagggcaagagctgtttggtcaattagaagcattaccgtttcatgtagtcgctgccattcatggcccatgtttaggcggtggcttagagcttgctttagcctgtcatagccgagtatgtagtgatgatgataaaacacgcttaggtctgccagaagtacaattaggtttgctgcctggctctggtggcacgcagcgtttaccgcgcttaattggcgtggctaatgcgttagatatgattctaacgggcaagcagctacgtgcaaagaaagcgaaaaacctgggtcttgtcgaagaagcggtgccattaagtatcttgcttgatatcgctgaaaaacaagctctgaaaggtaagccaaaacgcaagggctcgttccaagagtgggcaatgggaggcaatgcactgggtcgttctgttgtttttgatcaagcagcgaaaaaaacacatgaaaaaacccgcggtaattatcccgccgcagacgccatattagacgtaatcaaatatggtctgcaacatggtatgaagaaaggcttagatcaagaagccaagcgttttggtgagctggtgatgacgtctgaatcggccgcattacgcagcatctttttcgcgacaacagccatgaaaaaagaatcaggttctgatgcactgccagcaacaatcaagaaggttggtgtgctgggtggtggcttgatgggcggtggtatcagccatgtaacggcaacgaaagccggctatcctgttcgaattaaagatatatcaaacgatggtattaaaaatgcccttgtttataacttcaagttactcgacaaacagcgtaaacgccgaatcatcagtaaggctgaactacaaaataaaatgttcagtattacgggtggtacaacatttactgggtttacgaatgtcgatgtggtgatagaagccgtttttgaagatattaatctaaagcaccaaatggtaaaagacattgagcagcaaacatcggattatacgatttttgcgagtaacacatcgtcattgcctatccatcaaatcgcagctgcagcagagcgtcctgaaaatgtggttggtttacactatttcagcccggtagaaaaaatgcccttggttgaagttattccacatcaaggcactgaaaatggcagtgcgacctctgagcagaccatcgctacagtcgtcgctttagcgaagaagcagggtaaaacgccgatagttgtcgctgataaagcgggtttttatgtgaaccgtattctagcgccatacatgaatgaagccgctgccgtgctattaagtggtgagccaatcgaacatatcgatcgttcattattggatttcggtttcccagtagggccaataaccttgctcgatgaagtcggtgtcgatattggtgcgaagatcagcccgatattattggctgaattaggcgaacgatttaaagcgccggatgtattcgatctattactgagtgatgatcgtaaggggcgcaagagcggtaaagggttctatctgtataatacaaagaagaaagaagttgataagagtgtttataaactgctttctttagaaccagagcaaaaagctgcggggcaagatattgcgcttcgctgtacgctaatgatgttgaatgaagcggcacgatgccttgatgaaggtgttattaaatcagcacgagatggtgatattggcgcaatcttcggcatcggtttcccaccattccttggcggtccattccgttatatggatacgttaggggctaaaagggtggtagaaatgctgaaggatcatactgacaaatacggtggacgttttacgccgtgtgacaagttggttgcgatggcaaatgaagagcaatctttctattcatag

SEQ ID NO: 72296 - protein, 715 aa, Photobacterium profundum SS9
MTQHESANSQPSAFSLTFGDNGVAWLKIDVPNERMNTLQSAFVDQVTDVLAQLKDKKDIKGMVVYSGKPDNFIAGADIRMLAACQTADEAQQLAAKGQELFGQLEALPFHVVAAIHGPCLGGGLELALACHSRVCSDDDKTRLGLPEVQLGLLPGSGGTQRLPRLIGVANALDMILTGKQLRAKKAKNLGLVEEAVPLSILLDIAEKQALKGKPKRKGSFQEWAMGGNALGRSVVFDQAAKKTHEKTRGNYPAADAILDVIKYGLQHGMKKGLDQEAKRFGELVMTSESAALRSIFFATTAMKKESGSDALPATIKKVGVLGGGLMGGGISHVTATKAGYPVRIKDISNDGIKNALVYNFKLLDKQRKRRIISKAELQNKMFSITGGTTFTGFTNVDVVIEAVFEDINLKHQMVKDIEQQTSDYTIFASNTSSLPIHQIAAAAERPENVVGLHYFSPVEKMPLVEVIPHQGTENGSATSEQTIATVVALAKKQGKTPIVVADKAGFYVNRILAPYMNEAAAVLLSGEPIEHIDRSLLDFGFPVGPITLLDEVGVDIGAKISPILLAELGERFKAPDVFDLLLSDDRKGRKSGKGFYLYNTKKKEVDKSVYKLLSLEPEQKAAGQDIALRCTLMMLNEAARCLDEGVIKSARDGDIGAIFGIGFPPFLGGPFRYMDTLGAKRVVEMLKDHTDKYGGRFTPCDKLVAMANEEQSFYS

SEQ ID NO: 72297 - DNA, 2010 bp, Haloarcula marismortui ATCC 43049
  CDS (1)..(2010): transl_table=11
atgagagaaacgttgaagcctcggccggcagtggaacgatatgtcatggatttcgaggatattgacactatcgccgtgctcggtgccgggaatatgggccatggaatcaccgaagtggccgcgctcgcaggctacgacgtgcggatgcgagacatcaaagacgagttcgtcgaggacggctacgacaacatcgagtggtcgctgaacaagctggccgagagagaccagctcacccaggaggaagccgatgcggcgcttgaccgcgtcacgccgctggtcgatgtcgaggaagcagtcagcgacgtcgacgtggtcatcgaagccgtgccggagaaaatggagatcaagaaggacgtgtacacagaggtcgaagaacacgcgcccgaaaacgccatcttcgccaccaatacatccagcctctccatcacggagttgtcggaagtgaccgagcggcccgagcagttctgtgggatgcacttcttcaatccgccggtgcggatgcaactggtcgaggtcatctccggcgcacactcgggcgacgacacgctggaagccatcgaggcgcttgccgaagacttcggcaaaacaccggtccgcgtccgcaaggactcgccgggattcatcgtcaaccgcatcctcgtcccgctgatgaacgaggccgcgtggctcgtccacgacgacgcggcgaccatcgccgaggtcgactcgacgacgaagttcgacatgggcctgccgatggggtcgttcgaactctcggaccaggtcggcaacgacgtggggctgcacgtgcttgagtacatgcacgaggtcctcggcgagccgtacgccccgtgtccgctgctcgaagagaaggtcgagaacgaggaactcgggaagaagaccgggaagggcttctacgactatgagaacggcggcgtcgacattccgacggatgccggccgcgaagatgtcgagcaccgcctcgtcgccgtgatggcaaacgaggtcgggaaactcgtcgagaacgacgtcgctcccgttgcagacattgaccaggccgtccagctcggcggcggcttcccggacggtcccgcaaaaatcgccgacaagaccggtctggagacgcttatcgacacactcgaggaaacccacgaggagaccggcgcggaccgctatgccgtcgctgacggcctccgagaggccgccgagtcgggcggcttctacggcagcgacgacgatgcgccggcggagttcgacaacgtcaccgtcgaatatcccggtgacatggtcggtcacatcgaactcgaccgcccgcaccggatgaacaccgtcagcccggacctgatggacgaccttgccgacgccgtcgacctgctcgaaaatgacgacgaggtgcgtgccatcctgctgaccggagccggcgacaaggcgttctccgccggggccgacgtgcaggcgatggcctcgaacgcgacgccgctggacgccattgaactctcccgcaagggccagcaaaccttcggcaagcttgaggaatgctcgatgccagtcgtcgccggaatcgacggctacgcgctgggcggcgggatggaactggcgacctgtgccgacctccgcgtggcctcggaacgctccgaactgggccagcccgaacacaacctcggcctactgccgggctggggtggcacgcaacgcctcgctcgcatcgtcggcgaaggccgcgccaaggagattatcttcaccggtgaccgttacgacgccgacgagatggccgagtacggcttcatcaacgaggttgtcgacaacgacgctctgcacgagcgggcgctggagatggccaaagacatggccgccggcccgccggtcgcacagaaactcaccaagcgcgccatgctcgccggccgcgacgacatcgacgctggcctcgaagtcgaatcacaggccttcggccacctcatcgggaccgacgacgtgatggagggcatcaacgcgttcatgggcgacggagagccggacttcgaagggaagtaa

SEQ ID NO: 72298 - protein, 669 aa, Haloarcula marismortui ATCC 43049
MRETLKPRPAVERYVMDFEDIDTIAVLGAGNMGHGITEVAALAGYDVRMRDIKDEFVEDGYDNIEWSLNKLAERDQLTQEEADAALDRVTPLVDVEEAVSDVDVVIEAVPEKMEIKKDVYTEVEEHAPENAIFATNTSSLSITELSEVTERPEQFCGMHFFNPPVRMQLVEVISGAHSGDDTLEAIEALAEDFGKTPVRVRKDSPGFIVNRILVPLMNEAAWLVHDDAATIAEVDSTTKFDMGLPMGSFELSDQVGNDVGLHVLEYMHEVLGEPYAPCPLLEEKVENEELGKKTGKGFYDYENGGVDIPTDAGREDVEHRLVAVMANEVGKLVENDVAPVADIDQAVQLGGGFPDGPAKIADKTGLETLIDTLEETHEETGADRYAVADGLREAAESGGFYGSDDDAPAEFDNVTVEYPGDMVGHIELDRPHRMNTVSPDLMDDLADAVDLLENDDEVRAILLTGAGDKAFSAGADVQAMASNATPLDAIELSRKGQQTFGKLEECSMPVVAGIDGYALGGGMELATCADLRVASERSELGQPEHNLGLLPGWGGTQRLARIVGEGRAKEIIFTGDRYDADEMAEYGFINEVVDNDALHERALEMAKDMAAGPPVAQKLTKRAMLAGRDDIDAGLEVESQAFGHLIGTDDVMEGINAFMGDGEPDFEGK

SEQ ID NO: 72299 - DNA, 1965 bp, Haloarcula marismortui ATCC 43049
  CDS (1)..(1965): transl_table=11
atgcgagctgaccagccagagatagcgacagttgcagtgctcggtgcgggaacgatgggccacggcatcgccgaggtcgcggcaatcgccggctacgatgtcgtgctgcgtgacatcgatgcagccatcgtcgaagacggctacgacgaaatcgagtggtcgctcgaaaagctcgccgagaagggacgactcgacgaggaccccgacgacgtggcggcgcgggtcgcgacgacgaccgatcttgaggcggcagtgagcgacgcggatctggtcatcgaggccggcccggaacagctctcggtgaaacaggacatcttcgagtccgtcgacgccgcagcgcccgcggatgcactgttggcgacgaacagctcctcgctgtccattacagagattgccgcagcgacggagcggccggaatcggtgctgggtctgcacttcttcaatccgccggtgaagatggacctcgtcgaagtcatctacggcaaggcaacgaccgacgagacagcccagcgcggctacgagttcatcgaatcgctcggcaagacgccgatatacgtccgcaaggacgtgcgtgggtttgtcgtcaactccgtcctcgggccgttcatgagcgagccggcctggatggtctcggcgggcgaggcgaccatccggcaggccgatgccgcgatggtccacgagcggggctacccgatgggcccgttcgaactcggcgacctgaccggcatcgacatcggctaccacgtccggacggaggccgggaggccggtcccgcccatcatggcggagaaagtcgagaacgggaaccttggccgcaagaccggcgagggctactacgactacgacgacggggacggctcggactacgtccctgaagacagcgaggggttcgatcaccgccgcgtcgaggcagtgatggcgaacgaggccgcaaagctcgtcggcgacgacgtggcgacggcggaggccatcgacacggggatgcaactcggcgcgggcttccccgagggaacctgccggcgggccgacgacatcggtctcgacaccatcctcgaaaaactccgagcgctctccgacgaacacagtgacgaccgctacgagccggccgactacctcgtcgaactcgtcgaggccggccacaccggcacggaagcgggccggggcttccacgagtacgacaccggcgacggcctgggcgactaccacaccatcaactgggaactcgacgacgatggcctgctggaagtggaactcgaccgcccgtcgcggatgaacgctatcagcgaaaccctcgcggacgaggttgttgacctgctctcgtcggtcgatgatgacgaagtccgggccgtcgtgttcgaaggggccggcgaccgcgccttctctgccggggccgacatctccggctttgcggaccgcgaccccgcacagacatcggagccgacggacgtgttcacgacggtcgccgagtatccccgaccgacgctggcgcgcatcgacggctactgtctcggggcgggcctggagcttgccctcgcctgtgacctccggctggcgacgaccgactcggagttcggcttccccgaaatcacgctcggcctgctacccggcggcggcgggacccagcgcgcgatccgaatgttgaccgacgcccgggcgaaggaactcgtgttccgcggcgagcacatctccgccgagcgggcggccgactggggactcatcaaccgggccgtcgacgccgacgagttcgatgacgtggtcggggagttcgtcgatgacctcgtttcagggccgccgattgccctgcggaaggccaagcgcgtgatgaacgagggggccgacgagagtctcgacgccggcctcgaaatggagagccaggcctttgcgctcctgttgaccactgacgacgtagcggaagggacggcggcctttgcagccgaccgcgaaccggagttcgagggagagtag

SEQ ID NO: 72300 - protein, 654 aa, Haloarcula marismortui ATCC 43049
MRADQPEIATVAVLGAGTMGHGIAEVAAIAGYDVVLRDIDAAIVEDGYDEIEWSLEKLAEKGRLDEDPDDVAARVATTTDLEAAVSDADLVIEAGPEQLSVKQDIFESVDAAAPADALLATNSSSLSITEIAAATERPESVLGLHFFNPPVKMDLVEVIYGKATTDETAQRGYEFIESLGKTPIYVRKDVRGFVVNSVLGPFMSEPAWMVSAGEATIRQADAAMVHERGYPMGPFELGDLTGIDIGYHVRTEAGRPVPPIMAEKVENGNLGRKTGEGYYDYDDGDGSDYVPEDSEGFDHRRVEAVMANEAAKLVGDDVATAEAIDTGMQLGAGFPEGTCRRADDIGLDTILEKLRALSDEHSDDRYEPADYLVELVEAGHTGTEAGRGFHEYDTGDGLGDYHTINWELDDDGLLEVELDRPSRMNAISETLADEVVDLLSSVDDDEVRAVVFEGAGDRAFSAGADISGFADRDPAQTSEPTDVFTTVAEYPRPTLARIDGYCLGAGLELALACDLRLATTDSEFGFPEITLGLLPGGGGTQRAIRMLTDARAKELVFRGEHISAERAADWGLINRAVDADEFDDVVGEFVDDLVSGPPIALRKAKRVMNEGADESLDAGLEMESQAFALLLTTDDVAEGTAAFAADREPEFEGE

SEQ ID NO: 72301 - DNA, 2178 bp, Salmonella enterica subsp. enterica serovar Paratypi A str. ATCC
  CDS (1)..(2178): transl_table=11
atgctttataaaggcgacaccctgtacctcgactggctggaagatggcatcgccgaactggtgttcgatgctccaggctcggtcaataaactcgacaccgcaaccgtcgccagcctcggccaggcgcttgaggtgctggaaaagcaacacgatttaaaagggctgctgctgcgctctaataaagcggcctttattgtcggcgcggacatcaccgaatttctttcactgttcctcgtccccgaagagcagttaagccaatggctgcatttcgctaatagcgtctttaaccgtctggaagatttacccgtaccgacccttgccgccgtaaacggctatgcgctgggcggcgggtgtgaatgcgtgctggcgaccgattaccgtctggcgacgccagacctccgtatcggcctgccggaaactaaactgggcatcatgccgggtttcggcggctccgttcgtctgccgcgtatgctgggcgcggacagcgcgctggagattatcgcggcaggtaaagatgtcggtgctgagcacgcgctgaaaatcggccttgtggacggcgtggtcaaacaagagaagctaattgaaggcgcgatagcggtgttacgccaggccattaccggcgatctcgactggagagctaaacgccagccgaaactggaaccgttgaaactcagcaaaattgaagcagcgatgagctttactatcgctaaaggcatggtcgcacaaacggcgggtaaacattatccggcgccgatgaccgcagtgaaaaccattgaagccgccgcgcgttttggtcgtgaagaagcgctgaatctggaaaataaaagctttgttccgctggcgcataccaatgaggctcgtgcgctggtcggtatcttcctcaacgatcaatatgtaaaaggtaaagccaaaaagctgaccaaagatattgagacgccgaaacaggcagccgtactgggcgcgggcattatgggcggcggtatcgcttaccagtcggcctggaaaggcgtaccggtcatcatgaaagatatcaacgataaatcgttgaacctcggcatgaccgaagcggccaagctgctgaacaaacagctggaacgcggcaagatcgacggtctgaagctggcgggcgtcatttcgaccatccacccgactctcgattatgccggtttcgatcgtgtagatgttgttgtcgaagcggtggtcgaaaatcccaaagtcaaaaaagcggtactggcggaaaccgagcagaaagtgcgcccggaaaccgtgctggcctcaaatacctctaccatcccgattggcgaactggcaagcgccctggaacgtccggaaaacttttgcggaatgcacttcttcaacccggtacaccggatgccgctggttgaaatcattcgcggcgagaagagttcagacgaaaccattgccaaagtcatcgcctgggcaagcaaaatgggcaagacgccgattgtagtcaacgactgccccggcttctttgttaaccgcgtgctgttcccctatttcgccggtttcagtcaactgctgcgcgacggcgcggatttccgcaaagtcgataaagtgatggaaaaacagttcggctggccgatgggcccggcctatctgctggatgttgtcggcattgataccgcgcatcacgcgcaggcggtaatggcggcaggcttcccgcaacggatgcagaaagagtatcgcgatgcgatcgacgctctgtttgatgctaaccgtttcggacagaaaaacggtctgggcttctggcgctataaagaagacagcaaaggcaagccgaagaaagaagaagatgccgcggtggatgacctgctggcaagcgtcagccagccgaaacgcgacttcagcgacgacgagataatcgcccgtatgatgatcccgatgattaacgaagtggttcgctgtctggaagaaggcattatcgcaagcccggcggaagccgatatggcgctggtctacggcctgggcttccctccgttccacggcggcgcattccgctggctggatacacagggcagcgcgaaatatcttgatatggcgcagcagtatcaacacctcggcccgctgtatgaagtgccggaagggctgcgtaataaagcgcgccataacgaacctattatcccccggttgaaccagcccgtccggttggttctctga

SEQ ID NO: 72302 - protein, 725 aa, Salmonella enterica subsp. enterica serovar Paratypi A str. ATCC
MLYKGDTLYLDWLEDGIAELVFDAPGSVNKLDTATVASLGQALEVLEKQHDLKGLLLRSNKAAFIVGADITEFLSLFLVPEEQLSQWLHFANSVFNRLEDLPVPTLAAVNGYALGGGCECVLATDYRLATPDLRIGLPETKLGIMPGFGGSVRLPRMLGADSALEIIAAGKDVGAEHALKIGLVDGVVKQEKLIEGAIAVLRQAITGDLDWRAKRQPKLEPLKLSKIEAAMSFTIAKGMVAQTAGKHYPAPMTAVKTIEAAARFGREEALNLENKSFVPLAHTNEARALVGIFLNDQYVKGKAKKLTKDIETPKQAAVLGAGIMGGGIAYQSAWKGVPVIMKDINDKSLNLGMTEAAKLLNKQLERGKIDGLKLAGVISTIHPTLDYAGFDRVDVVVEAVVENPKVKKAVLAETEQKVRPETVLASNTSTIPIGELASALERPENFCGMHFFNPVHRMPLVEIIRGEKSSDETIAKVIAWASKMGKTPIVVNDCPGFFVNRVLFPYFAGFSQLLRDGADFRKVDKVMEKQFGWPMGPAYLLDVVGIDTAHHAQAVMAAGFPQRMQKEYRDAIDALFDANRFGQKNGLGFWRYKEDSKGKPKKEEDAAVDDLLASVSQPKRDFSDDEIIARMMIPMINEVVRCLEEGIIASPAEADMALVYGLGFPPFHGGAFRWLDTQGSAKYLDMAQQYQHLGPLYEVPEGLRNKARHNEPIIPRLNQPVRLVL

SEQ ID NO: 72303 - DNA, 2157 bp, Idiomarina loihiensis L2TR
  CDS (1)..(2157): transl_table=11
atgatctatcaaggtgaaagcattcgggtcgattttatcgaaccaggtttcgcagaattacaatttgatgcgaaaggctcggttaataaattcgaccaggctacattagaagaattcagtgaagcactgacaaaattacagaacactgacgatttacgtggcgttattgttaccagcagcaaatcgacctttattgtcggcgctgacattaccgagttcctgacgctattctctgatcaggaaaaaacccgcagctgggtggcaaaagcctcacgcgtgtttgatcaattagaagacctgccagttccaaccgttggagccgtaaccggattcgcactgggcggcggttgtgaagcattgttagcctgtgactaccgtgttgcggacaccacagcaactatcggcctgccagaagttaaactgggtcttatcccgggctttggcggcaccatgcgtttacctcgcgtgattggtccggacaacgcgcttgagtggataaccacaggtaaaaacaacaaagcccttgatgcgctgaaagttggtgctgtggatgcggttgttgaaccggaaaacctgactaaagccgcactcaacttagctaaagccgcagcagccggtcagcaggactggaaagcgaagcgtcagcctaagttagagccgctgaaagctaacgacaccgagctgatgatgacgctggttaccgccaaaggcatgattgcagcgaaggccggtaagcactatccggcaccgcacaaagcgttagaagccattgaaaacggtgcccgcgagcatcgtgaaggcgcgctaacagctgaaaacaacgcgtttttcgacctcacccaaaccgaggcttgtcaggctcaggttggtatcttcctggcggatcaggcagttaaaggtaagtcgaaaaaatacgctaaagctgcaaccaaagaaattaagacagcaggtgttttaggtgccggcattatgggcggcggtatcgcttaccagtcagcgcttaaaggcgtaccggctgttatgaaagacattaagcaagacgctttagacttaggcatgaaagaagccggcaagatcctgaaaaaaggtgttgagcgcggtaaggtaaacaacgagaagatgattaaaatcttgtcttctattacgcctacgttgctgaatgacgcagtcaaagacgtcgatattgtcgtagaagccgttgtcgaaaacccgaaagttaaaggctcggtgctggctgaaattgaaggcgtaattggcgatgatgccattttgacttcaaatacctcgaccatttctattactgaactggctaagaacctgaagcgccctgagaaattctgcggaatgcactttttcaacccggtacacaaaatgccattggttgaaattatccgtggcgagaaaacctcagatgacaccgttaatgcggtagtcgcctatgcgcttaaacttggcaaaacccctatcgttgttaacgactgccctggcttcttagttaaccgcgtattgttcccttacctggcaggctttgccggtatggttgatgaaggcgtcgatttcgtcggcatcgacaaggttatggagaagcagttcggttggccaatgggtcctgcgtacttaagcgatgttgttggtatagacacagctgatcattgtaccgttgttatggaagcaggcttcccgacccgcatgaaacgcgacgagtccagcgccattgctaaactggcagctgctgagcgttacggtcagaaaaacggcaaaggcttctatgtttacggcaccgacaaaaaaggtaagccaaccaaagaagcggatcctgccacttacgagctattaggctgtgagcaaggcaagaaactggatgctgatgaagtcattgcacgctgcatgatccctatggtgaacgaagtggttcgctgtctggaagaagacattgttggctctgctgccgaagcagacatggcgctgctttatggcttaggcttccctccattccgcggcggccctttccgttatctggaaacgcttggcatggacaactttattcaactggcagacaagtacgcgcacctgggtgaaatttatcaggttaccgacggcatgcgcgaaatggctaaagccggtaaatcttactttgacacaaccagcgcgaagtaa

SEQ ID NO: 72304 - protein, 718 aa, Idiomarina loihiensis L2TR
MIYQGESIRVDFIEPGFAELQFDAKGSVNKFDQATLEEFSEALTKLQNTDDLRGVIVTSSKSTFIVGADITEFLTLFSDQEKTRSWVAKASRVFDQLEDLPVPTVGAVTGFALGGGCEALLACDYRVADTTATIGLPEVKLGLIPGFGGTMRLPRVIGPDNALEWITTGKNNKALDALKVGAVDAVVEPENLTKAALNLAKAAAAGQQDWKAKRQPKLEPLKANDTELMMTLVTAKGMIAAKAGKHYPAPHKALEAIENGAREHREGALTAENNAFFDLTQTEACQAQVGIFLADQAVKGKSKKYAKAATKEIKTAGVLGAGIMGGGIAYQSALKGVPAVMKDIKQDALDLGMKEAGKILKKGVERGKVNNEKMIKILSSITPTLLNDAVKDVDIVVEAVVENPKVKGSVLAEIEGVIGDDAILTSNTSTISITELAKNLKRPEKFCGMHFFNPVHKMPLVEIIRGEKTSDDTVNAVVAYALKLGKTPIVVNDCPGFLVNRVLFPYLAGFAGMVDEGVDFVGIDKVMEKQFGWPMGPAYLSDVVGIDTADHCTVVMEAGFPTRMKRDESSAIAKLAAAERYGQKNGKGFYVYGTDKKGKPTKEADPATYELLGCEQGKKLDADEVIARCMIPMVNEVVRCLEEDIVGSAAEADMALLYGLGFPPFRGGPFRYLETLGMDNFIQLADKYAHLGEIYQVTDGMREMAKAGKSYFDTTSAK

SEQ ID NO: 72305 - DNA, 2127 bp, Idiomarina loihiensis L2TR
  CDS (1)..(2127): transl_table=11
atgagtcaggataaagcattcactatggaagttagggacgacggcgtcgctgtaattacgattgatgtccctggtgagtcgatgaataccttaaaagactcatttgccgaagaagttggcagtttgatgaatcgcttagaaagcgatgattcagtcaaaggtgtggtttttattagtggtaagccaggctcctttattgccggtgctgatatcaacatgatagacggttgtgaaaatgccgtggacgcagaaagtctggcgcgaaaagggcaggctatgtttgatcgcatcgagcagttaaatgtgcctgtggttgcggctattaacggagcttgcctgggtggtggactggaactggccatggcttgtcatgtaagagtttgtaccgacaacagcaagacagctctgggcttacctgaagtgaaattaggcttgttaccgggcagtggtggtacgcaacgtctgcctgaactggttggtgttcagcaaggactgacgatgatcctgaccggtaaagaactgcgtgctaaacaggctttgaaagcaggacttgtcaccgaggttgttccccaaagcatattgttggatgttgccgttgagcacgcgttaaaacgtaagccaaaatcaactaagccgccacttaagggcattagtaaagtgctggaggcgaccaagtttggccgtgacattatctttaaaaaggccagtgagcaggcgcagaagaaagctcagggcaattacccggcaattgataaaatcattcagacggtgcgtgaaggtgttgaacgtggccgcgaagctggcctggataaggaagcccgtagctttggtgagttggcaatgacgccagagtcttatcagctgcgccagattttctttgccaccacagaaatgaaaaaagaaaccggcgccgatggcgttaaacctgattcggtcaaacgggttggcgttttaggtggtggattgatgggcggcggtattgcctatgttacggcggctaaagcaggtattcctgcacgtatcaaggacatcgctgaagacggaattcgacatgcattacattacagttacgagcgtctagataaaaaagtgaaacgtcggcatatgcgccgggccgagcttgaaaagaccatgctaatgctgagcggttcgcttgattacagtggatttgagcgtaccgacgtggttattgaagcggtatttgaagaccttaacctgaagcaaaaaatggttgctgatgtggaggagcacgcagacgagtcgaccatttttgcaactaatacgagctcactgcctattactcaaatagcggctaaagccaagcgcccggaacaggttattgggctccactatttttctccggtcgataaaatgccgttggcggaaattattacccatccgggtacttccgataagacaatagccacaacggtttctctggccaagaagcagggtaaaactccgatagtggtgaaagatggtgccggattctatgtaaaccgaattcttgcgccctacatgaacgaagctgcgcgcttgctgttagccggagagcctattgagcatatcgataaaaccttagtgaaatttggtttcccggtagggccaattactttactggatgaggttggtatcgatgttgcggcaaaagtggctccggtattggtgaaagagctgggtgatcgttttgaagcgcctgaagcttttgagaagctgattgacgacgaccgtaaaggtaagaaaaaccaaaaaggcttttatcaatacggcaagagtgtaaagggtaagccggtagacacttcagtgtattctttgctggatattgatccgaacgagagcaagtctgcggacgaaattattgatatttgtttattgcccatgctgaatgaagctgcttactgtttgcaggaagagattattcgcagtcctcgcgacggtgatattggtgcaattttcggtatcggtttcccacctttccttggcgggccattccgttatatggacagccaggggcttgaaacgatagtgaataagctagagaagctggcagcagaacgtggcgaacgatacacgcctgcacctttgttgaagcaaatgctggaaaatggctggaatttctatcaatag

SEQ ID NO: 72306 - protein, 708 aa, Idiomarina loihiensis L2TR
MSQDKAFTMEVRDDGVAVITIDVPGESMNTLKDSFAEEVGSLMNRLESDDSVKGVVFISGKPGSFIAGADINMIDGCENAVDAESLARKGQAMFDRIEQLNVPVVAAINGACLGGGLELAMACHVRVCTDNSKTALGLPEVKLGLLPGSGGTQRLPELVGVQQGLTMILTGKELRAKQALKAGLVTEVVPQSILLDVAVEHALKRKPKSTKPPLKGISKVLEATKFGRDIIFKKASEQAQKKAQGNYPAIDKIIQTVREGVERGREAGLDKEARSFGELAMTPESYQLRQIFFATTEMKKETGADGVKPDSVKRVGVLGGGLMGGGIAYVTAAKAGIPARIKDIAEDGIRHALHYSYERLDKKVKRRHMRRAELEKTMLMLSGSLDYSGFERTDVVIEAVFEDLNLKQKMVADVEEHADESTIFATNTSSLPITQIAAKAKRPEQVIGLHYFSPVDKMPLAEIITHPGTSDKTIATTVSLAKKQGKTPIVVKDGAGFYVNRILAPYMNEAARLLLAGEPIEHIDKTLVKFGFPVGPITLLDEVGIDVAAKVAPVLVKELGDRFEAPEAFEKLIDDDRKGKKNQKGFYQYGKSVKGKPVDTSVYSLLDIDPNESKSADEIIDICLLPMLNEAAYCLQEEIIRSPRDGDIGAIFGIGFPPFLGGPFRYMDSQGLETIVNKLEKLAAERGERYTPAPLLKQMLENGWNFYQ

SEQ ID NO: 72307 - DNA, 2037 bp, Azoarcus sp. EbN1
  CDS (1)..(2037): transl_table=11
gtgatgggggcgcactacgaacatctgcgcctcgtgcgcgacgagggagatggagagggggccggggacggcgtcgcgtggctgcatctggactgtcgcgacgcggcgacgaatacgctgtcgcgcgcggtgctcgacgaactcgcggccgtgttcgccgcgctcgaagcgcagccgccgaaagggctcgtcatcgcgtcggcgaaacccgccggtttcatcgccggagccgatatcgaggaattcacgcgcctcgactcgccgcaggcagcgcgcgatctggtcggccgtggctgggagctcttcaaccggctcgtgcgcctgcgctttccgacgctcgcgctgattcgcggccattgcctcggcggcgggctggaactcgcgctcgcgtgccgctaccgcgtcgtcgtcgacgagcctgcgacgaagctcgcgctgcccgaagtgatgctcggcatcgtgcccgcgtggggcggcatgaagcggctgccggagacgatcggcgcaccggcggcgctcgacctgatgttgaccggaaagagcgtcgacgcgcgccgcgcgaagcagctcgggctcgccgacgagtgcgtgccgccgcgcgtcatggagaacgccgcgcgcatgctcgtgctgtcccgccagcggcggcgaaagccgcccctcgcgttgcggctgatgaacggtccgctgaagtcggtcgtcgccgaccgggcgaggaagcaggtcgcctcgaaggcgccgcgcgagcattacccggcgccgtacgcgatcgtggacatctggcagcgtttcggcggcaacgcgctggcggtgccggccggccatccggcgtcgctcgaagcgatcttgcgctcgccgacggcgaagaacctcatccgcgttttcttcctgcaggagcggctgaaaggtttcggcaagagtgatgacaacagcggggacctcgcgccgcgccgtgtgcatgtcgtcggcgccggcgtcatggggggcgacatcgcggcggtgtgcgcgctcgcgggcatgacggtgacgctgcaggatcaggccgtcgagcgcatcgcgccggccgtcggccgcgccgcgaagctcttcgagcgcaagctgcgcggcgacacggcgacgaaagcgcggcaggtgcgcttcgccctcgaccggctgatcccggacccgcacggccatggcgcgcggcgcgccgatgtcgtcatcgaggcgatcttcgagaatctcgacgcgaagcgcgcgctgttcgcacagctcgagcgccgcgccagacccgacgccgtgctcgcgacgaacacgtcgagcctgcgcatcgaggacatcggcgcggaactcgcgaacccggcgcgcctcgtcggcatccatttcttcaacccggtcgcgcagatgccgctcgtcgaagtcgtcgccggcgaggcgtcggatgccgacgcgctctaccgcgccgcggcgttcgtccgccgcctcgacaagctgccgctgccggtccgcagcgcgccgggcttcctcgtcaacgcggtgctcgggccatacatgctcgaagcgctgcgctgcgtcgaggaaggcgtcgcgccggaagccgtcgacgcggcgctggtcgcgttcggcatgccgatgggacccgtcgagctcgttgacacggtcggactcgatatcgcgctcgccgccggcagggcgctcggcgggggcgcagtcgcagtgccgaaacggctcgcggagctcgtcgccgccggccatctcggcaggaagtccggccagggctattaccgctggagcgacggcaaggcgcagaaaaccccggtcgacactgtccccgcggggctcgccgcgcgcatcgtcgcaccgctcctcgccgcgacgcgacgatgcgtcgatgaaggcgtcgtcgccgatgcggatctcgccgatgccggcgtgatcttcggcaccggcttcgcgcctttcaccggcggcccgctgcactatctggcgtccgtcggggaaaaaccgctcgacgcggcatcggcgcgccgggatgatgctatcgtttcggcccgatga

SEQ ID NO: 72308 - protein, 678 aa, Azoarcus sp. EbN1
MMGAHYEHLRLVRDEGDGEGAGDGVAWLHLDCRDAATNTLSRAVLDELAAVFAALEAQPPKGLVIASAKPAGFIAGADIEEFTRLDSPQAARDLVGRGWELFNRLVRLRFPTLALIRGHCLGGGLELALACRYRVVVDEPATKLALPEVMLGIVPAWGGMKRLPETIGAPAALDLMLTGKSVDARRAKQLGLADECVPPRVMENAARMLVLSRQRRRKPPLALRLMNGPLKSVVADRARKQVASKAPREHYPAPYAIVDIWQRFGGNALAVPAGHPASLEAILRSPTAKNLIRVFFLQERLKGFGKSDDNSGDLAPRRVHVVGAGVMGGDIAAVCALAGMTVTLQDQAVERIAPAVGRAAKLFERKLRGDTATKARQVRFALDRLIPDPHGHGARRADVVIEAIFENLDAKRALFAQLERRARPDAVLATNTSSLRIEDIGAELANPARLVGIHFFNPVAQMPLVEVVAGEASDADALYRAAAFVRRLDKLPLPVRSAPGFLVNAVLGPYMLEALRCVEEGVAPEAVDAALVAFGMPMGPVELVDTVGLDIALAAGRALGGGAVAVPKRLAELVAAGHLGRKSGQGYYRWSDGKAQKTPVDTVPAGLAARIVAPLLAATRRCVDEGVVADADLADAGVIFGTGFAPFTGGPLHYLASVGEKPLDAASARRDDAIVSAR

SEQ ID NO: 72309 - DNA, 2145 bp, Silicibacter pomeroyi DSS-3
  CDS (1)..(2145): transl_table=11
atgggtgattttcactacgcaaaggatgccgatggcatcgtcaccgtgaccatgaacatggacgggccggtcaacgcgatgaatgccgagttctggccgctgtttgccgcgaccatggaccggatcgaggcggagccggagctgaaaggcgtgatctggacctcggccaaggacacgttctttgccgggggcgacctgaagatgctgaaaagcatcgagcccgacggggtcgaggcgcttttccgatccgtcgaggcgaccaaggccgtgatgcggcggatggagaagcagcctgtgccccatgtcgccgcgatcaatggcgccgcacttgggggcgggttcgagatctgtctggcctgcaaccaccgcatcgccgccgacaatccaaaaaccaagatcggcctgccagaggtcacgctgggcctgctgcccggcggtggcggcactgtgcggttgacctggcttctgggtctggaaggcgcgatgcccttcctgctcgaagggcgacaggtgtccccagacaaggcgctcaaggccgggctgatccatcaggtggtgcccgcagatcaactcctgacccgtgccaaggaatacatcctgtcggtgcagggggatgcggcggcggtgactcagccctgggataccaagggttacaagatccccggcgggccatcgaccgcgccccataacatgacccgtatcgcgggcgccgccgcaatgctgttcaagaagacacgcgggctgatgcctgcgcccacgcgtatcctcgacatcatgaccgaggcagcgggcaaggtcgatttcgacaccgccacgcgctatgaaagccgccgtttcgtctcactgaccccgctggcgagcaccaagaacatgatcgaaacgctgtttttcggcatgaacaaggtcaatggcggcgccagccggcccaagggcgtgccgacctccaaggtgcagcgcctgggcattctgggcgcgggcatgatgggtcagggcatcgccttttcagcggccacggcagggctgcccgtggtgctcaaggaccagacgctagaggcggccgagcgtggcaaggcctataccgccaccctgctcgacaagcgggtcaaacagggccggatgagcgccgaggagcgcgaggcggtgctggccttgatcacgccgaccgacaaggccgacgacctgaaaggctgcgacctgatcatcgaggcggtgttcgaaaagatcgacatcaaggatgcggttctggccgagcatgaggcgctgctcgctgaaaacggcatctgggggtccaatacctcgaccctgccgatcacgcggctggccacgggcgccacacggcccgagaacttcgtcggtctgcatttcttctcacccgtcgacaagatgccgctgttggagatcatcgcgggcgagaagacctcggacgagacgctggcgcgcgccttcgactttgcccgccagatccgcaagaccccgatcatcgtgggtgacagcacggggttctatacctcgcgcaccatcggcaccaagatcatcgaggcggtggaactggtggccgaaggccacgacccgctgcgcgtcgacaacctgtcgcgcctcaccggcatgcccaccggcatgctgtcgctgcttgacgaggtgcagatcaagctggtgaccgatatctacaacacccaggtggaaatgggcctcttggaccctgacaaggaacagaacccggccgcccgcgccatgctggccgagatgatcagccagcacggccgccatggccgcgccaccggcaaggggttctatgactatgacggacagggcaagacgatctggccgggactggccgcctggcgcaaggagggggccgacattccagacgcggatatcaaggaccgcatcctgttccgcgccgtgctggaaagcctgcgctgtctggaggaaggcgtgctgcgcacggtcgaggatggcaatatcggctcgatccttgggatcggcgcgccggttcataccggcggctatctgcaatatgtgaacacctacggcccggcgcggttcctggcccggtgcgaggagctggcgggcaaatacggagaccggttcgccccacccgagatcctcagaacacatgtcgccgagggccgcgccctggcctga

SEQ ID NO: 72310 - protein, 714 aa, Silicibacter pomeroyi DSS-3
MGDFHYAKDADGIVTVTMNMDGPVNAMNAEFWPLFAATMDRIEAEPELKGVIWTSAKDTFFAGGDLKMLKSIEPDGVEALFRSVEATKAVMRRMEKQPVPHVAAINGAALGGGFEICLACNHRIAADNPKTKIGLPEVTLGLLPGGGGTVRLTWLLGLEGAMPFLLEGRQVSPDKALKAGLIHQVVPADQLLTRAKEYILSVQGDAAAVTQPWDTKGYKIPGGPSTAPHNMTRIAGAAAMLFKKTRGLMPAPTRILDIMTEAAGKVDFDTATRYESRRFVSLTPLASTKNMIETLFFGMNKVNGGASRPKGVPTSKVQRLGILGAGMMGQGIAFSAATAGLPVVLKDQTLEAAERGKAYTATLLDKRVKQGRMSAEEREAVLALITPTDKADDLKGCDLIIEAVFEKIDIKDAVLAEHEALLAENGIWGSNTSTLPITRLATGATRPENFVGLHFFSPVDKMPLLEIIAGEKTSDETLARAFDFARQIRKTPIIVGDSTGFYTSRTIGTKIIEAVELVAEGHDPLRVDNLSRLTGMPTGMLSLLDEVQIKLVTDIYNTQVEMGLLDPDKEQNPAARAMLAEMISQHGRHGRATGKGFYDYDGQGKTIWPGLAAWRKEGADIPDADIKDRILFRAVLESLRCLEEGVLRTVEDGNIGSILGIGAPVHTGGYLQYVNTYGPARFLARCEELAGKYGDRFAPPEILRTHVAEGRALA

SEQ ID NO: 72311 - DNA, 2046 bp, Silicibacter pomeroyi DSS-3
  CDS (1)..(2046): transl_table=11
atgggcgaaaaccaggtggttacggtaaggcgcgacggcgatatcgcctgggtcgagatcgacagcccgccggtcaacgcgacctcgacgccggtgcgtgccgggttggcccgtgcggtggccgaggtgcagggcgcccgcgtcgcgatcctgacctgcgccggccgcacctttgtcgccggtggcgacatgaccgaattcgaccgccccgccgaggaaccgcatctgcccgacgtggtgcagatgatcgaagacagcgaaacgccctttgttgcggcgatgcatggcacggttctgggcggtgggtttgagatcgcgctggcctgcgcctggcgcatcgccgcgccgggcaccaaattcggcctgcccgaggtcaatgtgggcctgatccccggcgcgggcggcacccaacgcgcgccgcgcctgatcggcatgatggcggccatcgacatggcctgttcgggcaagatgctggatgccgcgcagatgctggcgctgggggggctcgaccaggttgccgagggcgatttgcgggctgccgcacagggctttgccaagggtctgccgccacgcccggaaaagacccgtctgcggcaggtgcaggcgctgaacagcgaggcgttggctgaggccaagcgcgccctgtccaaggcggccaagggccgtgccgcgccgctgcacaatctcgacgcgctgcaatgggccgccttgccctttgaccagggccagccgcgcgaacgcgccctgcatctgggcctgcgccagtccgacgaaagccgcgccctgcgctatgccttctttgccgagcgtctcgtcgcccggcccgacgccatcgccggagtcaccccacgcgagctgacccgcgttgccattgtcggcggcgggctgatgggcgccggggtcgccatggcctgtcttggcggcgggctgagtgtcaccgtcatcgagcgcgatgcggcggcggctcaggcggcgcaggagcgggttgccgggctggtcgcagcgggcgtcaagcgcggcaagatcagccccgacgcccaggccgacatgctggcccggctcgccaccaccgacacctatgccgatgcctccgatgccgatctggccatcgaggcggtgttcgaggatctcgacgtcaagcgcatagtctttgctgatctggccgccgtgatgcgccccgacgccattctggcgaccaatacctcctacctcgatccgcaactggtctttgccggtatcgcgaaccccgcccgctgcttgggcctgcatttcttcagtccggcgcatgtgatgaagctgctcgaaatcgtcaaaacccccgataccgcgcccgaggtgctggccaccggctttgcgctcggcaagcggctgcgcaagatttcggtcctgtcaggcatctgtgacgggttcatcggcaaccggatgctggccgcctatcggcgcgaggcggaatacctgctggccgacggtgccctgccgcatgaggtggacgccgcgatgcgggcgcaggggctgccgatggggccattcgagttgcaggacctgaccgggctgcaaatcgcctgggccaaccgcaagcggcaagcggccacccgcgaccccgccgaacgctatgagcgcatcgccgatatgctctgcgagatggaccgtctgggccagcgcagcggcaagggctggtaccgctatgccgaaggatcgcgttccccggaacgcgaccccgaggtcgagacgctgatcgtcgactattcggccaaacggggcatcacccggcgccctttcagcgccgaagagatcgcccagcgcctgctggcggtgctggccaacgaaggcgcgcgaatcgtttccgaaggcatcgccgagcgcgccgaggatgtcgatatggtgcaactgcacggctacggctttccgcgtcaccggggcgggccgatgcatctggcccaatcgcaaggttgggaaaaatccatggaaatcatggaattggtcgccagcgaaagccccgactcgtgggttctggcgccaaggggagacccatcagcagaaatttaa

SEQ ID NO: 72312 - protein, 681 aa, Silicibacter pomeroyi DSS-3
MGENQVVTVRRDGDIAWVEIDSPPVNATSTPVRAGLARAVAEVQGARVAILTCAGRTFVAGGDMTEFDRPAEEPHLPDVVQMIEDSETPFVAAMHGTVLGGGFEIALACAWRIAAPGTKFGLPEVNVGLIPGAGGTQRAPRLIGMMAAIDMACSGKMLDAAQMLALGGLDQVAEGDLRAAAQGFAKGLPPRPEKTRLRQVQALNSEALAEAKRALSKAAKGRAAPLHNLDALQWAALPFDQGQPRERALHLGLRQSDESRALRYAFFAERLVARPDAIAGVTPRELTRVAIVGGGLMGAGVAMACLGGGLSVTVIERDAAAAQAAQERVAGLVAAGVKRGKISPDAQADMLARLATTDTYADASDADLAIEAVFEDLDVKRIVFADLAAVMRPDAILATNTSYLDPQLVFAGIANPARCLGLHFFSPAHVMKLLEIVKTPDTAPEVLATGFALGKRLRKISVLSGICDGFIGNRMLAAYRREAEYLLADGALPHEVDAAMRAQGLPMGPFELQDLTGLQIAWANRKRQAATRDPAERYERIADMLCEMDRLGQRSGKGWYRYAEGSRSPERDPEVETLIVDYSAKRGITRRPFSAEEIAQRLLAVLANEGARIVSEGIAERAEDVDMVQLHGYGFPRHRGGPMHLAQSQGWEKSMEIMELVASESPDSWVLAPRGDPSAEI

SEQ ID NO: 72313 - DNA, 2097 bp, Silicibacter pomeroyi DSS-3
  CDS (1)..(2097): transl_table=11
atgcccgaggccatcggatacgaacgcgttggagatatcgtcattctggcggccgacaatccgccggtcaatgcgctgggtcatgcggtgcgtcaggggctggctgtcgggcttgaccgggccgaggccgagggcgcgcgcggggtgctgatctacggcaccgggcggacctttttcgccggggccgatattcgtgaattcggcaagcccccgaaggaaccgcacctgcccgaactgtgcaatcggatcgaggcctcgccgctgttggtggtgtcggcgctgcacggcaccgcgctgggtggcgggctggaagtggcactggccacccattaccggatcgcggtgccgcaggccaaggttggcctgcccgaggtgcatctggggattctgccgggtgccggtggcacccagcgcctgccgcgtgtggcgggggtagaggcggcgcttgacatgatcaccacgggccgccatgtgcgcgccgacgaggcgctgcgtctgggtgtgatcgaccgcgtcgccgagggcgagccgcgcgaaatcggcctgagctacctgcgcgaactgctggacgagggcgccccgcgccgcccggtgggcgagatgcctgcgcccgcgccggtcgatttcgacgcgatttatgcggcggtgctgagaaagggccgcggccagctgtcgcccgccaccgcggtgcgtgcggtacaggcggcgtgcgaggccgagagctttgccgccgggctgaagcgcgaacgcgagttgttcatggagctgatgaactcggaccagcgcgaggggctgatccatgcgtttttcgccgaccgcgcggtgggcaagctgccggaactggaaggtgtggcgccgcgcccgctggcggcaatcggggtcattggcggcggcaccatgggcgcgggcatcgccaccgccgcgctcttgtcggggctgagcgtcaccatgctggagatgacgccagaggccgccgaggccgccaagggccggatcgagggcaacctgtcgggcgcgctgaagcgcggcaagctgacggcgcagcaattcgacaacctgaccaccaaggcgttgacgctggccatagattacgacgcgctggccgatgccgatctggtgatcgaggcggtgtttgaggatatggaggtcaagaaacaggtgttcaccaagctcgacgccgtgtgcaaaccgggcgcggtgctggcctcgaacacctcgtatctcgacatcaaccagatcgcggcagtgaccagccgtccgcaggatgtgctgggcctgcatttcttctcgcccgcgcatgtgatgaagcttttggaggtggtcatcgccgaccagaccgcgcccgatgtggcggccaccggctttgcgctgggcaagcggctgggcaaggtctcggtccgggccggggtctgtgacggattcatcggcaaccgcatcctgtcggtctatcgtacctgcgccgatcacatgatcctggacggggcctcgccctatcagatcgacgaagcgctggaagagttcggatttgccatggggccctttgcggtggccgacctggcggggctggatatcggctgggccgtgcgcaagcgcaagcgggccgaaggactggacccgcgcgcccgcgacagcgcctatgccgacaagctgtgcgaggcgggccatttcggacagaagaccggcaagggctattacgactatgccgcaggcgccaaggcgcgggtgccgaatcccgaggtgctgccgttgatcgaagcggagcgcgcccagcaggggattaccccgcgtgcgttcagcaaggacgagatcgtgcgccggtacatggcggcgatggtcaacgaggccgccaaggtggtgggcgagggcatcgcgcgccgtccgctcgacgtggatgtgaccctgctctacggttacggctttccgcgctatcgcggcgggccgctgaaatgggccgacatgcaggggctgcctgagttgctggccgatatcaaacgctgggcggcggaggatgcctatttctggcaacccgcgccgctgctggaacaactggtggccgagggccgcactttcgacgatctgaacaaggaagccgtctaa

SEQ ID NO: 72314 - protein, 698 aa, Silicibacter pomeroyi DSS-3
MPEAIGYERVGDIVILAADNPPVNALGHAVRQGLAVGLDRAEAEGARGVLIYGTGRTFFAGADIREFGKPPKEPHLPELCNRIEASPLLVVSALHGTALGGGLEVALATHYRIAVPQAKVGLPEVHLGILPGAGGTQRLPRVAGVEAALDMITTGRHVRADEALRLGVIDRVAEGEPREIGLSYLRELLDEGAPRRPVGEMPAPAPVDFDAIYAAVLRKGRGQLSPATAVRAVQAACEAESFAAGLKRERELFMELMNSDQREGLIHAFFADRAVGKLPELEGVAPRPLAAIGVIGGGTMGAGIATAALLSGLSVTMLEMTPEAAEAAKGRIEGNLSGALKRGKLTAQQFDNLTTKALTLAIDYDALADADLVIEAVFEDMEVKKQVFTKLDAVCKPGAVLASNTSYLDINQIAAVTSRPQDVLGLHFFSPAHVMKLLEVVIADQTAPDVAATGFALGKRLGKVSVRAGVCDGFIGNRILSVYRTCADHMILDGASPYQIDEALEEFGFAMGPFAVADLAGLDIGWAVRKRKRAEGLDPRARDSAYADKLCEAGHFGQKTGKGYYDYAAGAKARVPNPEVLPLIEAERAQQGITPRAFSKDEIVRRYMAAMVNEAAKVVGEGIARRPLDVDVTLLYGYGFPRYRGGPLKWADMQGLPELLADIKRWAAEDAYFWQPAPLLEQLVAEGRTFDDLNKEAV

SEQ ID NO: 72315 - DNA, 2178 bp, Vibrio fischeri ES114
  CDS (1)..(2178): transl_table=11
atgatttatcaaggtgaaaacctctctgtagactacatcgaaccgggcattgctcacttagtatttaatgctaaaggcagtgtaaataagctcaacttagccaccctacaatcggttggtgaagccatagatgcactctactcacaaaaggacttacaaggtctacttctatcatcagataaaagtgcatttattgttggtgctgatattacggagtttcttggtttgtttgatattccaacagaagaactcagtgattggttacatcaagctaacgccatttttaatcgtctagaagacattccagtacctactttatctgctattactggatttgctttaggaggcggttgtgaatgtgtccttgctacggattttcgattagcagatgaaacggcatctatcggtctacccgaaacacagcttgggatcatgcccggctggggtggctcagtgcgcttacctcgcttaattggtgccgatccagcaatggaagtcatcacaacgggtaagccaaagcgagcaaaagatgccttagctctgggaatggttgatggtgttgtttcacgtgaaaccttgataacagattctgtcactatgcttaaaaaagcgatagagggtcaactggattggcaatctcgtcgtacacagaaaaaagcaccattaaaactctctcctctagaggcagcaatgtcatttaatgtcgcaaaaggcatgataatgaaaatggcaggtaaacattaccctgcaccaatgacagcagtaaagtccattgaaaatagtgccttcatggatcgtgatgctgctcttgaagttgaaaataaaaacttcgttgcactcactcaaacagatgtggctaagtcattagttggtattttcttaaacgatcaattagtgaagagtaaagcgaaacaagccataaaaaatagtgaacccgtgactagcgcagcggttcttggtgctggaattatgggtggaggtattgcttatcaatccgcatcaaaaggcgtccctgtattaatgaaggacattgctcaacaatcattagatttaggcatgagtgaagcctctaaactgcttaataaacaattagaacgaggacgtttatctggtttaaagatggcaaaagtactctcttctattaccccatcactaaactatgccagtattgaaaacaaagatattgtcgtagaagccgtcgttgagaacccaaaggttaaagctgcagtattagctgaagttgaaaatgaagtgaatgagcacgccatcttagcctcaaatacatcgacaatacctatttccttactagcaaaatcattaaaacgcccagaaaatttctgtggcatgcacttcttcaatcctgtacatcggatgccactcgttgaagtgatccgtggtgaaaaaacgtcacaacaaaccattgatcgtgttgttgcttacgcttctcaaatgggaaaaacacctattgtcatcaatgactgccctggattttttgttaaccgagttcttttcccttatttcgcagggttcagtttgttgctgcgtgatggtggtgactatcaacaaatagataacgtcatggaaaaagagtttggttggccaatgggaccagcttatttacttgatgtcgttggaattgatacagcacatcacgcacaagccgtcatggcacaaggcttccctgagcgaatggcaaaaaatggacgagatgtgattgatgcgatgttcgaatccgatcgctatggtcaaaaaaatggaagtggtttttatgcatatagcatagatagaaaaggcaaacctaaaaagaacattgatgaaagcacagcaggcattattgcgacagtaaccaatacaacgcaaccttatacatcagagcagatcagtgctcgcatgatgatacctatgattaatgaggtcatccgctgcctagatgaaggaattattgcctctcctgcagaagctgacatggcattggtttatggtttgggcttccctccatttaaaggaggagtattccgctatcttgatgcaattggattaaccacttatctcgacatggcaaaagaatttgaacatctaggtgccgtttatcaagtaccagaaagcatcaaacaaaaagcagccgatgatgaatgttattacccagcgcctcaatcattatcagcaccgtcagcctag

SEQ ID NO: 72316 - protein, 725 aa, Vibrio fischeri ES114
MIYQGENLSVDYIEPGIAHLVFNAKGSVNKLNLATLQSVGEAIDALYSQKDLQGLLLSSDKSAFIVGADITEFLGLFDIPTEELSDWLHQANAIFNRLEDIPVPTLSAITGFALGGGCECVLATDFRLADETASIGLPETQLGIMPGWGGSVRLPRLIGADPAMEVITTGKPKRAKDALALGMVDGVVSRETLITDSVTMLKKAIEGQLDWQSRRTQKKAPLKLSPLEAAMSFNVAKGMIMKMAGKHYPAPMTAVKSIENSAFMDRDAALEVENKNFVALTQTDVAKSLVGIFLNDQLVKSKAKQAIKNSEPVTSAAVLGAGIMGGGIAYQSASKGVPVLMKDIAQQSLDLGMSEASKLLNKQLERGRLSGLKMAKVLSSITPSLNYASIENKDIVVEAVVENPKVKAAVLAEVENEVNEHAILASNTSTIPISLLAKSLKRPENFCGMHFFNPVHRMPLVEVIRGEKTSQQTIDRVVAYASQMGKTPIVINDCPGFFVNRVLFPYFAGFSLLLRDGGDYQQIDNVMEKEFGWPMGPAYLLDVVGIDTAHHAQAVMAQGFPERMAKNGRDVIDAMFESDRYGQKNGSGFYAYSIDRKGKPKKNIDESTAGIIATVTNTTQPYTSEQISARMMIPMINEVIRCLDEGIIASPAEADMALVYGLGFPPFKGGVFRYLDAIGLTTYLDMAKEFEHLGAVYQVPESIKQKAADDECYYPAPQSLSAPSA

SEQ ID NO: 72317 - DNA, 2100 bp, Vibrio fischeri ES114
  CDS (1)..(2100): transl_table=11
atgacgttagaaacgaaaaataatacgcttgaagccgttaaaaataccagtgcatttgcatggactaaagatgatgagcaaattgcatggttaaccatcgatgttccgaatgaaaaaatgaatacactccaagctgcttttgctgagcaagtgactcaagttttagatgagattgaagagcaacaagctcatattaaggggttagtgattcaatcaggtaagcccgataattttatcgcaggcgctgatattaatatgatagctaattgccaaaatgcctcagaagcacaagccttggctgaaaaaggacagcatttatttcagaggattgaagatcttccatttgctacggttgcagcaatacatggtccatgcctaggaggcggattagagctagctttagcatgtgattatcgtgtttgtagtgatgacaataaaaccaagctcggtttaccggaggttcaattagggttactcccaggttcaggtggaactcagcgattaccacgattaatcgggctactgccaagtttggatattatcttaacgggtaagcaactaagacctaaaacagcactgaaattaggcgtagtagatgcatctgttcctcatactattttgtctcgtatagctgcggactttgctttaaagaaaaaagcgaaacgtaaattgactgcaaaagaatgggggttatctcgaaatccattaggacgtaatgtcattttctcgcaagcggaaaaacaagcacagaaaaaagctcgtggtaattatcctgccattgccgctattttagactgtatcgagcatggtttagataaagggatgaaaaaaggattacaacgagaagctgaacaatttgctcgattggccatgacgccagaatcggcggcattacgctctttattctttgccatgacagagatgaaaaaagaaaaaggcagtgatgctgaacctaaatccatcgattatgttggggtactaggtggtggattaatgggaggaggtattgcccatgtttctattgctaaagcgaaaaagaaagtaacgataaaagacatcaataatgatggattacttaatgcttaccaatatcactatcaacgattagatacgttgagaaagcgccgaattatttcaaaagcgcaattacaacaacaaatgctgcaattaactggagtgacagagtttgacggttttaaaaagttagatgtggttgttgaagccgtatttgaagatttaaacctaaaacaagagatggtaaaagcagtacaagaacaaggcaaagaagacgttatttttgcaacgaatacgtcttcgcttcccataggccaaatagccgagggggctcaaaagcctgaaaatattgttggccttcattattttagtccagttgaaaaaatgccattggttgaggttattccacacgcaacaaccagcgatgaaaccatctcaaccgtagtggctttggctaagcaacagggtaaaacgcctattgttgtaaaagattctgcgggcttttatgttaatcgtatccttgcgccttatatgaatgaggcggcacgtctgttacttgctggagagccaatagaggtgctcgatgaagccttattggattttggatttcctgttgggcctatttcattattagatgaggttggagttgatattggcgcgaaaattatgccgatattggaagcggagttaggagatagattccgaagccctgatgtatttcagaccttaattgacgataagcgattgggtaagaaaacaaaacgtggattttatgtttataaagggaaaaagaaagaacctgatcaagaggtgtataccttattaaacatcaagccgcagtcacaactaagtaaaaatgaaatcgcaatgcgttgtgtattacctatgttggcagaggcaaaacgttgtttagatgaagggataatagcttctgaaagagatggcgatatcggtgctatttttggcattggttttcctccatttttaggtggaccttttacttatatgaacacgttaggggaagagaaattagcgaccttaatgagaaactatgccgataaatacggtgatcgatttattgagtaa

SEQ ID NO: 72318 - protein, 699 aa, Vibrio fischeri ES114
MTLETKNNTLEAVKNTSAFAWTKDDEQIAWLTIDVPNEKMNTLQAAFAEQVTQVLDEIEEQQAHIKGLVIQSGKPDNFIAGADINMIANCQNASEAQALAEKGQHLFQRIEDLPFATVAAIHGPCLGGGLELALACDYRVCSDDNKTKLGLPEVQLGLLPGSGGTQRLPRLIGLLPSLDIILTGKQLRPKTALKLGVVDASVPHTILSRIAADFALKKKAKRKLTAKEWGLSRNPLGRNVIFSQAEKQAQKKARGNYPAIAAILDCIEHGLDKGMKKGLQREAEQFARLAMTPESAALRSLFFAMTEMKKEKGSDAEPKSIDYVGVLGGGLMGGGIAHVSIAKAKKKVTIKDINNDGLLNAYQYHYQRLDTLRKRRIISKAQLQQQMLQLTGVTEFDGFKKLDVVVEAVFEDLNLKQEMVKAVQEQGKEDVIFATNTSSLPIGQIAEGAQKPENIVGLHYFSPVEKMPLVEVIPHATTSDETISTVVALAKQQGKTPIVVKDSAGFYVNRILAPYMNEAARLLLAGEPIEVLDEALLDFGFPVGPISLLDEVGVDIGAKIMPILEAELGDRFRSPDVFQTLIDDKRLGKKTKRGFYVYKGKKKEPDQEVYTLLNIKPQSQLSKNEIAMRCVLPMLAEAKRCLDEGIIASERDGDIGAIFGIGFPPFLGGPFTYMNTLGEEKLATLMRNYADKYGDRFIE

SEQ ID NO: 72319 - DNA, 2202 bp, Rhodobacter sphaeroides 2.4.1
  CDS (1)..(2202)
atgaccgatttcaccagccggaccgacgcggacggggtctgcaccatcacctgggacgtgccgggcaagtcgatgaacgtcatgtcgatggcgggatttgccgagctcgacgggctgatcgccgcggcgctcggcgatccgtctgtcaagggcgtgatcctcacctcgggcaagaaggactttgccgcggggatggatctcaatgtcatcgcccgcatgaaggaggaaggcggcgacgatccggcccgggccgtgttcgagggcgtgatggagatgcatgccgtcctgcgccggatcgagcgcgcgggcatggatccgaagacgctgaaggggggcaagcccatcgtggcggccctgcccggcaccgccctgggcctggggctcgagctgccgctggcctgccaccgcatcatcgcggccgacaatcccaaggccaagatcggcctgcccgagatcatggtggggatcttccccggcggcggcggcacgacgcggctcgtccgcaggctcggcgccatgatggcggctcccctcctcctcgagggcaagctgaacgatcccaagggcgccaaggccatgggtgtcgtcgacgaggtggtgccggccgatcagctgctcccgcgggcgaaggaatgggtgctcggcgcgaaggacgcggatctggtgaagccgtgggacgccaagggctacaagatgcctggcggcgcgccctaccatccggcgggcttcatgaccttcgtcggcgcctcggccatggtgacgggcaagacgatgggcgtctatccggcggccaagggcctgctcgccgcggtctacgagggcgcgctcgtgcccttcgacaccgcgctgaagatcgaggcgcgctggttcacccatgtgctgatgaatccctcctcgtcggcgatgatccggtcgctcttcatcaacaaggaggcgctggagaagggcgccgtccgccctgccctgcccgaccagtcggtccggaagctgggcgtgatcggggcgggcatgatgggcgcgggcatcgcccatgtcgcggccaatgcgggcatcgaggtcgtgctgatcgacgcgacgcaggaggcggccgaccgcggcaagtcccattcggaaggtctcctcgacaaggggatgaagcggggcaaggtctcggccgagaagaaggccgaggtgctgggccggatcgccgccaccaccgactatgcggccctctcgggctgcgatctgatcgtcgaggcggtgttcgaggatcccgcggtgaaggccgaggtcactcagaaggtcgaggccgcggtcgggcccgactgtatcttcgcaaccaacacctcgaccctgccgatctcggggttggccaaggcgagccgcgatccggcgcagttcatcggcatccatttcttctcgcccgtggacaagatgatgctggtcgagatcatccgcggcaaggccaccggcgaccgcgccgtggccaaggcgctcgatttcgtgcgccagatccgcaagacgcccatcgtcgtccacgatgcgcgcttcttctacgccaaccgctgcatcatcccctacctcaacgaggggatccgcatggtggccgaaggcgtggcgcccgcgctgatcgagaatgcggcgaagctggtggggatgccgctcggcccccttcagctggtggacgaaacctcgatcgacctcggggtgaagatcgccaaggccacgaaggccgccctgggcgaggcctatccggacgcggcggtggatgcggtgatcttcccgctggcggacgaggggcggctcggccgcaaggcgggcgcgggcttctatgcctacgacgccgccggcaagcgcgaaggtctctggccgggcctcgccgaccgctggccgcaggccgaggcgcagcccgagcttgccgaggtgcagcaccggcttctcttcgcgcaggtgctcgaggcggtgcgcgcgctcgaggagggcgtgctgaccgacatccgcgagggcgacgtgggcgccattctcggctggggcttcgcgccctggtcgggcggcccgttcagctggctcgacatgatcggcgcgccgcgcgcggtggagatctgcgaggggctggccgagcgtcacggcagccgcttcgcgccgccgaagctgctggtcgagatggccggcaagggcgagagcttctacgcccgcttcgcaccgcaggcccgcgcggcctga

SEQ ID NO: 72320 - protein, 733 aa, Rhodobacter sphaeroides 2.4.1
MTDFTSRTDADGVCTITWDVPGKSMNVMSMAGFAELDGLIAAALGDPSVKGVILTSGKKDFAAGMDLNVIARMKEEGGDDPARAVFEGVMEMHAVLRRIERAGMDPKTLKGGKPIVAALPGTALGLGLELPLACHRIIAADNPKAKIGLPEIMVGIFPGGGGTTRLVRRLGAMMAAPLLLEGKLNDPKGAKAMGVVDEVVPADQLLPRAKEWVLGAKDADLVKPWDAKGYKMPGGAPYHPAGFMTFVGASAMVTGKTMGVYPAAKGLLAAVYEGALVPFDTALKIEARWFTHVLMNPSSSAMIRSLFINKEALEKGAVRPALPDQSVRKLGVIGAGMMGAGIAHVAANAGIEVVLIDATQEAADRGKSHSEGLLDKGMKRGKVSAEKKAEVLGRIAATTDYAALSGCDLIVEAVFEDPAVKAEVTQKVEAAVGPDCIFATNTSTLPISGLAKASRDPAQFIGIHFFSPVDKMMLVEIIRGKATGDRAVAKALDFVRQIRKTPIVVHDARFFYANRCIIPYLNEGIRMVAEGVAPALIENAAKLVGMPLGPLQLVDETSIDLGVKIAKATKAALGEAYPDAAVDAVIFPLADEGRLGRKAGAGFYAYDAAGKREGLWPGLADRWPQAEAQPELAEVQHRLLFAQVLEAVRALEEGVLTDIREGDVGAILGWGFAPWSGGPFSWLDMIGAPRAVEICEGLAERHGSRFAPPKLLVEMAGKGESFYARFAPQARAA

SEQ ID NO: 72321 - DNA, 2133 bp, Azotobacter vinelandii
  CDS (1)..(2133)
atgttcaacggcaaggcgatgcgcctcaaggcactggaggcggggctggtcgagctgaccctcgatctgcagggctcctccgtcaacaagctggaccggccgaccctggacgagctggccgaagtcgtccggctgctcggtacccgcggccacgagatcgagggtctgctgatcgccagtgccaagccggcgttcgtggtcggcgccgacatcaccgaattcaccgcggccttcgcccgtcccgagagcgaggtggcggactggatcggctacgggcagcgactgttctccgccctggagcgcctgccgttcccgagcgtggcggcggtgaacggcctggcgctgggcggcggcttcgagctggcgctggcggccgatttccgggtgctggcggcggatgccagggtcggcctgccggaggtgaccctgggcctctgtccgggttggggcggcaccgttcgcctgagccggctgatcggcgccgaggcggcgctcgactggatgctcgccggcaagccgcaggccgcggccagggcgctggagctgggcgccgtcgaccgggtggtgctcgccgcggagctgcgcgatgtcgcgctgaacctgctgcgcctggccgccagtggcgagctgtcgggcgccgccgagcgctcccgcaagcagcagcccctcggcgacagtcaggaacgcctggccgctctccggcaacgcctcggcggcaagctcgatgcccgttatccagcgccggcggcgatcctcgatgcggtgatccgccatgccgggctgccgctggacgaggcgctgcgggtcgaggtgcgtaccttcggcgcgctggccaagtcggatgtcgcccgcgcgctgatcggcctgttcctcggcgagcaactggtcaggaagaaggccagggcctggagcggcaaggccgagccggtccgccgcagcgccgtgctcggcgccggcatcatgggcggcggcgtggccttccagtcggcgtcctcgggcgtgcccatcgtcatgaaagacatccgcggcgaggcgctcgaactgggcctgaagaccgccgggcaactgctcgaccggcagatcgacaagggccgcctggatgccgccggcaagcagcgagtgctggacaacatccggccggcgctggactacgcgggcttcggcgaagtcgacctggtggtcgaggcggtggtcgagaatcccagggtcaaggccgccgtgctggccgaggtggaggaccaggtggcggcgaacgcggtgctgacctccaacacctcgaccatctccatcgacctgctggcgcggggcctgaagcggccggaagccttctgcggcatgcacttcttcaacccggtgcaactgatgcaactggtcgaggtgatccgcggcagccgcagcagcgaggcgaccatcgcccgcaccgtggcctacgccagcgccatgggcaagacgcccatcgtggtcggcgactgtccgggctttctggtcaaccgggtgctcttcccctatttcaacggcttcaaccgcctgctcagggacggcgtcgacttcgagcgcatcgaccgggtcatggaagccttcggctggccgatgggcccggcctacctggccgacgtggtcggcatcgacaccatggtccacgccgaccatgtgctgcaggagggtttccccgagcgcatgggccacgacggcgagccgatcatggatgcgctgctggccagcggcgcgctcggccagaagaacggccggggtttctacgaatacaccgtcgacgcctccggacggcgcggcaagcagccggccgcggcggcccgcgcgttgatcgccgggcgggtggtcgaggccgtggaggtttccgacgaggaaatcgtcgaccggctgatgatcccgctgtgcctggaggcggtgcgctgcctggaggacggcatcgtcgagacgcccgaggagatcgacatggggctgctgctcggcatcggcttcccgcgctttcgcggcggcgccctgcgctacatcgacacccagggcctggcggtcttcgccgccaaggccgaggcccacgcccgtcatggcgggctctaccgcctgaccgaggatttccgcgcccgcctggccgccggccggggctatttctga

SEQ ID NO: 72322 - protein, 710 aa, Azotobacter vinelandii
MFNGKAMRLKALEAGLVELTLDLQGSSVNKLDRPTLDELAEVVRLLGTRGHEIEGLLIASAKPAFVVGADITEFTAAFARPESEVADWIGYGQRLFSALERLPFPSVAAVNGLALGGGFELALAADFRVLAADARVGLPEVTLGLCPGWGGTVRLSRLIGAEAALDWMLAGKPQAAARALELGAVDRVVLAAELRDVALNLLRLAASGELSGAAERSRKQQPLGDSQERLAALRQRLGGKLDARYPAPAAILDAVIRHAGLPLDEALRVEVRTFGALAKSDVARALIGLFLGEQLVRKKARAWSGKAEPVRRSAVLGAGIMGGGVAFQSASSGVPIVMKDIRGEALELGLKTAGQLLDRQIDKGRLDAAGKQRVLDNIRPALDYAGFGEVDLVVEAVVENPRVKAAVLAEVEDQVAANAVLTSNTSTISIDLLARGLKRPEAFCGMHFFNPVQLMQLVEVIRGSRSSEATIARTVAYASAMGKTPIVVGDCPGFLVNRVLFPYFNGFNRLLRDGVDFERIDRVMEAFGWPMGPAYLADVVGIDTMVHADHVLQEGFPERMGHDGEPIMDALLASGALGQKNGRGFYEYTVDASGRRGKQPAAAARALIAGRVVEAVEVSDEEIVDRLMIPLCLEAVRCLEDGIVETPEEIDMGLLLGIGFPRFRGGALRYIDTQGLAVFAAKAEAHARHGGLYRLTEDFRARLAAGRGYF

SEQ ID NO: 72323 - DNA, 2118 bp, Actinobacillus pleuropneumoniae serovar 1 str. 4074
  CDS (1)..(2118)
atgacagaacaacccattcagcaaccgatgtttcaagtcgaagtagatgaaaatcagattgccatcattcgcattcactctattgataatgatgaaaactggcttcccgaaaattttgccggcgaattaagagaagttatcggtacgctgatttatcgtcaggtacaaggtgcgatttttatttcgacacgggcaaatcattttattcagggcttaaaaccgagccttttcaaaaacaagacaaatgagcaattacttgctttttcccaagatgcacaagcgattatgcgagagttaaatacgctgaaaatgccgattgtcgccgctatcgacgggaattgctttagtgtcggtctggaactttccttagcttgcgattaccgtatcgccagtgatgaatcgcatactttctttgcgatgccgcaagtccgttccggcttattaccttttgccggcggtacgcaacgtttaccgcgtttaatcggtttacgttccgcgctaccgttaatgttattcggcgaaaaaataactgccgaaaccgccaaaggattgggtttggttgatcgattggtgcctaaaactcgtcttttaaccgatgcttatcaactcttactagagaagaaaattcaaaaagccaatcataaaaaaccgcttactttctttaaaaaatggcgtaagcagatcgaaggtaattcgttcttacgcgaaaaattgcttgatcgtacggaaaatgcgatttggcttaaaacgttcggtaattaccctgcggttgccaaactgatggaactgctcaaagagccgcactttaaacaagggttaatgctcgaacaacaagcctttgtcgaattgtttaatagcgcaacctcacaagtattaatcgaattaaagaaaaccgaacgggcaatgaaggataaatatcgtattcgaggtaatgtacgtgatgtcgctcaagtcagtattttaggttcgggctatatgggcgccggtattgcttatttaaccgccaacaatgctaaagtaccggttcgcataaaagatattcatccgtcggaaattcgtaaagccttacgtacctgctttgaattaatgcaaaaatcaacggataaaaatcagcttaatcacggtgaaatgatccaacgtatgaatctgattaccggcggagagcgattagtggcggcaaaatcaaccgattttgtgattgaagcggtgtatgaagatctcaaacttaaacaacggatgttagccgaaagtgaaagctactatagtgaacagaccatttttgcaacgaatacttcaacctttgcgattaaagatattgcggcttgtgcgattcgtccggaaaacgtaatcgggctacattatttcagcccggttaccacgcaaaaaatggtggaaatcataccgcatagcgcaaccggcgaacatacgattgcgacggcgattcattttgccattcaacaaggcaaaatcccgttgttggttgctgataagcagggcttttttattaatcgagttttaacgccgttactgcttgaagcggtgcaatgtttaattgacggcgaatcgattgaatttatcgatcgttcgttacaagaattcggcttcaaattaggcccgcttgccatgatcgacgaaatggggctggatgtattggtcaaatcgaactcggctttagtcagcgaattaggcagccgtttcagtttgcctcaagcggttgatttattgttccgaaatgaacgtaaaggctgtaaaaacaaacgcggtttctatatgtatgatcgcttcggagaacgtttacaggaagataaaagcatttatcacgtgatggaaaccattgcccgtaacgatttggaatccgaacagattgtccgccgttgcctgttacgtatgctcaacgaagcggcttggtgtttacaggataagattatcgcctcgaccgacgaaggtaatgtcgcttccgttctcgcaatgggctttccggagtttcgaggcggtatctatgtctatatcgaaaaaatcggtgcaaaagaaatcgtacggcaattacacttacacactaaacaatacggtaaacgtttcgaaccttgcgaatggctaatccgacaagccgaacaataa

SEQ ID NO: 72324 - protein, 705 aa, Actinobacillus pleuropneumoniae serovar 1 str. 4074
MTEQPIQQPMFQVEVDENQIAIIRIHSIDNDENWLPENFAGELREVIGTLIYRQVQGAIFISTRANHFIQGLKPSLFKNKTNEQLLAFSQDAQAIMRELNTLKMPIVAAIDGNCFSVGLELSLACDYRIASDESHTFFAMPQVRSGLLPFAGGTQRLPRLIGLRSALPLMLFGEKITAETAKGLGLVDRLVPKTRLLTDAYQLLLEKKIQKANHKKPLTFFKKWRKQIEGNSFLREKLLDRTENAIWLKTFGNYPAVAKLMELLKEPHFKQGLMLEQQAFVELFNSATSQVLIELKKTERAMKDKYRIRGNVRDVAQVSILGSGYMGAGIAYLTANNAKVPVRIKDIHPSEIRKALRTCFELMQKSTDKNQLNHGEMIQRMNLITGGERLVAAKSTDFVIEAVYEDLKLKQRMLAESESYYSEQTIFATNTSTFAIKDIAACAIRPENVIGLHYFSPVTTQKMVEIIPHSATGEHTIATAIHFAIQQGKIPLLVADKQGFFINRVLTPLLLEAVQCLIDGESIEFIDRSLQEFGFKLGPLAMIDEMGLDVLVKSNSALVSELGSRFSLPQAVDLLFRNERKGCKNKRGFYMYDRFGERLQEDKSIYHVMETIARNDLESEQIVRRCLLRMLNEAAWCLQDKIIASTDEGNVASVLAMGFPEFRGGIYVYIEKIGAKEIVRQLHLHTKQYGKRFEPCEWLIRQAEQ

SEQ ID NO: 72325 - DNA, 2160 bp, Psychrobacter sp. 273-4
  CDS (1)..(2160)
atggtataccaaggaaatcgcattacggtgacaatgctagaggatggcatcgccaacatgcagtacaacgccgaaaatgagagcgtgaacaagtttgatactgagactaataagcagtttgctgaagtcgttaatgcgttagaaaaagcggatgacgttaagggcttaattgtcacttcaagcaaaggcgtctttatcgctggtgcggacatcacggaatttgtggcctcttttaagcaatcagaagaagaaatcaaagattgggttattaatattaatgacgcctttaatcgctttgaagacctaccattcccgaaagtagctgccatcaatggcgccgcgcttggcggtggttgtgagatgactttagtttgcgaatatcgtgtcatgagtgacaaagcgatcatcggtctaccagaaactcaactcggtattttcccaggttttggtggtaccgtgcgtagtacgcgtgtcattggtatcgataatgcgcttgagctgattgcaacgggtgcacctaaaaaagcacttgatgccctaaaactaggcttggttgatgcgaccgttgctgctgatgatttgcaagatgctgccattgatctggtcaaaaaatgtatctcaggtgagcttgattggaaagcgaagcgtgaagagaagctggttgctgttaaattaaatcagcttgaacaagcgatggcgtttaacagtgcaaaaggtatgatttttgccaaagccaatcctaagcaataccctgcgccagcacttgctatcgctgctatcgaaaaacacgttaacttaccacgtgataaagcaatcgaagtagaagcggcaggttttgcaaaagctgcgaaaaccccacaagcagaaagcttggttggtctgttcttaagcgatcagttggttaaaaaattagccaagcaacacagcaaaaaagcacatgaaattaatgaagcggcagtattgggtgctggtatcatgggcggcggtatcgcttatcaggcagccagcaaaggcttgccaatcatcatgaaagacatcaagtctgagcaattagaccttggtatgggcgaagccagcaagttattgggcaaaatggttgatcgcggtaagatgacccccgccaaaatgggcgaaaccttaagccgtatccgtcctactttgaattatggcgattttgctgaaacggacatcgttatcgaagcagtggtagaaaatccaaatgtgaagcgtgcggtattaaaagaagttgaaggcttggtaaaagacgattgtatcctagcctcaaacacttcgactatctctattactttcttggctgaagcacttgagcgtccagaaaacttcgtcggtatgcatttctttaacccagtacaccgtatgccattggtcgaagttatccgcggtgagaaatcatctgaagaagcgattgcgaccacggttgcactagcctctaaaatgggtaaagtacctgttgtcgttaatgactgcccaggtttcttagtcaaccgcgtattgttcccatactttggcgcctttgatttattacttaagcaaggtgctgattttgctcatgtcgataaagtcatggaaaaattcggctggcctatgggtcctgcatatctaatcgacgttgttggtttagatacgggtgttcatggcgcagaagtcatggcagaaggtttccctgaccgcatgaagcctgattataaaggtgccatcgagcttttatatgaaaacaaacgcctaggtcagaaaaatggtgttggtttctataagtatgaaatggacaaacgtggcaagccaaagaaagttgctgatgaagccacttatgagctattaaaaacgacgactgatagcgaaaaacagacctttgatgatcaagcaatcatcgaccgtaccatgctggctttctgtaatgaaaccgtacgctgcctagaagacaacatcgtcagcacgccgtcagaagcggatatggcgatgatcatgggtgttggttttccaccattccgcggtggcccttgccgttatatcgaccaaatgggtttagataactacttggcactatgtgaaaaatatgcgcaccttggcaaagcctatgaagccccgcaaaagattcgcgacatggcagcagcaggcgagaccttttacgcaaccgcgtaa

SEQ ID NO: 72326 - protein, 719 aa, Psychrobacter sp. 273-4
MVYQGNRITVTMLEDGIANMQYNAENESVNKFDTETNKQFAEVVNALEKADDVKGLIVTSSKGVFIAGADITEFVASFKQSEEEIKDWVININDAFNRFEDLPFPKVAAINGAALGGGCEMTLVCEYRVMSDKAIIGLPETQLGIFPGFGGTVRSTRVIGIDNALELIATGAPKKALDALKLGLVDATVAADDLQDAAIDLVKKCISGELDWKAKREEKLVAVKLNQLEQAMAFNSAKGMIFAKANPKQYPAPALAIAAIEKHVNLPRDKAIEVEAAGFAKAAKTPQAESLVGLFLSDQLVKKLAKQHSKKAHEINEAAVLGAGIMGGGIAYQAASKGLPIIMKDIKSEQLDLGMGEASKLLGKMVDRGKMTPAKMGETLSRIRPTLNYGDFAETDIVIEAVVENPNVKRAVLKEVEGLVKDDCILASNTSTISITFLAEALERPENFVGMHFFNPVHRMPLVEVIRGEKSSEEAIATTVALASKMGKVPVVVNDCPGFLVNRVLFPYFGAFDLLLKQGADFAHVDKVMEKFGWPMGPAYLIDVVGLDTGVHGAEVMAEGFPDRMKPDYKGAIELLYENKRLGQKNGVGFYKYEMDKRGKPKKVADEATYELLKTTTDSEKQTFDDQAIIDRTMLAFCNETVRCLEDNIVSTPSEADMAMIMGVGFPPFRGGPCRYIDQMGLDNYLALCEKYAHLGKAYEAPQKIRDMAAAGETFYATA

SEQ ID NO: 72327 - DNA, 2172 bp, Psychrobacter sp. 273-4
  CDS (1)..(2172)
atgagcacaaacagcgtaaatgccattaatgaattaaacagtttttctgcagaatcagacaacggcattatcaccgttactattgatcaagctgaccgtaaaatgaacgtgattggtgatggttttaatgaagcatttgcggcattaactgatgcatttatcagtgatgcagaagcgaaaggtttaattttaacctctggtaaatcaacctttgtggttggggcagatattgatcaactagccactatcgaaactgctgagcaagcgtttgacttagtagaggatttaaaagccagcctacgtaagcttgagacttctggcaagccagtggttgccgcaattaccggcactgccttaggtggtggtttagagctggctttagcttgtcattatcgcatcgctattgactcaccaaagacaaaacttggtttacctgaagtcaaacttggtttattacctggcggtggtggcactcagcgtcttccacgtctagtcggtatccaaaaagcacttgaactaatgacgcaaggtaaagagcttagcccacagcaagccgttgaaatcggtcttatccatgacgtggcttacgacaatgaagagcttatcaaaaaagccaaaaaatggatcaacaacaatcctcaagctagccagccatgggacaataaaggttttaagattcctggtggtgatagcaaaaaccctaaaatagtaccgatattctccattgctcctgcgatggctaatcaaaagtcgcacggcaactatcctgccattacccatatcttatctagtgtctttgagggctgcttaacggatatcgacaacggtcttaaaatcgagtcgcgcttttttgtggcttgcgcgttatcagatgtgtccaaaaacatgattaatacgctttggacgcagcttaatagcatcaaaaaaggccaatcacgccctgaagggtttgaaaaatctaaagtgagcaaagtcggcatacttggtgccggtatgatgggcgcaggtatcgcttacgtctcagccaaagcgggcatggaagtggtattgttagatacggctctcgaaggcgctgaaaaaggtaaaaactattctactaagttgttagacaaggctatcagccgtggtcaatctactgaagagaaaaaacaagcgttattagaccttatcaaaaccacaacgtcttatgacgacttagaaggctgtgatttaattatcgaagcggtattcgaagatgtagacattaaagctgaatgtacgcgtaaatctgaagtggttattccagagaccgcggtttatgcatcaaacacgtctaccctgcctattactgagcttgcaagagctagcacacgtccaaaacagttcatcggtctacacttcttctcgccagtagataagatgccattggttgagattattgttggcgaagaaacggatgatgcaacgctagctaaaggttttgactatgttggtcaaatcggtaagacaccgatcgttgtcaatgacagccgcggcttctatacctctcgcgtatttggtacttacgtatcagaaggtattgcgatgttaggtgaaggtgttcacccacgcagcattgaagtggctggtatgaaatctggtatgccgatgccgccactcgcactgcaggacgaagtgtcactaagtttgtcattacatgtcatgcagcaaactaagcgtgccctagaatcggaaggcaaaacctttactccgcatcctgccatgccagtagtagaaaagatggttaatgagcttggccgcgaaggtaagaaagtcactaaaggcttttatgattatcctgaaaatggtgaaaaacgcttatggcccaagctcactgaactgtatccaactaaagatgagcagccatctcagcaagacttggtagaccgtttattatacgttcaagctaatgagaccgcgaaatgtttcgaggaaaatgtcgtacgtacagtggctgatgccaatgtaggttcaatctttggctggggctttgcaccaaatcaaggtggtacgcttcagtttgtcaattcagtaggcgtcgacaaatttgttgaacgtagccgcgagcttgctagcaaatacggtaagcgttttgaacctgctaaaatcttagtagagatggctgagtcaggtcaggagtttagcgatgagtaa

SEQ ID NO: 72328 - protein, 723 aa, Psychrobacter sp. 273-4
MSTNSVNAINELNSFSAESDNGIITVTIDQADRKMNVIGDGFNEAFAALTDAFISDAEAKGLILTSGKSTFVVGADIDQLATIETAEQAFDLVEDLKASLRKLETSGKPVVAAITGTALGGGLELALACHYRIAIDSPKTKLGLPEVKLGLLPGGGGTQRLPRLVGIQKALELMTQGKELSPQQAVEIGLIHDVAYDNEELIKKAKKWINNNPQASQPWDNKGFKIPGGDSKNPKIVPIFSIAPAMANQKSHGNYPAITHILSSVFEGCLTDIDNGLKIESRFFVACALSDVSKNMINTLWTQLNSIKKGQSRPEGFEKSKVSKVGILGAGMMGAGIAYVSAKAGMEVVLLDTALEGAEKGKNYSTKLLDKAISRGQSTEEKKQALLDLIKTTTSYDDLEGCDLIIEAVFEDVDIKAECTRKSEVVIPETAVYASNTSTLPITELARASTRPKQFIGLHFFSPVDKMPLVEIIVGEETDDATLAKGFDYVGQIGKTPIVVNDSRGFYTSRVFGTYVSEGIAMLGEGVHPRSIEVAGMKSGMPMPPLALQDEVSLSLSLHVMQQTKRALESEGKTFTPHPAMPVVEKMVNELGREGKKVTKGFYDYPENGEKRLWPKLTELYPTKDEQPSQQDLVDRLLYVQANETAKCFEENVVRTVADANVGSIFGWGFAPNQGGTLQFVNSVGVDKFVERSRELASKYGKRFEPAKILVEMAESGQEFSDE

SEQ ID NO: 72329 - DNA, 1908 bp, Dechloromonas aromatica RCB
  CDS (1)..(1908)
atgaatctgcaacactggaagctggtcgctgatgcggcgggtatcgccaccgctacgctcgacaaggcgggcgaatcggccaactccttgtcggccgaagtgctcagcgagttttcggccattcttgaccggctcgacgcctatccgcccaaaggcctgatcatccgctccggcaaggaggctggttttatcgccggggccgatatcgctgagttttcgcaactcgataccccggaaaagagcagggcgctggtcgaacggggctggaatctgttcaaccggctggcggcggtcaaatatccgacactggctttggtccgtgggcactgcctggggggtggtctggaactggcactggcctgtcgctatctgctggcggtcgacgagtcgggtaccaagatggggctaccggaagtcatgctcggcatctttcccggctggggtggcatgttgcgcctgccgcagcgggttggccctgctgccgcattggatctgatgctgactggcaagacactggatgccaagcgggcaaagaaaatgggcttggctgacgattgcgtgccgccgcgcgtcatggaaatggcggctcgccagctggtgttgtccggccagccgcgccgccaactgccttttgttcagcgcctgctcaatggccctctgaagtcggtggtggccaacggcgcgcgcaagcaggtggcgaagaaggcgcggccggaacactacccggccccctacgcgatcatcgacttgtgggcgaagcacgacggaaatgccctggccgcgccggaggtagtcgatcgcatcatttcttcaccgactgcacgcaatctacttcgggtgttccacctgcaggagcgcctgaaaggcttcggcaaggagtccgctttcaaagccaagcgcgttcatgtcattggtgccggcgtcatgggcggcgacatcgcagcctggtgtgcgttgcgcggcatgaccgtgaccctgcaggatcagacgctggagcgcatttcgccggcgctgaagcgggctcatgccttgttcaccaaacgtctgcgcgagccgctgaaaattcgtgatgccttcgatcgcctgattcccgaccccaaaggggatggcgtggcacatgctgatgtggtgatcgaagccattttcgagaacgtcgaagccaagcacgccctgtttaagtcggttgaacccaggttgaagccgggggcggtgctggccaccaatacttccagcttgcgcctggaagatttgcgaacggtgttgcagcgccccgaacgactggtcggtatccactacttcaatccggtggcgatgatgccgctggtcgaggtggttgccgccgagggagctgatccctccgccgttcaggctgcttgcgcctttgtccggcagatcgacaagttgccgttaccggtgaagagtgctccgggtttcctggtcaacgcggtattggcgccttacatgctggaagcgatgcgcgcggtcgattcgggaatttcgccggaaaccgtcgatgaagccatgcttgccttcggaatgccgatggggccgatagagctgatcgatacggtgggcctcgatattgcgatggccgccggtcagcaattggccggtggggcagaagcaccacgttgcctaatcgctcgcgttgataaaaatcagttgggcaaaaaatccgggcagggcttctatcactggaccgatggcaaggctaaaaaaggcgcagccgcgggtgttcccgccgggctggcagatcgcttggtcaaacccttgatcgaccgtgttgagcagctggtcgctgcaggtgtcgtcgccgataccgaactggctgatgccggggtaattttcgggacaggcttcgcaccgtttacgggcgggccacttaactaccgccgggtaaatcgataa

SEQ ID NO: 72330 - protein, 635 aa, Dechloromonas aromatica RCB
MNLQHWKLVADAAGIATATLDKAGESANSLSAEVLSEFSAILDRLDAYPPKGLIIRSGKEAGFIAGADIAEFSQLDTPEKSRALVERGWNLFNRLAAVKYPTLALVRGHCLGGGLELALACRYLLAVDESGTKMGLPEVMLGIFPGWGGMLRLPQRVGPAAALDLMLTGKTLDAKRAKKMGLADDCVPPRVMEMAARQLVLSGQPRRQLPFVQRLLNGPLKSVVANGARKQVAKKARPEHYPAPYAIIDLWAKHDGNALAAPEVVDRIISSPTARNLLRVFHLQERLKGFGKESAFKAKRVHVIGAGVMGGDIAAWCALRGMTVTLQDQTLERISPALKRAHALFTKRLREPLKIRDAFDRLIPDPKGDGVAHADVVIEAIFENVEAKHALFKSVEPRLKPGAVLATNTSSLRLEDLRTVLQRPERLVGIHYFNPVAMMPLVEVVAAEGADPSAVQAACAFVRQIDKLPLPVKSAPGFLVNAVLAPYMLEAMRAVDSGISPETVDEAMLAFGMPMGPIELIDTVGLDIAMAAGQQLAGGAEAPRCLIARVDKNQLGKKSGQGFYHWTDGKAKKGAAAGVPAGLADRLVKPLIDRVEQLVAAGVVADTELADAGVIFGTGFAPFTGGPLNYRRVNR

SEQ ID NO: 72331 - DNA, 2118 bp, Dechloromonas aromatica RCB
  CDS (1)..(2118)
atggcagtccatcgtctcgacaatgatgttgcacacctcgttttcgaccgccaggagagtgtgatcaacaagctggatcgtgccacgcttgaagaaatcgaaattgcagtcaagctggtggcagccgataccagcctgcgcggcttgctggtcagcagcgccaaggataatttcatcgtcggcgcggatatcaaggagttcggcgaactctttggccgggacgaagcagcgcttgatgcccatatgcgctgggccaatcagatattctgtgccttcgaggatttgccgattccaagtgtcgtcgccatcaatggcatggcgctgggtggcggtcttgaatttgcgctgggcgcgacgctgcgcgtgatggccgagaacgcccagattggcctacccgaggttactttgggaatttttcccggctacggtggcacggttcgcctggggcgtctggccggtgcacaggtcgccgtcgattgggtggcctccggaaagccgcggcgtgctgccgaggcgctggtcgccggggtggtcgatgccgtcagtccggccgagcaactgcaggagcaagccctgagtcttctgggcagggcaatggcgggcgagatcgatgttgcggcaattcgccggaagaagcagggcgcgattcccggtcaccatgatgccgtcttcgccgacgccttgaccaggcaggcaaaggcactcgctgtccatttgccggcggcagcgatggccatcgcatcgatggcgcgcggtgcgggtaaaggccgggatctggccctcgatgaagaacgccacgctttgctcaaggttgtcaaaacccaggcggcaggcgcgatgatccagggattccataaccagcaagccttgaagaagctgttcggtcggcaccgtgccaatgcccgtcgggtccgctcggccgcggtgcttggcgccggtatcatggggggcgggatagccttcaccagcgccctgaagggcgtgccggtccggctcaaggatatttcccggcagcagcttgatctgggtatggccgaggcgaaaaaacagattggtcgccagatcaagagcggtcgggtcagcgaggcaaaggggcagcaggtactgacctccatccagccgcagctcgattacgccggcttttccgattgtgatcttgtcgtcgaggccatcatcgagaacctgaaggtcaagcatgcggtgctgagcgaactggaacaggcggtcgcgccggataccgtcatcgcttccaatacgtccagcctgcgtatcgatgaaatcgccatgcccttgcaacgcccggaaaatttcgtgggcatgcatttcttcaacccggtccccgtgatggcgctagtcgaggtcatcaagggcagcaggaccagcgatgtcgcggtttcgactgcggtcgactatgcagtaaccatgggcaagacaccgattgtcgtgcaggactgcccggggtttctcgttaaccgtatcctgaccccttatgttcgggcttttctcgacctggtggccgatggggtcgatttcgtgcgtatcgatcgcgtgatggaagtcttcgggtggccaatggggccggcttatctgatggacgtggtgggcattgacactggttgccatgtcttcgatgtcatttcggccggttatcccgccgtgatgccgatccaggaaaacaatgcgctggccgtgatggtcgccaaccagcgctatggccagaaaaacggtattggcttctatcgctacgagaacgaccccaccggcaagccgaagaaaacggttgccgaggacagctatcccctgctgaaacctattcagctttcgccgccaagagaagtctcggatgaagagattgtcgagcgcatgatgttgagttccatcctcgaagcggcccgggcattggaagacggtgttgtcgccacggcgggggaactcgatgtcgccatgctgctcggtatcggctacccgcaatacctcggtggcccgctgaaatacgccgactggcttgggcttccgaaggtcgttgcgctcggcgagaagcacggccatctgggaccacagtatcgggtaaccgacaaaataaggagcatggcggcttcgggcgcgcagttctattga

SEQ ID NO: 72332 - protein, 705 aa, Dechloromonas aromatica RCB
MAVHRLDNDVAHLVFDRQESVINKLDRATLEEIEIAVKLVAADTSLRGLLVSSAKDNFIVGADIKEFGELFGRDEAALDAHMRWANQIFCAFEDLPIPSVVAINGMALGGGLEFALGATLRVMAENAQIGLPEVTLGIFPGYGGTVRLGRLAGAQVAVDWVASGKPRRAAEALVAGVVDAVSPAEQLQEQALSLLGRAMAGEIDVAAIRRKKQGAIPGHHDAVFADALTRQAKALAVHLPAAAMAIASMARGAGKGRDLALDEERHALLKVVKTQAAGAMIQGFHNQQALKKLFGRHRANARRVRSAAVLGAGIMGGGIAFTSALKGVPVRLKDISRQQLDLGMAEAKKQIGRQIKSGRVSEAKGQQVLTSIQPQLDYAGFSDCDLVVEAIIENLKVKHAVLSELEQAVAPDTVIASNTSSLRIDEIAMPLQRPENFVGMHFFNPVPVMALVEVIKGSRTSDVAVSTAVDYAVTMGKTPIVVQDCPGFLVNRILTPYVRAFLDLVADGVDFVRIDRVMEVFGWPMGPAYLMDVVGIDTGCHVFDVISAGYPAVMPIQENNALAVMVANQRYGQKNGIGFYRYENDPTGKPKKTVAEDSYPLLKPIQLSPPREVSDEEIVERMMLSSILEAARALEDGVVATAGELDVAMLLGIGYPQYLGGPLKYADWLGLPKVVALGEKHGHLGPQYRVTDKIRSMAASGAQFY

SEQ ID NO: 72333 - DNA, 2115 bp, Ralstonia eutropha JMP134
  CDS (1)..(2115)
atgaccaacgaagcttccgtcgttcgcacagcccgccacggcgacgtgcaggtgatcaccatctgcaatccgccggtcaatgccctcggcgttgccgttcgccagggcctgaagcaggccatcgaacaggccgaagccgatgccggcgtgcgcgccgtgctggtcgtgggagaaggcacggccttcatcgccggcgccgatatccgcgaattcggcaagccgccgatgccgccgtcgctgccggaagtctgcaaccagatcgaagccagcaacaagctcgttgtcgccgcgatccatggtccggcccttgggggcggcctggaagtcgccatgtcggcccactatcgcctcgcgctgccggccgccaagctgggtctgcctgaagtcaacctgggcctgctgcccggcgctggcggtacgcaacgcgcgccgcgcctgatgggcgtgaaggccgctgccgatctgatgctcagcggcaagcacctgtcggccaaggccgcgcaggccgctggtctcgttgatcgcctggctgaaggcgacgaccctgtggccgctggcctcgcctacgtcaacgaattgctggagcaaggcgcgccgctgcgccgcacgcgcgacctcgccattgccgacaaggccgcagcactggccgaactcgacacgttgcaggccgagactgccaagaagacgcgcggcctgttctcgccgcagaagattgtggaatgcgtgcgtgccgcggtcgaactgccgttcgacgaaggcctggccaaagagcgcgcgctgttcgtcgaatgcctgaacagcccgcagcgcgccggcctggtccatgcgttctttgccgagcgcgaaaccgccaaggtgcccgaggcacaaggcgccgccccgcgcgcgctcaaccgcatcgccgtgatcggcggtggcaccatgggcgcgggcatcaccgtggccgcgctcgataccggactgccggtggtgatgatcgagcgcgatgccgaatccatcgcgcgtggccaggccaatgtcgagaaggtctacgacggcctgatcgcgaagggccgcatgacgccggaaggcaaggccgcgatcatggcgcgctacacgccgagcacgtcgtatgaatcgattgccgacgtggacctcgtgatcgaagccgtgttcgaagacatcgaagtcaagaaggccgtgttccagcaactggaccgcgtgtgcaagccgggcgccgtgctggcgaccaatacgtcgtatcttgatatcgacgcgatcgctggcagcatctcgcgtccgcaggacgtgatcggcctgcacttcttcagcccggccaacatcatgaagctgctggagatcgtggtgccggccaaggtcagcccggacgtggtcgtgaccgcgttcgaactggccaagcgcatgaagaagatcccggtgcgcgcaggcgtgtgcgacggctttatcggcaaccgcatcctggccgtctacaagcaggccgccgactacatcatggaagacggcgccagcccttacgagatcgacgaggccgtgcgcggtttcggctatccgatgggcccgttccaggtgaccgacctcgccggcggcgacatcggctgggccacgcgcaagcgccgcgctgccacgcgcgatccaaaggcgcgctatgtcgaagtcgccgaccgcatctgcgaacgcggctggttcggccagaagacgggccgtggcttctacctgtacccgcaaggcgcacgcatcggccagcccgaccgggaagtgctcgccattgtcgaggccgaacgccagaagaagggcatcgcaccgcgcaagttcacggccgaggagatcatgcgccgctatatggccgcgatggtcaatgagggcgccaaggtggtggaagaaggcatcgcgctgcgtccgctcgatgtcgatgtgacgttcctgtcgggctacggcttcccgcgcttccgcggcggcccgatgaagtatgccgatatggtcggcctgccgaagatcctcgaagatatccgcacctttgccaaggaagacccgctattctggaagccggcaccgctgctcgagaagctggtggcggaaggcaaggactttgccagcctgaaccaggccggccgctga

SEQ ID NO: 72334 - protein, 704 aa, Ralstonia eutropha JMP134
MTNEASVVRTARHGDVQVITICNPPVNALGVAVRQGLKQAIEQAEADAGVRAVLVVGEGTAFIAGADIREFGKPPMPPSLPEVCNQIEASNKLVVAAIHGPALGGGLEVAMSAHYRLALPAAKLGLPEVNLGLLPGAGGTQRAPRLMGVKAAADLMLSGKHLSAKAAQAAGLVDRLAEGDDPVAAGLAYVNELLEQGAPLRRTRDLAIADKAAALAELDTLQAETAKKTRGLFSPQKIVECVRAAVELPFDEGLAKERALFVECLNSPQRAGLVHAFFAERETAKVPEAQGAAPRALNRIAVIGGGTMGAGITVAALDTGLPVVMIERDAESIARGQANVEKVYDGLIAKGRMTPEGKAAIMARYTPSTSYESIADVDLVIEAVFEDIEVKKAVFQQLDRVCKPGAVLATNTSYLDIDAIAGSISRPQDVIGLHFFSPANIMKLLEIVVPAKVSPDVVVTAFELAKRMKKIPVRAGVCDGFIGNRILAVYKQAADYIMEDGASPYEIDEAVRGFGYPMGPFQVTDLAGGDIGWATRKRRAATRDPKARYVEVADRICERGWFGQKTGRGFYLYPQGARIGQPDREVLAIVEAERQKKGIAPRKFTAEEIMRRYMAAMVNEGAKVVEEGIALRPLDVDVTFLSGYGFPRFRGGPMKYADMVGLPKILEDIRTFAKEDPLFWKPAPLLEKLVAEGKDFASLNQAGR

SEQ ID NO: 72335 - DNA, 2109 bp, Rubrobacter xylanophilus DSM 9941
  CDS (1)..(2109)
atgggatacctcgacgtgcgcaaggaggacggggtcgcggtcgtctggctggacgagccggggagccgggttaacaagctctccaccccggtgctgggggagttcgaggcggccctcgacgagctggagcgcgacgggggggtgagggcggccgtcctgatcagcgcgaagaaggactccttcgtggtcggcgcggacatcgaggagttctcccgcctcaagacccccgcggaggtggaggggatcatccgcaagggccacgagctcctcgggaggatggagtcctcccccaagccggtggtcgccgcggtgcacgggccggcggtcggcggggggctggagctcatcctcgcctgccactaccgcatcgccaccgaccacccggcgacgaagttcgccttccccgaggtgatgctcgggcttttgcccgccctcggcggcacccagcgcttcacccgcctcgtgggggtgcagaaggcgctcgagatcatcaccaccggaaagaacgtctacccctcccaggcgaggaggatgggcctcgtggacgcccttatgcacccggagggcctgctcgaggcggcgaagcgcgccgcccgcgcgctcgcggacggctccctctccccccggcgcagaaggccctccctgcgcgagcgggtgctggaggagaccccgctcgaccgcctcgtctacggccgggcgcgcgagctggcagacaggcagacccgcggcaactacccggcggtcccgaagatcatcgagtgcgtccgcaccggccggaaggaggggatggaggctggcttcgaggcggagcgaagggccttcgcctcgctgctcttcaccccggagtcgggggcgctgaggaacctcttcttcctgaagaccggcgccgagaagaacccctacgcgggcagggagaggaaggtcgggacggtgggggtgctcggggccgggctcatgggctccggcatcgcccaggtgagcgcggcccgggcctcccggaaggtgctgctcaaggacgcccggctggatctcgcggcgaaggggcggggcgaggtctacaggagcctcagccggcgcgtcggcagggggatgagcgccttcgagcgcgaccgggccgtcgagcggatcgtccccatcgaggactacgccccgctcgccagggcggacctggttatagaggcggtgcccgaggacctcgagctcaagcgcgagacgatccgccaggtcgaggcggtgggccgggacgacctcgtcatcgcctcgaacacctccgcgatccccataaccgagatctccgccggggcgcggcgccccgagcgcatcgtcgggatgcactacttctccccggtcccgcggatgccgctcctcgaggtggtgcgcaaggaggacacccccgagtgggtgctcgccacctgcatccaggaggggctcgcccaggggaagaccgtgatcacggtgaacgacggccccggcttctacaccacccgcatcctcgccttctacatcaacgaggcgctgctgcttctggaggagggggccgcggtcgacgccatcgacgaggcgatgatggacttcggcttcccggtcgggccgctcaagctcctcgacgaggtgggcatagacaccggcgtcaagataaacgaggtgctgcgcccgctcttcgccgcccgctcgctgcgcacgagcgaccggggcgccgaggtggtcgcggccggctacaagggccgcaagagcggtcgcggcttctacctctacgagggccgggagaagggcagggtgaacccggaggtctacgagttcctcggcaccgagaggcgccccatcccggcccgtgcgatccaggagcggctctcgatgatgatggtctccgaggcggtgcgctgcctggaggagggcgtcctctcctcgccgcaggacggcgacgtgggcgcggtcttcgggctcgggttcgccccgttccgcggcggcccgttctggtacctggaccagatgggggcggagcgggccctggtgctgctgaacaacctccgctcggcctgcggcgagcgcttctccccgcccgccctgctcgaggagcgcgccgcctccggcaagcggttctacgcctga

SEQ ID NO: 72336 - protein, 702 aa, Rubrobacter xylanophilus DSM 9941
MGYLDVRKEDGVAVVWLDEPGSRVNKLSTPVLGEFEAALDELERDGGVRAAVLISAKKDSFVVGADIEEFSRLKTPAEVEGIIRKGHELLGRMESSPKPVVAAVHGPAVGGGLELILACHYRIATDHPATKFAFPEVMLGLLPALGGTQRFTRLVGVQKALEIITTGKNVYPSQARRMGLVDALMHPEGLLEAAKRAARALADGSLSPRRRRPSLRERVLEETPLDRLVYGRARELADRQTRGNYPAVPKIIECVRTGRKEGMEAGFEAERRAFASLLFTPESGALRNLFFLKTGAEKNPYAGRERKVGTVGVLGAGLMGSGIAQVSAARASRKVLLKDARLDLAAKGRGEVYRSLSRRVGRGMSAFERDRAVERIVPIEDYAPLARADLVIEAVPEDLELKRETIRQVEAVGRDDLVIASNTSAIPITEISAGARRPERIVGMHYFSPVPRMPLLEVVRKEDTPEWVLATCIQEGLAQGKTVITVNDGPGFYTTRILAFYINEALLLLEEGAAVDAIDEAMMDFGFPVGPLKLLDEVGIDTGVKINEVLRPLFAARSLRTSDRGAEVVAAGYKGRKSGRGFYLYEGREKGRVNPEVYEFLGTERRPIPARAIQERLSMMMVSEAVRCLEEGVLSSPQDGDVGAVFGLGFAPFRGGPFWYLDQMGAERALVLLNNLRSACGERFSPPALLEERAASGKRFYA

SEQ ID NO: 72337 - DNA, 2223 bp, Mesorhizobium sp. BNC1
  CDS (1)..(2223)
atggctggctacaagaacttcaccgtcgaggtcgatagcgagggtatcgcactcgtcacctggaacatgccggaccgctcgatgaacgtcttcaccgaggaggtgatgggcgagttggacaagatcatcgaccaggtcgcaggcgatgccggcatcaagggcgcggtcttcacctctgggaaggagaccttctccggcggcgcggatctgtccatgctgcagaacatgctgggccggtatcacaaagagaaggcgaaaagccccgaaaaggcgaccagagagctcttcgacagggccggaagcatgagcaagctctggcgcaagctcgaagtttcgggaaagccctgggtttcggccatcaacggcacctgcatgggaggagcgttcgagctttcgcttgcctgccatggccgtgtggcggtggatgatgacagcgtgaagctcgccctgcccgaggtgaaggtcggcatcttcccaggcgcgggcggcacccagcgcgtgccgcggcttaccaacacgcaagaagctctgcagatgctcacttccggccagaacctctcgccgcagaaggcgaaggccatgggactggtgcatgagatcgtgcctcgcaagaagctggtcgatgcggcgaaaaggatgatcaaggacggactaaaacccgtccagccctgggacgagaaaggcttcaaactgcctggtggaccggtctattcggccgccggcgccaatctctggccgccggccatcgccattctgcgccgcgagacctacggcaactatcctggcgcaacagccatcttgaagtgcgtctatgagggcctgctggtccccttcgacacggctctccgtattgagcagcgttatttcacggaaattatgcagtcgaaggaggcggcggccatgatccgctcgctcttcatctcgatgcaggagctgaacaagggcgcgcgccggccaaaggatgtgccggccaagaagatcaggaaggtgggcgtactcggcgcaggcttcatgggcgcaggcatcgcctacgtgacagccaaggctggaatccctgtggttttgatcgaccgtgatcaggaatcggccgataagggcaaagcccattcggccgggctgatggatggtctcatcaagaagggccgcgccacggcggaagagaaagagaagcttctttcgctcatcaccgcgacgccggactattccgcgctcgaaggcgccgatctcgtgatcgaggcggtgttcgaggattcggccgtgaagaaggaagcgacggaaaaagcagaggctgcgctgaagtcctcggccatcttcgcctccaacacctccacaataccaatcacgagcctcgccaaaaattcgaagcggccgaaaaacttcatcggcctccacttcttctctccggtcgacaggatgatgctggtggagattatcctgggcaagaagacgggggacaaggcgctggcgctcgcgatggattacgttcgcgccatcaggaagacgccgatcgtcgtcaacgacacgcgcggcttctacgtgaaccgctgcgtcctgcgctacatgcaggaagcctattccatgctgatcgagggcgtgcccgcgcccatgatcgagaacgccgcgaaaatggccggcatgccggtcgggccgctagcgctcacggacgaaacggccatcgatttagctcagaagatcatgaagcagacgatccgcgatcttggcgagaaggcagtcgatccgcgccatatggagctgatcgacatgatggtcgacaagcacggccgccacggccgtaagaacggcaagggcttttacgaatatcccgccaaaccggccaagaaattcctttggccggggctgaaggatttttaccgtcagcaggaccccgacgagatcgatgtcgaggagctgaaggcgcgcttcctctatgtgattgcgctcgaggccgcgcgcgtgatggaggagggcatcgtcaccgatcctcgcgaagcggatgtgggctcgatcctggccttcgggttcgcgccttttacaggcggcgtcctctccttgatcgacggcattggcgcggcggaattcgtaaagcgcgccgagcggctgcagaagaaatacggcaagcagttcaagccgcccaggcttttgctggaaatggctgagaaaggcgagaccttctatgaccgctttgcgccggaaggcgttggcggattcaaggaggccgcctga

SEQ ID NO: 72338 - protein, 740 aa, Mesorhizobium sp. BNC1
MAGYKNFTVEVDSEGIALVTWNMPDRSMNVFTEEVMGELDKIIDQVAGDAGIKGAVFTSGKETFSGGADLSMLQNMLGRYHKEKAKSPEKATRELFDRAGSMSKLWRKLEVSGKPWVSAINGTCMGGAFELSLACHGRVAVDDDSVKLALPEVKVGIFPGAGGTQRVPRLTNTQEALQMLTSGQNLSPQKAKAMGLVHEIVPRKKLVDAAKRMIKDGLKPVQPWDEKGFKLPGGPVYSAAGANLWPPAIAILRRETYGNYPGATAILKCVYEGLLVPFDTALRIEQRYFTEIMQSKEAAAMIRSLFISMQELNKGARRPKDVPAKKIRKVGVLGAGFMGAGIAYVTAKAGIPVVLIDRDQESADKGKAHSAGLMDGLIKKGRATAEEKEKLLSLITATPDYSALEGADLVIEAVFEDSAVKKEATEKAEAALKSSAIFASNTSTIPITSLAKNSKRPKNFIGLHFFSPVDRMMLVEIILGKKTGDKALALAMDYVRAIRKTPIVVNDTRGFYVNRCVLRYMQEAYSMLIEGVPAPMIENAAKMAGMPVGPLALTDETAIDLAQKIMKQTIRDLGEKAVDPRHMELIDMMVDKHGRHGRKNGKGFYEYPAKPAKKFLWPGLKDFYRQQDPDEIDVEELKARFLYVIALEAARVMEEGIVTDPREADVGSILAFGFAPFTGGVLSLIDGIGAAEFVKRAERLQKKYGKQFKPPRLLLEMAEKGETFYDRFAPEGVGGFKEAA

SEQ ID NO: 72339 - DNA, 2034 bp, Mesorhizobium sp. BNC1
  CDS (1)..(2034)
atggacgggccggtggtatgggaactgcgcgggagggttctccacgtcctgatcgacaatcctccagtcaacgccggatcgcagcctgtacgtgcgggcgtgctaaaggcgataggcgaggccggcgcgagcaacgccgaggccgtggtcatccagggcgcgaacggaaactttgtagccggatccgatctgcgggagtttgagggcccgctttcacctcccgaatggccagaagtattcagcgcaatcggcaattgccccattcccgtggtggcggccatcgaaggcgcagcgctcggcggcggttatgaactggcgcttgcctgcgatggccgtatcgcagcacccgacgcggtggtcggcttgccggaggttgcattgggtatcatcccgggtgcggggggaacccagcgtcttccgcgcctcaccgggcgagccgaggcgatccgcctgatctgtggagcgatccgtgtacccgcgaatgaggcgctggcaaaaagcatggtagatcggatcgcggaagacgatctcatttctgcagcctgcgactttgccttgtcgctcccgggcaagcggcgcctcgacgacgccgctgtccccaaggagtctgccgaggtgatcgaggctgcggcgcgggcagcccttgccaaggcgcgagaaagccgcgcggtcgttgaagcaatcgcgttaatcacgagagcgggcataggcagcacggctgaggccttggccgaggaacgatctgttttccaggcactgcgcaaaagtgagcaatcggctgcgttacgctatctgttcttcgcagagcgcaccgccgcgcgcgcgctgcccaggttcgacaaagaaaaacgcgttacgcgtctcggtgtcattggcgctggcaccatgggggtgggattggcagtgagccttctcgcagccgggaaatccgtcgtgctcatcgataaggacgatcttgcgcttacccgtgccagcgctgcggtgaaatctgggctcgcccgtcttgaaagaggcggtaagctgaaggaggcccctgacgctgcgctggcacgtctggttgcctcgaaggagctttccgcggtcgaaaactgcgaggtggtgatcgaggccgtagtggaaagctttgaggtcaagtcggctgttctctcggacctccacgcgcgcctttcacccggcgcaatggtggtatccaatacttcctacctggatattgccgaactcgcgcgcgccagtggccgtcccgatcgctttctaggcctgcatttctttgccccggttccggtgatgacccttgtagaggtggtgccgctgccggagacctcgtctcatacgctcaccgttgctacgcagttggtgcgcgacatgggcaaggtcgcggtgcgcgctggcccctgcaacgggtttctcggaaatcggatttatgccgcatataggagagaatgcgagcttctcgtcgaggagggcgcaatgccttgggatgtcgacgccgaactgcggaaacagggcttccgtatgggtcctttccaggtgggcgacctttcgggcctcgatatcggttgggcgctccgccgcagtcgggatgcaacgcgtgatccgcgagagcgctatttcgcgctgccggacacgctctacgaaatgggcaggctcgggcgaaaatccggcgctggatggtacgcctacagcactgattgtcctgacggccaacccgatcctgaggtggagaggctggtccgcacaaacgcccgcgccggcatagctgctcccgatgccgaaaccatccggcagcgtgccatgggagcgatcctaaacgaggccgcgcgcgccttcgaggacggcaccgccgccgccgcgtcggacatcgatgtcgttctggtgaacggctacggtttcgcgcgcgagcgtggcggtcccctttggcaggcatcacgattgtcgtcggacgagcgcactctcatgattgatcttgtcgctcatgcgaacggttacggcttcacccgcggcgatgttgagtccctcatcgcggcgcttacctga

SEQ ID NO: 72340 - protein, 677 aa, Mesorhizobium sp. BNC1
MDGPVVWELRGRVLHVLIDNPPVNAGSQPVRAGVLKAIGEAGASNAEAVVIQGANGNFVAGSDLREFEGPLSPPEWPEVFSAIGNCPIPVVAAIEGAALGGGYELALACDGRIAAPDAVVGLPEVALGIIPGAGGTQRLPRLTGRAEAIRLICGAIRVPANEALAKSMVDRIAEDDLISAACDFALSLPGKRRLDDAAVPKESAEVIEAAARAALAKARESRAVVEAIALITRAGIGSTAEALAEERSVFQALRKSEQSAALRYLFFAERTAARALPRFDKEKRVTRLGVIGAGTMGVGLAVSLLAAGKSVVLIDKDDLALTRASAAVKSGLARLERGGKLKEAPDAALARLVASKELSAVENCEVVIEAVVESFEVKSAVLSDLHARLSPGAMVVSNTSYLDIAELARASGRPDRFLGLHFFAPVPVMTLVEVVPLPETSSHTLTVATQLVRDMGKVAVRAGPCNGFLGNRIYAAYRRECELLVEEGAMPWDVDAELRKQGFRMGPFQVGDLSGLDIGWALRRSRDATRDPRERYFALPDTLYEMGRLGRKSGAGWYAYSTDCPDGQPDPEVERLVRTNARAGIAAPDAETIRQRAMGAILNEAARAFEDGTAAAASDIDVVLVNGYGFARERGGPLWQASRLSSDERTLMIDLVAHANGYGFTRGDVESLIAALT

SEQ ID NO: 72341 - DNA, 2121 bp, Mesorhizobium sp. BNC1
  CDS (1)..(2121)
atgtctgtctcgcgcagggtctggaagctccttcaggatcgcaacgactatttcggccccgagggagagccgatgcgccggctttcgcattggcgctacagcagggacgaggagggcatcgtctggctcgtcctcgatcgcgcgggcgagagcgccaatacgctatcggaagcggtgatggcggaacttcatacggttctggaggatcttcgaagcctcaacgctcggggcctcgtcattcgctccgcaaagaaagggggctttgccgccggtgccgacatccgggattttcgcgacattcgagacgccggggaagtcgagaagcgcatccagcgcgcgcatgacatcattgataggctggcggctctcgcgatgcccaccgttgcggttattcacggccattgtctgggtggcggcctagaaatagcgctcgcctgcaaataccgcatcgccgtcaatggcgcgagcttcggttttcccgagatattgctgggtcttcatccaggattgggaggcacgttccggcttacctctctcattgatccggtcgaagcgatgaccatgatgttgacgggccgcagcgttcacaccaggaaggcgaaggcgcttggcctggtggacgagattgtggaagagcggcatgtgcgcgacgccgtgaaagctgccattgccggaaatctcaatcgcgcctccggcggctggaagaacagtgtgttccgcctgggtcctgcccggcgcctcgcggcgggccgaatgcgggccgaagcggagaagcgcgcccccaggaagcactaccccgccccctatcgccttatcgacctttgggaagagcatggcggcgacgcaagggccatgcagcgcgccgagatccgctccttctccgagcttctcttgggcaagacgtcccagaatctgatccgcgttttcttcctgcgtgagcggttgaagtcgcttgccaagggcgagagcggcatcgcgcgcgttcacgtcatcggcgcaggcaccatgggcggcgatatcgcagcgtggtgcgcatcgcggggcatgcgggtgacgctgacggacttggacccgaaggcgatcgcgaaggccgttggtcgggcgtcctccttgtttgacaaaaagcttcattcgagcctggagcgccgcgacgcgctcgaccgtctgacgcccgatttcgatggaacgggtttcgcaaaggccgacctcgtcattgaagcggttgccgaaaaggcggaagtgaagcgcagggtttacgaggcgattgcaccgcgcatgaaaccaggagcgatccttgccacgaatacctccagcattccgctgaagacgttgagcgagggcttgcctttcccggagcgcttcattggcctgcatttcttcaatcctgtctcgcgaatggagctggttgagatcgtcgcccatgagggggcgagcgaagatgcgctccagcgggcgcgcgccttctgcggagatatctctcgcctgccgtcgcctgtgaagagcgcgccgggcttcctcgtcaatcgtgcgctcatgccgtatctggtcgaggccttcgtcatgttcgacgaaggcgtgccgatagacgtgattgaccgggctgcccgcaatttcggtatgcccatgggaccgatcgagctggcagaccaggtcgggctcgatatctgcctcgaagtggcgcgcatgctgaaggagcagtcgcctgatccgatgcccgaaatcccgtcctggctcgtgcagaaggttgaggcgggtgagacgggacgcaaagcccgacggggcttctactcctacgatgagaaaggcaagatcagaaaagaagaggtaaaagcggcggaaggggcgcagatcccccgcgctgacgcggaagcggccgaccggttgatccttccaatgctcaacacgcttgtgagatgtttgcgcgagaatcttgtaaacgaagaagaattaatagacggcgccatgatttttggcaccggctttgcgccgtttcgaggcggtccgcttttttacgcgcgcacgcgcggagtgagcgagatcaccgctaagctgcggcagcttgaggaaaaatatggcgagcgttttgcgcccgatgaggggtgggagaggctgaaaacttga

SEQ ID NO: 72342 - protein, 706 aa, Mesorhizobium sp. BNC1
MSVSRRVWKLLQDRNDYFGPEGEPMRRLSHWRYSRDEEGIVWLVLDRAGESANTLSEAVMAELHTVLEDLRSLNARGLVIRSAKKGGFAAGADIRDFRDIRDAGEVEKRIQRAHDIIDRLAALAMPTVAVIHGHCLGGGLEIALACKYRIAVNGASFGFPEILLGLHPGLGGTFRLTSLIDPVEAMTMMLTGRSVHTRKAKALGLVDEIVEERHVRDAVKAAIAGNLNRASGGWKNSVFRLGPARRLAAGRMRAEAEKRAPRKHYPAPYRLIDLWEEHGGDARAMQRAEIRSFSELLLGKTSQNLIRVFFLRERLKSLAKGESGIARVHVIGAGTMGGDIAAWCASRGMRVTLTDLDPKAIAKAVGRASSLFDKKLHSSLERRDALDRLTPDFDGTGFAKADLVIEAVAEKAEVKRRVYEAIAPRMKPGAILATNTSSIPLKTLSEGLPFPERFIGLHFFNPVSRMELVEIVAHEGASEDALQRARAFCGDISRLPSPVKSAPGFLVNRALMPYLVEAFVMFDEGVPIDVIDRAARNFGMPMGPIELADQVGLDICLEVARMLKEQSPDPMPEIPSWLVQKVEAGETGRKARRGFYSYDEKGKIRKEEVKAAEGAQIPRADAEAADRLILPMLNTLVRCLRENLVNEEELIDGAMIFGTGFAPFRGGPLFYARTRGVSEITAKLRQLEEKYGERFAPDEGWERLKT

SEQ ID NO: 72343 - DNA, 1968 bp, Rhodobacter sphaeroides 2.4.1
  CDS (1)..(1968)
atgaccaacgacctcatccggcgcagcgactccgacgggatcgcgcttctgaccctcgccaacccgccggtgaacgcgctgagcctcgcggtgcgccagaggctcgccgcgctgacggccgagctcgaggccgacgagagcgtgcgcgccgtggtgcttgcggccgagggccgggtcttcgtcggcggcgcggacatcgccgagttcgaccgcccgcccgaggcgccgcacctgcccgatgtgatcgccgccatcgaggcctcgcggaagccgtggatcgcggcgctgaacggcgcggccctcggcggcggggccgagcttgcgctcggctgccactaccggatcttcgcggataccgcccggctgggcctgccggagacgagcctcggcctcatccccggcgcgggcggcacgcagcgcctgccgcgccggatcggccttgctcccgccatcgaggtcatcaccgccggccgcaccctgtcggccgccgaggcgcgggaggcgggccttgcggaccggatcgccgcgggcgagctgatccccgaggcgctggccttcgcccgcaccctcgacggcgccctgcccctgcctgcctctgcggccccgctcgccgatcccgggcccgccttctgggacgaggcccgcgcgcgcatcgccagggcggcccgaggcaatcccgcgcccgccgcggccctcgaagcgatccgcgcgggcgtggcggaaggcttcgccgcgggtctccgcgccgagcgcgagaccttcctgcggctccgcgcttcggacgaagccgcggccctgcgccatctcttcttcgccgagcgtgcggccctgcgcccggccgcccttcgcggcatcgagcctgtgcccctcacccgcgcaggcgtgatcggcggcggcacgatgggcagcggcatcgcggccgccctcgccgcggccgggctggaggtgcgtctcactgaaaccgggcccgagtcgctcgcggccggcctcgagcgggtcgaggccatcttcgaggcgcaggtcaagcgcgggctgacggatcgggccggcgcggcggagcggatggcccgcgtcaccggcacggtcggtctcggggcgctggcggactgcgatctggtgatcgaggcggtcttcgaggatctcgccgtcaagcgccgggtgttcgaagagctggtccgtctttgcgggcccgaggcgatccttgccaccaacacctcctacctcgatcccgaacggatcgtggagggcctgccgcacccccaccgcttcatcgcgctgcatttcttcagcccggcgcaggtgatgaagctgctcgagatcgtgccgctggccgccaccgcgccgcgcaccctcgccaccggcgtcgctctggcggcgcggctcggcaagatcccggtacaggcgggcaacggcgagggtttcatcggcaaccgcatcctcaagcgctaccgcgccgaggccgaggctctgctgctcgcaggagccaccccgaccgagatcgacgaggccatgcgcgccttcggcctcggcatgggtccgttcgagatgcaggacatggccgggctcgacatcgccttccgcgcgcgggaggccgcccgcgcgctcgggcaggacctgcccgaaggccccggagaccggctggtgcgcgcaggccgcctcggccgcaagtcgggcggcggctggtacgactatgcgccgggcagccgccttccccagccgtcgccggaggcagccgctctgatcgcgcctctggtgacccccggcccgcggccgagcggcaccgagattgccgaccgcctcatcgccgccatggccgaggaaggccaacggatctgcgacgagggcctcgcgcagagcccctcggacatcgatctggtcgaggtgcatggctacggcttcccccgtcacaaggggggaccgatgtttcacgccgcgcgcaagacccgaagccgcacgggcggagcatga

SEQ ID NO: 72344 - protein, 655 aa, Rhodobacter sphaeroides 2.4.1
MTNDLIRRSDSDGIALLTLANPPVNALSLAVRQRLAALTAELEADESVRAVVLAAEGRVFVGGADIAEFDRPPEAPHLPDVIAAIEASRKPWIAALNGAALGGGAELALGCHYRIFADTARLGLPETSLGLIPGAGGTQRLPRRIGLAPAIEVITAGRTLSAAEAREAGLADRIAAGELIPEALAFARTLDGALPLPASAAPLADPGPAFWDEARARIARAARGNPAPAAALEAIRAGVAEGFAAGLRAERETFLRLRASDEAAALRHLFFAERAALRPAALRGIEPVPLTRAGVIGGGTMGSGIAAALAAAGLEVRLTETGPESLAAGLERVEAIFEAQVKRGLTDRAGAAERMARVTGTVGLGALADCDLVIEAVFEDLAVKRRVFEELVRLCGPEAILATNTSYLDPERIVEGLPHPHRFIALHFFSPAQVMKLLEIVPLAATAPRTLATGVALAARLGKIPVQAGNGEGFIGNRILKRYRAEAEALLLAGATPTEIDEAMRAFGLGMGPFEMQDMAGLDIAFRAREAARALGQDLPEGPGDRLVRAGRLGRKSGGGWYDYAPGSRLPQPSPEAAALIAPLVTPGPRPSGTEIADRLIAAMAEEGQRICDEGLAQSPSDIDLVEVHGYGFPRHKGGPMFHAARKTRSRTGGA

SEQ ID NO: 72345 - DNA, 2148 bp, Burkholderia cepacia R18194
  CDS (1)..(2148)
atgaccacctacaccaccctctcgtttgatgtggatgccaacggcatcggcctggccaccctcgatcagcccggccgcgcgatgaacgtgcttgccccggcgctgatggaagagttcacgcgcgtcatcgggcacgtggaacaggaagccgggatcaagggcctcgtgatcacgtccggcaagccgagcttcgtcgccggcgccgacatcgaccagctcagccggatcacgtccgccgaacaagccttccagttgagcgagcagctcaaggcgctgctgcgccgcatggaaacatgcggcaagcccgtggtggccgcgctcaacggcaccgcgctcggcggcgggctcgaactggcgctggcctgccatgcgcgctttgcgatcgacgatcccaaggcgaagatcggtctgcctgaagtcaagctgggcctgctgcccggcggtggcgggacccagcgcctgccgcgcatgatcggcatccagaagagcttcgagctgatcacccagggcatcgagctgagcccggccaaggcgctgggtctcggcctgctgaacgaactggccgccacgcgcgaggaactgctgcaaaaggcccgcgcatggtgcgtggcgcaccccgcgcccgtgcagccgtgggacaccaagggttttcgcattcccggcggcgacagcaagagtcctgccgtcgttcaaatgctggccatcgcaccttccatcgcgaatgcaaaggcgcatggcaactatccggccctgacccacatcatgagttgcctgttcgagggctgcctgctcgacttcgacaccggctcgcaggtggagtcgcgctatttcgccgcctgcgtgatgtcgcaggtcagcaggaacctgatcggcacgctgtggtaccagctcaatgcgatcaagaaggggcagtcgcgccccgccggcatgccgccggccaaggtgaagaaggtgggcatcctcggcgcgggaatgatgggtgcgggcattgcttacgtgtcggccaaggcggggatcgacgtggtgctgctcgacacgacgcaggagaacgccgagaaaggcaaagcctattcgcaaggactgctggacaaggcgctggcgcgcggcaagaccacgcaggacaagcgcgacgccctgctcgcgcgcatcctgcccaccacgcgctacgacgacctgcggggctgcgacctggtggtcgaggccgtgttcgaggaccgcgcgatcaaggccgactgcacgacgctggccgaggccgtcatcggcgacgatgcggtgttcgcgtccaacacatccacgctgccgatcacggggctcgcacacgtgagccgccgtccggcccacttcatcggcctgcacttcttctcgcccgtggacaagatgccgctagtcgagatcatcgtgggcgcgaagacctcggacgagacgctggcgcgcggcttcgactacgtgctgcagatcggcaagacgcccatcgtcgtgaatgacagccgcggcttctacacgtcacgcgtgttcgccacctacgtgatggagggcatcgcgatgctggccgaaggcgtgcatccgcgttccatcgaggtggccggtctcaaggccggcatgcccatgccgccgctggcgctgcaggacgaagtgtcgctcggcctgtcgctgcacgtgacggaccagacccgccgcgacctggaggccgaaggcaaggattacccgccgcaccctgcggaggccgtgctgcgcaaggtgggcctcgacctgggccgggtcggcaagaaagcgggcaaaggcttttacgactaccagggcaaggaaaagtcgctgtggcccgagctcaccgcgctctacccgccgcgcgccgaccagcccgcgcagcaggagctggtggatcgcctgatgttcatccaggcgaacgaagccgcgcgctgcttcgaggaaaacgtggtgcgctcggtggccgataccaacatcggctcgatcttcggctggggctttgcaccccaccacggcggggccttgcagttcatcaatgcgatgggcgcgcaacgcttcgtgcagcgtgcgcgcgaactggcggcgcagtatggcgcgcgtttcgagcccgcggcgatcgtggtcgagctggcccgtgcaggcgggaggttcgaggatgcatga

SEQ ID NO: 72346 - protein, 715 aa, Burkholderia cepacia R18194
MTTYTTLSFDVDANGIGLATLDQPGRAMNVLAPALMEEFTRVIGHVEQEAGIKGLVITSGKPSFVAGADIDQLSRITSAEQAFQLSEQLKALLRRMETCGKPVVAALNGTALGGGLELALACHARFAIDDPKAKIGLPEVKLGLLPGGGGTQRLPRMIGIQKSFELITQGIELSPAKALGLGLLNELAATREELLQKARAWCVAHPAPVQPWDTKGFRIPGGDSKSPAVVQMLAIAPSIANAKAHGNYPALTHIMSCLFEGCLLDFDTGSQVESRYFAACVMSQVSRNLIGTLWYQLNAIKKGQSRPAGMPPAKVKKVGILGAGMMGAGIAYVSAKAGIDVVLLDTTQENAEKGKAYSQGLLDKALARGKTTQDKRDALLARILPTTRYDDLRGCDLVVEAVFEDRAIKADCTTLAEAVIGDDAVFASNTSTLPITGLAHVSRRPAHFIGLHFFSPVDKMPLVEIIVGAKTSDETLARGFDYVLQIGKTPIVVNDSRGFYTSRVFATYVMEGIAMLAEGVHPRSIEVAGLKAGMPMPPLALQDEVSLGLSLHVTDQTRRDLEAEGKDYPPHPAEAVLRKVGLDLGRVGKKAGKGFYDYQGKEKSLWPELTALYPPRADQPAQQELVDRLMFIQANEAARCFEENVVRSVADTNIGSIFGWGFAPHHGGALQFINAMGAQRFVQRARELAAQYGARFEPAAIVVELARAGGRFEDA

SEQ ID NO: 72347 - DNA, 2103 bp, Rubrivivax gelatinosus PM1
  CDS (1)..(2103)
atgagtgcccgttatgcagtccacggcccggcggccgtcatcacgctcgacaacccgccggtcaacggcctgggccatgccacccggcgcgacgtggccgacggcctggtgcgtgcccaggacgatccggcggtgcaggcgatcgtgatcaccggcgccggccgggccttctcgggcggcgccgacatccgcgagttcgacacgccgcaggcgatgcgcgagcccaacctgctgagcctcatcctcgccatcgaggcgtcgggcaagccggtgatcgccgcgctgcacacggtctgcatgggtggcggactggagctcgcgctcggctgtcattaccgcgtggccgcgccgggctgccaggtcgccctgccggaggtgaagatcggcctgatcccgggggccggcggcacgcagcgcctgccgcgcgtgctgggcgtcgaggacgcgctgaacatgatcctcagcggcgagccggtggcgagcgagcggctcgcggcgctgcccggccagcggctgttcgaccggctggtcgagggcgatctgatgaccggggcgctggccttcgcggccgaagtggcggctcggcgcccgctcccgctggtgcgccggctcacggcccatcacccgaacgccgacgcctatttccagttcgcccgcaacaccgccaccgcgatggccccgcagttcccggcgccgcgcaagtgcatcgacatggtcgccgcctcggtggcgctgccgttcgatgagggcctgcggctggagtggtcgaccttcaccgcgctgatgctcacgcccgagtcgcgtgcgctgcggcatgtgttcatggccgagcgcgcggcgggcaagatcgccgacgtgccggccgacacgccggtgcgcagcgtgaagcggctcgccgtcatcggcgccggcaccatgggcggcggcatcgcgatgaacttcctcaacgccggactgccggtggtgatgctcgagacgaagcaggaggcgctggatcgcggcgtggccacgatccgacgcaactacgaggcgcaggtgaagaagggcaagctcacggccgagcgggccgagcagcgcctgggcctgttgagcacgacgctggactacgccgacctggccgacgccgacatggtgatcgaggcggtgttcgaggacctgggcgtcaaggaacaggtgttccgtcgcctcgacgaggtgatgaagcccggcgccatcctcgcgtccaacacctccacgctggacctgaaccgaatcgccgcgttcacgcggcggccacaggacgtgatcggcacccacttcttcagcccggccaacgtgatgaagctgctggaggtggtgcgcggtgagcagacgggcaaggacgtgctcgccaccgtgatgcagctgggcaagaagatccgcaagacctgcgtggtctcgggcgtctgcgatggtttcatcggcaaccgcatggtcgagcagtacctgcgccaggccttcctgctggtcgacgaaggcagcacgccacagcaggtggacaaggcgatcgagcgcttcggcttcgcgatgggtccgttccgcatgagcgacctggcgggcaacgacatcggctgggcgatccgcaagcgtcgctacgccgaacggccgcacatgcagtacagcaagacccccgacttgctgtgcgagaccggccgcttcggccagaagaccggtgccggctggtacgactaccaggccggcaagcgcgacgcgatcccgtcgccggtggtgctcgagctgatcgaaggccatcgcaggacgctgggcatcacgccgcgcaagatcggcgacgacgagatcgtcgagcgcctggtctacgcgctggtgaacgagggcgcgcacctgctcgaggaggggatcgcggccaaggccggcgacatcgacatggtctacctcaccggctacggcttcccgctgcaccgcggcgggccgatgcgccatgccgacgaggtgggcctgttcaacgtggtgcgcgcgatgcggcgcttccagcacaacccgctcgacgacgcggccttctgggagccggcgccgctgctggcgcgcctggctgccgacggcaagaccttcggccacggcctgtaa

SEQ ID NO: 72348 - protein, 700 aa, Rubrivivax gelatinosus PM1
MSARYAVHGPAAVITLDNPPVNGLGHATRRDVADGLVRAQDDPAVQAIVITGAGRAFSGGADIREFDTPQAMREPNLLSLILAIEASGKPVIAALHTVCMGGGLELALGCHYRVAAPGCQVALPEVKIGLIPGAGGTQRLPRVLGVEDALNMILSGEPVASERLAALPGQRLFDRLVEGDLMTGALAFAAEVAARRPLPLVRRLTAHHPNADAYFQFARNTATAMAPQFPAPRKCIDMVAASVALPFDEGLRLEWSTFTALMLTPESRALRHVFMAERAAGKIADVPADTPVRSVKRLAVIGAGTMGGGIAMNFLNAGLPVVMLETKQEALDRGVATIRRNYEAQVKKGKLTAERAEQRLGLLSTTLDYADLADADMVIEAVFEDLGVKEQVFRRLDEVMKPGAILASNTSTLDLNRIAAFTRRPQDVIGTHFFSPANVMKLLEVVRGEQTGKDVLATVMQLGKKIRKTCVVSGVCDGFIGNRMVEQYLRQAFLLVDEGSTPQQVDKAIERFGFAMGPFRMSDLAGNDIGWAIRKRRYAERPHMQYSKTPDLLCETGRFGQKTGAGWYDYQAGKRDAIPSPVVLELIEGHRRTLGITPRKIGDDEIVERLVYALVNEGAHLLEEGIAAKAGDIDMVYLTGYGFPLHRGGPMRHADEVGLFNVVRAMRRFQHNPLDDAAFWEPAPLLARLAADGKTFGHGL

SEQ ID NO: 72349 - DNA, 2112 bp, Pseudomonas fluorescens PfO-1
  CDS (1)..(2112)
atgtgtgacctgatccattaccgcgtcgtagatggcctggcgctgatcggtcttgaccgtgcgccggtcaacgcactcgaccagaccctacgtgcagccctcattgatgcctgtgagcgtgccgctacggacatagcggtgggtgccgtcattctctatggggtgcagggactgttcagtgctggtaccgacatcaaagaattcgggaccgaagcgtgcttcgctgaacctgacttgcctggcatcctgactcgcttgagcgcgcttcataaaccactgattgcggcgatcggtacgtttgcgttaggaggagggctagagctggccctggcctgcggataccggattggtgcgccagatgcacggctagggttgtcggaaatcaatcttggtctgatgcctggcgccggcggtacgcaacgcttgcccaggctgataggcgccgaatcggctttgaacctcattctttcaggtgagcagatcgatgccgagcgtgctcgaatgctcggcattcttgaccgtatctcctccagcaccgaacagttgctggaagaggcgcgcgcttatgccaatgagttgatcgaatgttgtgctcctgcgcggccagccgaagcatggccaaaccccgccgaggacttgcccgatgatttcctggcgcgttatcgcgtggagcatgagccgcgctggaaaagtcgactggcgcccaggttggtgctttctgcgctggaggccgcctgcctgttgccgttggaagagggactggtgcgggaattgacgctgttcaagcaggctgaagcatcacgtcagtcgaaagcattgcggcatgttttcttcgcagaacaagacgcgcggcgaacgccccggatcgatacggctgatccgtcgcgcaagatcaacaaggttgccgtgatcggtgcaggcaccttgggtggaggcatcgcgatgagctttgccgatgtagggattcccgttgcgctgatggatcttgatgggcgcacgctggatcgcggtctcaaacgtgttcgtgaaaactatcaactcagcgtcaagcgcggaaaactcagtgccgtgcaaatgcagcagcggatggaactgctgtttggcacgctcgactacgcagacctttcagatgccgacctgatcattgaggcggtatgcgaaaagatggagagcaagcatcaggtgttcctcgctctggagagcgtgtgtaagccaggtgccattcttgcgaccaatacgtcgtcgctggatatcgatgcgctcgcgaagatggtctctcgtccgcaggatgtcattggcatgcatttctttagtccggccaacgtcatgcgattggtggaaattgtgctttgtcagacgacagcgccggacgtcgtaaccgctgtcatggacatcgccagacgtatcggcaaacttccggtcatctccggtaacagcgccggctccatcggtaatcgcatgctcgaaccctatgcccgcgaagctcaccgtctggtactggagggggcgacgccggtccaggttgatgcagtgctgaccagtctggatttgaatatgggcgtattcagcatgctggatctggcaggtatcgatgtgagctttctaatgcgcgacgccaatcgtgaagccatcgcccatgaccagagctactgctgccttgccgaggaactgtatgccttgggacggtacgggcaaaagaccggacgtggcttttacctctacgagggacgtagtccaagggaagaccgggaagtcatcatgctggcagagcagcttgcccgtgaacacaacgttacgcgtcgcaacatcgaagatctggaaattcacgatcgctgcctgtttgtaatgatcaacgaaggcattcgcttgctggacgaaggtattgcgctgcgtgccagcgacatcgatctggtgtggatcaacggctatggctttcccgcgcatctcggaggccccatgcattacgccgagcagttgggcctggaaacggtgctcagccgcatccatcactatcgcagcgcgcttggcgaatacggtgagatgtggtttcgcccagcggcgcttctggaacgtctggtagccgccggcagatctcgcatcgaaatattctga

SEQ ID NO: 72350 - protein, 703 aa, Pseudomonas fluorescens PfO-1
MCDLIHYRVVDGLALIGLDRAPVNALDQTLRAALIDACERAATDIAVGAVILYGVQGLFSAGTDIKEFGTEACFAEPDLPGILTRLSALHKPLIAAIGTFALGGGLELALACGYRIGAPDARLGLSEINLGLMPGAGGTQRLPRLIGAESALNLILSGEQIDAERARMLGILDRISSSTEQLLEEARAYANELIECCAPARPAEAWPNPAEDLPDDFLARYRVEHEPRWKSRLAPRLVLSALEAACLLPLEEGLVRELTLFKQAEASRQSKALRHVFFAEQDARRTPRIDTADPSRKINKVAVIGAGTLGGGIAMSFADVGIPVALMDLDGRTLDRGLKRVRENYQLSVKRGKLSAVQMQQRMELLFGTLDYADLSDADLIIEAVCEKMESKHQVFLALESVCKPGAILATNTSSLDIDALAKMVSRPQDVIGMHFFSPANVMRLVEIVLCQTTAPDVVTAVMDIARRIGKLPVISGNSAGSIGNRMLEPYAREAHRLVLEGATPVQVDAVLTSLDLNMGVFSMLDLAGIDVSFLMRDANREAIAHDQSYCCLAEELYALGRYGQKTGRGFYLYEGRSPREDREVIMLAEQLAREHNVTRRNIEDLEIHDRCLFVMINEGIRLLDEGIALRASDIDLVWINGYGFPAHLGGPMHYAEQLGLETVLSRIHHYRSALGEYGEMWFRPAALLERLVAAGRSRIEIF

SEQ ID NO: 72351 - DNA, 2091 bp, Ralstonia metallidurans CH34
  CDS (1)..(2091)
atgagcgacattgtcaactacgaacttcgcggcccggttgccgtgctttcgatgaacaaggggccggtcaacggtcttggcgcggcactgcgcacggccatcgccgatgcggtggatcgggccaacgcggacccggccgtgcaggccatcgtgctgaccggtacgccccgcgcattctcagccggtgccgacatcaccgagttcggaacgcccaacgcctcgcgcgagcccaatctgcgcgtcgtgatcgaccagatcgagggcggcgccaagccggtggttgccgcgatcgccgggcagtgcctgggcggtggactggaactggcgttgggttgccactttcgcgttgcgctgccggacgcccagttgggctttccggaagtcaagattggcctgctgcccggtggcggcggcacgcagcgcatgccgcgcctgatcggcctggagccggccgtcaacatggtgaccctcggcaacccggctcccgccaagagtttcgcgggcacgccgctgatcgaccgtgtggccgatggcgacgtggttgccgccgcggtggcattcgcccaggagctcatcgcagcgaagacgccaccgcgccgcacccgcgcactgagcgtcagccacccgcaaggcgagtctttcctgcagttcgcccgcaacagcgtggcgcaacaagccaagggacagatcgcaccgatgaaggcgctggaagccgtggccgcatcgttgaccaagtctttcgacgaaggaatgcgcgtggagcgcgaaggcttcatgagcctgatggcctcgccggagtcgcgcgcgctgcgccatatcttcaaggcggagcatgctgcgtcgaagatcgccgatctgccggccggcacgccgctgcgcgagatcaggaaggttggcgtgatcggtgccggcaccatgggcggcggcatcacgatgaacttccttaacgccgggattcccgtcgtactgctggagatgaagcaggaagcgctggacaaggggctggcaaccatccgccgcaactacgaaaactcgatgaaaaagggcaagctcaagcccgagcaggtcgagcagcgcatggggctgatcaccggcacgctgagctatgcagacctgtccgatgtggatctggtcatcgaggccgtgttcgagaacatggacgtcaagaagaccgtgttcgaaacgctggacaagacatgcaaggccggcgccatcctggcgtcgaacacgtcgtacctgaatctcgaccgcatcgcttcgttcaccaagcggccgaccgacgtgatcggcctgcacttcttcagcccggccaacgtgatgcgcctgctggaaatcgtgcgcggcgcgcagaccgcgcccgacgtgctggccacctgcatggcgctggcgaagaagatcaagaagatcgccgtggtctccggcgtgtgcgacggctttatcggcaatcgcatgctggcgcgctacggagccgccgccggcgcgttgatcaacgccggcgcgctaccgcagcagatcgacggggcgctgcaaaaattcggcatggccatgggcccataccgcatgggcgatctggcgggcctggacatcggctatgccacgcgcaagcgcaaggctgccgaggccggcgtaccgcttcgtccgtcggtggccgacaagctggccgaggccggccgcttgggccagaagaccggcgccggctggtatcgctatgaagccggcaatcgcgacccgatcccggacccggccactgaagccctgatcgccgaattccgcagcgcccagggcatcacgccgcgcgctatcagcgatgaagaggtagtggagcgctgtatcttcgccctcgtcaacgaaggcgcacgcattctggaggaaggcatcgccgcacgtgcctccgatctggacgtggtctatctcaacggctacggcttcccccgactgcgcggcggcccgatgctgtacgccgacatggtgggcctgcccaacgtcgtgcggagcctgcgccgcttcgccgccgaaccgggcgccgacccggcctggcagcctgcgccgctgctggtgcgcctggccgaagcaggcaagagcttcgattga

SEQ ID NO: 72352 - protein, 696 aa, Ralstonia metallidurans CH34
MSDIVNYELRGPVAVLSMNKGPVNGLGAALRTAIADAVDRANADPAVQAIVLTGTPRAFSAGADITEFGTPNASREPNLRVVIDQIEGGAKPVVAAIAGQCLGGGLELALGCHFRVALPDAQLGFPEVKIGLLPGGGGTQRMPRLIGLEPAVNMVTLGNPAPAKSFAGTPLIDRVADGDVVAAAVAFAQELIAAKTPPRRTRALSVSHPQGESFLQFARNSVAQQAKGQIAPMKALEAVAASLTKSFDEGMRVEREGFMSLMASPESRALRHIFKAEHAASKIADLPAGTPLREIRKVGVIGAGTMGGGITMNFLNAGIPVVLLEMKQEALDKGLATIRRNYENSMKKGKLKPEQVEQRMGLITGTLSYADLSDVDLVIEAVFENMDVKKTVFETLDKTCKAGAILASNTSYLNLDRIASFTKRPTDVIGLHFFSPANVMRLLEIVRGAQTAPDVLATCMALAKKIKKIAVVSGVCDGFIGNRMLARYGAAAGALINAGALPQQIDGALQKFGMAMGPYRMGDLAGLDIGYATRKRKAAEAGVPLRPSVADKLAEAGRLGQKTGAGWYRYEAGNRDPIPDPATEALIAEFRSAQGITPRAISDEEVVERCIFALVNEGARILEEGIAARASDLDVVYLNGYGFPRLRGGPMLYADMVGLPNVVRSLRRFAAEPGADPAWQPAPLLVRLAEAGKSFD

SEQ ID NO: 72353 - DNA, 2109 bp, Ralstonia metallidurans CH34
  CDS (1)..(2109)
atgagctggcaacagcagggcgatatcgccgtgctgtggctcgacaacccgccggtgaacggcctgggcgatagcacccgcgccggcctgcacgccgggatcacgcgcgcgctgcaggatgccaccgtggccggggttgtgctggcaggcgccggcaaggcgttttgcggcggcgcggacatccggcagttcaatacgcctgccgcgaccgcccggccgcttacgcgcgatgtgctggcgctgatcgaatcggcgagcaagcccgtggtggctgcgatacacggcgtggcgctcggtggtggcctggagctggccatgggatgccactatcgcgtggtggcatccgacgccagcctgggtctgccagaggtcaacctcgggctcgtgcccggtggcggcggtacccagcggctgccacggctcgttggtgtggaacaggcgctggacatggttcagcaaggggcgtccgtcagcggcgaagccgccgcgcgcatcggtcttgccgatgcggtagcagacgcgaggccgagcggcacacgggatgctggacctgttgtcgcactggcgatcgacttttgccggagtgctgccgcccgtgcggtggcgcatccggttgccagtgcgttggccgtcaaggcgagcggcgatgtcgatttcggggcgcggattgccgcgatcaacggcaaggcacgcaatgcgctcgcgcagaatgcgtgcatccggtgcgtcgaagccgcgacgcagctgccgattgccgacgggctggcattcgagcgcgcccagttcgaggcgcttgttgcgggcaacgagtcgaaggcgctgcgccatattttcttcgccgagcgcgaggcgccgaagtttgccgaagggaagggactggcgctgcggccgatcgaacgtgtcgccgtcatcggttccgggacgatgggcgtcggcatcgcaatgtcgttcgtcaacgcaggcattccggtcatgctgatcgaacgcgagcaggccgcgctggaccgcggcatggcactgatccgccgcaactacgagatcaccgccgcgaaaggcaagctggcgccgcagcagattgacgcgtgcatggggcgcataacgccgacgctggcgttcgaggccgtggccgatgccgatctggtggtcgaagccgtgttcgaggacatggccgtgaagcaggccatcttcgagcgtctggacgcgctgtgcaagccgtcggccatcctggcgacgaatacgtcgcggttgaacatcgacacgatcgcggcgtcgaccaaacgcccgggcgacgtgatcggcctgcattttttcagcccggcgaacgtgatgaagctgctggaagtcgtgcgtggacaggcgacccgcgccgacgtcatcgcgtcgtgcatggcgatggcgcagcgcatccgaaagattccggtgctggtgcgggtgtgcgaagggtttgtcggcaaccggatgctgacgccttactggcgggaggccggcttcctgttggaagagggcgcatcgccactgcaggtcgatcgcgcattgacgcagttcggcatggcgatgggcccgctgacgatggcggatttggccggcatggacatcaactgggccacgcggaagcggctggcgccgacgcggccggcgcacctgcggtattcggcggtggccgatcgaatctgcgaactgggccggttcgggcagaagaccaacggtggctactaccgctacgaacccggcagtcgcacgccgatccccgacccgcagatcgacgcgttgatcgaagagtgcgcgcgcgaggcaggcattacgcggcgaccggttgccgacgaggagatcgtcgagcgctgcatgctggcgctgatcaatgaaggcgcgcgcatcctggacgagggcatcgcgcagcgcgcttccgatatcgacgtggtgtacgtgcatggctacggctttccggcgtggcgtggcggccccatgttctatgcggaaacgctcggtctggcgcacgtgctggcccgtatccgcgcgttgcaggacgtgcacggtgcccattgggagcctgcgccactgctcgagcggttggtcgcagaaggccggcagactttcgacggtccacgttga

SEQ ID NO: 72354 - protein, 702 aa, Ralstonia metallidurans CH34
MSWQQQGDIAVLWLDNPPVNGLGDSTRAGLHAGITRALQDATVAGVVLAGAGKAFCGGADIRQFNTPAATARPLTRDVLALIESASKPVVAAIHGVALGGGLELAMGCHYRVVASDASLGLPEVNLGLVPGGGGTQRLPRLVGVEQALDMVQQGASVSGEAAARIGLADAVADARPSGTRDAGPVVALAIDFCRSAAARAVAHPVASALAVKASGDVDFGARIAAINGKARNALAQNACIRCVEAATQLPIADGLAFERAQFEALVAGNESKALRHIFFAEREAPKFAEGKGLALRPIERVAVIGSGTMGVGIAMSFVNAGIPVMLIEREQAALDRGMALIRRNYEITAAKGKLAPQQIDACMGRITPTLAFEAVADADLVVEAVFEDMAVKQAIFERLDALCKPSAILATNTSRLNIDTIAASTKRPGDVIGLHFFSPANVMKLLEVVRGQATRADVIASCMAMAQRIRKIPVLVRVCEGFVGNRMLTPYWREAGFLLEEGASPLQVDRALTQFGMAMGPLTMADLAGMDINWATRKRLAPTRPAHLRYSAVADRICELGRFGQKTNGGYYRYEPGSRTPIPDPQIDALIEECAREAGITRRPVADEEIVERCMLALINEGARILDEGIAQRASDIDVVYVHGYGFPAWRGGPMFYAETLGLAHVLARIRALQDVHGAHWEPAPLLERLVAEGRQTFDGPR

SEQ ID NO: 72355 - DNA, 2145 bp, Burkholderia fungorum LB400
  CDS (1)..(2145)
atggtcaccacccataccgaaggcccgatcggccatctcgtgatcgacgttcccggacgctcgatgaacgtcctcgaccccgaactggcacacgcgctcgacgaagcattgacgaggctggttgacgacgaagccgtgcggggcatcgtgatcagctccggcaagtccagcttcgtcgccggcgccgacctcgcgcgcatgagcgacttcgtcaagcccggcgtgagtcaggcggacgcgttggggctgatcggcctctacaaccggctgctgcgccgcatcgagacgtgcggcaaaccggtggtcgccgcggccagcggcacagcgctgggcggaggcctggagctgatgctgtgtgcccactaccgcatcgccacggacgatcccaaggcccgcttcggcctgccagaggtgggcttgggcctgctgcccggcgctggcggcacccagcgcctgcctcgcctgataggtattgccgccagcctgccgctcttgacgcaaggcacctcactggatgcccgcgcagccctcaagctcggcatcctgaacgaggtcgtgccggccggcgagcttatccaggcagccagccgcgcgctgctcgaaggccgcgtcaaggccatcgcgccgtgggacgaaaaaggtttcaggctgcccggtggcgatgcgtacagccgcgtgaacagcgacgcgctaatggccgccaatgcgtcgctgcatgccgccacgaaaggtaactatccggctccccaggctattctgcgggccgtctacgagggcaccagattgccgatcgacaagggcctgaaactggaacagcaactgttcgtgaagctcgtccagggcgcggtggcgcagaacatgatccgcaccctgttcttcgcgaggcaggccgccgacaagctgtcccggcgtcctgcaggcatcgcgaagcagtccgtgcgccgccttggcatcgtgggtgccggcttcatgggcgcgggcatcgcccaggtttcggctgcggccggcatcgacgtcgtgctgcttgaccgcgacctcgcaaccgccgggcgcggccgcgacagcattgccaaagccttgcaggccgaggtggacaagggccggcttcgcgaagcagtacgcgatcagatccttagccgcatcgaggtagcggcggaccattccgctttcgggaactgtgatctggtcatcgaagcggtgctcgaggacttcgaggtcaaggcatcggtcacccgtgccaccgaagcggcattgcctgcgcacgccatcttcgcgagcaacacgtccgcgctgcctatcaacgaactggcgtccgccagcgcgcgtccacagaactttatcggcctgcatttcttctcgccggttagccgcatggcgctggtggaggtcattgtcggctcggccacatccgacgagacacttgcccgctcgctggattacatccagcagattcacaagacgcccatcgtcgtgcgcgacggctacggcttctatacgacccgctgcgtcgaagcgtacatccgcgaaggggtacgtctgctcgccgacggggtgaacccggtcctgatcgagaacgctggcactgccctaggcatgccggtgggtccgctgacgctggccgacgaagtcggcatcgacgtactgcaccacattgtcagtctgtttcgcgaccgcgagcatggtcgctgggccgacgacaagcacggcgctggcaacgcgatcctcggccggctcgaactggcagggcgcttcggtcgcaaggccggacggggcttcttcgcctacccgcccggcgagcccaggcatcttgagctgggcgatctggatttatcagtggcagcggatcagccagaagtcggacaggtcaaggagcggctgctctacgctcaggtgctcgaagctgcgcgctgctggactgacggcgtgatcgacgatgcccgggaagccgacctcggcgcccatctgggctgggcctttccttcatggcttggcggcccgctggcgtttatcgacaccgtcggcattaccaacttcgtgcagcgcagcgacgaactggtggcccgctacggcccgcgcttcgaggtgccgggtcgcctgcgcgaggcggcggccgggggccaacgcttccacgcagtggccgcctga

SEQ ID NO: 72356 - protein, 714 aa, Burkholderia fungorum LB400
MVTTHTEGPIGHLVIDVPGRSMNVLDPELAHALDEALTRLVDDEAVRGIVISSGKSSFVAGADLARMSDFVKPGVSQADALGLIGLYNRLLRRIETCGKPVVAAASGTALGGGLELMLCAHYRIATDDPKARFGLPEVGLGLLPGAGGTQRLPRLIGIAASLPLLTQGTSLDARAALKLGILNEVVPAGELIQAASRALLEGRVKAIAPWDEKGFRLPGGDAYSRVNSDALMAANASLHAATKGNYPAPQAILRAVYEGTRLPIDKGLKLEQQLFVKLVQGAVAQNMIRTLFFARQAADKLSRRPAGIAKQSVRRLGIVGAGFMGAGIAQVSAAAGIDVVLLDRDLATAGRGRDSIAKALQAEVDKGRLREAVRDQILSRIEVAADHSAFGNCDLVIEAVLEDFEVKASVTRATEAALPAHAIFASNTSALPINELASASARPQNFIGLHFFSPVSRMALVEVIVGSATSDETLARSLDYIQQIHKTPIVVRDGYGFYTTRCVEAYIREGVRLLADGVNPVLIENAGTALGMPVGPLTLADEVGIDVLHHIVSLFRDREHGRWADDKHGAGNAILGRLELAGRFGRKAGRGFFAYPPGEPRHLELGDLDLSVAADQPEVGQVKERLLYAQVLEAARCWTDGVIDDAREADLGAHLGWAFPSWLGGPLAFIDTVGITNFVQRSDELVARYGPRFEVPGRLREAAAGGQRFHAVAA

SEQ ID NO: 72357 - DNA, 2121 bp, Burkholderia fungorum LB400
  CDS (1)..(2121)
atgaccctcaatccatcagccgacgttgtgacgcgcgaattgcgcggcaaggtgctgctcgtgacgatcgaccacgcaccggtcaacgccctctccgccgacgtgcggcgcggtctgctcgccgccgtcgaagccgcggacgccgatagcgccgtgcaagccgtgctgatcgtcggtgcggggcgcaatttcatcgccggcgcggacattcgcgagttcggcaagccgccgctgccgcccgcgctcccggacgtatgcaaccgcatcgaagcgtgcacgaaaccggtggtggccgcgattcacggcgcggcgctcggcggcggtctggaagtggcgctcgcggcgcactaccggattgccgtggaaggcgcgaaactcggcctgcccgaagtgcagctcggcctgttgccgggcgcgggcggcacgcagcgcacgccgcgcctgatcggcgcgcaggccgcgctcgatctgatcctgagcggccgccatgcgagcgcgaaggaagcgctggcgctcggcctgatcgaccgcctgggcagcagcggcgacatcctcgccgaaggactcgcgtatgtacacgagttgctggccgcccacgcgccggtgcgccgcacgcgcgacgccgtagcgcccggcgaccgcgccgcgagcctcgctgccgtaaccgcagcgcgcgcggaaaccgcgaagaaatcgcgcggcctgttctcgccgctgaaaatcgtcgacgccgtcgaggccgccatcgaacagcccttcgacgaaggtctgcgactcgaacgcaaactgttcctcgaatgcctcgacagcccgcagcgcgccggactgattcacgcgttctttgccgagcgcgaagtgctcaaggcgcccgaaacgcgcgacgccaaaccgcgcgcgctgaacgcgatcggcgtggtgggcggcggcacgatgggcgcgggcatcgctgtcgcggtgctcgacgcgggcctgccggtgaccatgatcgagcgcgacgacgcctcgcttgcgcgtggcctcgcgcacatcgaaaaagtctacgatggcctgatcgccaggggccgcatgagcgcggagaagaaagcggcggtcatgacgcgctggaacggcagtacctcttacgatgcactcaccgatgccgatctcgtgatcgaagccgtgttcgaagacctcgccgtcaaacaggccgtattcgccgaactcgatcgcgtctgcaaagcaggcgccgtgctcgcgaccaacacgtcgtatctcgacatcgacgccattgccgcgagcatttcgcgccccgccgacgtgatcggcctgcacttcttctcgcccgccaacatcatgaagctgctggaagtggtcgtgccgaaacgggtcagcgcggacgtagtcgccaccgcgttcgagctcgcgaaaaaattgcgcaaaacgccggtgcgcgcgggcgtgtgcgacggcttcatcggcaaccgggtgctggccgtgtaccgcgccgccgcggacgccatgatggaagacggcgcctcgccctatcagatcgacgccgccgtgcgtgcgttcggctttccgatgggaccgttccaggtggtggatctggcgggcggcgacatcggctgggcggcacgcaagcggcgcgcggccacccgcaatcccgcagcacggtacgtgcagatcgccgatcgcctgtgcgagcgcggctggttcggccagaaaaccggccgcggcttttatctgtaccccgaaggatcgcgcagcggcacgcccgaccccgaagtggaagcgatcatcgacgccgagcgcgcacgcgccggcatcacgccgcgcagctttaccgatgacgagatcatccgccgctatatggccgcgatgatcaacgaaggcgccaacgtcgtgcacgagcgtatcgcgctgcggccgctggacgtcgacgtgacgctcctgtacggctatggctttccgcgctatcgcggcggtccgatgaaatacgcggacatggtcggcctgcccaagattcttgccgacatccgcgaattcgccaaagaggatccgctcttctggaaggcctcgccgctgctcgtggaactggtggaacggggcgccgatttcgcgagcctgaaccagacggcctga

SEQ ID NO: 72358 - protein, 706 aa, Burkholderia fungorum LB400
MTLNPSADVVTRELRGKVLLVTIDHAPVNALSADVRRGLLAAVEAADADSAVQAVLIVGAGRNFIAGADIREFGKPPLPPALPDVCNRIEACTKPVVAAIHGAALGGGLEVALAAHYRIAVEGAKLGLPEVQLGLLPGAGGTQRTPRLIGAQAALDLILSGRHASAKEALALGLIDRLGSSGDILAEGLAYVHELLAAHAPVRRTRDAVAPGDRAASLAAVTAARAETAKKSRGLFSPLKIVDAVEAAIEQPFDEGLRLERKLFLECLDSPQRAGLIHAFFAEREVLKAPETRDAKPRALNAIGVVGGGTMGAGIAVAVLDAGLPVTMIERDDASLARGLAHIEKVYDGLIARGRMSAEKKAAVMTRWNGSTSYDALTDADLVIEAVFEDLAVKQAVFAELDRVCKAGAVLATNTSYLDIDAIAASISRPADVIGLHFFSPANIMKLLEVVVPKRVSADVVATAFELAKKLRKTPVRAGVCDGFIGNRVLAVYRAAADAMMEDGASPYQIDAAVRAFGFPMGPFQVVDLAGGDIGWAARKRRAATRNPAARYVQIADRLCERGWFGQKTGRGFYLYPEGSRSGTPDPEVEAIIDAERARAGITPRSFTDDEIIRRYMAAMINEGANVVHERIALRPLDVDVTLLYGYGFPRYRGGPMKYADMVGLPKILADIREFAKEDPLFWKASPLLVELVERGADFASLNQTA

SEQ ID NO: 72359 - DNA, 2094 bp, Magnetococcus sp. MC-1
  CDS (1)..(2094)
atgtggctcacggcggatcaaccggagcgcagcgccaatctgctctcgcgtggggtgttggaagagctgaacacccttttgctgcaactggaaaaatgggcaccggcagccttagtgattcagtcggccaaaccagcgggtttttttgccggggcggatattcagagttttgcagagatgcagcacctgcatgaggctcaggcgcttattgcggcgggccaacgggtgatggatcgtctggcacaaaccccgtatccaaccctagccctaatccatggtcactgtatggggggtgggctggaattggcattaagttgtgactatcgcattgcctgccaggatgggaacacccgtatcggcttgcccgaggtgcagttggggatctttcccgcttggggtggtacctggcgcttgacccgcgccattggtgagctgcccgccatgcagatgatgctcaatgggcagctgctccaccccaaacaggcgttgcagttgggtgtggtacacgaactgtcgccgcaacggctcatggtacgagccgctcgggatatgctcagccatccccccaaggcgcgacggcgtagcctgctggatcggctcttgagtcggcccacatggcgctgggtggcggcggcggtgatgacccgccaagtgaacaaaaaggcgcctttggaacactatccagcccctcacgcgctgctcaagcattggcgtttgaacatggcggaccatgggcaagcgatgctgggtgaacagcaggcggtggcaccattgatgggcagccacaccacccaacagttggtgcgtttgttccatcttaaggatcgtctgaagggtttggcaaaaaccgctgatggtgccatcccccgccatgtgcatgtggttggggatggggtgatggggcgggccattgcggtgtggtgtgccttgcagggtatgcaggtgtcgctgcaagggctctccaccgagctgctggggcgggcgctgcaagaggccactcaactggcccgcaaaaaacgtttggataggctggccacgcgggatttgttggatcgcttgatgcccgaccagcggggcgatggggtgtgtcatgcggatctggtcattgaggcgatttttgaggatgtgacggccaagcagcagctctacgccgcgctggagccgcgtatgcgcgagcatgccttgttggccaccaacacctcggccataccactacagaccttggcccagggcttaaaacgtccccagcagcttttgggtttgcacttttttaatcctgtcgcacgtatgccgctggtggaggtggtggagggtccccagaccagcatgcaggcgttacagatgggttatcgctttgtgcatgcgatccaacgtttgccgctaccggttaagagccgtccgggatttttggtcaaccgtgtgttgatgccctatctgatggaggctgtgcgcatggtggatgagggggtggatatgcgccgcattgataaagcggccatggactttggtatgcccatggggccgttggcgctggccgatgcggtggggttggatgtctgcaaggcggtggcacgggagctggtgggtagtgtgggtggcggtgtaccgcagcggttgttggagctggtcagtgccggtcaattggggcgcaagagcggtgcgggtttttaccgctatgggcggggacgggccaagccgggcagtcggggacgcgcctttatggaggagcgggatattacctaccggctgatattgcccatgcttaatgaggctgcggccattttacaagagggggtggtggcggatgcggatctggtggatgcaggcatggtgttcggcactggctttgcgcccttccgtggggggcctatggcttatgcggcccgcaccggagaggtctccatcatcgctctatttaaggagttagaggcgcactttggtagccgctttgccccccatagtgggtggatggcgcccagcctgaggcgttggttacaagagagggaggcgcgtcatgtggatgcatcatggcaccgatctgataccgttacagcaaacacccaccctaccggacctgttccgcatacgctgtga

SEQ ID NO: 72360 - protein, 697 aa, Magnetococcus sp. MC-1
MWLTADQPERSANLLSRGVLEELNTLLLQLEKWAPAALVIQSAKPAGFFAGADIQSFAEMQHLHEAQALIAAGQRVMDRLAQTPYPTLALIHGHCMGGGLELALSCDYRIACQDGNTRIGLPEVQLGIFPAWGGTWRLTRAIGELPAMQMMLNGQLLHPKQALQLGVVHELSPQRLMVRAARDMLSHPPKARRRSLLDRLLSRPTWRWVAAAVMTRQVNKKAPLEHYPAPHALLKHWRLNMADHGQAMLGEQQAVAPLMGSHTTQQLVRLFHLKDRLKGLAKTADGAIPRHVHVVGDGVMGRAIAVWCALQGMQVSLQGLSTELLGRALQEATQLARKKRLDRLATRDLLDRLMPDQRGDGVCHADLVIEAIFEDVTAKQQLYAALEPRMREHALLATNTSAIPLQTLAQGLKRPQQLLGLHFFNPVARMPLVEVVEGPQTSMQALQMGYRFVHAIQRLPLPVKSRPGFLVNRVLMPYLMEAVRMVDEGVDMRRIDKAAMDFGMPMGPLALADAVGLDVCKAVARELVGSVGGGVPQRLLELVSAGQLGRKSGAGFYRYGRGRAKPGSRGRAFMEERDITYRLILPMLNEAAAILQEGVVADADLVDAGMVFGTGFAPFRGGPMAYAARTGEVSIIALFKELEAHFGSRFAPHSGWMAPSLRRWLQEREARHVDASWHRSDTVTANTHPTGPVPHTL

SEQ ID NO: 72361 - DNA, 2094 bp, Thermobifida fusca
  CDS (1)..(2094)
atgatcagcgcgatcgaggccgcgcgggaacagtttgccgacgaagtcgtcacccgggcactctcccgcgacgtcgaactgccctacggggcgggcaaggccgttctcatcaccctcgacaacggccacgaccacaccaaacccaacaccttcggccctgccggcctgctgagcctcaacgaagcgatcgacgccgctgccgcacgcaccgacatcgtcgccgtagcgatcaccggcaaaccgttcatcttcgctgtaggcgccgacctcaacggggtgcccaagatccagaaccgggagcaggcgcacgccatcggcaagctcggccacgacgtgttccgcaagctcggcgaactccacgtgccgaccttcgcgttcatcaacggcgcggccatgggcggcggtgtggaagtggcgctgcactgcacctaccgcaccgtctcctccggggtgcctgcgttcgcgctgcccgaggtgttcctgggcctcgtgcccggctggggcggcacctacctgctgcccaacctcatcggcgcggaaaaggcgctgaagctcatcatcgacaacccgctggcccagaacaagacgatcaagggcccgcaggtctacgagatgggcatcgccgacgcgatcttcgaacccgccgacttcctcgaagagtcgctgcgctgggccgccaaagtggtcaccggggagatcaccgtcgagcgccccgaagtcgacaagggcgaggcatgggaccaggccgtggcgaccgcgcggtggaccgtggacgccaagctgcacggggcctcccccgccgcggtgcgggcgatcgacctggttgccgaagcgaagaaccgcacccgggatgaaggcttcgccgccgaagacgaagcgctcgccgacctgatcctcagcgaccagctccgcgccggactgtacgccttcgacctggtgcagaagcgggcccgccgccccaagggcgcccccgacaagtcgctggcccgccccgttaccaaggtcggcatcatcggcgcgggactcatggcaagccagctggcgctgctgttcgcccgccggctggaagtccccgtcgtcatgaccgacctggaccaggagcgcgtggaccgcggcgtgcgctacgtgcacgacgaggtcgacaagctgctcgccaagggccgggtcaactccgacaaggccaaccggattaaagccctggtcactgggtcgctgtcgtacgaggcgttcgccgacgccgacttcgtcatcgaagccgtcttcgaggagatgtcggtcaagaagacggtgttcgccaaggcggaagagcacatctcccccgaggcggtgctcgccaccaacacctcctcgctgtcgatcagcgagatggccgcggacctgaagcaccctgagcgcgtggtcggcttccacttcttcaacccggtggcggtgctgccgctgttggagatcatccgcggcgaacgcaccgacgacgccacgctggcgactgcttttgctgtcgccaagcagttgaagaagaccgcggtgctggtcaaggacgcgcccgcgttcgtcgtcaaccggctgctcaccctgttcatgggtgaagtgctgtcctcggtggaggaaggcaccgaaccggaggtcgccgaccgcgcggtcgcgccgctcggcctgcccatgtcgccgctgatgctgctgcaactggtcggcccggccgtggccctgcacgtggccgaaaccctgcacgccgcgttccccgaccggttccgcgtctcagagcagctcaaggcaatggtggaggcgggcaagaccacgatctacgcccccgacttcaccatcgaccctgaagtgcgggcgttcttcaccggcggcgactcccccaagagtgaggaggagatcctcaaccgtgccctggaggcgctggcccgggagatcaagatcatgctcgatgagggcgtggtcgccgagcccgccgacatcgacctgtgcatgatcaccggtgcgggctggccgttccacctgggcggtatcaccccgtacctggaccgcacgggaatctcggagaaggtcaacggggtccggttccaccccgacggtttgaaggcgctgtag

SEQ ID NO: 72362 - protein, 697 aa, Thermobifida fusca
MISAIEAAREQFADEVVTRALSRDVELPYGAGKAVLITLDNGHDHTKPNTFGPAGLLSLNEAIDAAAARTDIVAVAITGKPFIFAVGADLNGVPKIQNREQAHAIGKLGHDVFRKLGELHVPTFAFINGAAMGGGVEVALHCTYRTVSSGVPAFALPEVFLGLVPGWGGTYLLPNLIGAEKALKLIIDNPLAQNKTIKGPQVYEMGIADAIFEPADFLEESLRWAAKVVTGEITVERPEVDKGEAWDQAVATARWTVDAKLHGASPAAVRAIDLVAEAKNRTRDEGFAAEDEALADLILSDQLRAGLYAFDLVQKRARRPKGAPDKSLARPVTKVGIIGAGLMASQLALLFARRLEVPVVMTDLDQERVDRGVRYVHDEVDKLLAKGRVNSDKANRIKALVTGSLSYEAFADADFVIEAVFEEMSVKKTVFAKAEEHISPEAVLATNTSSLSISEMAADLKHPERVVGFHFFNPVAVLPLLEIIRGERTDDATLATAFAVAKQLKKTAVLVKDAPAFVVNRLLTLFMGEVLSSVEEGTEPEVADRAVAPLGLPMSPLMLLQLVGPAVALHVAETLHAAFPDRFRVSEQLKAMVEAGKTTIYAPDFTIDPEVRAFFTGGDSPKSEEEILNRALEALAREIKIMLDEGVVAEPADIDLCMITGAGWPFHLGGITPYLDRTGISEKVNGVRFHPDGLKAL

SEQ ID NO: 72363 - DNA, 1929 bp, Ferroplasma acidarmanus
  CDS (1)..(1929)
atgattaaacaggtagcggtaatcggcgcaggtgtaatgggtcatagcatagctgaagtctttgcattaaatggatataaggtgaatctggaagatttttacccggaagttatagagaaggcaaaagtggggattaatggcagtctggacaaactcattgcatcggggaagattaatgatgcagctaaaaaagcagctctggacaatatcaaattttttaataatattggagaagcagtaaaaaatgtagatctgtcaatagaagttgtacctgaaatttataatattaaagtcaaggtgctgaaggagatagcagagaatacagataaaataattgcctccaacacatcaaatattagaattactgaaatgggagaagaaataaaaaatcctgaaaggcttgttggaatgcatttctttaatccgccgatactcatgaagcttgttgaggtaataaagggagataaaacttccatggaatacgttgaagagatatatgaactggctggaaaaatagggaaaaagcccataaaagtccttaaggatgaagcaggatttgttgtcaacagaatatctgcccccgagatgctattactctgcaatgcatatggcaataaaatagaccgccctgaggcaattgacaaatactttaaatcccaggggctgcccatgggtccctaccagctgttcgactatgtaggcctggatacagttgttgattctctccagtattatggaaaagagctgtctccggattatggaaaatgccatgcctttgatagtttcatagaggcaaagcatctcgggcttaaaacaggcagtggcatatacaaatgggaaaatggaaaagctattatcccggatgccaacgaaagcgaaaaaattagccttatggatatgtttgccctggaaatcaacgaagctacaaagcttatagaagacggggttgcagtacctgacgatatagaaattggagtaaaatacgggctaaacaggccattcgggccaatcaccgtggcaaatggattgagcaacgatgaggtgcttgagacacttaataacctttacaaacagtataaaatagaggtttttaagccatcaaaaactatagagtcccataaaatgaaggagtctttcaataaaaaacctgttgaagtgaaaaaggaagaaaaatcagggattcttgattatagcaaagatggcaaggttggtgtgatcacaattaaaaatgggaaaaataatttaatgagctttgagctcctgaaggcactggacaaacaacttgatgccatagaagaagccaatgatgtaaatgtggtagtaataaaaggaaatgaaagggcgttctctgcaggagcagacctgtcacagtttataagcaatccatatatgtttatgaaaatatcaaatacaggggaaagcatattcgacagaattaccaggatgaataagattttcattgcacagctgcgtggatatgtccttggaggtggctttgaactgtcacttgcatgcgacataagaacgtctttgccggattcggtaataggattccccgagacatcccttggacttatacctggatacggaggaagccagaggctgccaaaccttataggaatttccagggcaatggacatgatattgacctgcgagaggattagcggtgaaaaggcatatgaatacggaataattacaagactatttaaagaagagctggaagaaaatacaatgaaacttgctaaagacctttcagagaagatatcgcctgcatccgtttatgtagccaagcgccttatatataatacagcaacaattaatcttgatgaagaagcactttcaatgggcatgctatatgcaggaaacgacatgaaagagggcgttaaggcattccttgagaaaagaaaaccggattacaaagggaattaa

SEQ ID NO: 72364 - protein, 642 aa, Ferroplasma acidarmanus
MIKQVAVIGAGVMGHSIAEVFALNGYKVNLEDFYPEVIEKAKVGINGSLDKLIASGKINDAAKKAALDNIKFFNNIGEAVKNVDLSIEVVPEIYNIKVKVLKEIAENTDKIIASNTSNIRITEMGEEIKNPERLVGMHFFNPPILMKLVEVIKGDKTSMEYVEEIYELAGKIGKKPIKVLKDEAGFVVNRISAPEMLLLCNAYGNKIDRPEAIDKYFKSQGLPMGPYQLFDYVGLDTVVDSLQYYGKELSPDYGKCHAFDSFIEAKHLGLKTGSGIYKWENGKAIIPDANESEKISLMDMFALEINEATKLIEDGVAVPDDIEIGVKYGLNRPFGPITVANGLSNDEVLETLNNLYKQYKIEVFKPSKTIESHKMKESFNKKPVEVKKEEKSGILDYSKDGKVGVITIKNGKNNLMSFELLKALDKQLDAIEEANDVNVVVIKGNERAFSAGADLSQFISNPYMFMKISNTGESIFDRITRMNKIFIAQLRGYVLGGGFELSLACDIRTSLPDSVIGFPETSLGLIPGYGGSQRLPNLIGISRAMDMILTCERISGEKAYEYGIITRLFKEELEENTMKLAKDLSEKISPASVYVAKRLIYNTATINLDEEALSMGMLYAGNDMKEGVKAFLEKRKPDYKGN

SEQ ID NO: 72365 - DNA, 2166 bp, Microbulbifer degradans 2-40
  CDS (1)..(2166)
atgaaatttgaaggtcaggcaatacggcttacaccgctagataatggctgtgtagagctcaactttgacttgcagggtgagtcggttaataagtttggtcaaactgtgtttaaagatcttgccgaggtgctcgatctccttgaatccgctaaagatgtaaaaggggtgttggttactagcgccaagagtgtgttttttgtgggcgcagacataaacgaatttggccccatcttcgccaagggtgaagaggccattatcgaaggggtaagcagtgttaataagctgtttagccggttcgaagacttgccattcccttcggtagtggcaattaatggctatgccttaggcggtggtttagagttttgtttggcgtgcgattaccgtgtaatgagcactgccgctaaaataggcttgcccgaaaccaagttgggtattattcctggttggggtggtactgtgcgcttgtctcgtgttgcgggtgtcgacgtggcagtggaatggattgccggcggcaccgaaaacagaccagatgctgcattaaaagcaggcgtagtagatggtattgtagaacctgaaaacctgcgcgacgccgctttaaaagtgcttgccgatgctgttgctggtgatctagaaattactcagcgcagagctaagaaaaaaggccccttaaaacataacgatattgaaagcctcctcgcttttgaatcttccaaggcctttgttaaagcaaaagctggtcgcaactacccagccccaatcgccgcaattgaatctatgcaacatggtgccaagctagggcgcgatgaggctattcctgtagagactaagctgtttgcgaaaatggcgcttactagtgtggcagaatcgttaataggtttattccaaagcgatcagctattaggtaaaaaagctaaaaattgggaaaagcaatcagacaaaaaagtagagcatgcagccgtattgggcgcgggcattatgggtggtggtatagcttatcagtctgcctaccgtggcgtgcccattaaaatgaaagacattgccgcagcgggtgtggagctgggcttaaaagaagccaccaagcttcttgcgaagcgcgtcgatagggggcgcatgaccaacctagaaatggggcaagtactaagccgcattgatggaactttaagctacgacaattttgacgatgtagatgtagtggtggaagctgttgttgaaaacccaaaggtgaagcgcgcagttttggctgaagtggaagacaaaataagcaccgatgctattttgtgttcaaacacttctactatttctatctcttatttaggtgaagcattaaagcggccagaaaatttctgcggaatgcacttttttaacccagtgcacgccatgccgttagttgaagttattcgcggtgctaaaacctctgatagagcaatagcaagaacagtggcctatgccaatgcattaggtaaaaaagcaattgttgttaacgattgccctggctttttagtcaaccgagtattgttcccttattttgctggattcgcgatgttgctgcgcgatggagcagattttcagcaagtagataaagtcatggagcgctgggggtggccaatgggcccggcttaccttatggatgttgtgggtattgatactggtgtacatgccgaatccgtaatggctgaggggtttccagatcgtatggcaaaaacctttaaagctgcgtctgatattttgtttgaatctggccgcttagggcagaagagcgacttaggtttttacgcgtataaagaagataaaaaaggtaagccgcaaaaagtaatggcggaagacacttacgagttgcttaaacctcactgcgcagaacgcaaagagtttagcgacgaggaaattattgcgcgcatgatggtgccaatggcaactgaacttgcgcgctgcttggaagagggggttgtgagcagtgccgctgaagctgatatggcgcttatttacggcttaggtttccctccattccgtggtggtgtattccgttggatagacagcattggtattcaagcgtttatcgatatggctgcgccgctggccgatttagggttggtttacgttccaactgatggaatgaaagccctagccgcaaaaaatgcaaaatattacaaccagacccaaggagcctaa

SEQ ID NO: 72366 - protein, 721 aa, Microbulbifer degradans 2-40
MKFEGQAIRLTPLDNGCVELNFDLQGESVNKFGQTVFKDLAEVLDLLESAKDVKGVLVTSAKSVFFVGADINEFGPIFAKGEEAIIEGVSSVNKLFSRFEDLPFPSVVAINGYALGGGLEFCLACDYRVMSTAAKIGLPETKLGIIPGWGGTVRLSRVAGVDVAVEWIAGGTENRPDAALKAGVVDGIVEPENLRDAALKVLADAVAGDLEITQRRAKKKGPLKHNDIESLLAFESSKAFVKAKAGRNYPAPIAAIESMQHGAKLGRDEAIPVETKLFAKMALTSVAESLIGLFQSDQLLGKKAKNWEKQSDKKVEHAAVLGAGIMGGGIAYQSAYRGVPIKMKDIAAAGVELGLKEATKLLAKRVDRGRMTNLEMGQVLSRIDGTLSYDNFDDVDVVVEAVVENPKVKRAVLAEVEDKISTDAILCSNTSTISISYLGEALKRPENFCGMHFFNPVHAMPLVEVIRGAKTSDRAIARTVAYANALGKKAIVVNDCPGFLVNRVLFPYFAGFAMLLRDGADFQQVDKVMERWGWPMGPAYLMDVVGIDTGVHAESVMAEGFPDRMAKTFKAASDILFESGRLGQKSDLGFYAYKEDKKGKPQKVMAEDTYELLKPHCAERKEFSDEEIIARMMVPMATELARCLEEGVVSSAAEADMALIYGLGFPPFRGGVFRWIDSIGIQAFIDMAAPLADLGLVYVPTDGMKALAAKNAKYYNQTQGA

SEQ ID NO: 72367 - DNA, 2091 bp, Silicibacter sp. TM1040
  CDS (1)..(2091)
atgtcagaccccgtgcttttggaaattaccgatgacatcgcggtcatcgccatcgcaaatccccccgtaaacgccctgagccattccgtacggcagggtttggacgcggcctttgacgagattgcccgccgcgatgacgtcaaggcggcggtgatctatggaaccgatcgcacctttattgccggggcggacatccgggaatttggcaaacctccgcaagagccgttccttcctgatctgataaaccgcatcgaggcctgtgcggtcccggttgtggccgcgctgcatggaaccgcacttggcggcgggttggaggtcgcgcttggcgcgcattaccgtatcgcggtaccctcggcgcgttttggtctcccagaggtgacgctgggcatcctgcccggggccggtggcacccagcgtctgccacggttggcaggggtggaatttgcgctggaggcgatcacctcgggacgtcagatcggcgccgaagaagcgctcgcggcgggtgtcattgaccggatcagcgacacggcagatatccgcgaaatgggcctgtcctatgcgcgagaactgatagcatcgggcgcgcagccgcgccgcaccagcgacatcgccccggagcccgtctctccggatgtgttcgagcaggcgcgggcaaaacttgccaagaaagcccgtggccagctggcccctcagaactgtgtcaaagcagtcgaaggcgcactctcattgccgtttgccgagggactcgccaatgagcgtgccttgtttcaggagctgatggagagcgaccagcgcgcggccttgattcatgcgttttttgccgagcgacaggtggcaaaagtgcccgaaatcaatggggtagagccgcgcgcgatctctcggatcggtgtgatcggcggcggtaccatgggcgcggggatcgcggtctcggcgttgttggcgggacttcaggtcacgttgatcgaacgcgacgccgaggcggtatcgcgtgcagaaaccaatgttgccaagatcctgcagggctcggtcaaacgcggcaagctcactcaagagaaattcgacgccatcatgcgcgaggccttcgaggccagcgcggaatacgccacgctcgcgacggctgatgtggtgatcgaggcggtgtttgagagcatggaggtcaaaaaagaggtcttcaccaagctggatgcgatctgcaagccgggcgcggttctggcctccaacacttcctatctcgatgtgaatgaaattgccgcgatgacgacgcggcctcaggatgtgatcgggctgcatttcttctcgcccgcgcatgtgatgcggctgttggagatcgtcgtggcggatgaaaccgcgcccgacgtgaccgcaaccgggtttgcccttgcgaaacggctgaaaaaagttgcggtgcgcgcaggcgtctgtgacggctttatcggcaaccggattctgagccattaccgcaaggccggagatggcgcggttctcgccggggcgagcccctttgaggtagaccgcgccctggtgaactttggccttgccatggggccctacgcggtgagcgatcttgcagggctggatatcggctgggccacgcgcaagcggcttgcgccgacgcgggacccgcgagaggtctatgccgaatttgtcgaccggttgtgcgaagcggggcatttggggcgcaaaaccggcaagggcttttacgtctatgatgacggcgggcagacgcccaacgcagaggtgctcgaccatattgccgaggaacgtgcagccaagggcattgccgcacgcgaaatccccgaacaggaaatcgtggatcgctatatggcggcgatgatcaacgaagcggcccgcgtcgttgaggagggtatcgcgctgcgtccgctggacgtcgatgtgacgttgctcaacggctatgggttcccccgctggcgtggtggtccaatgcaatatgccgacaccgtggggctggaaaaagttctcgccgacatcgagcgttttgcgcaggaggatgacttcctctggcagcctgcaccgcttttgaaacgattggtggcagagggaaagacctttgccgatctcaataacgcctga

SEQ ID NO: 72368 - protein, 696 aa, Silicibacter sp. TM1040
MSDPVLLEITDDIAVIAIANPPVNALSHSVRQGLDAAFDEIARRDDVKAAVIYGTDRTFIAGADIREFGKPPQEPFLPDLINRIEACAVPVVAALHGTALGGGLEVALGAHYRIAVPSARFGLPEVTLGILPGAGGTQRLPRLAGVEFALEAITSGRQIGAEEALAAGVIDRISDTADIREMGLSYARELIASGAQPRRTSDIAPEPVSPDVFEQARAKLAKKARGQLAPQNCVKAVEGALSLPFAEGLANERALFQELMESDQRAALIHAFFAERQVAKVPEINGVEPRAISRIGVIGGGTMGAGIAVSALLAGLQVTLIERDAEAVSRAETNVAKILQGSVKRGKLTQEKFDAIMREAFEASAEYATLATADVVIEAVFESMEVKKEVFTKLDAICKPGAVLASNTSYLDVNEIAAMTTRPQDVIGLHFFSPAHVMRLLEIVVADETAPDVTATGFALAKRLKKVAVRAGVCDGFIGNRILSHYRKAGDGAVLAGASPFEVDRALVNFGLAMGPYAVSDLAGLDIGWATRKRLAPTRDPREVYAEFVDRLCEAGHLGRKTGKGFYVYDDGGQTPNAEVLDHIAEERAAKGIAAREIPEQEIVDRYMAAMINEAARVVEEGIALRPLDVDVTLLNGYGFPRWRGGPMQYADTVGLEKVLADIERFAQEDDFLWQPAPLLKRLVAEGKTFADLNNA

SEQ ID NO: 72369 - DNA, 2202 bp, Silicibacter sp. TM1040
  CDS (1)..(2202)
atgaccgatttcaaatacgacgtagacgccgatggcatcgccatcatcacatgggacgcggaaggcaagagcatgaacgtcctcacccgcgaggcctttggcctggtggaggactatatcgaccgtgcgcttggcgatgacgccgtcaaaggcgtggtgatcacttccggcaagaaagactttgcgggcggcatggacctgaatgtgttggccaccatccgcgaggaatccggtgaaaacccggctcagggcctgtttgattttacgatgaatggccaccgcatcctgcgcaagctggagcgcgcagggatggacgccaagaacaacaagggcggcaagccgattgcctgcgccatcaatggcacctgtgcaggcatcggcaccgagatcgcgctggcctgtcattaccgaaccatgaccgacaacccaaaggccaagatcggcctgccggagatcctgctgggcatcttccccggtggcggcggtaccatccgctattcgcgcatggtgggtgccgtgaacgccgcccccgtgctgcttgaaggcaagatgatggaccccaagaaggcgaaatccgcgagccttgtggatgaggttgccgccgatccgctggaagcggcgcgtcagtgggtgctcaacgccaaagacgccgatatcgtgaagccctgggatcagaagggctacaaaatgcccggtggtgcgccctatcacccggcggggttcatgaactttgtcggcgcgtctgccatggtgcatggcaagacccaaggcgccttcccggcggccaaggcgctgctctcggcggtctatgagggcgcattggtggattttgacaccgcgctgcgcatcgaggcgcgctggttcacccatgttctgatgaacccgtcgtcctctgcgatgatccgctcgctgttcctcaacaagcaagcgctggagaaaggcgccgtgcggcccaagggcattgaggatcagtccgtgaagaagatcggcgtgctcggcgcaggcatgatgggcgcaggcattgcactggtttcagcgcaggcgggcatggaggtcgtactgatcgaccgcgatcaggacgccgccgacaaaggcaaggcctactctgccacctatatggacaagggcatcaagcgcggcaaagccacgccggagaaaaaagaggcgctgctggcgcagatcaccgcaacagcagatctcgacgccctcaaaggctgcgatctcatcattgaggcggtgtttgaagacccgggcgtcaaggccgagatgaccaagaaggtcgaggcgatcatccccgaggattgcatctttgcctccaacacctcgaccctgccgatcaccagcctggccgaggcctcggtccggcccgagcagttcatcggcattcacttcttctctccggttgagaagatgttcctggtggagatcatcaagggtgagaaaaccggcgatcgcgcggtggccaaggcgctggactatgtacgccagatccgcaagacgccgatcgtggtcaatgatgcgcgcttcttctactgcaaccgctgcatcatcccctacatcaacgagggcgcaaggatgatcaccgaaggtgtctcgccggtgctgatcgacaacgccgcgcgccagcttggcttcccggtggggccgatccagctgacggatgagacctcgatcgatctcggtgcaaagatcgcacgcgccaccaaggcggcgatgggcgacgcctatcccgaaagcccggcggacgatctgatcttctggatggaagatcaggggcgtctggggcgcaaggccaatgcgggcttctttgactatgacgacaagggcaagcgcgttgagtactggaaggggcttgcggagaaatacccgctggcggaggttcagcccgatctggttgaggtccaggagcggctgatgtttgcgcaggtccttgaggctgtgcgggcactggaggaaaacgtgctgatggacatccgcgagggtgacgtgggcgcggttctcgcctggggctttgcgccgtggtccggtggaccgctcagctggcttgacatcatcggcacgccctatgcagccgagcgttgtgaccaactggccgaggcatacggcgaccgttttgcctgcccgccgctcctgcgggagatggccgaaaaaggccagaccttctatggccggtttgcgccggaagaggatcaagccgcctaa

SEQ ID NO: 72370 - protein, 733 aa, Silicibacter sp. TM1040
MTDFKYDVDADGIAIITWDAEGKSMNVLTREAFGLVEDYIDRALGDDAVKGVVITSGKKDFAGGMDLNVLATIREESGENPAQGLFDFTMNGHRILRKLERAGMDAKNNKGGKPIACAINGTCAGIGTEIALACHYRTMTDNPKAKIGLPEILLGIFPGGGGTIRYSRMVGAVNAAPVLLEGKMMDPKKAKSASLVDEVAADPLEAARQWVLNAKDADIVKPWDQKGYKMPGGAPYHPAGFMNFVGASAMVHGKTQGAFPAAKALLSAVYEGALVDFDTALRIEARWFTHVLMNPSSSAMIRSLFLNKQALEKGAVRPKGIEDQSVKKIGVLGAGMMGAGIALVSAQAGMEVVLIDRDQDAADKGKAYSATYMDKGIKRGKATPEKKEALLAQITATADLDALKGCDLIIEAVFEDPGVKAEMTKKVEAIIPEDCIFASNTSTLPITSLAEASVRPEQFIGIHFFSPVEKMFLVEIIKGEKTGDRAVAKALDYVRQIRKTPIVVNDARFFYCNRCIIPYINEGARMITEGVSPVLIDNAARQLGFPVGPIQLTDETSIDLGAKIARATKAAMGDAYPESPADDLIFWMEDQGRLGRKANAGFFDYDDKGKRVEYWKGLAEKYPLAEVQPDLVEVQERLMFAQVLEAVRALEENVLMDIREGDVGAVLAWGFAPWSGGPLSWLDIIGTPYAAERCDQLAEAYGDRFACPPLLREMAEKGQTFYGRFAPEEDQAA

SEQ ID NO: 72371 - DNA, 2148 bp, Azotobacter vinelandii
  CDS (1)..(2148)
atgatctataaagggaaagccatcagggttcaggccctcggggatggcatcgccgagatgcagttcgacctcgagggcgattccgtcaacaaattcaaccgcctcacgctgaacgagttccgccaggcggtcgatgcgctgcaggcggagacttcgctcaagggtgtgctggtttccagcgccaagggtatgttcatcgttggcgccgatatcaccgaattcctcgaactgttccgggcgcccgaggaagagctgcgcggttggtgcctggagatcaaccggatcttctcggatttcgaggacctgccggtgccgaccgtggtcgcgatcaacggtctggctctcggtggcggcttcgagatgtgcctggcctgcgacttccgggtgatggccgagtcggccagagtgggtctgccggaggtcaagctggggatcaaccccggcttcggcggcaccgtgcgcctgccgcggctgatcggcagcgacaatgccatcgagtggatcgccgccggcaaggagaacggcgccgccgaggcgctcaaggtcggcgcggcggatgccgtggtcgccgacgagcggctgcgcgaggcggccctcgacctgctgaagcgggccgccgccggcgagctggacttccgcgcccgccgccagccgaaactggagccgctcaagctcggcaacatcgaacagatgatggccttcgagagcgccaaggcctacgtggccgcccaggccggtccgcattatccggcgcccctggcggcggtgaagaccatccagaaggccgccaactccgcgcgcgaggcggcgctggagatcgaggtcggcggcttcgtcaagctggccgccaccacggtggcgcagagcctggtcgggctgttcctcaacgagcaggagctcaagcgcaaggccaggaaatacgacaaggacgcccgcgaggtgaagcaggcggcggtgctcggtgccggcatcatgggcggcggcatcgcctaccagtcggcgctcaaggggacgccgatcctgctgaaggacattcgcgaggagtccatccgccagggtctggccgaggccgacaagcagctcgccaagcgggtggagaaaggccgcctgacggtggggcagatggccgaggtgctcaacggcatccgtccgaccctgtcctacggtgatttcccccaggtcgacctggtggtcgaggcggtggtcgagcggctagaggtcaagcaggcggtgctcgccgaggtggaggcccaggtgccgggggaggcagtgatcgcctccaacacctcgaccatctccatcagccggctggccgactcgctcaagcgtccgcagcgcttttgcggcatgcacttcttcaacccggtgccgctgatgccgctggtggaggtcatccgcggccggcagaccgacgagcggaccatcgccaccaccgtcgcctacgcgcgcaagatgggcaagacgcccatcgtggtcaacgactgtccgggattcctggtcaaccgcgtgctctttccgtatctcgccggcttcacccggctcctggccgccggcatcgacttccggcgcatcgaccgggtgatggaagggttcggctggccgatggggccggcctacctgctcgatgtggtcggtatcgacacggcggtgcatgcgcgcaacgtgctcgccgaaggctatcccgagcggatgaaggaggagggcgataccgccatcgacgtgctgctcagggccggccgtctcggccagaagagcggcagcggcttctacgcctacgagcgcgacggcggcgccaagccgaagaagctggaggacccgcgggcggccgaactgctcggtccgctggtgcgcgagacgggcgagctggacgacgaggagatcgtcgcgcggctgatgctgccgctgtgcctggaggcggtgcgctgcctggaggagggcatcgtcgagtcggccgccgaggcggacatgggcctgatctacggcatcggtttcccgcccttccgcggcggtgcgctgcgctacatcgacaccctcggcgtcgcccgcttcgtcgaactggccgaccgccacgccgacctggggccgctgtaccgaccgaccgaacaactgcgcgaaatggcccgtcagggccgtacgttctttgcctga

SEQ ID NO: 72372 - protein, 715 aa, Azotobacter vinelandii
MIYKGKAIRVQALGDGIAEMQFDLEGDSVNKFNRLTLNEFRQAVDALQAETSLKGVLVSSAKGMFIVGADITEFLELFRAPEEELRGWCLEINRIFSDFEDLPVPTVVAINGLALGGGFEMCLACDFRVMAESARVGLPEVKLGINPGFGGTVRLPRLIGSDNAIEWIAAGKENGAAEALKVGAADAVVADERLREAALDLLKRAAAGELDFRARRQPKLEPLKLGNIEQMMAFESAKAYVAAQAGPHYPAPLAAVKTIQKAANSAREAALEIEVGGFVKLAATTVAQSLVGLFLNEQELKRKARKYDKDAREVKQAAVLGAGIMGGGIAYQSALKGTPILLKDIREESIRQGLAEADKQLAKRVEKGRLTVGQMAEVLNGIRPTLSYGDFPQVDLVVEAVVERLEVKQAVLAEVEAQVPGEAVIASNTSTISISRLADSLKRPQRFCGMHFFNPVPLMPLVEVIRGRQTDERTIATTVAYARKMGKTPIVVNDCPGFLVNRVLFPYLAGFTRLLAAGIDFRRIDRVMEGFGWPMGPAYLLDVVGIDTAVHARNVLAEGYPERMKEEGDTAIDVLLRAGRLGQKSGSGFYAYERDGGAKPKKLEDPRAAELLGPLVRETGELDDEEIVARLMLPLCLEAVRCLEEGIVESAAEADMGLIYGIGFPPFRGGALRYIDTLGVARFVELADRHADLGPLYRPTEQLREMARQGRTFFA

SEQ ID NO: 72373 - DNA, 2004 bp, Azotobacter vinelandii
  CDS (1)..(2004)
ttggatgccgccaatgctgatccggcggtcgaggccatagtgctccatggcaacgacaaggtgttttccggcggggtcgacatcaatgaattcggttccgatctggcgacccgcagtccttccctgccggaattgatccgcgccgtggaaaacagccgcaagcccgtggtggccgcgctgggcgacctgtgcctgggcggcgggctcgaactggcgctcggctgtcattaccgggttttctccgcctccgccaggatcgggctgccggaggtgaccctggggctgttgccgggcgccggcggaacccagcttctgccgcgggccatcgggctcgatgccgccctgaacctcatcctctccgggcggcagcaggcggcggcggatttccgggacacggccctggtcgacgaactggcgacggaggatctgcgcgctgcggccgtggatttcgcccgccgcctgtcggccgacacggtcccctggccacgcctgcgcgatcgtccgctgcgcgtggaggtcgaggacgaactctatatccatttcgtccgcgaccggctcaagggccagaaggggcaggggccggcgccgctggccgcgctggaggccgtggccgccgccgggcgcctgccggtggacgaggggctggaagaggaaggtcgcttgttcgccgggctgcatgccggtccgcagtcgcgcgccctgtgccatgccttcctggccgagcgggccgccgggaagattcccggcatcgacgactccacgccgacgattccggtcgagcgggtcggcgtggtgggtgccggcaccatgggcaccggcatcgccatcgtctttctgaacgccggtttcgaagtggcgctgctggaaagcggcgaacaggccctggaacggggtctggccgtggtccgcgagcacttcgccgggctgctggcgaaaaagcgcctggaccaggcgcagtgcgatgccctgctcggcaagctttccggcagcctggactatgccgcgctgggcgatgtccaactggccgtcgaggcggtgttcgaggacctggaggtcaagcgccaggtgctgcggcggctggacgaggcgctgccggacggcgcgatcctcgccagcaatacctccacgctggacctgaacctgctggccgaggccacctcgcggccggagtcggtggtgggcctgcatttcttcagtccggcccaggtcatgcgcctgctcgaagtggtgcgcggccggcgcaccgccgactccgtcatggccacggccatgcgcctgggcaagcgcctgcagaaggtgagcgtggcgtccggcgtgtgcgacggtttcatcggtaaccgcatgctcaacgaatacctgcgcgtcgccggcctgctgctggatgccggcgccttgccctggcagatcgaccgggcgctggagacctggggcatggccatggggccgtttcgcatgtgcgacatggccggcaacgacatcggctgggcgatccgcaagcggcaacgggcggccgatcccggcctgcgcttttccgcgacggccgatcttttatgcgagcagggccgtttcgggcagaagaccggcaagggttggtaccgctacgaggcggggcggcgcggcggtactccggacccggaagtcgagcgactgatcgacgcttatcgcacccgcgcggggctgctaccgcggacgatcggcgaccgggaaatcgtcgagcgctgcatctatgccctggtgaacgagggcgcccgcctgctggaagagggcatcgcattgcgggcatcggatgtggatgtggtttatctggccggttacggctttcccaggttgcgtggtggcccgatgcactatgccgaggagcagggcctggccaatgtcgtacggcgcatgcgcgagttcgcgtgcgaagaagggggcgacgcgcgtttctggacgccggcgccgttgctggtgcgcctcgccgaacacgacctcggcttcggccgggcgggagaactgcaatga

SEQ ID NO: 72374 - protein, 667 aa, Azotobacter vinelandii
MDAANADPAVEAIVLHGNDKVFSGGVDINEFGSDLATRSPSLPELIRAVENSRKPVVAALGDLCLGGGLELALGCHYRVFSASARIGLPEVTLGLLPGAGGTQLLPRAIGLDAALNLILSGRQQAAADFRDTALVDELATEDLRAAAVDFARRLSADTVPWPRLRDRPLRVEVEDELYIHFVRDRLKGQKGQGPAPLAALEAVAAAGRLPVDEGLEEEGRLFAGLHAGPQSRALCHAFLAERAAGKIPGIDDSTPTIPVERVGVVGAGTMGTGIAIVFLNAGFEVALLESGEQALERGLAVVREHFAGLLAKKRLDQAQCDALLGKLSGSLDYAALGDVQLAVEAVFEDLEVKRQVLRRLDEALPDGAILASNTSTLDLNLLAEATSRPESVVGLHFFSPAQVMRLLEVVRGRRTADSVMATAMRLGKRLQKVSVASGVCDGFIGNRMLNEYLRVAGLLLDAGALPWQIDRALETWGMAMGPFRMCDMAGNDIGWAIRKRQRAADPGLRFSATADLLCEQGRFGQKTGKGWYRYEAGRRGGTPDPEVERLIDAYRTRAGLLPRTIGDREIVERCIYALVNEGARLLEEGIALRASDVDVVYLAGYGFPRLRGGPMHYAEEQGLANVVRRMREFACEEGGDARFWTPAPLLVRLAEHDLGFGRAGELQ

SEQ ID NO: 72375 - DNA, 2160 bp, Polaromonas sp. JS666
  CDS (1)..(2160)
atgaaaaccatccagtacgcactgaccgaagagtcttttggccgggtggccaccattacctttgacgagcccggctcgcccgtcaacaccatgtgccggcaatggcaggacgacctgagcgaagtcaccgcccaggtgctcaaggacagggaagccatccagggcgtgatcctggcctctgccaagagcacgttttttgccggcgccgacctgaaggccgcgatgcgactgacggccgccgatgcgtcccaggtgtacgccgagatcgaacgggtgaagaaaaacttccgcacgctggagaccctgggcaagccggtggtgagctgcctcaacggcgcggccctgggcggcggctgggaactggcgctcgtgggccactaccgtgtggcggtggatgacagcaaggtacggtttggcctgcccgaagtcacgctgggcctgctgccgggcgccagcggcgtgaccaagatgacgcgccacctgggcctgatggcagcgcagccctatctggtggaaggcaagacctttggcccgcgtgaagcgctggcgctgagcctggtgcatgcgctggtgcccgatgccgctgcactccgcgcccaggcgctcgcctggatagccgccaaccccagggcgcagcacccctgggacgccagggactacgagatccccggcggaacccctgccagccccgaggttgccgcagcgctgagcgtggcgcccgccatgctgaagaaaaagacgcgcggactctacccggccccggaagccatcctggcctgcatggtcgaaggtgcgctggtagacctggaaaccgccttgcgcattgagagccgctacctggccaggctcatgaccggccccaacgccagggccatgatcaacacctttttcttcaacatgaacgcgatcaaaagcgggcagtcgcggccgtccagcgtgccgcacgccacgcccctcaaggtcggtgtactgggcgccggcatgatgggcgcgggcattgcgtacgcgcaggccagccggggcttggccaccgtgctcaaggacgtgagcctggacaaggccgaggccggcaaggcctacagcgccaggctcacgcagccgcaggtcgagaagggccacatgaccccggcgaaccaggcagccctgctctcacgcatcacggcaactgaccagctggcggatctggcgggctgcgacctcatcatcgaggcggtattcgaacaacgcgacctgaaggccaaagtgactcaggaggccgaaccgctgctggcggcgggcggttttttcgcgtccaacacgtccaccctgcccatctccggcctggcagtggccagcagccgccccgagaaattcattggcatccacttcttcagcccggtggacaagatgaagctggtcgagatcattcgcggccggcagaccgatgacgaaaccgtggcgcgcgccttcgactacgtgcaggcgctgggcaagattcccatcgtggtcaacgactcgcgcggcttttacaccagccgcactttcgccgccttcgtgatggaaggcgcggccatgctgggcgaaggcattccggccgcggtgattgaaaacgccgggatgcaggccggcatgccggtcggcccgctggcagtgctggacgaaaccgccctgtcgctgagcgtgcatgtgctggaccagacgcgcgccgacttcgccgccgaaggcaaaacctatatcgcaacaccgggcgaattgctggtggaacgcatggtcaaggaattccagcgaaatggccgggccgaagggggcggtttttatgactaccccgctgaaaagggggcgaagaaaatgctgtggccacacctcaaggcactgtttgaaaagtccggaacaccctgggacataaccgggatcaaggaccgcctgctctaccgccaggccgtggaagcagcgcgctgcctcagcgaaggcgtgctgaccaccgtcgcagaagccaatatcggctccatcttcggcatcgggtttccggcctggaccggcggcaccctgcagttcatttacggcatgggcctggacgactttatccggcgctgcgatgaactggcggcaaaattcggcccgggctttatgctgaccaacacggtcagaagtgccctgcgcaagcaccagcccgtctactga

SEQ ID NO: 72376 - protein, 719 aa, Polaromonas sp. JS666
MKTIQYALTEESFGRVATITFDEPGSPVNTMCRQWQDDLSEVTAQVLKDREAIQGVILASAKSTFFAGADLKAAMRLTAADASQVYAEIERVKKNFRTLETLGKPVVSCLNGAALGGGWELALVGHYRVAVDDSKVRFGLPEVTLGLLPGASGVTKMTRHLGLMAAQPYLVEGKTFGPREALALSLVHALVPDAAALRAQALAWIAANPRAQHPWDARDYEIPGGTPASPEVAAALSVAPAMLKKKTRGLYPAPEAILACMVEGALVDLETALRIESRYLARLMTGPNARAMINTFFFNMNAIKSGQSRPSSVPHATPLKVGVLGAGMMGAGIAYAQASRGLATVLKDVSLDKAEAGKAYSARLTQPQVEKGHMTPANQAALLSRITATDQLADLAGCDLIIEAVFEQRDLKAKVTQEAEPLLAAGGFFASNTSTLPISGLAVASSRPEKFIGIHFFSPVDKMKLVEIIRGRQTDDETVARAFDYVQALGKIPIVVNDSRGFYTSRTFAAFVMEGAAMLGEGIPAAVIENAGMQAGMPVGPLAVLDETALSLSVHVLDQTRADFAAEGKTYIATPGELLVERMVKEFQRNGRAEGGGFYDYPAEKGAKKMLWPHLKALFEKSGTPWDITGIKDRLLYRQAVEAARCLSEGVLTTVAEANIGSIFGIGFPAWTGGTLQFIYGMGLDDFIRRCDELAAKFGPGFMLTNTVRSALRKHQPVY

SEQ ID NO: 72377 - DNA, 1902 bp, Cucumis sativus
  CDS (1)..(1902)
atgatcactgatatttttgaagctgcccgaaaacctgcggttgcagcgatagatggacttgctttgggtggagggttggaggttgccatggcttgtcatgctcgaatatcaactcctaccgctcaattagggttgcctgaacttcagctcggaataattcctggttttggaggaacacaacggcttccacgtcttgttggtctctcaaaggccctagaaatgatgttgacgtcaaagccaattaaaggacaagaagctcattctttggggttagtggatgccattgtccctcccgaagagttgatcaacactgcacgtagatgggctcttgaaatcctagagcggagaagaccatgggttcacagtcttcacaggactgacaagttagagtctcttgctgaggctaggaaaatatttaacttagctagagctcaggcaaagaaacagtacccaaatcttaagcatacaattgcctgcattgatgctgttgaaacgggtgtcgtctctggccctcgtgctggactttggaaggaggctgaagaatttcagggactcctacattctgatacttgcaaaagcttaattcatatcttctttgcccagcgttcaacaactaaggtacctggagttactgatctgggtttggtaccgagacaaatcaagaaagttgctattgtcggaggaggattaatgggatctggtatagctacagcattgattcttagcaactatcatgtggtacttaaagaagtgaacgataagttcttgcaggctggcattgacagagtcagagcaaacctacaaagccgagtcaaaaaagggaatatgactaatgagaaattcgaaaagagtatttctttactcaagggagttcttaactacgaaagttttaaagatgtagatatggtgatagaggctgttattgagaatgtttctttgaagcaacaaatcttttctgatcttgaaaaatattgccccccacattgcatgcttgctactaatacttccacaatagacttggagttgattggagagagaataaagtctcgtgacaggattattggagctcatttctttagtcctgctcacatcatgccgctattggaaattgtccgtaccaagcatacagctgcacaagtgattgttgatctgctagatgttgggaagaatataaagaaaacaccagttgtcgttggaaattgtacaggttttgctgtcaacagaatgttttttccctactctcaggctgcaattttacttgcagaacatggggtagatccctatcagattgacagggctatttccaagtttggaatgccaatgggacccttcaggttgtgcgaccttgttggttttggtgtggcagcagcaactgccagtcagtttgttcaagcttttccagaaagaacttataaatcgatgctaattcctctgatgcaagaggataagaatgcaggtgaatccactcgtaaaggtttctatgtctatgacaagaaccgaaaagctgggccaaatccagagttaaagaaatatatcgagaaggctaggaacagttctggtgtttcagttgatcctaagctcacaaagttacccgaaaaggacattgtggagatgatatttttcccagtggtgaatgaagcatgtcgtgtccttgccgaaggcatagcagtcaaagcagctgacctggacattgctggtgtaatgggaatgggtttcccctcctacaggggaggactcatgttctgggcggattctcttggatcaaattacatctattcaaggttggaggaatggtcgaaacagtatggtggatttttcaagccctgtggatacttagctgaaagggctgttcagggtgcaactctgagtgctccgggtggccatgctaaacctcgaatgtaa

SEQ ID NO: 72378 - protein, 633 aa, Cucumis sativus
MITDIFEAARKPAVAAIDGLALGGGLEVAMACHARISTPTAQLGLPELQLGIIPGFGGTQRLPRLVGLSKALEMMLTSKPIKGQEAHSLGLVDAIVPPEELINTARRWALEILERRRPWVHSLHRTDKLESLAEARKIFNLARAQAKKQYPNLKHTIACIDAVETGVVSGPRAGLWKEAEEFQGLLHSDTCKSLIHIFFAQRSTTKVPGVTDLGLVPRQIKKVAIVGGGLMGSGIATALILSNYHVVLKEVNDKFLQAGIDRVRANLQSRVKKGNMTNEKFEKSISLLKGVLNYESFKDVDMVIEAVIENVSLKQQIFSDLEKYCPPHCMLATNTSTIDLELIGERIKSRDRIIGAHFFSPAHIMPLLEIVRTKHTAAQVIVDLLDVGKNIKKTPVVVGNCTGFAVNRMFFPYSQAAILLAEHGVDPYQIDRAISKFGMPMGPFRLCDLVGFGVAAATASQFVQAFPERTYKSMLIPLMQEDKNAGESTRKGFYVYDKNRKAGPNPELKKYIEKARNSSGVSVDPKLTKLPEKDIVEMIFFPVVNEACRVLAEGIAVKAADLDIAGVMGMGFPSYRGGLMFWADSLGSNYIYSRLEEWSKQYGGFFKPCGYLAERAVQGATLSAPGGHAKPRM

SEQ ID NO: 72379 - DNA, 2172 bp, Pongo pygmaeus
  CDS (1)..(2172)
atggccgagtatacgcggctgcacaacgccttggcgctgatccgcctccgaaacccgccggtcaacgcgatcagtacggctttactccgtgacataaaagaaggactacagaaagctgtaatagaccatacaataaaagccattgtgatttgtggagcagagggcaaattttctgcaggtgctgatattcatggcttcagcgctcctaggacatttggctttacactgggacatgtagtagatgaaatacagagaaatgagaagcccgtggtggcagcaatccaaggcatggctttcggagggggactagagctggccctgggctgtcactataggattgcccactcagaggctcaagttggcttaccagaagttacactgggacttctccctggtgcaagaggaacccagcttctccccagactcattggagttcctgctgcacttgacttaattacctcaggaagacatattttagcagatgaagcactcaagctgggcattctagataaagttgtgaactcagacccggttgaagaagcaatcagatttgctcagagagtttcagatcaacctctagaatcccgtagactctgcaacaagccaattcagagcttgcccaacatggacaccatttttagtgaggccctcttgaagatgcggaggcagcaccccggatgtcttgcacaggaggcttgtgtccgtgcagtccaggctgccgtgcagtatccctatgaagtgggcgtcaagaaggaggaggagctgtttctatatctttttcaatcagggcaggctagagccctgcaatatgctttcttagctgaaaggaaagcaaataagtggtcaactccctccggagcatcgtggaaaacagcatcagcgcggcctgtctcctcagttggtgttgttggcttaggaacaatgggccgaggcattgtcatttcttttgcaagggccaggattcctgtgattgctgtagactcggacaaaaaccagctagcaactgcaaacaagatgataacctctgtcttggaaaaagaagcctccaaaatgcaacagagcggccacccttggtcaggaccaaaacccaggttaacttcatctatgaaggagcttggtggtgtagatttagtcattgaagcagtatttgaggaaatgagcctgaagaagcaggtctttgctgaactctcagctatctgcaaaccagaagcatttttgtgcactaatacttcagccctggatgttgatgagattgcttcttccactgatcgtcctcacttggtcattggcacccacttcttttcgccagctcatgtcatgaagttgttagaggttattcccagccaatactcttcccccactaccattgccactgttatgaacttatcaaaaaagattaaaaagattggagtcgttgtaggcaactgttttggatttgtggggaatcgaatgttgaatccttattacaatcaggcatatttcttgttagaagaaggcagcaaaccagaggaggtagatcaggtgctagaagagtttggttttaaaatgggaccttttagagtttctgatcttgctgggttggatgtgggctggaaatctagaaaggggcaaggtcttactggacctacattgcctccaggaactcctgcccgaaaaaggggtaataggagatactgcccaattcctgatgtgctctgtgaattaggacgatttggccagaagacaggtaagggttggtatcaatatgacaagccattgggtaggattcacaaagccgatccctggctttccaaattcctatcacagtatagagaaacccatcacattgaaccacgtaccattagccaggatgagatcctcgagcgctgcttatattcacttatcaatgaagcattccgtatcttgggagaagggatagctgctagcccagagcacattgatgttgtctatttacatggatatggatggccaaggcacaagggtgggcccatgttctatgcttccacagttgggttgcccacagttctagagaagttgcagaaatattacaggcagaaccctgatattccccaactggagcccagtgactatctaaaaaaactggcttctcagggaaaccctccccagaaagaatggcaaagcttggcaggctcccctagcagtaaattgtga

SEQ ID NO: 72380 - protein, 723 aa, Pongo pygmaeus
MAEYTRLHNALALIRLRNPPVNAISTALLRDIKEGLQKAVIDHTIKAIVICGAEGKFSAGADIHGFSAPRTFGFTLGHVVDEIQRNEKPVVAAIQGMAFGGGLELALGCHYRIAHSEAQVGLPEVTLGLLPGARGTQLLPRLIGVPAALDLITSGRHILADEALKLGILDKVVNSDPVEEAIRFAQRVSDQPLESRRLCNKPIQSLPNMDTIFSEALLKMRRQHPGCLAQEACVRAVQAAVQYPYEVGVKKEEELFLYLFQSGQARALQYAFLAERKANKWSTPSGASWKTASARPVSSVGVVGLGTMGRGIVISFARARIPVIAVDSDKNQLATANKMITSVLEKEASKMQQSGHPWSGPKPRLTSSMKELGGVDLVIEAVFEEMSLKKQVFAELSAICKPEAFLCTNTSALDVDEIASSTDRPHLVIGTHFFSPAHVMKLLEVIPSQYSSPTTIATVMNLSKKIKKIGVVVGNCFGFVGNRMLNPYYNQAYFLLEEGSKPEEVDQVLEEFGFKMGPFRVSDLAGLDVGWKSRKGQGLTGPTLPPGTPARKRGNRRYCPIPDVLCELGRFGQKTGKGWYQYDKPLGRIHKADPWLSKFLSQYRETHHIEPRTISQDEILERCLYSLINEAFRILGEGIAASPEHIDVVYLHGYGWPRHKGGPMFYASTVGLPTVLEKLQKYYRQNPDIPQLEPSDYLKKLASQGNPPQKEWQSLAGSPSSKL

SEQ ID NO: 72381 - DNA, 2292 bp, Pongo pygmaeus
  CDS (1)..(2292)
atggtggcctgccgggcgattggcatcctcagccgcttctctgccttcaggatcctccgctcccgaggttatatatgccgcaattttacagggtcttctgctttgctgaccagaacccatattaactatggagtcaaaggggatgtggcagttgttcgaattaactctcccaattcaaaggtaaatacactgagtaaagagctgcattcagagttctcagaagttatgaatgaaatctgggccagtgatcaaatcagaagtgccgtccttatctcatcaaagccaggctgctttattgcaggtgctgatatcaacatgttagctgcttgcaagacccttcaagaagtaacacagctatcacaagaagcacagagaatagttgagaaacttgaaaagtccacaaagcctattgtggctgccatcaatggatcctgcctgggaggaggacttgagcttgccatttcatgccaatacagaatagcaacaaaagacagaaaaacagtattaggtacccctgaagtcttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatggaatacctagaagaagttgcaattactttcgccaaaggactagctgataagaagatctctccaaagagagacaagggattggtggaaaaattgacagcgtacgccatgactattccatttgtcaggcaacaggtttacaaaaaagtggaagaaaaagtgcgaaagcagactaaaggcctttatcctgcacctctgaaaataatagatgtggtaaagactggaattgagcaagggagtgatgctggttatctctctgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaggtctccgtggataaggggctaaagactatacttaaagatgccaccctcactgcgctagaccgaggacagcaacaagtgttcaaaggattgaatgataaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctcgcccgtggacaagatgcagctgctggagattatcacgaccgagaaaacttccaaagacaccagtgcttcagctgtagcagttggtctcaagcaggggaaggtcattattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcagaagatctgggcaaagtctttggggagcggtttggaggtggaaacccagaactgctgacacagatggtgtccaagggcttcctaggtcgcaaatctgggaagggcttttacatctatcaggagggtgtgaagaggaaggatttgaattctgacgtggatagtattttagcgagtctgaagctgcctcctaagtctgaagtctcgtcagacgaagacatccagttccgtctggtgacaagatttgtgaatgaggcagtcatgtgcctgcaagaggggatcttggccacacctgcagagggagacatcggagccgtctttgggctcggcttcccgccttgtcttggagggcctttccgctttgtggatctgtatggcgcccagaagacagtggaccggctcaagaagtatgaagctgcctatggaaaacagtccaccccatgccagctgctagctgaccatgctaacagccctaacaagaagttctaccagtga

SEQ ID NO: 72382 - protein, 763 aa, Pongo pygmaeus
MVACRAIGILSRFSAFRILRSRGYICRNFTGSSALLTRTHINYGVKGDVAVVRINSPNSKVNTLSKELHSEFSEVMNEIWASDQIRSAVLISSKPGCFIAGADINMLAACKTLQEVTQLSQEAQRIVEKLEKSTKPIVAAINGSCLGGGLELAISCQYRIATKDRKTVLGTPEVLLGALPGAGGTQRLPKMVGVPAALDMMLTGRSIRADRAKKMGLVDQLVEPLGPGLKPPEERTMEYLEEVAITFAKGLADKKISPKRDKGLVEKLTAYAMTIPFVRQQVYKKVEEKVRKQTKGLYPAPLKIIDVVKTGIEQGSDAGYLSESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDVDSILASLKLPPKSEVSSDEDIQFRLVTRFVNEAVMCLQEGILATPAEGDIGAVFGLGFPPCLGGPFRFVDLYGAQKTVDRLKKYEAAYGKQSTPCQLLADHANSPNKKFYQ

SEQ ID NO: 72383 - DNA, 2007 bp, Oryza sativa
  CDS (1)..(2007)
atggcggagaaggggaggacggagatggaggtccggcccggcggcgtcgccctcatcaccatctccaaccctcccgtcaatgccctctccatccacgtcttgtatagcttgaaggaccactatgaagaagcacttaggaggaatgatgttaaagctattgttgtcacaggaaaaggaggagtattttccgggggactagacattaatacatttggtgctattcagagaaacaaagcggagcagctaaaggttgattatgtgtccatagatgtcatgactaatactcttgaagctgctggaaagccatcagtagctgctatcaacggtcctgctcttggtggagggttagaaatttccatggtatgtcaagcacgcatttcgattccaacggctcaattaggtcttccagagcttcaacttggagtgatccctgcatttggaggaacacaacgacttccccgccttgttggactaacaaaagcacttgaaatgatgctgatgtccaagcctattaaagccgaagaggcccatcagctggccctcatcgatgccatagtttcacctaatgatttgctgaatactgcctgccgttgggccttggatatatccgaatctagaaggccatgggtccataccctcagtagaactgacaagctagagtctcctgatgaggccagggagatcctcaagtttgccagagctcaggttcagaagcaggctgccaatcttcggcacccacttgtctgtattgatgttatcgaggaaggtatagtttcaggaccccaagctgggctacggaaggaagccattgctttccaggaccttgttttctcagatacatgtaaaagcttggttcatgtctttttttcacagcgtgcgacatcaaaggttcctgggatcacagacttaggtttaatgcctaggaaggtatctaaagttgccattgttgggggtgggcttatgggttctgggattgcaactgcactgatgctgagtaattatcctgttgtactcaaagaagtaaacgacaaattcttggacgcaggaattgacaggatcaaagcaaatttgcagagtcgtgtgaggaatgggaaaatgaccaaggagatatacgaaaaaacgctctcacttcttacaggtgtcgttgattacgagagattcaaggacgtagatttagttattgaggaaattgtagagaatgtgaaggtgaagcagcaagtgtttgctgacttggagcggtactgtccttcccattgtgtacttgccactaacacttctaccattgatcttgacctgattggagagaagacaaactcccaagatcgcattgccggtgcgcacttttttagtccagctcatgtgatgccacttctggaaatagtccgctccaatcatacctcaccacaagtagttgttgatttgctggatgtggggaagaagatcaagaagacaccagtagtggttgggaattgtaccggctttgcggttaaccggatgttctctccctatactagtatagcgctcttgcttgttgatcgtggaatggatgtttacaagattgatcaagtttgtaccgaatttgggatgccaatgggtccattcagattgctagacctggttgggtttggagtagctcttgcctctggcatgcagtaccttgagaactcccccgggagtgtcgacaagtcaatgctaattcctctcatgtttgaagacaaaaggacaggcgaagcctctcaaaagggattttacaagtatgagggtaatcggaaggccatccctgatcctgatatcttcaagtatgttgagaagtcaaggagaatggctggaactgtgcctgatcttgagctactgaagcttgacgacaaggaaatagtggagatggtgttcttccctgttatcaacgaggcctgccaggtcctcagtgagggcattgccaacaaagcctcggacctcgacatcgcctcaatcttcggcatgggatttccaccatacagtgggagatga

SEQ ID NO: 72384 - protein, 668 aa, Oryza sativa
MAEKGRTEMEVRPGGVALITISNPPVNALSIHVLYSLKDHYEEALRRNDVKAIVVTGKGGVFSGGLDINTFGAIQRNKAEQLKVDYVSIDVMTNTLEAAGKPSVAAINGPALGGGLEISMVCQARISIPTAQLGLPELQLGVIPAFGGTQRLPRLVGLTKALEMMLMSKPIKAEEAHQLALIDAIVSPNDLLNTACRWALDISESRRPWVHTLSRTDKLESPDEAREILKFARAQVQKQAANLRHPLVCIDVIEEGIVSGPQAGLRKEAIAFQDLVFSDTCKSLVHVFFSQRATSKVPGITDLGLMPRKVSKVAIVGGGLMGSGIATALMLSNYPVVLKEVNDKFLDAGIDRIKANLQSRVRNGKMTKEIYEKTLSLLTGVVDYERFKDVDLVIEEIVENVKVKQQVFADLERYCPSHCVLATNTSTIDLDLIGEKTNSQDRIAGAHFFSPAHVMPLLEIVRSNHTSPQVVVDLLDVGKKIKKTPVVVGNCTGFAVNRMFSPYTSIALLLVDRGMDVYKIDQVCTEFGMPMGPFRLLDLVGFGVALASGMQYLENSPGSVDKSMLIPLMFEDKRTGEASQKGFYKYEGNRKAIPDPDIFKYVEKSRRMAGTVPDLELLKLDDKEIVEMVFFPVINEACQVLSEGIANKASDLDIASIFGMGFPPYSGR

SEQ ID NO: 72385 - DNA, 1782 bp, Streptomyces kanamyceticus
  CDS (1)..(1782): transl_table=11
atggacgctcccttgaacaccgtcgccgtcatcggtctgggcacgatgggcaccggcatcgccgaggtcctggcccgcgcgggccgcgaggtcatcggcatcgacatcagccaggcggcggccacccgggcggtgacggccctggagacctccacggcccgcgcggtgcggcgcgagcgcctcaccgatgaggagcggcgcggcatcctggcccgcttccgcaccttcaccgatctgcaggccgcggccgacgtcgacctggtgatcgaggtcgtccccgagtcgtacgagatcaagcagcggatcgtgcgtgaactcgacgccgtggtccgccccgagacgatcatcgcgaccggcaccaacgcgctgtccgtcacccggctcgccgccgagtcggcgcgccccgagcgcgtgctcggcctgcacttcttcaaccccgcgcccgcgatgaagctcgtcgagatcgtctcgtccgtgctcaccgcgcccgccgccgtcgccgcggtcaccgagctcgcgtacgccctgggcaaggagcccgtcgcggtcggcgaccggcccggcttcgtcgccgacgggctgctcttcggctacctcaaccaggccgccgcgatgtacgaggcgaagtacgcctcccgcgaggacatcgacgccgcgatgaagctgggctgcggcctgccgatgggcccgctcgcgctgctcgacctgatcggcgtggacaccgcccgcacggtcctcgacgccatgtacgccgagtcccacgaccgcctgcacgcccccgcgccggtcctcaagcagctcagcgaggcgggcctgaccgggcgcaagtcggggcgcggcttctacacgtacgccgagccgggcagcacggaggtggtgcgcgacgcgctgaccccgccggagggcgagcggagcgtcccgagccgtgccgtgcgcgcggtcggtgtggcgggctccggcacgatggcgtccggcatcgccgaggtcttcgccaaggcgggctacgacgtggtgctcgccgcacgcagcgaggagaaggcgcagctcgccagggcccgtatcggcaagtccctcgcgcgctcggtggagaaggggcggatcaccgccgagtcggcggcggagaccctggagcggatcaccccggccggttcgtacgaggcgttcgccgatgtcgatctggccctggaggccatcgcggaggacctggacgtcaagcagcagctgttcgcgacgctcgacaaggtctgcaagcccggcgcgatcctggcgaccacgacgtcctcgctgccggtcgtcgcctgcgcccgcgccacctcgcgcccgcgtgacgtgatcggcatgcacttcttcaacccggccccggcgatgaagctggtcgaggtggtgcgcaccgtgctgacctcggacgaggtgcacgccaccgtccgtgaggtctgcgcggcgatccgcaagcacccggtggactgcggcgaccgcgcgggcttcatcgtgaacgcgctgctcttcccgtacctgaacaacgcgatcaagatggtccaggagcactacgccacgctggacgacatcgacgccgcgatgaagctgggcggcggctaccccatggggcccttcgagctcctcgacgtggtcggcctcgatgtctcgctcgccatcgagaaggtcctgcaccgcgagttccgcgacccgggcctggccccggcgccgctgctcgaacacctggtggccgcgggctgcctcggccgcaagacggggcgtggcttccgcgaatatgcccggcgctga

SEQ ID NO: 72386 - protein, 593 aa, Streptomyces kanamyceticus
MDAPLNTVAVIGLGTMGTGIAEVLARAGREVIGIDISQAAATRAVTALETSTARAVRRERLTDEERRGILARFRTFTDLQAAADVDLVIEVVPESYEIKQRIVRELDAVVRPETIIATGTNALSVTRLAAESARPERVLGLHFFNPAPAMKLVEIVSSVLTAPAAVAAVTELAYALGKEPVAVGDRPGFVADGLLFGYLNQAAAMYEAKYASREDIDAAMKLGCGLPMGPLALLDLIGVDTARTVLDAMYAESHDRLHAPAPVLKQLSEAGLTGRKSGRGFYTYAEPGSTEVVRDALTPPEGERSVPSRAVRAVGVAGSGTMASGIAEVFAKAGYDVVLAARSEEKAQLARARIGKSLARSVEKGRITAESAAETLERITPAGSYEAFADVDLALEAIAEDLDVKQQLFATLDKVCKPGAILATTTSSLPVVACARATSRPRDVIGMHFFNPAPAMKLVEVVRTVLTSDEVHATVREVCAAIRKHPVDCGDRAGFIVNALLFPYLNNAIKMVQEHYATLDDIDAAMKLGGGYPMGPFELLDVVGLDVSLAIEKVLHREFRDPGLAPAPLLEHLVAAGCLGRKTGRGFREYARR

SEQ ID NO: 72387 - DNA, 2145 bp, uncultured bacterium 443
  CDS (1)..(2145): transl_table=11
atgagttttcattacgaaaaagacagcaacaacatcgtgaccgtcactatggacatggacgggcccgttaattcgatgagcgacgccttccttcctgcactagaagcgacactgggcaacctggaagctgatgctgaccttgctggggtggttttggcgtcgggcaagtcaacgtttttcgccggtggtgaccttaatatgctgtgtgcggtcactgaagagactgtcgaagcgtttttcgagggtatgtgcgcgacgaaagccgctatgcgccgacttgaaatgctgcatgcgccggtatgtgcggccatcaatggtgcggcgcttggtggtggactggaacttgctttgtcgtgccaccatcgaattgcctggaacgaccgcagcgtccaacttggctttcccgaggtgacgctgggacttcttcctggtggcggtggcaatgtgaaagcggtttacctcatggggctcatggccgctaatgaatacatcgtcgagggaaaacgtgtggccccggaaaaggcactcgcatccggtcttatcgacgcagtgattgaggacaaagatgaacttttgtcggcggctaagcagtggttattagcgaataaagacgacgagtctgctcgcactcagccctgggataccaagggttataaaattccgggcgggaacattcgcaacccgcaagttgcgcagatggtgaccatgggtgcaccgatgattcgcaagaatacacgcggtttgcttcctgcgcctgagaaaattttcgacgttgcggttcaggcattgaccgtcgactttgagacggctatgcgtattgagagccgaggtctcgccgagctcgcactgactccgcaagcaaaaaacatgatcaatacgttcttctttcagatgaacaaggtcaatggcggtgcatcacgtccgaaagaggtcccaccgcaaaaaacagagaaggtcggcattttgggtgcaggcatgatggggcagggaattgcctattcgtcagccatggtcggcattgaggtggtacttaaagacattagtctagacgcggccataaagggcaaaacttatactcaagcgctacttcaaaaacgggtcgataaggggcgcatgaccgatgaaaagatggctcaggtcttatcattgatccatcccactgcgtcggacgaggacttggacggatgcgatttaattatcgaagccgtgttcgagaatatgacgctgaagcatcagatgactcgagatctagagccgcgcttggcggaaggcggtgtatggggatcaaatacctcgacgctcccgattactcagttggcgcaagcgagtcagaatgctgaaaaattcatcggcattcactttttctctcctgtcgacaaaatgcccttggtggagatcatcatgggcgagcaaacaggtgatctggcgctggccaaagcgtttgattttaccaagcaaatcaagaagacgccgatcgtggtcaatgactccttaggtttcttcacttcgcgaacctttggaacataccttgacgagggcgttcggttgctcgttgagggcatgaagccgcttcgtattgataatctaggaaaggccgttggaatgccggttggtccattaaccgtctatgacgaggtgagcttggaactctcgcgtaaagcgtcgcagacctggaaagaaatgggccttagtgtgggtgatgacgatcgctcgattacggccggggttgtcgaaacaatggtcggcgattatgggcgcgggggtcgctaccacggtggtggcttttacgaatacggcgcagacggctccaaagaggtctggtcgggactcgctgaactctatggggcaacagcgtcgcccttgtccgatgcggatgccaaagatcgcttactgttccgtcaagtgattgaggcgcttaagtgtcttgagacgggtgttctaaggaccgttgctgatgggaatatcggttcgattatgggcattggtgctcccgcatggaccggcggattgctacagttcgtgaacacttatggcctccaaaacttcattgagcgatgcgcatcgttgagtgcagcctacggcgagcgctttcaagcgccggcgattgtggccgaaaagctggtcaaaggagagacgtttgtttaa

SEQ ID NO: 72388 - protein, 714 aa, uncultured bacterium 443
MSFHYEKDSNNIVTVTMDMDGPVNSMSDAFLPALEATLGNLEADADLAGVVLASGKSTFFAGGDLNMLCAVTEETVEAFFEGMCATKAAMRRLEMLHAPVCAAINGAALGGGLELALSCHHRIAWNDRSVQLGFPEVTLGLLPGGGGNVKAVYLMGLMAANEYIVEGKRVAPEKALASGLIDAVIEDKDELLSAAKQWLLANKDDESARTQPWDTKGYKIPGGNIRNPQVAQMVTMGAPMIRKNTRGLLPAPEKIFDVAVQALTVDFETAMRIESRGLAELALTPQAKNMINTFFFQMNKVNGGASRPKEVPPQKTEKVGILGAGMMGQGIAYSSAMVGIEVVLKDISLDAAIKGKTYTQALLQKRVDKGRMTDEKMAQVLSLIHPTASDEDLDGCDLIIEAVFENMTLKHQMTRDLEPRLAEGGVWGSNTSTLPITQLAQASQNAEKFIGIHFFSPVDKMPLVEIIMGEQTGDLALAKAFDFTKQIKKTPIVVNDSLGFFTSRTFGTYLDEGVRLLVEGMKPLRIDNLGKAVGMPVGPLTVYDEVSLELSRKASQTWKEMGLSVGDDDRSITAGVVETMVGDYGRGGRYHGGGFYEYGADGSKEVWSGLAELYGATASPLSDADAKDRLLFRQVIEALKCLETGVLRTVADGNIGSIMGIGAPAWTGGLLQFVNTYGLQNFIERCASLSAAYGERFQAPAIVAEKLVKGETFV

SEQ ID NO: 72389 - DNA, 2148 bp, Pseudomonas oleovorans
  CDS (1)..(2148): transl_table=11
atgatttaccaaggtaaagccatcacggttaaggctcttgaaagtggcatcgtcgagctcaagttcgacctcaagggtgagtccgtcaacaagttcaaccgcctgaccctgaacgaactgcgccaggccgtcgatgccatccaggccgacgcctcggtcaagggcgtgatcgtcagcagtggcaaggacgtgttcatcgtcggcgccgacatcaccgagttcgtcgacaacttcaagctgcccgaggccgaactggtcgccggcaacctggaagccaaccgcatcttcaacgccttcgaagacctcgaagtgccgaccgtcgccgccatcagcggcatcgccctgggcggcggcctggaaatgtgcctggccgccgactaccgggtcatgtccaccagcgccaagatcggcctgccggaagtcaagctgggtatctacccgggcttcggtggtaccgtgcgcctgccgcgcctgatcggttcggacaacgccatcgagtggatcgctgccggcaaggaaaaccgtgccgaagacgccctgaaagtgggtgccgtcgacgccgtggtcgcgcctgaactgctgatggccggtgcccttgacctggtcaagcgcgccatcagtggcgagctggactacaaggccaagcgccagcccaagctggaaaagctcaagctcaacgccatcgagcagatgatggccttcgaaactgccaagggcttcgtcgctggccaggccggcccgaactacccagctccggtcgaagccatcaagaccatccagaaggctgccaacttcggccgtgacaaggccctggaagtcgaagccgcaggcttcgccaagctggccaagacctcggttgccgagagcctgatcggcctgttcctcaacgaccaggaactcaagcgcaaggccaaggcgcatgacgaaatcgcccacgacgcgaagcaggccgccgtgctcggcgctggcatcatgggtggcggcatcgcctaccagtcggcggtcaagggcacaccgatcctgatgaaggatatccgcgaggaagccatccagctgggcctgaacgaggcctccaagctgctcggcaaccgcgtcgagaagggccgcctgaccccggccaagatggccgaggcactcaacgccattcgcccgaccctgtcctatggcgatttcgccaatgtcgacatcgtcgtcgaggccgtggtcgagaacccaaaagtcaagcaggccgtgctggctgaagtggaaacccaggtgaaggacgatgcgatcctcgcttccaacacctcgaccatttccatcaacctgctggccaaggcgctcaagcgcccggaaaacttcgtcggcatgcacttcttcaacccggtgcacatgatgccgctggtggaagtcatccgtggcgagaagtccagtgaagtggcggtcgccaccaccgtggcctacgccaagaaaatgggcaagaacccgatcgtggtcaacgactgcccaggcttcctggtcaaccgcgtgctgttcccgtacttcggcggcttcgccaagctggtaagcgccggtgtcgacttcgtgcgtatcgacaaggtcatggaaaagttcggctggccgatgggcccggcgtacctgatggacgtggtcggcatcgacaccggccaccacggccgcgacgtgatggccgaaggcttcccggaccgcatgaaggacgagcgccgctcggccgttgacgcactgtacgaggccaaccgcctgggccagaagaacggcaagggcttctacgcctacgaaaccgacaagcgcggcaaaccgaagaaggtcgccgacgccagcgtgctcgacgtgctcaagccgatcgtcttcgagcagcgtgaagtcaccgacgaagacatcatcaactggatgatgatcccgctgtgcctggagaccgtgcgctgcctggaagacggcatcgtcgaaaccgctgccgaagccgacatgggcctggtctacggcattggtttccctcccttccgcggtggtgcgctgcgctacatcgactcgatcggtgtggccgaattcgttgccctggccgatcagtacgccgacctggggccgctgtaccacccgaccgccaagctgcgtgaaatggccaagaacggccagcgcttcttcaactga

SEQ ID NO: 72390 - protein, 715 aa, Pseudomonas oleovorans
MIYQGKAITVKALESGIVELKFDLKGESVNKFNRLTLNELRQAVDAIQADASVKGVIVSSGKDVFIVGADITEFVDNFKLPEAELVAGNLEANRIFNAFEDLEVPTVAAISGIALGGGLEMCLAADYRVMSTSAKIGLPEVKLGIYPGFGGTVRLPRLIGSDNAIEWIAAGKENRAEDALKVGAVDAVVAPELLMAGALDLVKRAISGELDYKAKRQPKLEKLKLNAIEQMMAFETAKGFVAGQAGPNYPAPVEAIKTIQKAANFGRDKALEVEAAGFAKLAKTSVAESLIGLFLNDQELKRKAKAHDEIAHDAKQAAVLGAGIMGGGIAYQSAVKGTPILMKDIREEAIQLGLNEASKLLGNRVEKGRLTPAKMAEALNAIRPTLSYGDFANVDIVVEAVVENPKVKQAVLAEVETQVKDDAILASNTSTISINLLAKALKRPENFVGMHFFNPVHMMPLVEVIRGEKSSEVAVATTVAYAKKMGKNPIVVNDCPGFLVNRVLFPYFGGFAKLVSAGVDFVRIDKVMEKFGWPMGPAYLMDVVGIDTGHHGRDVMAEGFPDRMKDERRSAVDALYEANRLGQKNGKGFYAYETDKRGKPKKVADASVLDVLKPIVFEQREVTDEDIINWMMIPLCLETVRCLEDGIVETAAEADMGLVYGIGFPPFRGGALRYIDSIGVAEFVALADQYADLGPLYHPTAKLREMAKNGQRFFN

SEQ ID NO: 72391 - DNA, 2190 bp, Enterobacter cloacae
  CDS (1)..(2190): transl_table=11
atgctctacaaaggcgacaccctgtacctcaactggctggaagatggcattgccgaactggtgttcgatgctcccggctcagtgaacaagcttgataccgcgacggtggccagtcttggccaggcgctggatgttcttgaaaaacaacctgaattaaaagggatgctgctgcgttcgaacaaagcggcctttattgtcggtgccgatatcaccgagtttctttcgctgttcctggtcccggaagaacagctgagccagtggctgcactttgccaacagcgtctttaatcgtttggaagatctgcctgtcccgaccatttccgccgttaacgggtacgcgctgggcggcggctgcgaatgcgtactggcgaccgactaccgtctggcgacgccggacctgcgcatcggcctgccggaaaccaggctgggcatcatgccgggctttggcggctccgtgcgtatgccgcgcatgctgggtgccgacagcgcgatggagatcattgccgcaggtaaagacgtcggcgcagaacaggcgcagaaaatcggcctggtcgacggcgtcgtgaagccagagaaactggttgaaggcgcactcgccattctgcgtcaggccattaacggcgatctcgactggaaagccaaacgccagccgaagctggagccgttaaaactcagcaagattgaagccaccatgagcttcaccatcgccaagggcatggtgatgcagacggcgggtaaacactacccggcgccgatcacggcggtgaaaaccattgaagcggctgctcgtctcggacgcgatgaagcgctgaagctcgaaaatcagagctttgtcccgctggcgcacaccaatgaagctcgcgcgctggtcggtatcttcctcaacgatcagttcgtgaagggtaaagccaggcagctgactaaaaacgttgagacgccaaaacatgcggcggtactcggcgcgggcattatgggtggcggcatcgcttaccagtcggcctggaaaggcgtgccggtagtgatgaaagacatcagcgagaaatccctgacgctgggcatgaccgaagcggccaagctgctgaataaacagctggagcgcggaaaaattgacgggctgaagcttgcaggcgtgatctccaccattcagcccgtgctggaatacagcggtttcgaccgtgtcgacgtagtagtcgaagccgtcgtcgagaacccgaaagtcaaaaaagcggtgctggcagaaacggaagataaagttcgtcctgagaccgtgttggcttcaaacacctccaccattccaatcagcgaactggcgagcgtgttgaagcgtccggaaaacttctgcgggatgcacttcttcaacccggtacaccgtatgccgctggtcgaagtgatccgcggggaaaaaacctctgacgaaaccatcgctaaagtggtggcatgggccagcaagatgggcaaaacgccgatcgttgttaacgactgcccgggcttcttcgtcaaccgagtgctgttcccttacttcgccggtttcagccagctgctgcgcgacggtgcagacttccgcaaaatcgacaaagtgatggaaaaacagttcggctggccgatgggcccggcgtatctgctggacgtggtcggcattgataccgctcaccacgctcaggcggtgatggcggcaggcttcccgcagcgtatgcagaaagattatcgcgacgccattgacgctctgttcgacgctaaccgcttcggccagaaaaacggcctgggcttctggcgctataaagaaaacagcaaaggcaaaccgaagaaagaagaagatgccgtggtagacggcctgctggccgatgtaagccagccaaaacgcgacttcaccgacgatgagatcatcgcccgcatgatgatcccgatgatcaacgaagtggtgcgttgccttgaagaaggcatcatcgccagcccggcagaagccgatatggcgctggtgtacggcctgggcttccctccgttccacggcggcgcgttccgctggctggacacgctcggcagcgcccgctatctcgatatggctcagcagtatcagcacctcggcccgctttatgaggtgccggaagggctgcgtaacaaagcgcgccataacgaaccctactatccagcagttgagccagcccgtccggttggcgagctgaaaacggcttaa

SEQ ID NO: 72392 - protein, 729 aa, Enterobacter cloacae
MLYKGDTLYLNWLEDGIAELVFDAPGSVNKLDTATVASLGQALDVLEKQPELKGMLLRSNKAAFIVGADITEFLSLFLVPEEQLSQWLHFANSVFNRLEDLPVPTISAVNGYALGGGCECVLATDYRLATPDLRIGLPETRLGIMPGFGGSVRMPRMLGADSAMEIIAAGKDVGAEQAQKIGLVDGVVKPEKLVEGALAILRQAINGDLDWKAKRQPKLEPLKLSKIEATMSFTIAKGMVMQTAGKHYPAPITAVKTIEAAARLGRDEALKLENQSFVPLAHTNEARALVGIFLNDQFVKGKARQLTKNVETPKHAAVLGAGIMGGGIAYQSAWKGVPVVMKDISEKSLTLGMTEAAKLLNKQLERGKIDGLKLAGVISTIQPVLEYSGFDRVDVVVEAVVENPKVKKAVLAETEDKVRPETVLASNTSTIPISELASVLKRPENFCGMHFFNPVHRMPLVEVIRGEKTSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFDANRFGQKNGLGFWRYKENSKGKPKKEEDAVVDGLLADVSQPKRDFTDDEIIARMMIPMINEVVRCLEEGIIASPAEADMALVYGLGFPPFHGGAFRWLDTLGSARYLDMAQQYQHLGPLYEVPEGLRNKARHNEPYYPAVEPARPVGELKTA

SEQ ID NO: 72393 - DNA, 2292 bp, Rattus norvegicus
  CDS (1)..(2292)
atggttgcgtcccgggcaattggcagtctcagtcgcttctctgccttcaggatcctgcgctccagaggctgcatttgcacagctttacaacttcttcctgctttgctgtctagaacccatattaattatggagtcaaaggggatgtggcagttattcggattaactcgcccaattcaaaggtaaatacattgaataaagaagtacaatcagagttcgtagaagtaatgaacgaaatctgggccaacgaccaaatcaggagcgccgtccttatttcgtcaaagcctggctgctttgttgcaggtgctgacatcaacatgctggcctcttgtacaacgccccaagaagcagcacgaatatcacaagaaggacagaaaatgtttgagaaacttgaaaagtcaccaaagcctgttgttgccgccatcagtggatcctgcttgggaggcggacttgagcttgccatagcatgtcaatacagaatagcaacaaaagacagaaaaacagtattaggtgtccctgaagtgttgctgggaatcttaccaggagccggaggtacccagaggctgcccaaaatggtgggtgtgcctgctgcttttgacatgatgctgactggtaggaacattcgtgcagacagagcaaagaaaatgggactggttgaccagttggtggacccgctaggaccaggaataaaatctccagaggaaaggacaattgaatacctagaagaagttgcagttaattttgccaaaggcctggctgacaggaaggtctctgcaaagcagagcaaaggcctgatggaaaagctgacatcgtatgccatgactatcccactttgtctgactacaacattcaaaacagtggaagaaaaagtgaagaagcagaccaaaggcctttaccctgcacctttgaagataattgacgctgtgaagactggacttgagcaaggaaatgatgctggctatcttgccgaatcagagaaatttggagagcttgcattgaccaaagaatcaaaagccctgatggggctttataatggccaggtcctgtgcaagaaaaataaatttggagcgccacagaagactgttcagcagctagccatccttggcgcagggctgatgggggctggcattgcccaggtctctgtggacaagggactgaaaactcttcttaaagacactacagtgacagggctgggccggggacagcaacaagtgttcaaaggactgaatgacaaggtaaagaagaaggcactcacatccttcgaaagggactccatcttcagcaacctgatcgggcagctcgactacaagggcttcgagaaggctgacatggtgattgaggctgtcttcgaggacctcgctgttaagcacaaagtgttaaaggaagtggaaagcgtgactccagaacactgtatcttcgccagcaacacatctgctctcccaatcaatcaaattgctgctgtgagccaaaggcctgagaaggtgatcggcatgcactacttctctcctgtggacaagatgcagcttctagagatcatcacaactgacaaaacctccaaggacaccacagcgtctgccgtggccgtgggtctcaagcaggggaaggtcatcattgtggtcaaggacggacctggcttctacaccaccaggtgtcttgctcccatgatgtcagaagtcataagaatcctccaggaaggagttgaccctaagaagctggacgccttgaccacaggcttcggcttccctgtgggtgctgccaccctggcagatgaagtagggatagatgtagcacagcacgtagcagaagatctaggcaaagccttcggggagcggtttggaggtggcagcgtagaactgctgaaactgatggtctccaagggcttcttgggtcgcaagtctgggaagggcttctacatctatcagtcgggctcaaagaataagaatttgaattctgaaatagataatatcttggtaaacctgaggctgcctgccaagcccgaggtctcctctgatgaagacatccagtaccgtgtgataacaaggtttgtgaatgaggcagtcctgtgcctacaggaagggatcctagccacgcctgaagagggagacatcggagcagtctttgggcttggctttcccccttgtctcggagggcccttccgctttgtggatctgtatggtgctcagaaggtagtggaccggctccggaagtatgagtctgcctatgggacacagtttaccccgtgtcagctactccgcgaccttgctaacaactctagcaagaagttctaccagtga

SEQ ID NO: 72394 - protein, 763 aa, Rattus norvegicus
MVASRAIGSLSRFSAFRILRSRGCICTALQLLPALLSRTHINYGVKGDVAVIRINSPNSKVNTLNKEVQSEFVEVMNEIWANDQIRSAVLISSKPGCFVAGADINMLASCTTPQEAARISQEGQKMFEKLEKSPKPVVAAISGSCLGGGLELAIACQYRIATKDRKTVLGVPEVLLGILPGAGGTQRLPKMVGVPAAFDMMLTGRNIRADRAKKMGLVDQLVDPLGPGIKSPEERTIEYLEEVAVNFAKGLADRKVSAKQSKGLMEKLTSYAMTIPLCLTTTFKTVEEKVKKQTKGLYPAPLKIIDAVKTGLEQGNDAGYLAESEKFGELALTKESKALMGLYNGQVLCKKNKFGAPQKTVQQLAILGAGLMGAGIAQVSVDKGLKTLLKDTTVTGLGRGQQQVFKGLNDKVKKKALTSFERDSIFSNLIGQLDYKGFEKADMVIEAVFEDLAVKHKVLKEVESVTPEHCIFASNTSALPINQIAAVSQRPEKVIGMHYFSPVDKMQLLEIITTDKTSKDTTASAVAVGLKQGKVIIVVKDGPGFYTTRCLAPMMSEVIRILQEGVDPKKLDALTTGFGFPVGAATLADEVGIDVAQHVAEDLGKAFGERFGGGSVELLKLMVSKGFLGRKSGKGFYIYQSGSKNKNLNSEIDNILVNLRLPAKPEVSSDEDIQYRVITRFVNEAVLCLQEGILATPEEGDIGAVFGLGFPPCLGGPFRFVDLYGAQKVVDRLRKYESAYGTQFTPCQLLRDLANNSSKKFYQ

SEQ ID NO: 72395 - DNA, 3274 bp, Cavia porcellus
  CDS (43)..(2223)
aggcagagtttggcagtggcccctcggcagcaacagacagagatggcggagtacctgaggctgccccactccctggcgctgatccgcctccgaaacccgcctgtcaacgccatcagtccggctgtaatccatggaataaaggaaggactacagaaggctatgtcagactacacaataaaaggaattgtgatttctggagcaaataatatcttttgtgcaggtgcagatatccatggcttcagtgcacctctatcctttggcactggcagtggattgggacccatagtagatgaaatgcagagatatgagaagccagtggtggctgctatccaaggcatggctcttggagggggactggagctgtccctgggctgtcactacaggattgcgcatgcagaggctcgaattggtttcccagaagtcacgctagggattcttcctggtgcaagaggaacccagcttctccccagactcattggagttcctgctgcacttgacttaataacctcaggacggcatattacagcaggtgaagcactcaagctgggtattctggataaagtcgttaattcagccccagttgaagaagcaatcaaattcgctcagaaaattttaaatcaacccctagaacctcgcagaatcctcaacaggccagtctccagcttgcccaacatggacgccatttttggggaagccgtcgagaagatgcggaggcagcacccagggcagcttgctccggagacctgtgtccgttcagtccaggcctctgtgcagtacccctatgaagggggcatcatgaaggagagagaactgtttctgaaccttcagcactccgggcaggccaaagccctgcagtatgccttcttcgctgagagaagtgcacccaagtggtcaaccccatctggagcctcctggaaaacagctgctgcgcgcccagtctcctccgttggtgttcttggcttgggaacaatgggccgaggcatcgccatttcttttgcaagggtcgggatccctgtgattgctgtggaatcagacccaaagcagctagaaactgcacagaagttaataacttcaatcttggagaaagaagcatccaaaagcaggcaacagtgtggccagcaaaggtcaggaccaaaacctaggttcagctcatctatgaaggacctagccagtgtcgatctagtcgtcgaagcagtatttgaggacatgaacctgaagaagcgggtctttgctgaactgtcagctgtgtgcaagccagaagcttttctgtgcaccaatacttcagccctggatgtggatgaaattgctacttctaccaatcgccctcagcaggtcatcggcactcacttcttctccccagctcatgttatgaagttattagaggttattcccagtcgacactcatcccccaccaccattgccactgttatggacctagcaaagaaaattaaaaaggtcgcagttgttgtaggcaactgttacggttttgttgggaatcgcatgttgagatcttattatgaacagactaatttcttattggaagatggcagtaagccagaggacatagatcaggcactggaagagtttggttttagaatgggacccttcagagtgtcagacctcgcagggctagatgtgggttggaaaattcgcaaggggcaaggccttactggaccatcattgcaaggtacagcccctgcccgaaagcgaggcaatgccaggtacagccccattgctgatatgctgtgtgaattgggaagatttggccagaagactggtcagggttggtataaatatgacaagccattgggtaggattcacaaacctgacccctggctttccaaattcctgtcagaatacagagagacccatcacatcaaaccgcgtgtcattgggcgggatgagatcctggagcgctgcttgtatgcactcatcaatgaagccttccgcatcttgggggaagggatagctgctagtccagagcacattgatgtgatctacttgcatgggtatggctggccgcggcacaaaggtgggcccatgttctatgctgcctcagttgggttgcccacagttctagagaagttgcagaagtattaccagcagaatcctgatattccccacctggagccctgcaactatctaaaaaagctggcttcccagggaaaccctcctctgaaagaatggcagagcctggcagggctacccagcagtaaattgtgattcagccttctcagttgggctcacatactggagtcagaaaaaaaaaagaaaacaaaaaccggaaattcaacctaaattgcaatctttagaatgtgcttcctatacttctgagtctgtccctattattaaattcagtgaatgaacttgtgttacacaatgccatgctatctgacgaatatgttaaggttcccaagtgctttgatcgttggagaaatatgtcatcaatttataaatgacatgcatctgttaaatatatttaagtcataaactgattttgtcaattaagtcataaactcattttggccccttagcgtcccatacgcagtatgagtcacacacattcactgagtctctcctgaacatctctgaccatcagagagcacctagcagacctacagtccagtggggcattaaaccaacatgggaacctgcattggattctcgtggagaaggttggcagggcagagtcggcagtggcaacctctgtgtgtaggtagacaagctgcctacagacaggtagaggtagtaacttgacagaggcaagacacatgcaggaattgccaacagagtcaagaatgtctggccagaatgggaactggagagcacctgggtatgtcatgctcagcctgtatctatgcaaggtccaatctcatgtaagtagtcattcttgatgcttagagagggcttagtgatttttgataatttccgtaagacagacagacagacaacccctgccacccagtctttacttttctattcaaagtgggacagagacagtaagttgttgacccagtgtaagaagggattatagggaaggcacaatcttcagagattccttgattgtgaatgtgtgatgacgccattttcactggcaggataagccttcctgatattgtctgtggaaacagttaaatcttgaaacatctaaaattattccaaaacaaaattttatactttcattgtaactataagaattcttctgtttgccaaggatttagctcagtggcataagcatatgcctggcaagcacaaggtcatgagttgatcccag

SEQ ID NO: 72396 - protein, 726 aa, Cavia porcellus
MAEYLRLPHSLALIRLRNPPVNAISPAVIHGIKEGLQKAMSDYTIKGIVISGANNIFCAGADIHGFSAPLSFGTGSGLGPIVDEMQRYEKPVVAAIQGMALGGGLELSLGCHYRIAHAEARIGFPEVTLGILPGARGTQLLPRLIGVPAALDLITSGRHITAGEALKLGILDKVVNSAPVEEAIKFAQKILNQPLEPRRILNRPVSSLPNMDAIFGEAVEKMRRQHPGQLAPETCVRSVQASVQYPYEGGIMKERELFLNLQHSGQAKALQYAFFAERSAPKWSTPSGASWKTAAARPVSSVGVLGLGTMGRGIAISFARVGIPVIAVESDPKQLETAQKLITSILEKEASKSRQQCGQQRSGPKPRFSSSMKDLASVDLVVEAVFEDMNLKKRVFAELSAVCKPEAFLCTNTSALDVDEIATSTNRPQQVIGTHFFSPAHVMKLLEVIPSRHSSPTTIATVMDLAKKIKKVAVVVGNCYGFVGNRMLRSYYEQTNFLLEDGSKPEDIDQALEEFGFRMGPFRVSDLAGLDVGWKIRKGQGLTGPSLQGTAPARKRGNARYSPIADMLCELGRFGQKTGQGWYKYDKPLGRIHKPDPWLSKFLSEYRETHHIKPRVIGRDEILERCLYALINEAFRILGEGIAASPEHIDVIYLHGYGWPRHKGGPMFYAASVGLPTVLEKLQKYYQQNPDIPHLEPCNYLKKLASQGNPPLKEWQSLAGLPSSKL

SEQ ID NO: 72397 - DNA, 2190 bp, Escherichia coli
  CDS (1)..(2190): transl_table=11
atgctttacaaaggcgacaccctgtaccttgactggctggaagatggcattgccgaactggtatttgatgccccaggttcagttaataaactcgacactgcgaccgtcgccagcctcggcgaggccatcggcgtgctggaacagcaatcagatctaaaagggctgctgctgcgttcgaacaaagcagcctttatcgtcggtgctgatatcaccgaatttttgtccctgttcctcgttcctgaagaacagttaagtcagtggctgcactttgccaatagcgtgtttaatcgcctggaagatctgccggtgccgaccattgctgccgtcaatggctatgcgctgggcggtggctgcgaatgcgtgctggcgaccgattatcgtctggcgacgccggatctgcgcatcggtctgccggaaaccaaactgggcatcatgcctggctttggcggttctgtacgtatgccacgtatgctgggcgctgacagtgcgctggaaatcattgccgccggtaaagatgtcggcgcggatcaggcgctgaaaatcggtctggtggatggcgtagtcaaagcagaaaaactggttgaaggcgcaaaggcggttttacgccaggccattaacggcgacctcgactggaaagcaaaacgtcagccgaagctggaaccactaaaactgagcaagattgaagccaccatgagcttcaccatcgctaaagggatggtcgcacaaacagcggggaaacattatccggcccccatcaccgcagtaaaaaccattgaagctgcggcccgttttggtcgtgaagaagccttaaacctggaaaacaaaagttttgtcccgctggcgcataccaacgaagcccgcgcactggtcggcattttccttaacgatcaatatgtaaaaggcaaagcgaagaaactcaccaaagacgttgaaaccccgaaacaggccgcggtgctgggtgcaggcattatgggcggcggcatcgcttaccagtctgcgtggaaaggcgtgccggttgtcatgaaagatatcaacgacaagtcgttaaccctcggcatgaccgaagccgcgaaactgctgaacaagcagcttgagcgcggcaagatcgatggtctgaaactggctggcgtgatctccacaatccacccaacgctcgactacgccggatttgaccgcgtggatattgtggtagaagcggttgttgaaaacccgaaagtgaaaaaagccgtactggcagaaaccgaacaaaaagtacgccaggataccgtgctggcgtctaacacttcaaccattcctatcagcgaactggccaacgcgctggaacgcccggaaaacttctgcgggatgcacttctttaacccggtccaccgaatgccgttggtagaaattattcgcggcgagaaaagctccgacgaaaccatcgcgaaagttgtcgcctgggcgagcaagatgggcaagacgccgattgtggttaacgactgccccggcttctttgttaaccgcgtgctgttcccgtatttcgccggtttcagccagctgctgcgcgacggcgcggatttccgcaagatcgacaaagtgatggaaaaacagtttggctggccgatgggcccggcatatctgctggacgttgtgggcattgataccgcgcatcacgctcaggctgtcatggcagcaggcttcccgcagcggatgcagaaagattaccgcgatgccatcgacgcgctgtttgatgccaaccgctttggtcagaagaacggcctcggtttctggcgttataaagaagacagcaaaggtaagccgaagaaagaagaagacgccgccgttgaagacctgctggcagaagtgagccagccgaagcgcgatttcagcgaagaagagattatcgcccgcatgatgatcccgatggtcaacgaagtggtgcgctgtctggaggaaggcattatcgccactccggcggaagcggatatggcgctggtctacggcctgggcttccctccgttccacggcggcgcgttccgctggctggacaccctcggtagcgcaaaatacctcgatatggcacagcaatatcagcacctcggcccgctgtatgaagtgccggaaggtctgcgtaataaagcgcgtcataacgaaccgtactatcctccggttgagccagcccgtccggttggcgacctgaaaacggcttaa

SEQ ID NO: 72398 - protein, 729 aa, Escherichia coli
MLYKGDTLYLDWLEDGIAELVFDAPGSVNKLDTATVASLGEAIGVLEQQSDLKGLLLRSNKAAFIVGADITEFLSLFLVPEEQLSQWLHFANSVFNRLEDLPVPTIAAVNGYALGGGCECVLATDYRLATPDLRIGLPETKLGIMPGFGGSVRMPRMLGADSALEIIAAGKDVGADQALKIGLVDGVVKAEKLVEGAKAVLRQAINGDLDWKAKRQPKLEPLKLSKIEATMSFTIAKGMVAQTAGKHYPAPITAVKTIEAAARFGREEALNLENKSFVPLAHTNEARALVGIFLNDQYVKGKAKKLTKDVETPKQAAVLGAGIMGGGIAYQSAWKGVPVVMKDINDKSLTLGMTEAAKLLNKQLERGKIDGLKLAGVISTIHPTLDYAGFDRVDIVVEAVVENPKVKKAVLAETEQKVRQDTVLASNTSTIPISELANALERPENFCGMHFFNPVHRMPLVEIIRGEKSSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFDANRFGQKNGLGFWRYKEDSKGKPKKEEDAAVEDLLAEVSQPKRDFSEEEIIARMMIPMVNEVVRCLEEGIIATPAEADMALVYGLGFPPFHGGAFRWLDTLGSAKYLDMAQQYQHLGPLYEVPEGLRNKARHNEPYYPPVEPARPVGDLKTA

SEQ ID NO: 72399 - DNA, 2190 bp, Yersinia pestis
  CDS (1)..(2190): transl_table=11
atgctctaccaaagcgaaacattacagcttcactggttggaaaacggtattgccgagttggtatttgatgctccgggttcagttaataaactggatactaaaaccgtagccaatttgggtgaagccttgaatgtgttagaaaaacaaagtgaactcaaagggttgctattacgttcagcgaagacagccttgattgttggtgccgatattactgagtttctatccctgtttaatgccccaccagaaaaactgcaccagtggctggtgttcgccaacaccattttcaatcgactggaagatttacccgtgccaaccatttcagcaattaatggatacgcactaggtggaggatgtgaatgtattttggcgacggatttccgtatcgcctccccagaagcacgtatcggcctcccagaaaccaagttgggcatcatgccgggcttcggtggttcggtccgtttaccacgcctgctaggcgctgatagtgcacttgagattattgccacaggtaaagatgttactgccaacgatgcactaaagattgggctggttgatgcagttgtcgaccctgagaaactggtcggttcagccttaactatgctgaaacaagctattgacggtaagctcgattggcaggcagcacgccgcccaaaactggaacccctaaaacttaatcctaccgaagcggctatgtgttttaccattgctaaaggcagagtcatgcaagtcgccgggaaacactatcccgcaccattgactgcagtaaaaactattgaagccgccgcaaaatttggtcgtaccgaagcgctgaacttggaaaccaacagttttgtccctttagcgggttccaatgaagctcgcgctttggtggggatttttcttaacgaccagtatgtaaaagcgcaagccaaaaaactgtccaaaggcgtcgctgcaccaaaactggctgcggttctgggcgcagggatcatgggaggtggaattgcctatcagtcagcgctgaaaagtgtgccagtcattatgaaagatattaatgaaaactcgctggatcttggaatgaatgaggccgctaaattactgaataaacagctggaacgcggcaaagtggatggccttaaaatggcaagtattctagcgactattcgaccaaccttggattatgcaggtattgaacgagcccaagtgatcgtcgaagctgtggtggagaacccgaaggttaaagccgctgtacttgcggaagtagaagcattaatcggtgaagataccgttttagcttccaatacctcgacgattcctattgatcagttggctaaatcactcaaacgccctgaaaatttctgcggtatgcacttcttcaatccagtacaccggatgccactggttgaaattattcgtggggcaaaaacctcagataaaacccttgcggcagtagtcgcttacgctacacaaatggggaaaaccccaattgttgtcaatgattgccctggtttcttcgttaaccgcgtcttattcccgtatctcgcaggctttggcatgttagtcagagacggtggggatttccaccaaattgataaagtgatggaaaaacagtttggctggccgatggggcccgcttatctattagatgtcgtcggtattgatactgcccatcatgcacaagcggtgatggctgccggtttccctgagcgaatgaacaaggattaccgtgatgcggttgatgtgatgtttgataaccaacgatttgggcaaaagaatggtcaggggttttaccgctatacgcaagatgcaaagggtaagccacgtaaagaaaatgacgaacaagtggataaattactggcagaaatcagccaacctctccaagaattcagcgatgaagacattattgcccgcaccatgatcccaatgatcaatgaagtcgtccgctgcctggaagaaggtattattgccagcgcagccgagggtgacatggcgctggtttatggccttggcttccctccattccacggaggagtcttccgttaccttgatacgctcggtagcgcaaattatgtcgaaatggctcaacgctatgcccaccttggtgcgttatatcacgttcctgcggggctacgagctaaagctgaacataacgaaagttattatcctgtggcagcagcgctgcttgatgtttctaccaatcaaccagcatga

SEQ ID NO: 72400 - protein, 729 aa, Yersinia pestis
MLYQSETLQLHWLENGIAELVFDAPGSVNKLDTKTVANLGEALNVLEKQSELKGLLLRSAKTALIVGADITEFLSLFNAPPEKLHQWLVFANTIFNRLEDLPVPTISAINGYALGGGCECILATDFRIASPEARIGLPETKLGIMPGFGGSVRLPRLLGADSALEIIATGKDVTANDALKIGLVDAVVDPEKLVGSALTMLKQAIDGKLDWQAARRPKLEPLKLNPTEAAMCFTIAKGRVMQVAGKHYPAPLTAVKTIEAAAKFGRTEALNLETNSFVPLAGSNEARALVGIFLNDQYVKAQAKKLSKGVAAPKLAAVLGAGIMGGGIAYQSALKSVPVIMKDINENSLDLGMNEAAKLLNKQLERGKVDGLKMASILATIRPTLDYAGIERAQVIVEAVVENPKVKAAVLAEVEALIGEDTVLASNTSTIPIDQLAKSLKRPENFCGMHFFNPVHRMPLVEIIRGAKTSDKTLAAVVAYATQMGKTPIVVNDCPGFFVNRVLFPYLAGFGMLVRDGGDFHQIDKVMEKQFGWPMGPAYLLDVVGIDTAHHAQAVMAAGFPERMNKDYRDAVDVMFDNQRFGQKNGQGFYRYTQDAKGKPRKENDEQVDKLLAEISQPLQEFSDEDIIARTMIPMINEVVRCLEEGIIASAAEGDMALVYGLGFPPFHGGVFRYLDTLGSANYVEMAQRYAHLGALYHVPAGLRAKAEHNESYYPVAAALLDVSTNQPA

SEQ ID NO: 72401 - DNA, 2178 bp, Brassica napus
  CDS (1)..(2178)
atggcttcacgaacgaaagggacgacgacgattgaagttggcgccgatggcgtcgccgtcataactctcatcaatccccccgtcaattcgctctcattcgacgtgctatacagtctcaagagtaattacgaggaggccttgagcaggaacgatgttaaagctattgttgttacaggtgctaaggggaagttctctggtggatttgatatatctggatttggtgaaattcagaaagggacgatgaaagagccaaaggttggatacatatcgattgatatcctcacagatttgcttgaagctgcaaagaaaccgtctgtagctgctattgatgggcttgccttaggaggagggttagagctttccatggcttgccatgctaggatatcagctcctggtgcacagttaggtctgcccgagcttcaactcggtgttattcctgggtttggaggaacacagcgtcttccacgtcttgttggtctcacaaaagcccttgagatgattttgacatctaagccggttaaagcagaggaaggtcattcattgggtcttattgatgctgtcgtgccacctgcggagttactaaacgctgctcgtcgctgggcccttgacattgccgagaggagaaaaccatgggtttctagtgttttaaagactgataagttacctcctcttggagaggcaagggagatactgaaattcgccaaggatcagacgcgcaggcaagcccccaacatgaaacaccccttaatgtgccttgaggctgttgaagttggtattgtttctggttcaagagctggtttagaaaaggaggctcaagtcggctcagaagtgataaacctggatactaccaaaggactgatccatgtcttcttttctcagcgaggaactacaaaggttcctggagttactgatcgtgggttggtgccaaggaagattaataaggtagccataattggaggcgggttaatgggatctggaatagccactgcattgatcctcagtaactattcagtgattctcaaggaggttaatgagaagttcttggaggctggaattggcagggtcaaagctaatcttcagagtcgtgtaaagaaaggaaagatgtcgaaggaaaagtttgagaaaaccatgtctctcctcaagggttctcttgactatgaaagctttagggatgtggacatggtcatcgaggctgtcattgagaatatatctctgaagcagcaaatttttgctgatctcgagaagtactgtcctcaacattgtatccttgctagcaacacatctaccattgatttgaacaaaattggggagcggaccaagtcccaggatcggattatcggagcacatttcttcagtccagcgcatgtcatgccactacttgaaatagttcggaccaatcatacctctgcccaagtaattgttgacctgttagatgttgggaagaagattaggaaaacaccagtcgtggttggaaactgcacggggttcgcagttaataggatgttcttcccatacacacaggcagctatgttccttgttgagcatggaacagatccatatctcatcgacaaagcagtcagcaagtttggaatgccaatgggtcccttcagattgtgcgacctggttggattcggtgtggcgattgcaaccgcaacacaattcattgagaacttccctgaacggacatacaaatcaatgattatcccactcatgcaagaggacaagagagctggtgaagccactcgtaaaggtttctatctttatgatgataggcgcaaggctaaacctgaccctgaaataaagaactatatagacaaggcaaggagcgtatcaggagcaaagcctgacccgaagctggagaaactgtcggagaaggaaattattgaaatgacgttcttcccagtagtgaacgaggcgtgtagagtctttgcggaaggaattgctgtcaaagcagcagaccttgacattgctggcatatttggaatgggttttccaccttacagaggaggaatcatgttctgggctgattccattggatcgaaatacatttactcaaagctagaggagtggtcgaaggcttatggtgaattcttcaagccttgtgctttcttggctgaaaggggatccaaaggagctcctctgagcgctcctttggaacaatccagatcacggttgtaa

SEQ ID NO: 72402 - protein, 725 aa, Brassica napus
MASRTKGTTTIEVGADGVAVITLINPPVNSLSFDVLYSLKSNYEEALSRNDVKAIVVTGAKGKFSGGFDISGFGEIQKGTMKEPKVGYISIDILTDLLEAAKKPSVAAIDGLALGGGLELSMACHARISAPGAQLGLPELQLGVIPGFGGTQRLPRLVGLTKALEMILTSKPVKAEEGHSLGLIDAVVPPAELLNAARRWALDIAERRKPWVSSVLKTDKLPPLGEAREILKFAKDQTRRQAPNMKHPLMCLEAVEVGIVSGSRAGLEKEAQVGSEVINLDTTKGLIHVFFSQRGTTKVPGVTDRGLVPRKINKVAIIGGGLMGSGIATALILSNYSVILKEVNEKFLEAGIGRVKANLQSRVKKGKMSKEKFEKTMSLLKGSLDYESFRDVDMVIEAVIENISLKQQIFADLEKYCPQHCILASNTSTIDLNKIGERTKSQDRIIGAHFFSPAHVMPLLEIVRTNHTSAQVIVDLLDVGKKIRKTPVVVGNCTGFAVNRMFFPYTQAAMFLVEHGTDPYLIDKAVSKFGMPMGPFRLCDLVGFGVAIATATQFIENFPERTYKSMIIPLMQEDKRAGEATRKGFYLYDDRRKAKPDPEIKNYIDKARSVSGAKPDPKLEKLSEKEIIEMTFFPVVNEACRVFAEGIAVKAADLDIAGIFGMGFPPYRGGIMFWADSIGSKYIYSKLEEWSKAYGEFFKPCAFLAERGSKGAPLSAPLEQSRSRL

SEQ ID NO: 72403 - DNA, 2178 bp, Cucumis sativus
  CDS (1)..(2178)
atgggaagcaatgcaaaaggaagaacggtaatggaggtgggaactgatggagtagcaataatcaccatcatcaaccctccagttaactccttgtcttttgatgtgttattcagcctgagagatagttatgaacaagccttgagaagagatgatgtgaaggcaattgttgttacaggtgcaaagggaaaattttctggtggctttgatataactgcttttggtgtactccaaggaggaaagggggagcaaccaaatgttagaaacatatcaattgaaatgatcactgatatttttgaagctgcccgaaaacctgcggttgcagcgatagatggacttgctttgggtggagggttggaggttgccatggcttgtcatgctcgaatatcaactcctaccgctcaattagggttgcctgaacttcagctcggaataattcctggttttggaggaacacaacggcttccacgtcttgttggtctctcaaaggccctagaaatgatgttgacgtcaaagccaattaaaggacaagaagctcattctttggggttagtggatgccattgtccctcccgaagagttgatcaacactgcacgtagatgggctcttgaaatcctagagcggagaagaccatgggttcacagtcttcacaggactgacaagttagagtctcttgctgaggctaggaaaatatttaacttagctagagctcaggcaaagaaacagtacccaaatcttaagcatacaattgcctgcattgatgctgttgaaacgggtgtcgtctctggccctcgtgctggactttggaaggaggctgaagaatttcagggactcctacattctgatacttgcaaaagcttaattcatatcttctttgcccagcgttcaacaactaaggtacctggagttactgatctgggtttggtaccgagacaaatcaagaaagttgctattgtcggaggaggattaatgggatctggtatagctacagcattgattcttagcaactatcatgtggtacttaaagaagtgaacgataagttcttgcaggctggcattgacagagtcagagcaaacctacaaagccgagtcaaaaaagggaatatgactaatgagaaattcgaaaagagtatttctttactcaagggagttcttaactacgaaagttttaaagatgtagatatggtgatagaggctgttattgagaatgtttctttgaagcaacaaatcttttctgatcttgaaaaatattgccccccacattgcatgcttgctactaatacttccacaatagacttggagttgattggagagagaataaagtctcgtgacaggattattggagctcatttctttagtcctgctcacatcatgccgctattggaaattgtccgtaccaagcatacagctgcacaagtgattgttgatctgctagatgttgggaagaatataaagaaaacaccagttgtcgttggaaattgtacaggttttgctgtcaacagaatgttttttccctactctcaggctgcaattttacttgcagaacatggggtagatccctatcagattgacagggctatttccaagtttggaatgccaatgggacccttcaggttgtgcgaccttgttggttttggtgtggcagcagcaactgccagtcagtttgttcaagcttttccagaaagaacttataaatcgatgctaattcctctgatgcaagaggataagaatgcaggtgaatccactcgtaaaggtttctatgtctatgacaagaaccgaaaagctgggccaaatccagagttaaagaaatatatcgagaaggctaggaacagttctggtgtttcagttgatcctaagctcacaaagttacccgaaaaggacattgtggagatgatatttttcccagtggtgaatgaagcatgtcgtgtccttgccgaaggcatagcagtcaaagcagctgacctggacattgctggtgtaatgggaatgggtttcccctcctacaggggaggactcatgttctgggcggattctcttggatcaaattacatctattcaaggttggaggaatggtcgaaacagtatggtggatttttcaagccctgtggatacttagctgaaagggctgttcagggtgcaactctgagtgctccgggtggccatgctaaacctcgaatgtaa

SEQ ID NO: 72404 - protein, 725 aa, Cucumis sativus
MGSNAKGRTVMEVGTDGVAIITIINPPVNSLSFDVLFSLRDSYEQALRRDDVKAIVVTGAKGKFSGGFDITAFGVLQGGKGEQPNVRNISIEMITDIFEAARKPAVAAIDGLALGGGLEVAMACHARISTPTAQLGLPELQLGIIPGFGGTQRLPRLVGLSKALEMMLTSKPIKGQEAHSLGLVDAIVPPEELINTARRWALEILERRRPWVHSLHRTDKLESLAEARKIFNLARAQAKKQYPNLKHTIACIDAVETGVVSGPRAGLWKEAEEFQGLLHSDTCKSLIHIFFAQRSTTKVPGVTDLGLVPRQIKKVAIVGGGLMGSGIATALILSNYHVVLKEVNDKFLQAGIDRVRANLQSRVKKGNMTNEKFEKSISLLKGVLNYESFKDVDMVIEAVIENVSLKQQIFSDLEKYCPPHCMLATNTSTIDLELIGERIKSRDRIIGAHFFSPAHIMPLLEIVRTKHTAAQVIVDLLDVGKNIKKTPVVVGNCTGFAVNRMFFPYSQAAILLAEHGVDPYQIDRAISKFGMPMGPFRLCDLVGFGVAAATASQFVQAFPERTYKSMLIPLMQEDKNAGESTRKGFYVYDKNRKAGPNPELKKYIEKARNSSGVSVDPKLTKLPEKDIVEMIFFPVVNEACRVLAEGIAVKAADLDIAGVMGMGFPSYRGGLMFWADSLGSNYIYSRLEEWSKQYGGFFKPCGYLAERAVQGATLSAPGGHAKPRM

SEQ ID NO: 72405 - DNA, 2178 bp, Oryza sativa
  CDS (1)..(2178)
atggcgggggcgatccgcgtcaccatggaggtgggcgccgacggcgtcgcggtcgtcaccatctgcaacccgcccgtcaatgcgctgcatcccatcatcatccagggattgaaggagaagtacgcggaggcgatggatcgcgacgacgtcaaggccatcgtgctcaccggtgctggaggcaaattttgtggaggctttgatatcaatgtgttcacagaagttcacaagactggaaatgtatctcttatgcctgatgtatctgttgagcttgtgtcgaatttgatggaagcgggcaaaaagccttcagttgctgccattcaaggccttgctcttggtggcggtttggagttgaccatgggttgccatgctcggatatctacccctgaagctcaacttggactaccagagttgactctgggcataattcctggatttggaggaacccagcgtctgccaaggcttgtaggtctgcccaaagcaatagaaatgatgctgcaatcaaagttcatcacagcaaaggaagggaaagaaggtggtcttgttgatgccctgtgctcccctgatgagttgataaagatgtcacgcctttgggctctggagatagctaattaccgtaaaccttggataagatctcttgccagaacagataggcttggttcactgtctgaagctcgttctgtattaaatagtgcaagacagcaagcgaagaaggttgcagcaaacttgccacagcaccaggcctgcctagatgttatggaagaaggtgtactatgtggaggccatgctggtgttctgaaggaggccaaggttttcaaggagttggtgctatcaccaacatcaaaggcacttgtacatgctttctttgcccagcgtttaaccacaaaggtgccaggtgttactgatgttcaattgaaacctaggaaaataagaaaagttgctgttattggtggtggtttgatgggctctggaattgcaacagctcttcttgttagcaatacatccgttgtgcttaaggaagtaaatcctcaattccggcaaaggggacagaagatgatagcagctaatcttgagggtctagtcaagaggggctcattgacaaaggacaagatgaacaaggccatgtcacttctcaagggtgcattggattattgtgatttcaaggatgttgatatggtcatcgaggctgtcatagagaagattcctttgaaacaatcaatattttctgaccttgagaaagtatgcccaccccactgcatacttgcaacaaacacatctaccatcgatttgaatgttgtgggcgagaagacaaattctcaagatagaattataggggcacatttctttagccctgcccatattatgcctttgcttgaaattgtccggacggagaagacatcaccgcaagctattcttgatctcatcacagttgggaaaatgataaagaaagtccctgttgtggttgggaactgcacaggcttcgcagtcaatcgtacatttttcccttacacacagggttctcatcttctagttagtattgggatcgacgttttcagaattgatcgagtaataagcagctttggcatgccaatgggaccttttcaactgcaagatctggctggatatggagtgcattgcagtaaaggattctatgcggctgcctttggaacaaggaatctggactctaatctggtggatttgatggtacagaatggacggcagggaaagagcaatggtaaaggttattacctttatgagaagggtgggaagccgaagcctgacccaagtgttcaggttgtgattgacgagtacagaagatgtgcaaagacaatgcctggtggaaagcctgttactttatctgatcaagatatattggagatgattttcttcccagttgttaatgaggcatgcagggtcatggatgaaaatgttgtgatccgagcttctgatcttgatattgcttctatccttgggatgggttttcccaagttcaggggtggtcttgtcttttgggctgacactattggagcaccttatatacattcaaagcttagcaagtggactgaaatttatggcgatttcttcaaaccatcatcctatttggaagatagagctaaaagaagcctaccattgagcgcaccaaacgcaacccagcaggcttcgtcgaggtcacgcatgtga

SEQ ID NO: 72406 - protein, 725 aa, Oryza sativa
MAGAIRVTMEVGADGVAVVTICNPPVNALHPIIIQGLKEKYAEAMDRDDVKAIVLTGAGGKFCGGFDINVFTEVHKTGNVSLMPDVSVELVSNLMEAGKKPSVAAIQGLALGGGLELTMGCHARISTPEAQLGLPELTLGIIPGFGGTQRLPRLVGLPKAIEMMLQSKFITAKEGKEGGLVDALCSPDELIKMSRLWALEIANYRKPWIRSLARTDRLGSLSEARSVLNSARQQAKKVAANLPQHQACLDVMEEGVLCGGHAGVLKEAKVFKELVLSPTSKALVHAFFAQRLTTKVPGVTDVQLKPRKIRKVAVIGGGLMGSGIATALLVSNTSVVLKEVNPQFRQRGQKMIAANLEGLVKRGSLTKDKMNKAMSLLKGALDYCDFKDVDMVIEAVIEKIPLKQSIFSDLEKVCPPHCILATNTSTIDLNVVGEKTNSQDRIIGAHFFSPAHIMPLLEIVRTEKTSPQAILDLITVGKMIKKVPVVVGNCTGFAVNRTFFPYTQGSHLLVSIGIDVFRIDRVISSFGMPMGPFQLQDLAGYGVHCSKGFYAAAFGTRNLDSNLVDLMVQNGRQGKSNGKGYYLYEKGGKPKPDPSVQVVIDEYRRCAKTMPGGKPVTLSDQDILEMIFFPVVNEACRVMDENVVIRASDLDIASILGMGFPKFRGGLVFWADTIGAPYIHSKLSKWTEIYGDFFKPSSYLEDRAKRSLPLSAPNATQQASSRSRM

SEQ ID NO: 72407 - DNA, 24 bp, Primer
atggaaatgacatcagcgtttacc

SEQ ID NO: 72408 - DNA, 24 bp, Primer
atggaaatgacatcagcgtttacc

SEQ ID NO: 72409 - protein, 775 aa, consensus
  MISC_FEATURE (1)..(775): consensus for the disclosure of xaa see table XV
NXXXXXXXXXXXXXXXXXXXXXXXXXXXXXXXXXXXXXFXXGXXXXXXXXXXXXXXXXXXXXXXXXXXXXXXXXXXXXXXXXXXXXXXXXXPXXAAXXGXXLGGGXEXXLXXXXRXXXXXXXXXXGLPEXXLGXXPGXGGXXRXPRXXGXXXAXXXXXXXGXXXXXXXAXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXXXXXXXXXXXXXXXXXXXXXXXEXXXFXXXXXXXXXXXXXXXFXXXXXXXXXXXXXXXXXXXXXXXXXXXXXXXXXGXGXMGXGIAXXXXXXXXXXVXXXXXXXXXXXXXXXXXXXXXXXXXXXXXXXXXXXXXXXXXXXXXXXXXXXXXXXXXXDXVXEAVXEXXXXKXXXXXXXXXXXXXXXXXAXNTSXXXXXXXXXXXXXPXXXXGXHFFXPXXXMXLXEXXXXXXXXXXXXXXXXXXXXXXXXXXXXXKXXXXVXXXXGFXXXRXXXXXXXXXXXXXXXGXXXXXXDXXXXXXXGXPXGPXXXXDXXGXXXXXXXXXXXXXXXXXXXXXXXXXXXXXXXXXXXXXXXXXXXXXGXKXXXGXYXYXXXXXXXXXXXXXXXXXXXXXXXXXXXXXXXXXXXXXXXXXXXXXXXXXXXXXXXXXXXXXXXXXXXXXXXXXRXXXXXXXEXXXXXXXEXXXXXXXXXDXXXXXGXGFXXXXGGXXXXXXXXXXXXXXXXXXXXG

SEQ ID NO: 72410 - protein, 791 aa, consensus
  MISC_FEATURE (1)..(791): consensus for the disclosure of xaa see table XV
NXXXXXXXXXXXXXXXXXXXXXXXXXXXXXXXXXXXXXFXXGXDXXXXXXXXXXXXXXXXXXXXXXXXXXXXXXXXXXXXXXXXXXXXXXXPXXAXXXGXXXGGGXEXXXXXXXXXXRXXXXXXXXXXXXPEXXLGXXPGXGGXXRXXXXXGXXXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXXXXXXXXXXXXXXXXXXXXXXXEXXXXXXXXXXXXXXXXXXXXXXXXXXXXXXXXXXXXXXXXXXXXXXXXXXXXXXXXGXGXMGXXIAXXXXXXXXXXXXXXXXXXXXXXXXXXXXXXXXXXXXXXXXXXXXXXXXXXXXXXXXXXXXXXXXXXXXXXXXXDXXXEAVXEXXXXKXXXXXXXXXXXXXXXXXXXNTSXXXXXXXXXXXXXXXXXXGXHXFXPXXXMXLXEXXXXXXXXXXXXXXXXXXXXXXXXXXXXXKXXXXXXXXXGFXXXRXXXXXXXXXXXXXXXGXXXXXXXXXXXXXXXXXXXXXXGXXXXGXXXXXDXXXXXXXXXXXXXXXXXXXXXXXXXXXXXXXXXXXXXXXXXXXXXXXXGXXXGXGXXXYXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXGXGXXXXXGGXXXXXXXXXXXXXXXXXXXXG

SEQ ID NO: 72411 - protein, 85 aa, consensus
  MISC_FEATURE (1)..(85): consensus for the disclosure of xaa see table XV
XXXXXXXXXXXXGXXEXXXXXXXRXXXXXXXXXXXXPEXXXGXXPXXXXXXXXXXXXXXXXXXXXXXXXXXXXXXXXXXXXXXXX

SEQ ID NO: 72412 - protein, 13 aa, consensus
  MISC_FEATURE (1)..(13): consensus for the disclosure of xaa see table XV
XXXGXGXMXXXXX

SEQ ID NO: 72413 - protein, 71 aa, consensus
  MISC_FEATURE (1)..(71): consensus for the disclosure of xaa see table XV
XXXXEXXXEXXXXKXXXXXXXXXXXXXXXXXXXNTSXXXXXXXXXXXXXXXXXXXXHXFXPXXXXXLXEXX

SEQ ID NO: 72414 - protein, 62 aa, consensus
  MISC_FEATURE (1)..(62): consensus for the disclosure of xaa see table XV
XXXXXXXXXXXXXXXXXXXXXXXXXXXXXXXXXGXXXXXXXXXXXXXXGXXXXXXXXXDXXX

SEQ ID NO: 72415 - protein, 18 aa, consensus
  MISC_FEATURE (1)..(18): consensus for the disclosure of xaa see table XV
XXXXXXXGXXXXXGXXXX

SEQ ID NO: 72416 - protein, 49 aa, consensus
  MISC_FEATURE (1)..(49): consensus for the disclosure of xaa see table XV
XXXXXXXXXXXXXXXXXXXXXXXXXXXXXXXXXXXXXGXXXXXGGXXXX

SEQ ID NO: 72417 - DNA, 879 bp, Escherichia coli K12
  CDS (1)..(879)
atgttcacgggaagtattgtcgcgattgttactccgatggatgaaaaaggtaatgtctgtcgggctagcttgaaaaaactgattgattatcatgtcgccagcggtacttcggcgatcgtttctgttggcaccactggcgagtccgctaccttaaatcatgacgaacatgctgatgtggtgatgatgacgctggatctggctgatgggcgcattccggtaattgccgggaccggcgctaacgctactgcggaagccattagcctgacgcagcgcttcaatgacagtggtatcgtcggctgcctgacggtaaccccttactacaatcgtccgtcgcaagaaggtttgtatcagcatttcaaagccatcgctgagcatactgacctgccgcaaattctgtataatgtgccgtcccgtactggctgcgatctgctcccggaaacggtgggccgtctggcgaaagtaaaaaatattatcggaatcaaagaggcaacagggaacttaacgcgtgtaaaccagatcaaagagctggtttcagatgattttgttctgctgagcggcgatgatgcgagcgcgctggacttcatgcaattgggcggtcatggggttatttccgttacggctaacgtcgcagcgcgtgatatggcccagatgtgcaaactggcagcagaagggcattttgccgaggcacgcgttattaatcagcgtctgatgccattacacaacaaactatttgtcgaacccaatccaatcccggtgaaatgggcatgtaaggaactgggtcttgtggcgaccgatacgctgcgcctgccaatgacaccaatcaccgacagtggtcgtgagacggtcagagcggcgcttaagcatgccggtttgctgtaa

SEQ ID NO: 72418 - protein, 292 aa, Escherichia coli K12
MFTGSIVAIVTPMDEKGNVCRASLKKLIDYHVASGTSAIVSVGTTGESATLNHDEHADVVMMTLDLADGRIPVIAGTGANATAEAISLTQRFNDSGIVGCLTVTPYYNRPSQEGLYQHFKAIAEHTDLPQILYNVPSRTGCDLLPETVGRLAKVKNIIGIKEATGNLTRVNQIKELVSDDFVLLSGDDASALDFMQLGGHGVISVTANVAARDMAQMCKLAAEGHFAEARVINQRLMPLHNKLFVEPNPIPVKWACKELGLVATDTLRLPMTPITDSGRETVRAALKHAGLL

SEQ ID NO: 72419 - DNA, 897 bp, Haemophilus influenzae
  CDS (1)..(897)
atgtcagcgcaaaattctttattttcgggtagcatagttgcccttgttacgccaatgaatcattatggcgaagtcgatttttcctgtttagaaaaattagtagaacaccacattgaagctggttctaacgcacttgtttctgtgggtacaacgggagaatccgccacgctaagtattgaagaaaatgtaaaagtcattgaaaagactgttgaatttgccaaaggacgtattcctattattgcgggagcgggtgcaaatgcgacgagtgaagcaattacaatgaccaaattattacgagacagtggtgtagcaggatgtttatctgttgtgccttattataataaaccaacccaagagggaatgtatcaacattttaaagccattgcggaatgtactgatttaccacagattctttataatgttcctagtcgcacaggcagtgatatgaaacctgaaacagttgctcgtttagctgaaattgaaaatattgtaggcattaaggaagcaacgagagatgttagccgaatagttaaaattaagcagcttgcaggtaagaattttattgttttaagtggtgatgatgcaacaggcttagaagcaataaaattaggtgctgaaggagtaatatcagtaacaaataacattgcagcaaaagatatggctgatatgtgccgttatgcacttgcgggagattttgataaagcggaagaaattaatgctcgtttaatgcgtttacatcacgacctattcattgaatctaatccaattccagtgaagtgggcagcttatcgcttaggcttaattaaatcgccacatttacgcttgccacttacaacacttagtgaagaaattcaaccaaaagtaggagatgcgctwaaaatcgcaggattattataa

SEQ ID NO: 72420 - protein, 298 aa, Haemophilus influenzae
MSAQNSLFSGSIVALVTPMNHYGEVDFSCLEKLVEHHIEAGSNALVSVGTTGESATLSIEENVKVIEKTVEFAKGRIPIIAGAGANATSEAITMTKLLRDSGVAGCLSVVPYYNKPTQEGMYQHFKAIAECTDLPQILYNVPSRTGSDMKPETVARLAEIENIVGIKEATRDVSRIVKIKQLAGKNFIVLSGDDATGLEAIKLGAEGVISVTNNIAAKDMADMCRYALAGDFDKAEEINARLMRLHHDLFIESNPIPVKWAAYRLGLIKSPHLRLPLTTLSEEIQPKVGDALKIAGLL

SEQ ID NO: 72421 - DNA, 852 bp, Methanobacterium thermoautotrophicum
  CDS (1)..(852)
atgaagattgaaggcacagttgtggccatggttactccattcacagaggacgatgtggtggatgaggccgggctgcgggagaacataaactaccttatagagaacggggttgatggcctgctggttgccggaacaaccggtgaatcagcgacaataacccacgaagagcagaggagaatgatcgatatactggtggatgaggtcaacggtcgcgtcaggacagttgcaggggcaggtagcaattcatccagggaggccatgggacttgtggagtacgcagaggacgccggtgcagacgcggccctcgtcataaccccctactacaacaagccccagccccatggactcattgaacactacaccatgctggaggaagccgctgacataccactcataatatacaatgtcccctcaaggacaggcacagatatagacgttgacacggtcgccgaactagcaaagctcgacgggataattgggataaaggaggccagccccgacctggacaaggtatccatgctcaggtcaaggctcatggacctgggccttgatgacttcacagtcctctcaggtaacgataacctgactctccccatgatctccatgggtgccgagggtgtgatatcggtggttgcaaatgtcgacccggctcgtatgagccgacttgttaacgaggccctctcaggggacttcgagtctgcaatgaaaacacactatgaactctacagtctcatgaaggtccttttcattgagagcaaccccgtacctgtcaaggaggcccttaacatgatgggcaaggcccgcgggtcatgtgaggatgcccctggcacccctgcaggatgcaaaccgtga

SEQ ID NO: 72422 - protein, 283 aa, Methanobacterium thermoautotrophicum
MKIEGTVVAMVTPFTEDDVVDEAGLRENINYLIENGVDGLLVAGTTGESATITHEEQRRMIDILVDEVNGRVRTVAGAGSNSSREAMGLVEYAEDAGADAALVITPYYNKPQPHGLIEHYTMLEEAADIPLIIYNVPSRTGTDIDVDTVAELAKLDGIIGIKEASPDLDKVSMLRSRLMDLGLDDFTVLSGNDNLTLPMISMGAEGVISVVANVDPARMSRLVNEALSGDFESAMKTHYELYSLMKVLFIESNPVPVKEALNMMGKARGSCEDAPGTPAGCKP

SEQ ID NO: 72423 - DNA, 942 bp, Halobacterium sp. NRC-1
  CDS (1)..(942)
atgctggtcgccgcacaccacacacgcatgccaacgcacgcgccggccccgggcagcggggacccactgggactgcatggcgtcgttccgccggttgtaaccgccttcgacgcggacgagagcctcgacgccgacaccaccgccgaccacgcccgcatggtcgtggatgcgggcgtacatggggtgttcccgctggggacgaacggcgagttcccgctgttgaccccgagtgagcgcgaccgcgtcgtgactgcggtcgtcgacgaggtcgggggcgaggtgccggtcatcgcgggcgtcggcgcgccgtccacgcgccagacggtcgcccacgccgagcacgccgcgtcggtcggtgccgacggggtcgtggtcgtgacgccgttctactatccgctggacggcacggccgccgtcgaacactaccggcgggtggcggcggccgtcgactgcccggtgtacgtctaccacatcccgtcgaagacgggcaacgagctgtccctggagacgctggcggcgctggcggagatcgacaccctggcgggggtcaaagactcctcgaaggacgtgccgtggctggggcaggccgtcgacgcccatcccgagttgacgttcctggcgggctcggactccctgcttgcgccgggcttggacgtgggctgtgcggggctggtgtcggccgtcgccaacgtcgccccggagctggtggtggggctgtacgaggcctacgacgagggcgaccgcgagcgcgccagggcgcgccagtccaccgtctacgaggtgcgggcagcgctcaagcgcggcccctacatggcgggcgtgaaggccgccctggggctgcgggggttcgacgccgggccgctgcggtcgccgctgcgcgggctggacgacgacgaccgggcggcgctcgaagcggacctcgccgacctggggctgctgtga

SEQ ID NO: 72424 - protein, 313 aa, Halobacterium sp. NRC-1
MLVAAHHTRMPTHAPAPGSGDPLGLHGVVPPVVTAFDADESLDADTTADHARMVVDAGVHGVFPLGTNGEFPLLTPSERDRVVTAVVDEVGGEVPVIAGVGAPSTRQTVAHAEHAASVGADGVVVVTPFYYPLDGTAAVEHYRRVAAAVDCPVYVYHIPSKTGNELSLETLAALAEIDTLAGVKDSSKDVPWLGQAVDAHPELTFLAGSDSLLAPGLDVGCAGLVSAVANVAPELVVGLYEAYDEGDRERARARQSTVYEVRAALKRGPYMAGVKAALGLRGFDAGPLRSPLRGLDDDDRAALEADLADLGLL

SEQ ID NO: 72425 - DNA, 936 bp, Streptococcus pneumoniae
  CDS (1)..(936)
atgtcttatcaagatttaaaaaaatgtaaaatcattacagcctttattacccccttccatgaggatggttccattaactttgatgctattccagccttgattgagcatttattggcccatcatacggatggaattcttctcgcaggaacgactgctgagagtccaactttgacccacgatgaggagttggagttgtttgcggctgtacaaaaggttgtcaatggacgcgttcctttgattgcgggtgtaggtactaatgatacgcgtgactctattgagtttgtcaaagaagtagcggaatttggtggtttcgcagctgggcttgctattgttccttactacaacaaaccttctcaagaagggatgtatcagcactttaagactattgcagatgcttctgacctaccaattattatctataacattccagggcgtgtagttgtcgaattgactccagaaaccatgcttcgcttggctgaccatccaaatattatcggtgtcaaagaatgtactagcttggctaatatggcttacttgattgagcacaagcctgaagagttcttgatttatacaggtgaggatggagatgctttccatgccatgaaccttggggcggatggggttatttctgttgcctctcatacaaatggggatgaaatgcacgagatgtttactgcgattgcagaaagcgatatgaagaaagccgcagcaattcagcgtaaattcattcctaaggttaatgctctcttctcttatccaagtcctgctccagttaaggcaattcttaactatatgggatttgaagctggacccactcgtctacctcttgttccagcaccagaagaagatgccaaacgcattatcaaggttgtcgtagatggcgactacgaagcaactaaggcaactgtaacaggggtcttaagaccagattactaa

SEQ ID NO: 72426 - protein, 311 aa, Streptococcus pneumoniae
MSYQDLKKCKIITAFITPFHEDGSINFDAIPALIEHLLAHHTDGILLAGTTAESPTLTHDEELELFAAVQKVVNGRVPLIAGVGTNDTRDSIEFVKEVAEFGGFAAGLAIVPYYNKPSQEGMYQHFKTIADASDLPIIIYNIPGRVVVELTPETMLRLADHPNIIGVKECTSLANMAYLIEHKPEEFLIYTGEDGDAFHAMNLGADGVISVASHTNGDEMHEMFTAIAESDMKKAAAIQRKFIPKVNALFSYPSPAPVKAILNYMGFEAGPTRLPLVPAPEEDAKRIIKVVVDGDYEATKATVTGVLRPDY

SEQ ID NO: 72427 - DNA, 900 bp, Sinorhizobium meliloti
  CDS (1)..(900)
atgaaactcgaagggatctattcggccctccttaccccgttctccgaagacgaaagcattgaccggcaggccatcggggcgctcgtcgattttcaggtccgtctcggcatcgacggggtctatgtcggcggcagctcgggcgaagcgatgctgcagtcgctcgacgagcgcgcggactacctctccgacgttgccgccgccgcgtccggccgcctgacgctgatcgctcatgtcggcacgatcgcgacgagagatgcgctcaggctttcgcagcatgcggccaaatcgggttaccaggcgatttcggcgatcccgcccttctactacgacttctcccggcccgaagtcatggcgcattatcgggagctcgccgatgtttcggccctgcctctcatcgtctataacttcccggcccgcaccagcggcttcaccttgcccgaactggtcgagcttctctcgcatcccaacatcatcggcatcaagcatacgtcgagcgacatgttccagctcgaacgcatccggcatgcagtacccgacgccatcgtatacaacggctatgatgaaatgtgcctggccggtttcgcgatgggcgcacagggtgcgataggcaccacgtataatttcatgggcgatctgttcgtcgcgctcagggactgcgcagcggccgggcggatcgaggaggcccggcggctgcaggccatggcgaaccgcgtgatccaggtgctgatcaaggtcggcgtcatgccggggtccaaggcgctgctcggcatcatgggccttcccggaggcccctccagacgccccttccggaaggtcgaagaggcggatctcgcagcccttcgcgaagccgtggcgccggtcctcgcgtggcgcgagagcacttccagaaaaagcatgtaa

SEQ ID NO: 72428 - protein, 299 aa, Sinorhizobium meliloti
MKLEGIYSALLTPFSEDESIDRQAIGALVDFQVRLGIDGVYVGGSSGEAMLQSLDERADYLSDVAAAASGRLTLIAHVGTIATRDALRLSQHAAKSGYQAISAIPPFYYDFSRPEVMAHYRELADVSALPLIVYNFPARTSGFTLPELVELLSHPNIIGIKHTSSDMFQLERIRHAVPDAIVYNGYDEMCLAGFAMGAQGAIGTTYNFMGDLFVALRDCAAAGRIEEARRLQAMANRVIQVLIKVGVMPGSKALLGIMGLPGGPSRRPFRKVEEADLAALREAVAPVLAWRESTSRKSM

SEQ ID NO: 72429 - DNA, 909 bp, Agrobacterium tumefaciens
  CDS (1)..(909)
atggcgacacgattcaagggactttcggcttttccgatcacgccggctgacgaggccgggcgagtcgatattgaggccttctccgccctgatcgcgcggctggacgcggcggaggtcgattccgtcggcatcctcggcagcaccggcatctatatgtatctcacgcgtgaggagagacgccgcgccatcgaggcagccgccacgatcctcaggggcaggcgcacgctgatggcaggcatcggcgcgttgcgcaccgatgaagccgtggcgctggcgaaagacgctgaagcagccggtgcggacgcgctgctgctcgcacccgtctcctacacgccgctgacgcaggaagaggcctatcaccacttcgccgccgtcgcgggcgcaacggccctgccgctcgccatctacaacaacccgacgaccacccgcttcaccttcagcgacgagcttctcgtgcggctggcctatatcccgaatatccgcgccatcaagatgccgctgccggccgatgccgattatgccggcgagcttgcacgtctgcgccccaagctgtcggacgatttcgccattggttacagtggtgactggggctgcactgacgccacacttgccggcggtgacacctggtacagcgtggttgccggtctgctcccggttccggcgttgcaactgatgcgggcggctcaggccggcaatgcggaggaggcaaaaaggctcgatgcgaccttccagccgctctgggcgctgtttaaggaattcggcagtatccgcgtgatctatgccgccgccaacatcctgtcgctgacggtcagcgaaccaccccggccgatcctgccgctcaccagcgcggagcgccagcgggtggaagaggcgctggaggcactatccgcgctagaaaccgcgccataa

SEQ ID NO: 72430 - protein, 302 aa, Agrobacterium tumefaciens
MATRFKGLSAFPITPADEAGRVDIEAFSALIARLDAAEVDSVGILGSTGIYMYLTREERRRAIEAAATILRGRRTLMAGIGALRTDEAVALAKDAEAAGADALLLAPVSYTPLTQEEAYHHFAAVAGATALPLAIYNNPTTTRFTFSDELLVRLAYIPNIRAIKMPLPADADYAGELARLRPKLSDDFAIGYSGDWGCTDATLAGGDTWYSVVAGLLPVPALQLMRAAQAGNAEEAKRLDATFQPLWALFKEFGSIRVIYAAANILSLTVSEPPRPILPLTSAERQRVEEALEALSALETAP

SEQ ID NO: 72431 - DNA, 912 bp, Agrobacterium tumefaciens
  CDS (1)..(912)
atgaaattcgaaggtatatataccccggcgattacaccgctcggtcatgacggagagatcgaccgcgacgccttcgcagctgtcctcgagtcgctcatggaagcacgggtgcacggcatcatcatcggtgggtcgacgggcgaatattacgcgcagacggcccaggagcgcttcgatctggcagcctacgccagacaagtgatcggtacgcggctgccgctcgtcgtcggaaccggcgccacccgtaccgaagattccattgaatatgccaaggcggccaaggaaatcggcgctgacgccattctcgtttcctctccgccctacgcgctgccgaccgagcgtgaaaacgccgtccacgcgcttgcggttgatcgcgcggcgaaccttccgatcatgctgtacaactaccctgctcgcatgggtgtggtgatgggggaggaatatttctcccgcgtcggcaaatcgaagaatgtcgtcgccatcaaggaaagctctggcgacatgggcaatctgcatctcctcgcccgcaagttcccgcagattgcgctgtcctgcggctgggacgaccaggcgttggaattcttcgcctggggcgcgaaaagctgggtctgcgcgggctcgaatttcctgccgcgcgagcatgtggcactctacgaagcctgcgtcgtcgaaaagaacttcgacaagggacgcgcgatcatgaccgcaatgctgccgctgatggattttctcgaatgcggaaaattcgtccaatccatcaagcatggatgcgaaatcatcgggcttcgggccggatctgtccgggctccgcttcgccccctcaattccgatgaaaaacgaactctccagactgtcgttaccacgttgaagcgaacagtcgcccagattgcgtcgggagccaatcatgcatga

SEQ ID NO: 72432 - protein, 303 aa, Agrobacterium tumefaciens
MKFEGIYTPAITPLGHDGEIDRDAFAAVLESLMEARVHGIIIGGSTGEYYAQTAQERFDLAAYARQVIGTRLPLVVGTGATRTEDSIEYAKAAKEIGADAILVSSPPYALPTERENAVHALAVDRAANLPIMLYNYPARMGVVMGEEYFSRVGKSKNVVAIKESSGDMGNLHLLARKFPQIALSCGWDDQALEFFAWGAKSWVCAGSNFLPREHVALYEACVVEKNFDKGRAIMTAMLPLMDFLECGKFVQSIKHGCEIIGLRAGSVRAPLRPLNSDEKRTLQTVVTTLKRTVAQIASGANHA

SEQ ID NO: 72433 - DNA, 882 bp, Yersinia pestis
  CDS (1)..(882)
atgtttacaggcagcatagttgcgctaataacgccaatggacgacaacggtgatgtcgatcgtgcaagcctgaagagcctgattgattaccacgtggccagtgggactgcggcgattgtctctgtggggacgacgggtgagtcagcaacgttgaatcatgatgagcatgtcgatgtggtcatgcagacactcgaactggctgatggccggatcccggtgattgccggaacaggggccaattccacctccgaagccatttctctcactcaacggtttaatgataccggtgttgtgggctgcttaacagtgacgccatattataaccggccaatgcaggaagggttataccaacactttaaagcgatcgctgaaagtaccgatttgccacaaattctttataatgtgccttcgcgtacgggttgcgatatgttaccgccaaccattgctcgcttagcgaagattaaaaatattgttgctgttaaagaagccacagggaacttaagtcgggttagtcagatccaagtgctggttgatgatgaagatttcatcctgctcagtggtgatgatgcgagtggactggactttatgcaactgggtggtaaaggtgttatttctgtgacggcaaatatcgctgcccgtgaaatggttgaactgtgcgcattagcagcacagggaaatttcgccgaaggtcgccgtttgaatcagcgcttgatgccgttgcatcagcatttatttgtagaagcaaacccaattccggttaaatgggccgcgaagaggttgggattaatggcaaatgatactatgcgcctgccaatgaccccactgactgatccggccaaacggattgtggaagacgcgttgaaaagcgcaggtttgctgtaa

SEQ ID NO: 72434 - protein, 293 aa, Yersinia pestis
MFTGSIVALITPMDDNGDVDRASLKSLIDYHVASGTAAIVSVGTTGESATLNHDEHVDVVMQTLELADGRIPVIAGTGANSTSEAISLTQRFNDTGVVGCLTVTPYYNRPMQEGLYQHFKAIAESTDLPQILYNVPSRTGCDMLPPTIARLAKIKNIVAVKEATGNLSRVSQIQVLVDDEDFILLSGDDASGLDFMQLGGKGVISVTANIAAREMVELCALAAQGNFAEGRRLNQRLMPLHQHLFVEANPIPVKWAAKRLGLMANDTMRLPMTPLTDPAKRIVEDALKSAGLL

SEQ ID NO: 72435 - DNA, 879 bp, Salmonella enterica subsp. enterica serovar Typhi
  CDS (1)..(879)
atgttcacgggaagtattgtcgcgcttgttacgccgatggatgagaaaggtaacgtcagtaggtcttgcctgaaaaaactcattgattatcatgtcgccaacggtacctcggcgattgtttcggttggcaccaccggcgagtctgccacgctaagccatgatgaacatggcgatgtcgtgatgatgacgctggaactggctgacggacgtattccggttatcgctggcacgggcgcaaacgcgaccgcggaagcgattagcctgacgcagcgttttaacgatagcggcattgttggctgcctgacggtaacgccgtactacaatcgccccacgcaggaaggtttgttccagcatttcaaagccatcgcggaacacactgacttgccgcaaattctgtataatgtgccgtcccgtaccggttgcgacatgttgccggaaaccgtgggtcgtctggcggaaataaaaaatattatcgctatcaaagaggcgacagggaacttaacccgcgttcaccagatcaaagagctggtttcagacgattttattctgcttagcggcgatgacgcgtccgcgctggactttatgcaactgggtggtcatggcgtgatttccgttactgctaacgtagcggcgcgcgatatggctgacatgtgcaaactggcggcggaagggcaatttgccgaggcgcgcgctatcaaccagcgtctgatgccgttacacaacaaactatttgtcgaacccaatcctatcccggtgaaatgggcatgtaaggcattgggtcttgtggcgaccgacacgctgcgcctgccaatgacgcctatcaccgaccatggtcgtgacatcgtcaaagcagcgcttcagcatgctggcctgctgtaa

SEQ ID NO: 72436 - protein, 292 aa, Salmonella enterica subsp. enterica serovar Typhi
MFTGSIVALVTPMDEKGNVSRSCLKKLIDYHVANGTSAIVSVGTTGESATLSHDEHGDVVMMTLELADGRIPVIAGTGANATAEAISLTQRFNDSGIVGCLTVTPYYNRPTQEGLFQHFKAIAEHTDLPQILYNVPSRTGCDMLPETVGRLAEIKNIIAIKEATGNLTRVHQIKELVSDDFILLSGDDASALDFMQLGGHGVISVTANVAARDMADMCKLAAEGQFAEARAINQRLMPLHNKLFVEPNPIPVKWACKALGLVATDTLRLPMTPITDHGRDIVKAALQHAGLL

SEQ ID NO: 72437 - DNA, 969 bp, Brucella melitensis
  CDS (1)..(969)
atgcctttgacccccgcgcagaactcaactgaaccagaaagcgaatttgaaatgtcgaaattttttggcgttgtccctcccgtcgtcactccgcttaacgatgaccattcggtcgattacgattcctatacccgcgttctcgaacatctgatcgaaggcggctgccatggcctttttgccctcggttccaccagcgaggtggtgttctatgacgaggcagaccggcgcaggattcttgaacatacggtgaaagtggcgaatggccgtgttccggtcattgccggtgtcatagacccggcgaccgaccgcgtgattgcccatgcaaaagccgcaaaggacgttggcgccgatgcggtcgtcgtcacggctcctttctatacaatcaccagccagcccgagatcatcgatcatttccgcatggtgcgcgatgcggtcgatattccgctgattgcctacgacatcccggtctgcgtccatgccaagcttacacgccagaccgtggtaacgcttgccaatgaaggcacgatcatcggcctgaaggattcctccggcgatgacggcaatttccgctgtgcactgctcgatctggctaaaaacaaaaacatgttcctgatgaccggctcggaaatcgtggtggacaatgcgcttttgatgggcgcgcacggcgttgttcccggcctcgccaatgtcgatccggcaggctatgtgcggctttgggatgccgcgcagcgcggcgactgggtggccgcgcgcaaggaacaggagcgcctttgccgcctcttcgagatcgtctgggttggtgcggggcgcgtcagcggcggagccgcaggcgtcggcgctttcaagaccgcgatgcgcagtctcggcattatttccaccaacaagatggcgcgcccgcgccaggcgcagaatacggcggaagcaggccgcatagacgcgatcctgcgcagcgtcggcctcctggattga

SEQ ID NO: 72438 - protein, 322 aa, Brucella melitensis
MPLTPAQNSTEPESEFEMSKFFGVVPPVVTPLNDDHSVDYDSYTRVLEHLIEGGCHGLFALGSTSEVVFYDEADRRRILEHTVKVANGRVPVIAGVIDPATDRVIAHAKAAKDVGADAVVVTAPFYTITSQPEIIDHFRMVRDAVDIPLIAYDIPVCVHAKLTRQTVVTLANEGTIIGLKDSSGDDGNFRCALLDLAKNKNMFLMTGSEIVVDNALLMGAHGVVPGLANVDPAGYVRLWDAAQRGDWVAARKEQERLCRLFEIVWVGAGRVSGGAAGVGAFKTAMRSLGIISTNKMARPRQAQNTAEAGRIDAILRSVGLLD

SEQ ID NO: 72439 - DNA, 885 bp, Agrobacterium tumefaciens
  CDS (1)..(885)
atgttcaagggatcaattcccgccctcattaccccgttcacggacaatggttccgtggacgaaaaggcctttgccgcccatgtggaatggcagatcgccgaaggcagcaacggccttgtgcccgtgggcacgacgggggaatccccgacgctctctcacgatgagcacaaacgggtcgttgagctgtgcatcgaggttgcggcgaaacgggttccggtcattgcgggtgctggctccaacaataccgatgaagcaatcgagcttgcgctgcacgcgcaggaggccggtgcggatgccctgctggtcgtcactccctattacaacaagccgacgcagaagggcctgttcgcgcatttttccgctgtcgccgaagcggtgaaactgccgatcgtcatctacaatatcccgccgcgctcggtggtggacatgtcgccggaaaccatgggtgcgctggtcaaagcgcataagaatatcatcggcgtcaaggatgcgaccggcaaactcgatcgggtttccgaacagcgcatttcctgcggcaaggattttgtccagctgtcgggcgaggatggcacggcgctcggctttaacgcccatggcggcgtcggctgcatttcggtcaccgccaatgtcgcgccgcgcctttgttccgagtttcaggcggcaatgcttgccggtgattacgccaaggcgcttgagtatcaggaccgcctgatgccgctgcacagggcgatcttcatggagcccggcgtctgcggcaccaaatatgcgctgtcgaagacacgcggcggcaatcgccgggtccgttcgcccttgatgagcacgctggaaccggcaacggaagcggcgatcgatgcggcgctgaagcatgccggcctgatgaactga

SEQ ID NO: 72440 - protein, 294 aa, Agrobacterium tumefaciens
MFKGSIPALITPFTDNGSVDEKAFAAHVEWQIAEGSNGLVPVGTTGESPTLSHDEHKRVVELCIEVAAKRVPVIAGAGSNNTDEAIELALHAQEAGADALLVVTPYYNKPTQKGLFAHFSAVAEAVKLPIVIYNIPPRSVVDMSPETMGALVKAHKNIIGVKDATGKLDRVSEQRISCGKDFVQLSGEDGTALGFNAHGGVGCISVTANVAPRLCSEFQAAMLAGDYAKALEYQDRLMPLHRAIFMEPGVCGTKYALSKTRGGNRRVRSPLMSTLEPATEAAIDAALKHAGLMN

SEQ ID NO: 72441 - DNA, 924 bp, Brucella melitensis
  CDS (1)..(924)
atgctgcgtggggtcccgtctatctgtttcaggagttcacgaatgctgaagggctcaattaccgcacttgtcacgccgttcgaccgtgaaggggcgttcgacgaaaaagcctttcgtgctttcgtcaactggcagatcgaagaggggacgaaaggtctcgttccggttggcacgaccggcgaaacgccgaccctttcccatgatgaacataagcgtgtgatcgaagtctgcattgaagtcgccgctggccgtgtgccagtgattgcgggtgccggctcgaacaatacggtggaagcgatcgaactggcgcagcacgccgaaaaagcgggcgcggatgcggttctggttgtcacaccttattacaacaagccgaatcagcgtggcctctacgagcatttttcgcgcgttgcccgctctatctcgatcccgctggtgatctataacattccgggccggtccattatcgacatgacgccggaaaccatgggcgctctcgttcgcgactgtaagaatattgtcggcgtcaaggatgcgaccggcaagatcgagcgtgtttccgaacagcgcgcgatctgtggcaaggagttcatccagctttccggtgaagacgccacggcgcttggcttcaatgctcatggcggggtggggtgcatttcggtaacgtccaacattgcgccgcgtctttgcgcggaatttcaggaagcctgccaggctggtaatttcgccaaggcgctggaattgcaggaccgtttgatgccgctgcacaaggcgctgttcctggaacccaatccttccggcccgaaatatgcgctttcgcgcctgggtcgtattgaaaatgttctgcgttcaccaatggttacgatcgaagcggcgacggcggaaaagatcgaccatgccatgaagcacgcggtcctcatcaactga

SEQ ID NO: 72442 - protein, 307 aa, Brucella melitensis
MLRGVPSICFRSSRMLKGSITALVTPFDREGAFDEKAFRAFVNWQIEEGTKGLVPVGTTGETPTLSHDEHKRVIEVCIEVAAGRVPVIAGAGSNNTVEAIELAQHAEKAGADAVLVVTPYYNKPNQRGLYEHFSRVARSISIPLVIYNIPGRSIIDMTPETMGALVRDCKNIVGVKDATGKIERVSEQRAICGKEFIQLSGEDATALGFNAHGGVGCISVTSNIAPRLCAEFQEACQAGNFAKALELQDRLMPLHKALFLEPNPSGPKYALSRLGRIENVLRSPMVTIEAATAEKIDHAMKHAVLIN

SEQ ID NO: 72443 - DNA, 885 bp, Nostoc sp. PCC 7120
  CDS (1)..(885)
atgggagattttggcacagttttaaccgctatgattacaccgttcaaagcggacgggagcgttaactatgctgtagcggcagaactagcagcgaatttagttgacaatggtacagatacattggttgtgtgtggtacaactggagagtcacccaccttgagttgggatgaagaatacaatttatttgtagaagttttgcagacagtagcaggcaaagccaaggtaatagctggatgtggttccaattccaccaaagaagcgatcgcagctacgcaaaaagcagctaaaataggagtacatggtactttacaagttgtaccttactacaacaaaccgccacaagccggactataccagcactttcaggcgatagcgcaagcctgtccagagctaccgctattgttatataacgttcctggtcgtactggtcaaaatctcagtccagagacagttgtgcggttagctgaaatcgacaatattgttggtgttaaagaagctagtggcaatcttgaccaagcgggtgaaatccgtcgcttgacaccaaaagaattccagatttacgctggagatgattcgttaactttacccttgttagctataggggcaaaaggcgtagtcagtgtggcttcccatctggtagggaaccaactacaacagatgattcaagcttttaattctgggcaagtgacagttgccagtgatattcatcttcgacttttgccgttgtttaagactttatttatcactacaaatccgattcccattaaacaagcactaaaacttcaaggttgggaagttggctcaacccgtccaccgctaagtgatgctgatgcagaagtcagtcaaaaactagaagcagtaatgaaacatctcgatttaatttaa

SEQ ID NO: 72444 - protein, 294 aa, Nostoc sp. PCC 7120
MGDFGTVLTAMITPFKADGSVNYAVAAELAANLVDNGTDTLVVCGTTGESPTLSWDEEYNLFVEVLQTVAGKAKVIAGCGSNSTKEAIAATQKAAKIGVHGTLQVVPYYNKPPQAGLYQHFQAIAQACPELPLLLYNVPGRTGQNLSPETVVRLAEIDNIVGVKEASGNLDQAGEIRRLTPKEFQIYAGDDSLTLPLLAIGAKGVVSVASHLVGNQLQQMIQAFNSGQVTVASDIHLRLLPLFKTLFITTNPIPIKQALKLQGWEVGSTRPPLSDADAEVSQKLEAVMKHLDLI

SEQ ID NO: 72445 - DNA, 882 bp, Listeria innocua
  CDS (1)..(882)
atggatttagggaaagtaattacagcaatggtcacgccaattcacccagaaaaaaataaagtatgcaaaaaaagaattcatcatctcgtgaatcacttaatagataacggctcagatggtttagtaatcgctggaacaactggtgaatctccaactttgtcacatgatgaaaaaatgaaattattccgccaagtggtggaaacaaatgcaggacgcgcgaaattaatcgctggcacaggttctaataatacagcagaaacgattgcttttacaaaagaagtagcagaattgggcggaattgatgctgtcttagtcgttgcgccgtattataacaagccaaatcaagatggtttatacgctcattttgttgctgttgcggaagcttctgatttaccagtagttatttataatattccaggacgtagtgttgttaatatcgaaccagaaacaattattcgtttagcaaaattaccaaatattattggtgttaaagaatcaagcggcaacttagacaatataagtaaaatcattgctgaaacttccgatgatttcctcgtatacagtggagatgacagcttaaccttgccaattttagcagttggagggaatggcgtaatttccgttgcaagtcatgtggtaggaaatgaaatgcaagaaatgatgcaagcgtatgaaagtggggacgtaaaaaaagcagcaagtatacatcgctcgttattaccattaatgaacggtcttttctctgttccaaacccagcgccaactaaatacttattaaatcaacaaggtattagcgttggacctgtaagattaccacttgtagatttgaatgctgaacaaggaacgaaattacaagctatattagaaggactttctaaatag

SEQ ID NO: 72446 - protein, 293 aa, Listeria innocua
MDLGKVITAMVTPIHPEKNKVCKKRIHHLVNHLIDNGSDGLVIAGTTGESPTLSHDEKMKLFRQVVETNAGRAKLIAGTGSNNTAETIAFTKEVAELGGIDAVLVVAPYYNKPNQDGLYAHFVAVAEASDLPVVIYNIPGRSVVNIEPETIIRLAKLPNIIGVKESSGNLDNISKIIAETSDDFLVYSGDDSLTLPILAVGGNGVISVASHVVGNEMQEMMQAYESGDVKKAASIHRSLLPLMNGLFSVPNPAPTKYLLNQQGISVGPVRLPLVDLNAEQGTKLQAILEGLSK
